United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 14

SEQ ID NO: 68023 - DNA, 1170 bp, Glycine max
  Peptide Sequence Number=SeqID_159708
atggcgccatcccgctatcatctcattgaacgtttcccactttcacgcaacggcaaattggatcgcaccttgctatcgccaggcaccgaacggagtcaggccagcgatgttgcacccgcggcgtccgcggaactcatgctgctacgagagctgttggcgaatacgttaggctgtaccccagacaagatcgacccccatgccagcttcttcagcaatggcggcagctcgctttccggcatcacgtttttgggcaacatcaagcgcgcccttaatgtggaattaaccctggcggaaatccttggctactcacagctcgataaacttgtcgagcgtctgcgcgcgaatgcgcccctgccgttatcgatgctgtccggctcagccgatcgcccctctctgcccaccttgtatttggtgcatggcgccggcggccaggtacatcaatatgcaaagtggacaaaacagctttgcgcctgcgccaacatcattaccatcgccagcccggggttggccgcgccaggcgcagacgacacactcaccctgcagcgattggccgcctcccacttggcggccataccgcgtgccaaacgcgacacggccgttatcgccggctggtcattgggtggccaattagctgtccatatggcggcgctggccacggaacaaggcgcgccctttgcgcatgcggtggttgtcgacagcggtttgcccgcccagcagcccgcagtgaagcgacgtttcagcgtggcccaaagttacctcagtctgttcgactccctcggtattgcgcgccatttgtgtcggcgtcaagaaacgaatgcgatagacagcttcgccaacgagataaaaatgcactatgcgctgaatcagagcgtgcttgcggagaaggtcacgctggaacatgccgaaaccttctgttgggcgctgaaaaaatcgttcgaactaacgaataacgccggccccctgccgcagatagcgataccgctaacgctttggctcagccagcaacgtcagcgtaaacacccccatcttgcacaacgctgggagatgcaatcctcgcatagcgttcaactcagttattgtgcagaaacgcattacagcattttaaacaacgctcaacttcttcgagcgctgacgcaattgctgcacgcgttgtcaacatcattggaataa

SEQ ID NO: 68024 - DNA, 493 bp, Glycine max
  Peptide Sequence Number=SeqID_159709
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtctccgcaaagtcgtaagaccatgtatgggggctgacgcctgcccagtgccggaaggtcaaggaa

SEQ ID NO: 68025 - DNA, 285 bp, Glycine max
  Peptide Sequence Number=SeqID_159710
atggaccaaaaagtaactacaggggaaatccaacaaagtgatttgattcccattgatttggagattaaagccacttgtataaggcgtaattcagagagagtcagaaaatttttgcaggatttagaagcagcagcaacttcagaagaagaacctcgatcttctgaggcatcttctagttttcctattgcagggcattctcatatagaacctgttgaagacacaatcatggctgaagagctgagaagagtaaccctggaggattattcaagttctactgtgccataa

SEQ ID NO: 68026 - DNA, 285 bp, Glycine max
  Peptide Sequence Number=SeqID_159711
atgaagattgttatctctattccactaagaaattgtgattttgctggaagagaacattatcaggacatttgtttttcctattccataaataattccaactggacacaggagtcaatcatgtacaatcatcatgaaaaaggaagagctcctgatcttgaaagtgtgttagcaggcttcatgacatatcaagctagctcaaaagataattgctattcaacgcaacagcagggagcacagaaagatccaattgttggagctagaagaaatgcgattaacagcttatga

SEQ ID NO: 68027 - DNA, 315 bp, Glycine max
  Peptide Sequence Number=SeqID_159712
atggatccactcagtgggagtcgtcccctccacactccaccagaagctgaaatttgtggtggaaggacatttggccatagtatggggctaggaagacgtcctgggcatgtctacaagcctgaaatgggtttgggcaagaataatggcggcagggacagcctggtaaatatcaaaggaaacctcgagaaattagggctaggctataaacctacacaggctgacataaggaaaaacatctcggaaaggaaaaatagaggccaaggcccgtggtcgagaccacaggccaaagaggtcccaccgtgcccacatcagtag

SEQ ID NO: 68028 - DNA, 223 bp, Glycine max
  Peptide Sequence Number=SeqID_159713
gtgcggataaccagaaggtgtttccgtatgctaccagactcttgggtcatgatagcaaaagggcgagaaagtcactagccacaggattttggttggcgatcaaagggagaggaccacttcaggttgtgggcaaggatggacattctcacactgggtcaaggtttatggtaagttgggattttggttcaaggcttgtagaaccagtggacaagatatatgccag

SEQ ID NO: 68029 - DNA, 330 bp, Glycine max
  Peptide Sequence Number=SeqID_159714
atggcatacaccaactggcacttagacagagggaggtcagagttgtggttgctaggcaagacattgctgagcagcaatgtcatccatatctgggtcaaggtagtcatgctggtgcgcatgattcgcacccgcctccctattgcggtccaggcaaaatccctgccccgatatgcacagctgctgggcgatggcttcctcatcgaaatcgtctgcctggctcctcctctagctgaattcacactgctggtcttcctccaaaatcgacgggtcacccaagaactggctgatggcatctgcatcaaaggggacccagtgacccctcacccatga

SEQ ID NO: 68030 - DNA, 102 bp, Glycine max
  Peptide Sequence Number=SeqID_159715
atgacagtcgacgtcgccaggaaagatgaacgatcggggtctaaaaaagttacgaaggtttggatgacgccacttccgatgaaggaagataagtcagggtag

SEQ ID NO: 68031 - DNA, 231 bp, Glycine max
  Peptide Sequence Number=SeqID_159716
atggcaaggcaactagttgtgcatgctaaatgcagtgtaggacctcaacccgtagcacctttctcatctacaaatgaacctgccaaacttcactctactccagaaaaaggtgaatcttccattggtaattctgatttacagaagcagcacatccctcctcttccattccctccaagagcagtttccaacaaaaaaatggagaggagagaaagagatcttggaaacatttag

SEQ ID NO: 68032 - DNA, 981 bp, Glycine max
  Peptide Sequence Number=SeqID_159717
atggctgatggtgaatctgacaagaacattgagatatggaagatcaagaaattgatcagagcattggaatctgcaagaggtaatggcaccagcatgatttctctgattatgcccccacgtgatcaaatatctcatgtcactaagatgctgggagatgagtttggaactgcttcaaatatcaaaagcaggcctatcaatgcatcactttacctctgtgataacaagtttcacatagaagctctaaatgaacttttagaatcagatgacaagtttggttttattattatggatgggaacgacaccctttttgggacattaactggaaacactcgtgaggtgcttcataaatttactgttgatctaccaaagaagcatggtcgaggagggcagtcagcattgtgttttgcttgtcttcgcatggaaaagcggcacaactatgtcaggaacactgcagaacttgctactcagtttttcatcaatcctgctactagtcaacctaatgtttctggacttatacttgctggttcagttggcttcaagactgagctgagccagtcagatatgttcaatcctcgtttgcaagcaaaaatattgaatgtggttgatgtttcctatggtggggaaaatggttttaatcaagctattgagttatccgcggagatgttatctaatgtgaacacgctgaaggctctggagatgggtgctgtgggaacacttattgtgtgggaaaatttggatattaatagatatgtactgaaaaatagttctactggtgagattgtcataaagcacttgaacaaggagcaagagggtaatcagagcaacttcagagactcgcccacctcagcagagttagaggttcaggagaagatgcccttgagtgggtttggtggtattgggggtatcctttgctaccagctcaatatcagatcgtttgatgagttatctgatgatggagaagtgtatgaggattccgattaa

SEQ ID NO: 68033 - DNA, 402 bp, Glycine max
  Peptide Sequence Number=SeqID_159718
atgttaggttttccattcatgcttccaggtccctctgttattcagaacctcccaaaaggctcctacgttattaagtggcaggaggctgggagggtagaagcagattttgtttgctttgatgttaagtcagttataaggaacatctacacactcttctctggaagtgagataccaatagcaggtgataatcaggaaatcatggatttgtatgacccaactactcccctaccaccatggttctctgaggaagacctggcaacctatgaatcactatacaaaaaatctggcttcagatttgcattgcagttttatagtctagggtacttcagtaatattatcgcagctaatgatccacagaggactcttggagtggatagtggcattgctggaattagtagttaa

SEQ ID NO: 68034 - DNA, 423 bp, Glycine max
  Peptide Sequence Number=SeqID_159719
atgtccgttattcttagacggtcttcgcatcgaaaccgtcttagaatgtgtggtcaaaaggcactggttttcttacatggattcccagaaatatggtatacatggaggcataagatgattgttgcagcaaatgctggctatcggactattgcctttgatttcagaggctatggactttctcaacatcatgcgaagccacaaaaagcaaacttacttgaccttgttgatgatgtcgtgggtctgttggattcattaggcattaccaagggagaagggagacacaaaagaattcaggcggttagtccgcggttagtccttcgttcttttggaaaagggagaagagagacacaaaaagaattcaggcgattagtccttgttgaattctttttggcaaagggagaagagaatgaaaaagatgaatag

SEQ ID NO: 68035 - DNA, 411 bp, Glycine max
  Peptide Sequence Number=SeqID_159720
atgtcgagaaaagttaacatggtggctattggatttctattgctttgtggactcaaagctggcaccaaaaaacgaatatatgatgaaatcagtgagataaagcaaaccgccaatggaactggcgagtttgctttctgtgatggaccttccagtggtaatggcgatatcgccatgcatggggaaccgccagtcaaactggcgagttccaagttgcaggttgtaggcttcaggttgcaggttgtaggcttggcagacgtgcttttttcagatggcaggccaaaggtacatcatgaattcggttataacagtgttgtattcaatggaagggtatacgaagaaaatgatggtgtaatatttgaaggcagtaaaaaagcaattcagattaaacgtggattagtttcaatgcattga

SEQ ID NO: 68036 - DNA, 300 bp, Glycine max
  Peptide Sequence Number=SeqID_159721
atggggaactgccagtcaaactggcgagttccaacaggttcaacagtgcgaagggaggtcaggccatgcaggagggatgcagtgcagcaggaactcgccaaccctattggcggtttgcttttgggggagggaattgccagcctggctggcggtgttgatttgcgtcacgagttttctgctgaggctgagcaagtagaagcggggagacaatgcggcagaagaaatcctaatcgtcaagcccgaagatgggatcgaccatgtgacacatcctcacggcatcacggacaccataatgaatga

SEQ ID NO: 68037 - DNA, 333 bp, Glycine max
  Peptide Sequence Number=SeqID_159722
atgccgcataactttgttcctttacttacgttgtttactaagaactttttcaaaaaagtatgggcgcctagattgtggaggtgtaaggtggcagacaagtcatccatagtccacaacaatagatatcccacgaatcaaacttccaaattaacaaaactccgcaatcacgtagtggtttgttttatttggaaaaatagccttcaggtttacacggttcagcaaaccgccactcctagtggcgagtttgctgggaaaacgccacgtggcacggaaaacgccactcgtagtggcgagttgcccagctgcaggcctaaaggggaacttgtgatttga

SEQ ID NO: 68038 - DNA, 354 bp, Glycine max
  Peptide Sequence Number=SeqID_159723
atgtctacactgcatgagacagtccacttcagaaagaaaaatgttcaaggagagaggagtaaagagtcaaacttccaagacagggtcatgtgtctatatatatccatttgtggcaacaaagacttgcacaacatcttcagctttccctcgttgaacacaaagaaaattatgggttcttctttgtggactttgtgtataattttggcttcactagcttctgctgcattctgtgcctttccacggaggccagtgaatgttccattcggccgaaactacgttcccacttgggcttttgatcacatcaaatacttcaagggggttctgaaattcaacttcatcttgataagtacactg

SEQ ID NO: 68039 - DNA, 627 bp, Glycine max
  Peptide Sequence Number=SeqID_159724
atgaagaacagaacatcagggtttctgaaggagatcatagcaaatctgagctcaatggccaagtcaaaaaccatggccttgaagtccaaaacaaacgccataagggcacgtttgatcatattctcacttatgaagaacaagaaattcttgatgagttccctctctgagaagttccattctgtgtgggggcaaagttcatctcaacaaaaggaagatcattgcttattggaagatggcagcaatgatcaccaaagcaaggccatagtgttgtacaacagcaatgcacactcctatgaggccctgcctaaccccagtgaaacccaattggtggtggaggaggaacaagaccaagatggatatgatggttactacaattatcattgtgatgatgatgagaagtaccctgatctcacacacaccctttttgagtctgaggatttggatcttggagggtcagtgattgatttgatgaagaattctaaggaggaggcagggaaagagtttaagctggaggatgagattgaccttgctgctgatcttttcatcatgaagtttcgaaggcaaatggtgctgcagaagcaagaatcattgaagaggaagagggaagtgctggaaaatggtgcatga

SEQ ID NO: 68040 - DNA, 282 bp, Glycine max
  Peptide Sequence Number=SeqID_159725
atgattgaaagttttcaacaacaacaagaaatgagtgtcattgaattgtgcgttgaagtagatgttgtcggtgtttctgcgttgaatgtggcaaattcactattatcatgtgggaataatatagctggcaatgaatcaaaagatgaggaggaagatatcgatgatatatctgacacagatgaagaagtaacattaattggagtcatccagatgaaaaagacatttgtggtttcgatatgggatcaaccttcaatattggccaagaattatttgttggcatag

SEQ ID NO: 68041 - DNA, 906 bp, Glycine max
  Peptide Sequence Number=SeqID_159726
atggggagtctggtgtaccaagtaatttcctccgcggcacttctgacgctgggcatgtaccatctgataagcaccacgcgcaactacctcaaatcgcctcacgcctacgccgccaaacccttccaccccttcccctacccccgccgcctcccgctctacctaatcatactctctctcctcctcgccatggcccaccaccttctcgtctccgccgacgccgatccccttgttcgcggcgccaccgccgtccaccgcatcacctccctccaatccgccgccacgctctttttattcctcctcctcgccttcgccctcctcatcgcggacgcctcccccgccctcctccccctctcccccgacctctccttcgccctcgcctccgtcctcttcctcctccacgccgccctcgcctccgcccgcgccgccctccagacctccgccatcgaggccaaatgcctctccgtctctgctaacctctcccacctctccgccctcctctgcctcctcctcgccgcgctcccgcgcctcttccccgccgacgccgccctctccgccaccttctgcctccgcgggctctgggctctccagagcggcctctccctctacgccgacgccttcatccccgagggctgccaccgcctcctcgacgtcaccagcggcgtcgagggctccacacagtgcgatctggacgagtccaagctccgcgccgtcgccatccttgatctcgcattcttgatccacgccatcatcgtggtcctaatcgtgctcctcacttatgccctcttcgccagaagcttcggcgggaggaggctcggatcctatgaggcgctccccaccgcggcttcccctacggaccccaaccacagccttattcagatgaaggccttgactggcacccaggcttga

SEQ ID NO: 68042 - DNA, 117 bp, Glycine max
  Peptide Sequence Number=SeqID_159727
atgcgttgcggttcacgccgacgggaacggtatgctgtgaagaggaaggttgtgggaatatggggatgcaaggattgtggtaaagtgaaagctggcggtgcctacactttgaagtaa

SEQ ID NO: 68043 - DNA, 360 bp, Glycine max
  Peptide Sequence Number=SeqID_159728
atggcgacaaaggtgaggtgcagtggcaatgacaatgatagtggaacgaatgttggttatggaggtagtgacatggacaatgtggtggcaatggccgcaatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaaattgccagaccgtcttgtgccagccgacaggcggccgggcaaggctaaccgagggatgctcctttaggaagaagggagactga

SEQ ID NO: 68044 - DNA, 393 bp, Glycine max
  Peptide Sequence Number=SeqID_159729
atggcagctcaagctagacaagtgttttatgtccaagacccatgtgactcaagatggtcagtggttctacaagggagaacaatttgtattggtgaccatagtgatggttcaacacttgatgtcaatgacatgccgccttttgctcaacaaatgcctttcataaatggtgaagatcaggacgatgatgtacatgcaaatcacaatgagggtcaacaaaaagataatccttctgttaagtatggtattgatgcaacaacttgggttgaatttgcaaaaatccgccaaatccctaattggcaggaatacggaaaaaggcccaggaaatacaaaaatacaatgactgtccccacttactgtctcgtgggggttatgatctgcttgaaaagaaactaa

SEQ ID NO: 68045 - DNA, 357 bp, Glycine max
  Peptide Sequence Number=SeqID_159730
atgagtgatgaaattaacaaacaacaagagcttgttgaggggttcaagaaaacaaaggatccttctagtactgatttaacctcagctttggaggggcttaatgtgaccacattgccccctcttaaggttactcaatccacgcaaataaatgtggagggttttgaaaggaactacaatggagttgagtttgggcatgagcaagcttctataggagaagcttttgaaggtttcaatgatgcttggggtggtggacttgatccttttgagtttgggaagaaggagaaggggttggacaacacggtggtggtgatcggcgatgatggcagcatggtggtggtggtttctgttggagaataa

SEQ ID NO: 68046 - DNA, 1713 bp, Glycine max
  Peptide Sequence Number=SeqID_159731
atgaagaaggtagcgtcgggtgtgacgatggatcacgtgctgctggcgtcgcaggagacgaaggaggcacgtgaggctcggattcggagcctcttcgatttcttcgacagagagaatctcgggttcttggactactctcacattgaggccggtctctcggcgctccagattccggctgagtataagtacgcgaaggatttgctgaacgcctgcgatgccaacaaggatgggagagtggatttccaggagttcaggaagtacatggacgacaaggaactggagctttaccgcatttttcaggccatcgatgtcgcgcacaatggctgcattttgcccgaggagctctgggaggcgcttgttagagcaggcatagttggaggttggagatctatggccaaaatagtagttatgagtaagaatgatggtgatcgtgatcctcaactcacctctgatataaccgaaatcgtgatggggacaattctcctctcccgggcagtgaattacaagtttaataaaaagaaagcagatttcaaccaggtagtggtgcaagctggcatcaaatgttcatctcaagtcataagaaaaattggagtcctggctacatttgctgatgtagagtgtgtttggttccctgttgaaattcccactttccaagatgagaaagtagaagcaagtattaagattgatgacgaggaactcgctcgttttgttgagcgtgttgataaggataataatggtgttataacatttcaagaatggagggattttctgctgctttaccctcatgaagcaaccatagagaacatttaccattatttggagcggatgtgtatggttgatatcggggagcagactgttattccagcaggcattggtaagcacattcatgcaagcaggtatctgattgcagggggagtagcaggtgcagcatcacgcacagcaactgcaccccttgaccgtctaaaggttgtattgcaagtccaaacaacgcgagctcaaataatgcctgcaataaaagatatatggaaggagggtggtttgttaggattttttcgaggcaatggcttaaatgttcttaaggtggcccctgagagtgccattagattttatagctatgagatgctgaagaccttcattgtgcgtgccaaaggggaagaggcaaaggctgctgatattggagctatggggcggctactagctggtggtattgctggtgctgtagctcaaactgcaatatatcccatggatcttgttaaaacacgactacaaacctatgcttgtaaaagtggaagaattcctagccttggaaccctttcaaaagatatatgggttcaggaaggaccccgggcattttataggggattgattccttctcttcttgggattatcccttatgctggcatagatcttgctgcgtatgaaaccttgaaggatatgtccaagcaatatattcttcatgatggagaacctggccctctagtacaattaggatgtgggactgtatctggagctcttggagcaacatgtgtttacccactgcaggctcaacgctcatacaagggaatggctgatgtattcaggaaaacccttgaacatgaaggcttgaggggattctacaaaggaatatttcctaacttgctcaaagttgtaccgtcagcaagcatcacctacatggtttatgagtctatgaaaaaaaatttggatttggagtga

SEQ ID NO: 68047 - DNA, 711 bp, Glycine max
  Peptide Sequence Number=SeqID_159732
atggtggctcactcaagcttgaggatagagatttcccaagctatttatcttctctctcagagaggctctctacttggattgactcattctacggtggctcactcaagcttgaggatagagacttcccaagcaatttatcttctctctcagagaggctctctacttggattgagtcatcctatggtggctcactcaagcttgaggatagagacttctcaagctatttatcttctctctcagagaggctctctacttggattgagtcaccctatggtggctcactcaagcttgaggatagagacttctcaagctatttatcttctctctcagagaggcttactcaagcttgaggatagaaacttctcaagctatttatcttctctctcagagaggctctctacttggattgactcactctacggtgactcactcaagcttgaggataaagacttcccaagctatttatcttctctcttagagaggctttttctcactctaagaaatggattcactcttgcttggatggataggaatgaaggctcctacccttatttatactactccacctccacaatgaatggtggagattacttgtatcctagggtggagactaattctctagaatgctccacacattctaggagtctctacactcttctactctcttccatactttttcataaggttccagaaggtttcacacatctctag

SEQ ID NO: 68048 - DNA, 510 bp, Glycine max
  Peptide Sequence Number=SeqID_159733
atggagattcttccactatacaaaaagatagtagggttacaaggatgtgtttacaaaattgactcactctatggtggctcactcaagcttgaggatagagatttcccaagctatttatcttctctctcagagaggctctctacttggattgactcattctacagtggctcactcaagcttgaggatagagacttcccaagcaatttatcttctctctcagagaggctctctacttggattgagtcaccctatggtggctcactcaagcttgaggatagagacttctcaagctatttatcttctctctcagagaggcttactcaaagagactctatacttggattgactcactctacggtggctcactcaagcttgaggatagagacttctcaagctatttatcttctctctcagaaaggctctctacttaagaaatggattcactcttgtcttggatggataggaatgaaggctcctacccttatttatactactccacctccacaatga

SEQ ID NO: 68049 - DNA, 186 bp, Glycine max
  Peptide Sequence Number=SeqID_159734
atggctcttcatgaatcacaccaccgtggaagagaagatcctcatggagctaacaacagtgcttacttccactcacagcaacgaccaataagactggacaaaagagtattcaatgttggaaaaactagaagtcagaagtacaaaacagaaacatataacacagattggaggtttgttgtgccgtga

SEQ ID NO: 68050 - DNA, 1659 bp, Glycine max
  Peptide Sequence Number=SeqID_159735
atggtgaccgtggaggaaatccgcaacgctcagcgttcccatggacccgccaccatcttggccttcggcaccgccacgccgtccaactgcgtctcccaagccgattaccctgactactacttccgcattaccaacagcgaacacatgactgatctcaaagaaaagttcaagcgcatgtgtgaaaagtccatgataaagaagcgatacatgcacctgacggaggagtttctgaaagagaacccgaacatgtgcgagtacatggcgccatcgctggacgtgagacaagacgtagtggtgatggaggtgccgaagctgggaaaacaagccgcaacgaaagcgattaaggagtggggtcaaccaaagtcaaagatcacacaccttgtgttctgcaccacttcaggcgtggacatgcccggagcagattaccagctcacgaagcttctcggcctgaggccctccgtgaagcgcctcatgatgtatcagcagggctgcttcgccggcggcaccgtactccgcctcgcgaaggacctcgccgagaacaacaagggtgcgagggtgctcgttgtctgctccgagataaccgccgtgacgttccgcggcccctcggacacgcacctcgactcgctcgtgggacaggcactgttcggagatggcgccgcagcgttgatcatcggatcagaccccgacccagcagtggagcggccgatattcgagatgatatcggccgcccagacaatcctgcccgactctgacggtgctatagatgggcaccttcgggaggtgggactcacgttccacctcttgaaagatgtgcccgggatcatctcgaagaacattgagaagagtcttgttgaagcttttgagcccatcgggatcagcgactggaactctatcttctggatcgcacatcccggtggtcccgcgatcctcgatcaagtcgaggagaagctccggctcaagccggagaaactccagtccacccggcatgtgctgagtgagtacggaaacatgtcaagcgcgtgtgttttgttcattctggatgaaatgaggaagaagtctaaggaggaagggaagagtaccactggagaagggttagagtggggggtgctattcggattcgggccggggataaatcatgctgatgcggtgactagtgatttaagagtgatcaataaggaaccctcggaaataccagggaaacgtctccccaaaggacgcgttcaccgtaaaggcgacacgttgcagcacttgggacgcgccctgcgtacaggcacgacgggtgcgtcaggtcgtgttggagactcaggcgcgacgggtcgcgctggggacccaggcgcgacgggtcgcgctggggacccaagcgcgacccagttggcgcgacccgtcgcgcctgggtctccaacacgacctgacgcgcctgctgcagcagcgctacccgtcgcgcctttcgcggtcgatgacagagacggtgaacaggtcgcacaagttcgtgataaagggatactcgctggcgaaggggatcggagtcggaaaacacatcgcgagcgagacgttcacggtaggaggatactagtgggcgatatacttctaccccgacggcaagaacctagaggacaactccgcctacgtctacgtctgcgtgagtggctgagacagcgt

SEQ ID NO: 68051 - DNA, 519 bp, Glycine max
  Peptide Sequence Number=SeqID_159736
atgttaatgtgtaatgagcaatactcgtgtgttggccctatagaattattatgtaccattattagaacaccggatgttatactcaacctgcttcaatcaactatcactcctactcatgatgcacttatgtattacaacgggaagtggaacataccacgtcaaggtcagtttttgggttactcctttactagaactaatccaataagatttggcattccttcgggatgtagcatggacaaactaaaggatttaatcaagcaagttgcacctatagggaattcacgaatcacaattgtcatccagggaggaagcaaggctgcctgtggaggggcaattagaaatagtatggacctctggttgacgagcttcactttcaatctgggatcatgtactgttttgagagctgaattgatgggaattctatctaggttgaagctggcctgggaaaaagattttaggaatacaatatggttggagagtgattatgttactgtgaacaagcttattttagatacttag

SEQ ID NO: 68052 - DNA, 783 bp, Glycine max
  Peptide Sequence Number=SeqID_159737
atgttgtttcctgagtttggttccatagctgctgggatgtctggggaagtttttgatggacaagatgcaggctatgtgcctgagaaccctgtttcatggcttacaatgattaatgaagaaactctgaagaaactgtgctttaataccttagttgtggcagtggttgcaggaccatggccagcacccgtggcacaaatgatacttttgggattgcaagaggttgctgatataatacgattgttatttagtgataactccaatagacggttaatgcatgaaggtgatttggacagtggagatgttccttcttcacttgctagccttgtgcctattgtcatagcagcccttcaaattgaggaagagaatccaagagttgcctatctttggcttatgcaatcgtgggatgctatagtgatgggaatattatctgggagcattccatgggtgactatgatgattttgcctaaaaagtcaaccttgctacaaaagatggattgggtacaaatggaccgttgtcgtgtagcagcattgttgccttcgatcaaggagaaacaactagagagtcatagtaattgtgttagacatgatcgagaaaaccaaggtcttgataaagggaatatggctgaaattgatggctatcaaaacttgtttggtttgatgaaacagaggtttctgagtttcaagaaccaaaaatatataaaagagttggagcattttcaagcccttgctgaagctcaatttccaaaggtgataatagatttacctagtccatttagcatttaa

SEQ ID NO: 68053 - DNA, 333 bp, Glycine max
  Peptide Sequence Number=SeqID_159738
atgaatctcatgaaggccataaaaagagcacagggtgcacagaaatcatgcggcaacacgcatttggccattgatcaattgatcctcggaatcctcgaggactcccaaatcagagagttgctgaaggaagccggtgttgcaaggttaatgaagttgatcttgtacttcccggtactgcaagaggatcctgctttccatgctatatcacgattaatagcagaatttgagtatcatctgtgcctcattcacactaaatttgatgcctgtctgatgctacatcctggatcaatcggagtgctcactcgtgagatggaaaacaaccctgaggtctaa

SEQ ID NO: 68054 - DNA, 183 bp, Glycine max
  Peptide Sequence Number=SeqID_159739
atgggtgtgcaagagaagaggggaggagaaggagagtattgcaactcgaaagggaagaatgaaggagaaggaagtggcgtaagtgagcaaggggtgcatctgatggtggaggaagggagaggtgagccgtgtgacacagaatggaaaaaggccagtgaatctataacaggcaaaaccagttaa

SEQ ID NO: 68055 - DNA, 264 bp, Glycine max
  Peptide Sequence Number=SeqID_159740
atggtagctcaagggatggtcgtggccacgcaagagagcaacgttggtggctcaacgggtggcagggaaggaaaaatgaagttggaacggtggaagggaaaggaagattccggagttggatggggaagtgggaaaggcaagtgtgaggaaggagaaaggttttggttggaaaagaagagaggtggggaagtgggaaaagaagagaggtggagaagtgggaaagacaacatggaaaagggggaaggttttagagtaaaaaagtga

SEQ ID NO: 68056 - DNA, 177 bp, Glycine max
  Peptide Sequence Number=SeqID_159741
atgggcgaggaagagaaaaaaccagaggaaaacaaagtcggggagaaaaaagcaaaggaagaacaaaagaaagaagaagagaaaaaactagaggaatcaaaagatgacaaggaatccaaggaggagtctgcgctgtcagaaatcatgcaaggcataaccttcgcccattggtgttga

SEQ ID NO: 68057 - DNA, 258 bp, Glycine max
  Peptide Sequence Number=SeqID_159742
atgaatgcaaagagaagagaagataaggttggtgtgcttccaaggagaagaatactgatgcggcatggaaagtcgcaaaggaacaggggcacaccggcgtacaccaccacacccgaccatagtattcagtcaacagtgcaaggcatgactcaggccttccgcgtcgtcgaacacctttgccgcgtgatggatacgacagttgctccccagactagtgggtgtagttttatgtgtccccctacgcccacacctgattga

SEQ ID NO: 68058 - DNA, 219 bp, Glycine max
  Peptide Sequence Number=SeqID_159743
atggatcattcttcttccatccagaacgttcttccaattccctctccctgtcctctagatacttcacaccaaaatgtcagtgaagttccatcttctcctccgcactcgactgatgttggccctccagtacttgaaggttcacctcatgattttcattctccttcaatcactcctcaagccatggatcctgccatctctccttcctctgattcagactga

SEQ ID NO: 68059 - DNA, 429 bp, Glycine max
  Peptide Sequence Number=SeqID_159744
atggatataataagaagcaaaccttcatgtagtctagcggatgaagaagtccttgagaacagattggcatggttgaggattgtcgatttgcctctaaatgtatggagtaagcaatgtttccaacaagtggtagccactgtaagaaccctcataacaatagatgagagcattgaatcgttggcaacactggagttcacaagagtttgcattcaaacttactgtctagattcaatatgcaagaacataaagttttggagcttgaaaatgaaaacattattcaagtctcaagaactgtggggttttgttgaagatggatttgaagatgctcaacctccagaaccagatcagcaattgagagagaagagaaagaaagattccaaggcattgtttatgtacaacaggccttggatgatgaaatctttcccataa

SEQ ID NO: 68060 - DNA, 126 bp, Glycine max
  Peptide Sequence Number=SeqID_159745
atgaagcaacatgatcagtcgctcctaaatcaaggatccaagtcacctgatcatgtttgcttatggcgcaagcaaaagcttgctgatgaagcagatccaataatgcttgatgttgttgagttgtga

SEQ ID NO: 68061 - DNA, 1035 bp, Glycine max
  Peptide Sequence Number=SeqID_159746
atgcttcaagttcaccatcaagtttattcagagagagaaaagaggccaatttattgtgttcatagaaataagactatagaaaaacctttcatagagttaaacaaggtggatcgaaggcatgggaagaggcctttcccttctgatcatgcatcaagggaggagagggaaggtttcaacttttctgttcttccatctccacctaagagccaaggggaagaagcttctcaattttcctttatacatccaatcaataatactagtgatgatagcaccccttccacaccaattccacaatatgggcaaataagcaattcttgcttgattgagactcaggacccatcccaacagcctttaaatcaaggaggcaatgggagaaaaagacactatagaggagttaggcagagaccgtggggtaaatgggctgccgaaatccgcgaccctaaaaaggctgctagagtgtggcttggcacgtttgacacggcagaggctgctgctgctgcttatgatgctgctgctttgaagttcaaaggctctaaagccaagctcaatttcccagaacacgttcttgttcctcctcctccaatatcatcatcaccttataataataatcatcaaaataatcatagttattgttatggttcttcagctcttgcaccaccacctccactaccactaccatcatcacaacacgtttatgatcaaccacaacaacccttgttatcatcatcatcacaagaagaagggtttccaaatctaatgcagtacgcgcagcttctttggagtagggatgatgatgatctacaacgtgttgcttcaggccttcatcatcaacaacatcatcatcatcatcatcatcccaatgaagctttctatgattcaagttcttcaactttgttctcatcatcgtccactacttcttctatggctgtgtctgatcaacagcagattggagatgacacgagtactgctcccaaaaggggagaatattatgactcttgcttttttagagggaatgattttcatgacaagaattga

SEQ ID NO: 68062 - DNA, 255 bp, Glycine max
  Peptide Sequence Number=SeqID_159747
atgaaaaagaaaaagaaagaaggaaatacctttggggcgatcgagggttatgacagcgacaccgttttgatgaacagagcccttcacaaattcttcggccatagcggaaaatgctcgcagagaaaaggaaggctgcaacttgcctacatgaagccggaatcgctagtaatcgactgcatgaaggaagaaacaaaaagaataaaaggaaaagaggagaagattgaggaagagaaagatggagaaagagaagattga

SEQ ID NO: 68063 - DNA, 297 bp, Glycine max
  Peptide Sequence Number=SeqID_159748
atggcagttggtctgtcaaaagatgatattgaatccaggaaaagcaataggtacataccattttatagaatcactcagggacagaacaaagtgctaattactaatagaatgtgggctaggcttctatcttcaacaaatctgcccagctttacgattgctaagactgtctctctaaagaaaaaagggaagaagaagcaaacggtcatgtccctgacattggctgggatgtctactgagtatcttatatatggattttctaaaggaggtctagatgacataagaaagcttggtatctaa

SEQ ID NO: 68064 - DNA, 1683 bp, Glycine max
  Peptide Sequence Number=SeqID_159749
atggggttcaccttgttcttgaacacctccttcctcgtgattgtgttttgtgtttctcttattgttcccttccactcttcatcagaacacgttgttctgaggagcaacagggttggtttgaggggtgaagaacaagattgcaagagtttccacagtttggaggactccaaagccaagtgcttgtacttgaaatccaatgatccatgtgtctctcagggctatgttgactacctttacctattctattgcaaatttgggggtttccctctgttgggtcactctcttttgtttctttggcttttggttctgttctatttgttggccaacactgcctctgagtacttttgtccttctcttgacaacttgtccaaattgctgaggctctctcccacaattgctggggtgacccttctctctcttggaaatggtgcttgtgatgtttttgccacccttgtctctttcaagggtagtgggacccgtgacattggcttcaacactgtgcttgggggtgcttcctttgtgtcctgtgtggtggttggaatagtgagcattgcaataaggcatagggggatccgggttaagaagtgggacttggtgagagatgtttgtttcctcctcttggttcttctgtgcttgttaaccattttgattgctggtgagattaatgttcctggggcaattgggttttgcttgatgtatgtggtgtatgtggttgttgtttatgtcttgtctacccgagggaacaagggtgtgtgtggagatgctgatggtgaaattggttgtgatttgaatcatggtggtggcagtgatttatctgttcctatgctcagtgggatggagaaaggacttgtaaatggagctcaggaatgtaacatgaaaattgagaggaaacgttgttgtttacaatcttcaatgtgtagtatgttactctttgtcttggagatgccactttacttgcctaggagattgacaattcctggtgtttgtgaagagagatggtccaaagtttatgcagtttgttcagctatgctagcaccacttctcttgtctttcttgtggatacctaatcatctaaacggcttcaacagcattattgtttatggaattggattgttgattgggattatattaggggttattgcatttttcacaaccaatgtgtcaaaccctccaaggaagtacttgcttccttggcttgcaggagggtttgtgatgagtgtgacttggagctacatttcagctcaggaattggtgggattgttggtttcacttggttacatatgtggagttagtccttcaatactcgggctaacagttcttgcttgggggaattcacttggggatttggtgacaaatttgacaatggctttgaatggtggaccagaaggtgctcaaatagcaatatcaggttgttatgctggccctattttcaacatagtagttggattgggcttatctcttgtgagctcttcttggtctgagtaccctttatctgttgtgatcactagagacccatatctgtgggaaacattggcacttttgggggttggattggtttgggcacttgtcgtgctgattagaagagacatgaagcttgatgcactattgggaggagggcttttgctattagccactgacatcactttctgtgcaggagctatattgtgcaaccatgataggtag

SEQ ID NO: 68065 - DNA, 186 bp, Glycine max
  Peptide Sequence Number=SeqID_159750
atgaaagagaaagagaaaagagggatgaatgtgggatttgacccagatttctctggtccatggacctctaataggatcgcagattcgacacaagcattttgcggcatagaatcaaacgatccttcgattacactagccaaccatcacaaccccgattcaacatggagagagttccctagtgcgtag

SEQ ID NO: 68066 - DNA, 678 bp, Glycine max
  Peptide Sequence Number=SeqID_159751
atgttgaattcagaggggtcttcgttgttcaagcctaccggtgatagggtagatgccttttggaaatggaacagtttaaaggataaaaataacaggaagagtgtaacctgtgatttttgtcacaaaacgactacgagaggaatttctagagcaaaaagacatcaacttcaaataaaaggagatgtgggttcttgtaaaaaagtaccggaggatgttaaattagaaatgattgctgcttatgagaagaaaatagctgaaactgcagcatacatggaggcaatgcaagaagaagacgaggaagaggaagatgggatcctagagattgcaagacttaaaagtggaaaaaagcgtccaacaacatcaaatgaagcctcctcaactgcttccaataagaggatcacaactaaaaaaggccctattgattttttgttctccaaagcacctaaagaaagtatcaaattacgaaaaaccatgagacaatcaagtgtaaatgaaacttataacaaggctgcaagagacagagcagttcagtacattgctcgtttcttttttaggaatggaataccattcaatgttgctaaatcaaaaagtctcaagttgatgattgaggcgattggaacctatggtcctcatttaaagcctccaagctatcatgaaattgagagttccactccttaa

SEQ ID NO: 68067 - DNA, 807 bp, Glycine max
  Peptide Sequence Number=SeqID_159752
atgaacgcagtggtggcctttgttggtctgccttcaccttttttggtacttgttctactcctgccgccgaaaccaagtgacccaggagcccctgttttagcattgtgtcaacctggttttcgatctcttgtttttggtactatggatatcggctggagatggcaggtgattgatggtgaggagagtttggggaagaagttttttgggttgaaggaggctctatgcgcaagtggaagaacgtgctcgcagtgccggactgggtcatgcgccgtagcaatcgagggagggaagggaaccttcgggaaggtcctcctcttcatccttaaaaatcaacagaaagagcttagaggagcagcgatgaccccgagcgatggtggcgtcgaaactaatgatgaggaacttgtggtgaagcgaggtgacagaggtcccatggtcgaagaaaatcgagatcgtggcggtcctgaaaacgacaacggagacgagccagagacgctgcctgagttagcgtcagaggttgtagggcctgtacctcacgcagcccagtcaggtcctcgtaggaagacggtgcaaaacaggcttcgagggcgtggagaaaaggagaccacgaggatagttgggcattctgagacatccattggagccatgccaacactagaccatccatgtagaaggaggctatgggaaaggttggatggtctccaatcgttccaggcgaaggataaggttgtcgatcttggtggacatgttgatttgagagtaggtgagtcgagcaatggtgtctttgatacggtctatgttggactttga

SEQ ID NO: 68068 - DNA, 1224 bp, Glycine max
  Peptide Sequence Number=SeqID_159753
atggttaggactagaggcttaggtcgtgccttaggtagggttattggtagagctctagggagagaggatcgtcatgattctgatgatgctccccaacggcgaaggcctaccacatcggcacgcagacaacagggagctgtccttgttgccgaggatgagcttgtgctacctgcggacgagcctgtggtacctacggttgaccctgtggtagcttccgatgagcctatgatagatgcagacgtacaggacactggtgcagaggctgttgcagatgagcctgagggatttctaggtggaccgcgtgacgcgctggtgcttactaagtatgctaaccatgttgcagccagcgtatggagcagagaggcctgttcctgtaattgggggttagttgctggcacaggagtaagtcctctgatcgcgtgttcagtagacactagtgatcaaggacttatatcctcgtttgtggagagatggcacagggagactagtagttttcatcttcccatagaggaggagaggcagctagggccaagacaagacattgccatggaccatacgtacgcctatcttggctacgagatatatatcagcgcaaatgttaagccggacattggacaactgcagctcactgggaggtatgcatggggagctgctgccctggtgcatatgtacgatcacttgaatgatgcttgtatcagtagcagccgacagcttgctgttgcggagtgcatcgttgatccggactacgacgaggtgtctccacgtgcatgccgatggattgctatgaagaagactggagcatcaaccagcccgggagttttagttgatttcatgcttttccggttagctccgctgggggcccgttgctgtcagacactaaccagaaaaggtgagatgtgtgttgtgccaggtcagtgtgcgcccgactacattgattggttcttggtcatttctcatccattcgtggcagtggcacaaccattagatccgccgcgcgatgcacctgcgacacatcatgccgcatttgtggagccacataggccccaggaggcttgccaagtgatcgctgaaaggttggagcgtcatctcaacctaaggatagtcacgccaggcacaaagacacatgagatcatcgaacaatgcctcaggattgccaggggtgtcacagaagaccgcactgtgtatgtgaggtctcgacgtaggcgacgcacggatcaactatag

SEQ ID NO: 68069 - DNA, 396 bp, Glycine max
  Peptide Sequence Number=SeqID_159754
atggacgaagatcagtggatgtatgaaagtataatgtctgaagaagcggatatggaatatcaaaatgaagaaacatgtggtgtgaatgaaccatatgttgattgttccgatgcattgaatacttctcaggtgtttgacagccgagaggatgttttgcggtgggctcgatccgttgctcatgaaaacggatttgtggcggtgattataaggtctgacacaaacactgatattagaggaagaactttgtttgtgataattggctatgaaaggagtggcaagtatagatgtaggaagaaagaatttgttagaagaaatactggaactaggaaatgtggatgtcccttcaagtttcgtggcaagccagtggttggaagacaaggctggatggtgaagtga

SEQ ID NO: 68070 - DNA, 336 bp, Glycine max
  Peptide Sequence Number=SeqID_159755
atggaggatttcccgaatgcctatgtgtattgtcaacaactcaaggaattgttcgatcaactcaagaacgtaggtgcaccggtgtcgaacaattgtcttgttcttcaaatggtggtcgacctcactaaggcttataatggggctactgtgaatcttggggagaatgtgaatgtacgtatacatgattttgatgatgtcaaaaaagaatcaaacaaggctgcttcaaaggataaacattgcttcgagattaatacaagattgctaaacaaagccttgcttcaagatttcttcaagatcaagccttgcctcaaaacaaaggatttcaaagtcatctaa

SEQ ID NO: 68071 - DNA, 396 bp, Glycine max
  Peptide Sequence Number=SeqID_159756
atggctaaaagacccattagcagctttagagccaacactgagataaagctcaaagaggagtgcaaggtaattttcactatgagggaaactgcagagaaggaaaggagaattaaggaggatatgcgtgatgaggaaggagaaaaaaagaagagggaggaaaagataagagtaaggagagtggtaataaggtctcaaccactaagaccaagaccaagagccataatacagaagctacctcccaagttcaaagatccaggaagcgtcaccatcccatgctctattgggagtgtattcgtagctgatgatgatgccgcaaatgttgaagctaatgatgattatgttgcgaacatcaatgatgcttatagagcttgggatctaggacccacacaggattga

SEQ ID NO: 68072 - DNA, 339 bp, Glycine max
  Peptide Sequence Number=SeqID_159757
atgactgattccaacaaattccatgcagctcttgcagtctccaacatcaagaaccatatctccatcaccctgaagataggaaatgtccaatatgtgacgtgggcggaactgtttaatattcacgcacgttatcacaaggtcctccaccacatcgtcccaccggagaaaggtaaggagaaggtgcctaaaaccgataaagaaaaggaactgtggtcaacccttgatgttgtggtccttcaatggatctatgcaataatctcacatgacctgttgcatactattcttgaacccgacgcaatgacaatggaggcagggaataggttgcgtgatatattctaa

SEQ ID NO: 68073 - DNA, 579 bp, Glycine max
  Peptide Sequence Number=SeqID_159758
atggttctcttgaacatacatgaagagtctataaaagcaagagggtacatttacttgggtttgactgagaacaagagagggtatatctcttgtggatcagttctagtggagggtacatccactaggttcaaagagaacaagggagggtacatcccttgtggatctttgcttaaacgccatgatccccgtcgaagttggggaacctttgacaaggaggctacttttctaggaaaaacaaaacaaagaaaactcaaggaggcacgtcaaacccaaggtttgcccttggtgaatctcataagcttgtcaaacccaaggtctgcccttggtgagtctcacttctccaaaggctcgataaacccaaggtttgcacttgcccttccgctgctaagttcagcctcccaggagctcaaggaatacaagtttgcaggaatatcagaaactcaaggtccgcccttggtacaaaaacccaaggtttgtccttggtacaaaaacccaaggtccatccttggtacgcattcctacaaaaagccaaggcatgcccttggtaagctcactccttgggaactacaacaagtatag

SEQ ID NO: 68074 - DNA, 576 bp, Glycine max
  Peptide Sequence Number=SeqID_159759
atgacaaaatggaatgcctcacccattgagttaagtgtgaaaaatgggttggtatatgtgaatggaaaattctgcaaacatcccaacctcacgattcctgaagatttcttcagacatgtggaacccgggagcactgccaaccaattgggcttaggactgagtcctgtgaatgttgcacaattacctggactaaacacgcttggcgtgtctatgtctcgcatagattatgcaccaaagggtttaaaccctccacacactcaccctcgaggcactgagatgcttatggtcatggaaggcactctttttgttggatttgtctcctccaaccaagacaataatcgtctcttttccaaagtgctcaacaagggtgatgtgtttgtgttcccaattgggctcattcatttccaatacaatgtggggaaaggcaatgctgttgccatcactgcttttagcagtcaaaatgcaggagttatcggtatttcaagtgctgtgtttctgtctactccacctattccttctgagattctcgccaaaggtttccaagtgggacagaatgtaattgatgagtttcgttga

SEQ ID NO: 68075 - DNA, 507 bp, Glycine max
  Peptide Sequence Number=SeqID_159760
atgttgagcccagctaagccaaactcttcctccttggatagtcctctatcacctaagacgagactttggcgcttcacggactctaaggcttattctattaagtcaggatactctcaagtgattaaaaagatgattgtggagggtcctataaaccgtggcctctctccatttaaaccgaatcccaaaagctgggtacgtcctagggagggagtcattaaggcaaattttgatgcttcccttaagcagaatcatggaactggtttgggagtggtttttcgtgaccactatggtgaagtgttatctgtgggctctgtccttctccctaattgctatgaagcgcatattgtagaagtgataactttcaggggggttgcaaaaatgacagtaaatctttcctttggtttgatccaattcaaatcggatttccaaagactagttcaaacgtggaagaacaaggactcgactggtaacaactatttggacaatgtgatcaaagagactctgtag

SEQ ID NO: 68076 - DNA, 2448 bp, Glycine max
  Peptide Sequence Number=SeqID_159761
atgaatctcataaaatcatgtacgaggaaaacccatctccacaacctcggcaccttgacttcgccaaaacgacactttcaacatgtcgatgcttccatgatcaagacaggcttcgatcccaacacgtgccgtttcaatttccaagttcagacccatctccagcgcggggatttgggcgcagcacgcaaactgttcgacgaaatgcctcacaagaacgtcatctccaccaacaccatgatcatgggttacctaaaatctggtaacctttccactgctaggagcctgtttgacagcatggttcaacgctcggttgttacctggacaatgctgattggtggctatgctcagcacaaccggtttctcgaagctttcaatctctttgccgatatgtgtagacacggaatggttccggatcatatcaccttggccactctcttatctgggttcactgaatttgaatctgtaaacgaagtagcacaagtgcatggccatgttgtcaaagtggggtatgattccaccctcatggtttgcaactcgttgcttgattcttactgtaagacgcgtagcctcggtttggcttgtcacctcttcaagcatatggcagagaaagataatgtcactttcaatgcattgttgactgggtactccaaagaggggttcaatcatgacgccataaacctatttttcaagatgcaggatttggggtttaggccctcggaatttacttttgctgcggttttaactgctgggatacagatggatgatatagagtttgggcaacaagttcacagttttgtggtgaagtgtaattttgtgtggaatgtgtttgtggctaatgctttgcttgatttctactcgaagcatgatcggattgttgaggcaaggaagcttttttatgagatgccagaggtggatggtatctcttacaatgtgctcatcacgtgttgtgcatggaatggaagagttgaagaatctcttgaacttttcagggagttacagtttactagatttgaccggaggcaattcccctttgctaccttgttgagcattgctgcaaattctttgaacctggaaatgggtaggcaaatccattcccaggctattgtaacagatgccatttcggaagttctagttgggaattctttggttgacatgtatgctaaatgtgacaaatttggggaagcaaataggatttttgctgatctggcacatcaaagttcagttccatggacagctttgatctcaggttatgttcagaagggactacatgaagatggcctaaagctattcgttgagatgcacagagccaaaataggtgctgactcggccacttatgccagcatcttaagagcctgtgcaaatctagcttcactgacactaggaaaacagttacactcacgtataatcagatcaggatgcctttcaaatgtattttctgggagtgcactggttgacatgtatgcaaaatgtggatccataaaagaagcacttcaaatgtttcaagagatgcctgtgaggaattctgtctcctggaatgcactgatttcagcctatgcacaaaacggagacggtggccatgctcttagatcatttgaacaaatgattcattcaggtctgcaaccaaattctgttagcttccttagcattctatgtgcttgcagccactgtggtcttgttgaagaaggactacagtactttaactccatgactcaagtgtataaacttgaacccagaagagaacattatgcatcaatggttgatatgttatgtcgtagtggaagatttgatgaggctgagaaattgatggctcggatgccatttgaaccggatgagataatgtggtcatcaattctcaactcatgtaggatccataagaatcaagagttggcaattaaagcagcagaccaactattcaatatgaagggccttagagatgctgctccatatgttagcatgtccaatatctatgcagcagctggtgaatgggacagtgtgggaaaggtgaagaaggccttgagagaacgagggatcagaaaggtcccggcatacagctgggttgaaatcaaacagaagacccatgttttctccgccaatgacacgtctcacccacagacgaaagagataacgaggaagcttgatgaactggaaaagcaaatggaggaacaagggtataaacctgactcaacttgtgcccttcacaatgtggacgaggaagtcaaggtagagtcactaaaatatcacagtgaacgcattgccattgcctttgcactaattagcaccccaaaggggtcacccatattggtgatgaagaatctacgagcttgtaatgattgtcatgctgctatcaaggtaatctccaagattgtaaatagggaaatcacagtcagggattcaagtagattccatcatttcacagatggatcttgctcctgtaaggactactggtag

SEQ ID NO: 68077 - DNA, 562 bp, Glycine max
  Peptide Sequence Number=SeqID_159762
atgcagtttcttggtttcaatgttaccccgcacattttggctgaagctaatgtcaattttggaaaagttaatcctatcattcctatgccccaaagctttctcataggcttcaacgatgaccaggatatagagggtttctcattggattgctctaacaaagaggatactatcatcgacaaagaagatgtgggaaacttaggcgcccttgggcaaactttcatcgtgttgacaattaataagcacggagaaagatgtggtagctatgcatctatagatcatactgcaccatttttggggaaatcccccctttctaccacattgtctgacactcatgtggtgaaagcatttgaaagcaaccagggcattaagaccacctccgacaaaatctgcttcaatctattagctatggtctttgtaaccatcttgaagatgacgttacaaagactaataaggtggaactttgtagtgcatttggtgaaaggcatcccaaacttcctctctaaagaactcccagttaagggtcgcacaatggccctcagacaccctcccaacaaccagagag

SEQ ID NO: 68078 - DNA, 321 bp, Glycine max
  Peptide Sequence Number=SeqID_159763
atggacgaagatcaatggaggtatgactatgcgatgtcacaagaagttcatatggattatgattatgataatgaagaagaatgtggggtgaatggaccacatgtggattgttcaaatgcttttaatacgtttcaggtattcggtactcgagatgatgttttgcaatgggctcgaacagttgcccatgaaaatggatttgttgcagtgattatgaggtctgacacagagaccagtagcaaaggaagaagaataaagaatttgttagaaaagacactgggagtaggaaatgtggttgtcccttcaggcttcatgggaaactag

SEQ ID NO: 68079 - DNA, 273 bp, Glycine max
  Peptide Sequence Number=SeqID_159764
atggatattgatgaagataaagattgtatggaaaataatagctatgatgatcatcttcttgcatctgaaattatgttttcattcccaattagattccgttacaatctagcttttctacaagatctaagagacttgcagtgcaagcttctaacagttagctgccagctgtcacttgacaactgggtgactaactcccacatgcttatctcacttaaccaactaatcctgcctaggttagctttgctattcttagccggtcccaagcccggataa

SEQ ID NO: 68080 - DNA, 123 bp, Glycine max
  Peptide Sequence Number=SeqID_159765
atggcgttggatgcactgaacataaccaaattgcctgggcaccctatttggaagataagaccacatgtccgtattgcacctgatgaagccagagaaaaaggcctactggggaaaaggaaatag

SEQ ID NO: 68081 - DNA, 561 bp, Glycine max
  Peptide Sequence Number=SeqID_159766
atggctgcacctctatactctcattgggtagtagtgaaaagaatcttaatgtatctcaagggtactttgtttcatggactacttcttcagcctgctcttattacaaaacccttggttcttcgcgcgttctgtgatgctgattgggcatctaatgtggatgacaggtcagattggtggcggtttggttgggtttgggttgagggtggcagctcagattggggtgacagtgttggtgtttggttggtgattatggactggttgccaagggtttggaagagagaaatttgcgatgcaatgagaaagggggtaggtcacgagggtttggaaattgcaagagagaagtgtttttttcccctatctgcagccatcttctttatcagcaccccttttaagaagggttatttggacttttcactaacaccgttactggacagagatggtcagggggtgggtggaattactttgcccatcatgagaaaggcacttctacaagcaagagatggcaggaagcatatacttggtaaagttaaaacactaacttcatggtggtatgacttataa

SEQ ID NO: 68082 - DNA, 939 bp, Glycine max
  Peptide Sequence Number=SeqID_159767
atgtccatggaagctcaacagattctttccagattctgtccaaaaccatcttcagtgccatctattccaattgtgaaacaacaattctctccaaagttccctcgtttaccttcttcatcgttgtatccttctagtcaatctcagaatctcaatgttcctagtggagctttccatcctatcagcattgtgcacaaagaagtgtgttctagttcttgcaagaggatatggtgcagcagcagcagcagcagcactgcagaaccaaaggagggccatgaggtgagggctcaggtcaccgtgcgaaggaaaaagctagcagttttcgtttctggtggaggatccaacttcagagcaattcatgaggcctccaaaaggggatcacttcatggagatgttcttgtgttggtcacaaataaaagtgattgtggaggtgcggagtatgcaagaaataatggtatcccagttatactgtaccatatatcaaaggatgaatctaatccaagtgaccttgttgatacactaaggaaatttgaggttgattttattcttttagctggatacctcaaacttataccagtggaattgatccgagcttacaaaagatctatattcaacattcatccatcacttcttccagcttttggaggcaagggattctatggcatgaaagtgcacaaagcagtaattgcttctggagcaaggttttcaggtcctaccattcattttgttgatgaacactatgatacagggcgtatccttgcacagcgtgttgtccctgtgcttgccaatgatactgtagaagagctggctgcaagggttctcaaagaggagcaccaattatatgtggaggtggtggaggctttatgcgaagaacgtgtggtttggaggcaagatggtgttcctctcatccaaagcaaagaaaaccccaatgagtttcgctga

SEQ ID NO: 68083 - DNA, 1851 bp, Glycine max
  Peptide Sequence Number=SeqID_159768
atgaaggtggtggcactcgttagcggcggtaaagacagttgctatgccatgatgaaggctattcactatggccatgagattgttgcattggccaatttgatgccgcttgatgattccgtggacgagctcgatagctacatgtaccaaactgagcttggttacaaagaaactcaaggtgatgaagttgaagacctgtgcattttgttacgtgaagttaaaaggcagataccctcagttagtgcagtttcttctggagccattgcatctgactatcagagattgcgggtggaaagtgtttgttcaaggttaggccttgtttctctggcatacttatggaaacaagatcagtcattgcttctccaggaaatgattacaaatggaattgtagctgtaactgtgaaggtagctgccatgggtttggatcctgcaaagcacttgggtaaagaattagccttcttaaatgcttatttacataaattgaaagagtataatgctcgcattgtgcttgatgaatatcaagttgtgatgcactcttcagattccatagctcctgtcggaatccttcatcccctggcatttcatttggaaaataaggcagatgttcagtatttaaaatcacaagacaaaatacatgagagttttacacagaaactgggatctgtttttgaagtgcaagacagtgtagaaggatgtgaggccacatgcaagcctgaagacttgaagattgttttggggaaaattgaatcacagttattgggccttggttttggctgggagaatgtcctttatattcacctttacattgatgacatgaataatttctctgaggcaaatgagacatatgtgaagtttataacacaggagaaatgtccatttggtgttccgtctcgtagtactgttgaaatgcctcttatagaaatgggtttcagcagagcatacattgaagtactggtagcaaacaataaagataaaaaggttttgcatgtacagagtatttcctcttgggcacctagttgcattgggccatacagccaggcaaccttgcatgagggtatacttcacatggctggtcaattggggcttgatcctcctacaatgaatctttgcaagggaggccctggtgttgaactggaacaagcactaaaaaacagtgaagcggagaagcaagaaacaatccttagacagatgaagatctcccatttacaggaaagaaccacttacaaagcattagatcccttgttcctttatgttcttgttcctgatctacctaaaagagcatatgtagaagtaaagcctattctttatgtcgaggatgacacggatgtagcatttgaggtcgtaacagaaagattttgtttggagacaccaccaagttattggggtttcaagccggaaaattggcatgattcttgcactcagaaatgtgtgatttctggaaagacatgtgccattatactgtctattactagtgagctggctgcgaagatatgttttgattctctgcctgctgaatatgtgaataatggtcagcattctcttccaaaggcacatatggagaagatatcaaagttctgcatttaccttcttgacaaagttatgacagacgatgactttgcttgggaagatataatgagtttgaggttctacatccctgtaagccttcaaatgtcagtgcagctattacaacctatgttctgcaatgctctttttgaactttcggaaatgagtcagaagaaattaaaaactggtgaggagccaatcttcaacatagttcctgtcataggttctgggaggtctgcttcatccatggacgatgtagtaacctgtgaattaatggctcagaaatcctga

SEQ ID NO: 68084 - DNA, 174 bp, Glycine max
  Peptide Sequence Number=SeqID_159769
atgttgaagctgaaaaacaaaatttggacactgcaaaaacgtgtttgttgcgtgtcggtgttgaggttgtgtcggacacctaaacacctctgtcagccactgtgtccaggtttcataggatgtgacaatctgtcttacattcccatgaccagcaatttttactcctcttcctaa

SEQ ID NO: 68085 - DNA, 906 bp, Glycine max
  Peptide Sequence Number=SeqID_159770
atggcttttgtaaaatcatttatgacctatgaagcacggacaccccatccccttgccgtgtctgggtgtccgacacgtgtccgtgtctgtgtccgacacgacactgacactgacaaatatggcagagaagatacacactatctgctttatatatatgatttaatgaggatcaaattatttgcattgtctaaggagtctgaaggttctgataatcctctactggaggtttacaagcgcagttatgatgtctgcatgcagctatacgagaaagagctgctgaaagaagactcgtaccttcatatatgggggttgcgaggggctggttttaatgctcagcagcttgccgttgtttcaggactttgggaatggcgtgacggtcttgctcgtgcagacgatgaaggtcctggctatgtattgccaaatagaattattcttgaaatcgctaaccagatgcctgtcattataagcaatctacggcgaatagtaggaaggacaaaacacccatatgttgagcgcagccttgatgtcattgtcaacattgtcagacattctatgcaaaatgctgctgcctttgaagaggctgcactacgtttgaaagaagaacatgctgcaagtttgtcaaatgtgatacccgttaaggatggaactgaagtacctcatacactacaaaaggatggatgtgcagcaagaggaagcatgggaattgaaaatggctcctgtgttgatatcacacaaaactgtatgctttcttatgaccaagaggagaaaagttttcagcatcaagttgaagatggactatccgattgtctcaattcagatctactaagggtcagtcccactattccatataagaatcgggataatgcaaatgttattgtactctctacagcaaaggttgtaaaataa

SEQ ID NO: 68086 - DNA, 1584 bp, Glycine max
  Peptide Sequence Number=SeqID_159771
atggacaggctgataaaagtagacccaacaaacacggtccctataagaatcgagccaggccaaaaatgccacggccaaataaccctacgcaacgtgatgtacaccatgcccgtggctttcaggcttcaatcgttgatcaaaacgcgttacacgttgaagccacaatctggtatcatatctcccttatccacagtaaccatagaaatcctctacaatcttccactgggctccaccctcccacactcttttccacactccgaagactctttcctcctccacagcgtcgttgttcccggtgccaccgtgaaagaaccctcctccatgttcgaatctgtaccctctgattggttcaccgcgaagaagaaacaagtgttcatcgacagcggcatcaagatcatcttcgtgggctcgttgatccttgcccagttagtccacaacgggtccatcgacgaaatcagagaagtgctggaacacagtgaacacacgtggaaagccgttgactccgttgaccaaaacggagacacgctcctccacgtggcgatctccaaaagcagacccgacatagtgcagctcctcctggagttcaacgccgacgtggaatcaaaaaaccgcaccggcgagactccgctggaatcagcgtgtgcctccggagaagaactaatcgttgagcttctcttagctcacaaggcaaacacagagagaacggaatcttcatctttaggagcgattcatttatcagcaagagaaggacgcagggaggttttacggttactgttgctgaaaggggctagcgttgactcgttgactaaagacggttacaccgcgttgcaccttgcggttagagaaggttcaagagactgcgcgaggctgttactagcgaacaacgcgagaactgatattagagattcacgagacggagacacgtgtctgcacgtggcggcaggggtgggagacgagagcatggtgaagctgttgttgaacaagggtgctaacaaggacgtgaggaactttaacggtaagactgcgtatgatgttgcggcggagaaggggcacgcgcgcgtgttcgacgcgctgcggctgggggatgggttgtgcgtggcggcgaggaagggggaggtgaggagcatccagaggctgatagaggggggagcggtggtggacgggagggaccagcacgggtggacggcgttgcacagggcgtgttttaaggggcgcgtggaggcggtgagggcgttgctggagagagggattgatgtggaggcgagggatgaggatgggtatacggcgctgcattgcgcggtggaggcggggcatgctgacgtggcggaggtgctggtgaagaggggtgtggatgtggaggccaggacgaataagggtgtgacggctttgcagatcgcggaggcgttggggtatggtgggattgcgaggctgcttggtgctgctgcgggacacgtggcggaaggagaacaacaatctgtgcttggggagatgaagaaggaaaagaaaaacaagcttggaagaagaagaagggagagggagattcgggggagctttgaccggtcaatgcctttgcctgtcctctag

SEQ ID NO: 68087 - DNA, 2025 bp, Glycine max
  Peptide Sequence Number=SeqID_159772
atggcgatgaaactcaaatatctgtcttccattgccgaggatgtcatcaagagatgttcacagaaactggacacttcggtagagaaattggtggtggattttgaaggggggtggcaccctgaaatgggaaactattgcagaaaattagttgaattttgcagtgggaaggctgtgagtgaattgtgccacaacatagagggaaacatcaacgatggctcatttagcaggttgacatatgacatgatgcttgcttgggagagacctagctactacgatgaagaagataccacggagaatgtagcaaaggagaaagaagaaaggaagataactttgaataccactcaagaacaggatgatatccctcttttttattcagacatcatgcccctccttgttaataatgagcccaatgttggagaagatgcatttgtatggttgggatcattagtacctttagttgcagatgtagcaaatggaaggtttacttttgaatctcttacagcaccgacaggcaatcgactacattttccagcatacgacatgttcttaaaagaaatggacaagtgcatacgacatttgcagaaacatgcaacaccaaatggggtggaactggctgaggatgaatatatattacatgtagatggaacagccagcactcagagagtagttcgccacattggatcaacaagttggcctggtaggcttacactgaccaattactctctttactttgaggcttccggagtaataaggtatgaagatgctctcaaaatagacctctccaagaatattgagcagagtgttgaacctgctgccacaggtccatggggagcacaactttatgacaaagccataatctatgattcaactgatttatcagagacagttgtactggagtttccagagcttacgagttccacgagacgtgatcattggcttgcactagtcagagaaataatgtttctccaccagtttttatcaaagtaccagataaaatgtccaatacaaacatgggagctgcatgcaaggacaatcttgggaattgtaaggctgcaagcagcaagagaaatgctaagaatatcacctcctgtcccaacaaaattcttaatattttccttatatgacgagataccaaagggagattatgtgctagaagagcttgctgatagcctcaaaaagggcaataatggacagtcatgtagtgcaagttctatccttagaagtatgaacatttctaagactgtagattcgtgtataataacagatgaggcaagccaagcagatggaagtgttaatgttgtagacgatagtcccttattggaggctgctatcaaacaatctagggaggaagaaaaggaaattctcattgctaaagctaccactgaaaaattaaaggatgaaggagtcattgacagtgttttggttataacggaactactgaagccacttaaacatgtagtcccttggtttcaagaaatattcacatgggagagaccaataattactcttgctgttcttgctgcatccctgatgatcatctatatggaatgggttggcaagacatttgcagctttcttgatttgggcaataataaagatgcttgatgcaagaaaaaagaagattcgtgagaaatgctacgagatagttatcagtagatccagtatggcttctgatcaatctacgatggagagcattgtctcggcccagcatggattgtacacaattcatgacatgatgcagatagcaaacatagcaatgctaaagatatggtcaatacttatttcaaaggctgataagcatgcaaatctagtgatggtggcaatgagtggattggctatcttattggcagtaattccattcaaattcttccttatggctctcattctccaaagcttcactatgacattaggaaagtcttctggaagtggaacagggaatagacgattgagggaatggtgggattcaataccaattgttcctattcgtgtagtagacgatgttcctaacactgttgatgctaaataa

SEQ ID NO: 68088 - DNA, 141 bp, Glycine max
  Peptide Sequence Number=SeqID_159773
atgatgcatgcacctgactcaacactcagatgcaatgtgggaaccatgcagagttcgtcgagaccacccgattgtgcacgtaactacccctctcctataggtgatcagcctgggagcccaaaggagttccctaccaggtga

SEQ ID NO: 68089 - DNA, 2184 bp, Glycine max
  Peptide Sequence Number=SeqID_159774
atgaaaaaacatggcaacgattcagattctgagttagaaactaaaagcaaatccgacacatcagttagtcctagtgtcaaggtcctcaaggaagcacaagttgagaagtttgaatcttactctaggaaatatgagacagatgaagaatacatgttgtcagaggaagaacggggtggttctgttgcaaagaaaaagaagaaaacgaagggttctagcaaaagttccgggaagagcatggtggagatgggcatgcagcttgtttctatagccgctgaaaaggatctagagcttgaaaggaagctttccaagaagctcaaggtgaaggaaggaaaattgaggggagtggatgatgggctgaacataatactagatggaatgtcgtcagcttttgattttattatgggagaaggggaggttcctggtactggtgaattgtctgcgatgagattgaagaagagcttgtcgagtaagaaggacaagttgtcaaataaaagaatcaaagtggaagcagtggttgctgtatcagggcatgtagaaacttctgatgaagacatagaatcggatgatgttcctgatagtgtgccttcaaggaagaaacataagaaaaggaaagtgtctggccaacagcagaaagacaatgtggaggatgatggtgttggcatgtccaagcctgtggaatcttgtggaaaggaggtgaaattgggggatgctcctgctgaagttccagaaaagaaagccaaagaaaaatatatagcgcctcacttgagagctcgtgctggcaatgaacctgaagagcatactcaaattcgaagacgtgtgcgaggccttcttaacaggctttctgaatctaatgttgagtcaattactggggaattgtccttgatctttcagtctgttgctcgtagtgttgcttcacagatcttgactgaggaagtcttggcatcatgttctagtggtccccgtggcaatcaacagcaatttgttgagctctattttggttttaggggaaggtatgctgctgtttttgctgcatttgttgctgggatggcatgtttggtcggtgttgacttcagtgcaaaggctgatgatccagctgccatgaaagatttcattcttagtgttcagaatacatcaaataagttgaaggcttcctctgaagatgacaatgaaaagaaaaatagtaaaagaatggagttcatgcttgaaatcatatgtgacatcaagaataacaaaaggaagccaaatgaggactctgcacatcacactcggattaagaagtggttacggaagggagtgtctatgacagttgaaattcttggcttgttgaaagacagtgttgagttcaattcttacgatgctagtagtttcagaacagatgatcttttaagagttgatgacattttgattagagggcttaaatggagcaaattacttgatcctgacaagaagggccaatggtggttgtctggggatgtggcttcttcaacaggtaatgttgaagaagttgccaacagaatagacaaggatgttcttgaaacccaaagaatgcttcagcttgccgctgctcaaaagatgaacacagatgctagaagggcaatcttttgtataataatgagtggggaggactatcttgatgcatttgagaagcttctaagattggaactaccaggcaagcaggacagagatatcatgcgggttcttgtggagtgttgcttgcaagagaaagtttttaacaagtattataccgtgttggcttccaagttatgcgagcatgacaaaaatcataagtttactctacagttttgtctgtgggaccagtttaaggatctggagtcaatgccgctaatgaggtcaatgcaccttgcaaaatttgtggctgaaatggttgcctctttcactctatccctttctgttctgaagactgtcgatctgaatgatatcaccctattgacaccaaaaaggatcatgcatttccgcattctgtttgaggccattttagagtatcctgaaaacttggtatggaatatcttcacacgtgcagcagtgacccctgaacttgaaagttttaggcaaggccttgagtttttcataaaggagtatattgtgaaaaccaataaagatctaactcaaaagtttaagttagcaaaaagggccctcaacaatgtggaaggaattttaatgtga

SEQ ID NO: 68090 - DNA, 177 bp, Glycine max
  Peptide Sequence Number=SeqID_159775
atggggatgttttgttccttgttgcatttgttggcaaatagaccaaagcggggggtatgtttttggagggaactcgccagtggagttggcgagttggacatgtggcagcagttggaaaaactcgccagtggagatagcgagacacgatccacgtggcgggtcccgtcattcgtaatg

SEQ ID NO: 68091 - DNA, 1133 bp, Glycine max
  Peptide Sequence Number=SeqID_159776
atggcgaagaagaattgcaggatttgccaagaatctgggagtgccactctcattgagctggaatgttcttgcaaacatgacttggcttttgcccgcaaacactgtgccgagaaatggttcagcaccaggcctgacaaaatttgtgaaatctgtcgatccattgcacgcaatgtagcgttacaaggtgcggctgaaacgacgacgacattgtccgaacgtaggaatgcaccaaacaatcatgtgagcgaaatgcaattgccagaatggaggaatgctatttcaatatttacggttataggactcatattcattcctgttggtcttgcttcattgtttgcatcagagagtgtggtggaagttccattccgatatgatgatgaatgccttccacctgatcataaaaatgatgcagtggcatatatcaaagacgttgggtcaaacaaaacttgcaccaagaaattgactgttaagaataaaatgaaggcccctgtttatgtctattatcagcttgataacttttaccaaaaccatcgccgatacgttaaaagtagagatgataaacaactgaggagtaaagcagctgagaatgatgtaggctcatgtagtcccgaagactatacaccaaatgacatgggccataaaccaattgttccttgtggccttattgcttggagtctttttaatgacacatacaaacttacaagcaataacaaggatttggtgatcaacaaaaagaacatagcatggaagagtgaccaaaatgggaaattcgggtccgatgtttatccaaagaattttcaggctggaggtttgattgggggtgctagacttaacgagagcttaccattgagtgaacaagaggatctcattgtttggatgcggacagcagcacttcctactttcagaaaactatatggaaagattgagactgacattgaagttaatgatgtagtgcttgtaatagagaacaactataatacatacgagtttggaggcagaaagagcattgttctttcaaccacaacttgggttggtggaagaaataacttcttggggatggcatacattctcattggtgggatttccttgttattggccgcagctttcctacttctatatgtgatgcagccaag

SEQ ID NO: 68092 - DNA, 1896 bp, Glycine max
  Peptide Sequence Number=SeqID_159777
atgaaagagcttgctcttgcatacacgcctcttagaaagtgggaattgtccaacctaggttttgggcaccgtgctcttgcatacatgccactcgccatgggtggcacacactggagaaatggtaatatgctcctgcatatatgtcacttgtcgtgggtggcacatattggagtcgtgggtgctcgtgcgtacatgtcactcattctgggtggcatgtactggagtcaccaaggtgatatgctcttgcatagtcaccaaggtgacacacttttgcatgtgtgtcactcatcgtgggtggcacacattggagtcatgatgctagaagaagggctcaccaaggatggaccttgggttttaaaagccttggaggttggttgtgaccctaaagggaccttcccagttggggccaagctttcttgctcgggtatcttttttgacctcacctcggattcgccatatgaggtcgccaggttggaaggctcgcggttgaacctttctattgaatcttctggctgctcgaatagtctccttgtcgatggttcccctacttctacggggattatagcgtctgtgccatatggccctgacgatgactctgttagctgtctctgtgtgttcgttagtctgaggatgttcgacagaggctcaataggagctaagactgtgaaggttgttaggaggatttgcaccgctttggtggctagggagcatcctccggaccccacgaatcaggaagcttttgtaggggctcatccagtttggttcctcctcttctctgaccataatttcctcagcatctatggtgagagtttggagcatctcctggatgatggtcttgaggtccactcaggtattgctttccctggggatgtaggaaattttgaaacattcaaaattatcgatgagagacttcgctatgtgatagtacttgagcaacactgtttccttagtctggctttgaagttgaggttgagggcttgctctagagtgatattatcagggcctccgaggatgatctctgccccatttccttttacgttggatgcaccgctttcccaaaacctacttgatggggtaatttgtcttgactaccacttaatgactctagaagtagggcctgagtcgtcggctgaggtgatgaatgctagtgccacctttaatcatttggtagcgcttctcggtgtcatgaagcatgcgtctggtaaagtagatagggagctagtgcttcccttcctcttgagcgggggtgcttctggcctaggtcgactcaaaactagtgatgtggcaatgctcttcatgaaagccaggaaggcttgttcacaacttactgttgagcttttggactttttgaatgttggtgggactgtgcatctccagtatgacagtgcatttgtcgaggttggcataattcccttcgtacatgatcatgaagctgaggaacttgccgccacctaccccaaaagtacatttttcaaggccgaatggcatgacctcgtagcaaaagatggcatctttagtgatgaatgtcgttttctcctcgtccagagaatgcattctaatctggttgtatatggaataagtgtaatcactgcacattcaccatttgttgttggcctttttgaccatgacaacgctggtgagccaaatggaaaacctgacctctctgatgaagtttacatggaggagtcaacttcttctttgacgcacgtcgatgatgcgccgatgctcatgactggtgagctggacaagctcttcgattggcttcaagcctctatcggaggtgtcatctcgcggatctatgttaaattctctacccagactctcggatgggaggatatggtgctaccttcaggctctctgcatagcactgtcgtgcttgcttttggtcagcattga

SEQ ID NO: 68093 - DNA, 687 bp, Glycine max
  Peptide Sequence Number=SeqID_159778
atggcagacacaaacactctacagcaacttcaaaaccacatcacggagatggagcaacgccatgaggaagagttgacaaagctaaaggttgactatgaccagttagaggctcgtgtcagacgtccccagggcgacgagcaatacatccacaccttgcctgaatgcaaccaaggggaatcacacctccaacgcacaggcaacactgcagaagatctgagccttttccacatgcacgctccagcagcacagactgcaaacctctacaccaacaacaacgtgattctatgtcgtgtctttcctacatcctttaaaggagtagcattgacctggtctcattgcatgacattggccgccttggccagtctgcgacaagtaaacgaagagtccctcaaaaagttcatggacagatttgggtgcatggtcgtccagatccaaaatctcaaccccaaggtagcattgcattctatgcttctcgtcttacgccccggcaaattccggaatgaagttcgccaagccgagcagaagcgcaacaagcacgaagcacacaccaaggccgactcgcacaaatcgaacaacatgcacaagctagacaagagtcagcctttctccaaagggtccagatatgagcgttacacacccctaatgaccaatcacaccataattcttgaggaagcattcaacctggag

SEQ ID NO: 68094 - DNA, 276 bp, Glycine max
  Peptide Sequence Number=SeqID_159779
atgaagctgaatggctgcgcaccagcgttaccagcaatagaggtcaagttttcgagctcactcaacgttcttttaaagctaaaaacatgtgtccagttccaaaagaagtggaatgctccctgtgatccttttttcaagttgaacaccaatggaagctccatgcgtaatccggggcgctcaagattcggaggtatcatcagaaactctctccgtcattggatatctggctactgtggtaacgtggtcacactacaaacatccacgcagaacttctag

SEQ ID NO: 68095 - DNA, 264 bp, Glycine max
  Peptide Sequence Number=SeqID_159780
atgacgccctcacttgagaccccgacaaaacttttcgtagaaatagaaatgaaaaccgcttcatcgacatttccttgcgtacgcgtcaatgcgtgtgtaaccgacacgtcattaaatgtcgcactcaatggatctggaaaatgctataaatacctcagacacaagccactggaatatgttattactgtttgttcgctaattaattggttgaatctattgttggaaattgttgtttatcatctcagatcttgtacaaaattttag

SEQ ID NO: 68096 - DNA, 162 bp, Glycine max
  Peptide Sequence Number=SeqID_159781
atggaggcatcaaagatgaagtttttcttggttttggtggtttccgtgttggcgatggcagcaactggggtttcagctgctgaggcacctgccccagaagggttttttttttttgaggatgcattgaattggagatttggagtgaggaaagatgacaagtag

SEQ ID NO: 68097 - DNA, 141 bp, Glycine max
  Peptide Sequence Number=SeqID_159782
atgaacaggacaagagaaggaagtgtggatgacgatagccaaggtaggtggagagtgaacgaaacaagcgctggaaagggaggcagaagaggaggtgcaaaacgacgtcgctgctcaacctctcgggattgcaagcgatga

SEQ ID NO: 68098 - DNA, 436 bp, Glycine max
  Peptide Sequence Number=SeqID_159783
atggctgctagggtctcgatacgttttggcacgaaggagcgaaggttgctcgagtatttggaatctgagcaaagacttgaaaaatggtactctttgaatccatgtaaggtaatcattgctattggattcattgcaagcacacctcaaatcattgctactggagttctagctctgacatacattgtctttaattcacaacaagcaagtgggtggactccaagccacgagggacaatgggaaaacatggatcaccttgggactgctatggcagttgttggtttggtagcatgtcgtgcatatgcagttaaaaagaattcctctgtgaaaagatccagtgggctcaatgtgaagattgtatcaagtggtgcaaattgccagcaagtgcgcttcttccatcaagatgggtgtgttttgataattcgtgggatccagaaag

SEQ ID NO: 68099 - DNA, 927 bp, Glycine max
  Peptide Sequence Number=SeqID_159784
atggatgaacatcaacaaaactggaaggaaatgacaaacataatggtgaagattaacaaagaatcaaatgaaatgttcaacattgttcatgttattgatcaggatgaactagatcctacgcggcgtcttctacactctagcggcaacatgcactttgtcacatataaccaagattttgtaagtccaactctacttgctggatggacagaatttagagatttctatgggctcactgaaaatcatcaggagcctcctcgtttcgacccaatcaccaaatgtagcacccaagaccgctccaaccagaccatcgcctcggaccttgatggcaccctccttgtctcccggagtgccttcccctactacttcctcgtcgccctcgaagccggcagcgtctacttcacgtacctcgtcctctccgaaaccctagctatcaaaaccctaatcttcataaccttcacggggcttaaactaaaagacgtcgagctcgcggtcgcgaagacgtttctcggcgcggatacggcgctcggtacagagctggtggtgacggcgtcggggagggttacggggctcgctaaggaggctggtgtgcttgttggtgttcacaagaaggaggtgatattgaaggagtttgggacttggggacagtgtaacggacatgaacttcttgtcgatttgcaagacatgtgtcctctcaggttcatcctgatctttttctccactatgttggccgcctatattgcctggaccaccgtgagttcctctccggagattgatgtgaccagccaagacacagaaaacagagcctcctctaacaaggatcatttcaatttcatcaagatgattcagaatgaattctgggtattcgttgacatggccagcgggaggtatgtatggaggaatttgaagtctaggagtcaaggcatctaa

SEQ ID NO: 68100 - DNA, 150 bp, Glycine max
  Peptide Sequence Number=SeqID_159785
ttctgctcaggtggtggtgacaaggactacaaggaggtacccccacctcctttgtttaaacctgcagggggacacatcaaccaagctgtgactttcaacagatcttattacaaggtaatcagttcaatggaaaaatggttgagtcactag

SEQ ID NO: 68101 - DNA, 447 bp, Glycine max
  Peptide Sequence Number=SeqID_159786
gtctgcactggagctaagagtgagcaacagtctaaattggcggcaaggaagtatgctagaattatccaaaagcttggtttcccagctaaatttaaggattttaagattcagaacattgttggctcttgtgatgtcaagttccccattcgacttgagggtcttgcctattcccatagtgctttctcaagttatgaaccagagctgtttcccggactaatctatcgcatgaagcaacccaagatagtcttgcttatatttgtctccggaaaaattgttctgacaggagccaaggttagagatgagacttacacagcttttgagaacatatatccagtgcttactgagttcaggaaaaaccaacaatgctatcagaatataattgcatcagatgtagggctgagattactactgtcaagagagcaggagcaagacttgattgaactgtaa

SEQ ID NO: 68102 - DNA, 387 bp, Glycine max
  Peptide Sequence Number=SeqID_159787
atggagactgttgtcgtgcggaggagccatggtggcacgtggtgcaacgtgaggagaggagaggaggagtctgagtgcgagagagaggagtcgtggcagcaccctcatgtttccaaatctgtgaatttttctgatatcaaatgtggcattcctaagttaaaggatgacaattataaggtttggaaagagagagttcttcttcatttgggatggatggacattgattatactataaggaaggaaaaaccattagctattactgagaccaacactctagttgcagttgatctttatgaaaagtgggataggtataatcgcctttctatgactttcataaagaccaacatttttgtttgtatccggggttctatcgtccaacccttataa

SEQ ID NO: 68103 - DNA, 776 bp, Glycine max
  Peptide Sequence Number=SeqID_159788
gaaatattggaggtgtccttcaaaacgtctacttcggtcacaatttcctcaagttcctctctataggggattcgtcttctattggcagtgaggagtcgagtgacttctctacctatttgaatcaacttctagagagggtggccgataacataggaaagaggcctccttcttcggaagccgcaaagacaactgtggattcccctaacccttccatgaaggtgatgcgacaaaaatgccaacacgtgttgacagagaagaagcacacgagattgccttttgatgacttcaccatggatgtcctctgtgctttgaacgtggccttatttgagctacatccgaataagtgggctgccatacaagcattccaagccttgtgtttgtatacttttgttaaggctaccttgggcatgttcctccattatttttgtcgtctgtctcacaagaaggcacgatggggaaaccggtgttcccttttcattaacaacagtgtccctatcgatatggcaagtcgggatgaaggtgttggagaaaaggcacttaatgttgaggcttcaaacaagcttaataaggaggaaatggcaaggttggaagttgctttggacattgtcgagagggagataaatgctagaaaaaaggaaaggctttggattgaacataaagcatataacgatgtttatgaagctcatgagtttgacttcaaccactgcctccgacaagtactcttccactatgaagccccagatgaatccatttttgacatcaacaaagatgtctaa

SEQ ID NO: 68104 - DNA, 846 bp, Glycine max
  Peptide Sequence Number=SeqID_159789
atggcaattgcacgcactggagtctacgtcgacgactatttggagtttcgtttcgctttcgtttctgaattttccatttccacagacgcgagcacattacccgctgaacttcagagactgctcaacactgtccgggaacttgatgatcgatcccaatctatgataacgcagaccaggcagcagacgaagtacactatggggttctcatcacatggctccaagaagggtaatcacagttataataacaattatgggaatgaggacgatgatgcagctattgagaaaatgcggaaagaaatcgaggtgaatcaggatagtgcattgagtctttgtactgagaaggttttgttggcaagacaagcatatgacttgatagatagccatataaaacgacttgatgaggatttaaacaactttgctgaagatttaaagcaagagggtaaaatagcaccagatgaaccagcaattctgcccccattgcctatagtccctaaagctgaaaagcgcaagcccatatatataactcctcaatcaaagagaattgattacagggaaagagattgggatagggagcgtgatagggacttcgagctaatgcctccaccaggaagtcataaaaaggagtatgctaccccgatggatgttgatcaacccattgatccaaatgaacctacatactgtgtttgtcatcaggtatcttttggagacatgattgcttgtgacaatgaaaattgccaaggaggtgaatggttccactattcatgtgttgggctaacgcaagagacaagattcaagggaaagtggtactgtcctacttgcatattactcccacaatgtcaacgatga

SEQ ID NO: 68105 - DNA, 357 bp, Glycine max
  Peptide Sequence Number=SeqID_159790
atggtgggacccacgattgagggacacagagatggacgtcgcagaggccttagcgtacgagggcttcgacgaggtgaacaaggcccggagatgagttcgcgattgcaaattttacaaagtgatttgattcatctaggagggaggtggagagaaagagctaggttttctgagggagaagagagatcaacactcaacggagaaagggggtgtccaaaggggattcctaaattagtgtgttctaagcttgagattcaaaggagttttttgtggggagggaatggagagtggaagaaaaaaatagcctgggttaagtgggagggtgtaaacaaggataagtgcataggaggtctttgttaa

SEQ ID NO: 68106 - DNA, 78 bp, Glycine max
  Peptide Sequence Number=SeqID_159791
atgggaaaaaggtatcctccactagaggcaatcctgtttgagtcgggtaagaccacaaccgcaaagttctccctctaa

SEQ ID NO: 68107 - DNA, 1041 bp, Glycine max
  Peptide Sequence Number=SeqID_159792
atggctgctcaaaacaactcgtttctcacttcttcatttcctagttcgatttctcataaactagatgatttgacccttctactatggcgccaacagctgattgagcagctggaattgagaatccatcatacgaagtttgggagcaacaagatcagaattcatgattactttcacaagcaaacacgagctccagcgcgacaattgctcagtgaattgcgagcgacgacgctcggaggaagatcgatgcgagagtttttgatgcaaatcaaaacaatttttgactctcgcctcgattggaaccttcttttggctcatgaagcttgcctgaacaagttcaacaagcaatcactctcttattctccttcgattaactatatgcaagcgcacaacaaatccttctcatcgcatggatctgatggttatatggtgccaaacaagtcctttttgcattcagatcctgagagtttttctaattctcgtggtggtggttttaacaaccgcggtggtggctggtgcgacggcaccggcggaggaggccggggtcgtggttggtttgctaactttcagtgccaagtctgcctgaagtatggtcacactacctcagtctgtcattatcgacacgagcaacattatcaaccaaattcaactttggtgcttcaggatcctactactatgcgagtccgtctcagaattctggttatcggcaaattaattctaattctgggtagcagaatggtgataatcgtcttgctaatgttcgaggcttcttttcatgttactggagaatctcagaacattcagcagatagaaccttttgaaggtcttgatcagatcttcattggcaatggtcaaggtctgaagattacttcctcaaattcttcttccttcatttccccttacacaagtccaaaggacaatgcagttttctttgagttttactctaattattgtgttgtgaaatctcagtttaccaatgaggtcttactacaaggcactgttggtcctgatggtctctacagtttctccaacattcagttttag

SEQ ID NO: 68108 - DNA, 600 bp, Glycine max
  Peptide Sequence Number=SeqID_159793
atgaaacagaagcttaaggaggccataaaaattgagttatccctaaggggatcgcagtactcacccccgattgaggtagaaatacaagtattgagtgcacatgtgagcacaaaggggagcaatgctgaaactgctgtcaccccatcaggagaagaacatgttgctcatgtgataccgattatggggttgaaggcccttgacacattcattgcatggccgacaaatcttgtcaaacttgtatcgcatgaggattcacatattactgttgaacctgttcaaaggtcaaataatgttgttgtagatgatcccttgtgtgggttgattaagagcctttatgatatttacgagaagcctattgagttgttgtgggatacgactaaatttgggattccaaatgtagatgcatccttcttcttaacatattctgatgttaatgaaacaatatcaggttcatggatgagtggagctcaagcttgggtcatggttcggtgtatggattccttaagccttagtccatacacaatgcaaaggattgacgtgttgaatgtcaacattacattgaaacatggcttaaggaatcccaacgagaggtctacctag

SEQ ID NO: 68109 - DNA, 942 bp, Glycine max
  Peptide Sequence Number=SeqID_159794
atggctaacaaaacggaagaaggacaatctgtgatgtttgagaatcatgtgtatgagccagacaaacagcaggtgacttacaaaaatggaagcacggaatattttcaaaggcttatatgtaaagtggctttctgtcaaagtaaaggtgtttcccatggaaacttaaaggtggcaagcattactggctatgagggtgcacacgctgatatattgtcatgtggtgttattctttttgttctattggctagttatttacccttcaatgataaagacattaagactttatatataaagacaatccttgatccctgtcctgctacaattgatgagatgttggaggatgaatggttcaagaatgaacatcaaccttttagatctttccagcaaaatattagttctgataaagtaagtgctggtttcagtggagcagctgaaaaagcttttggattctatgaagtggtactgcttgttgctcaagacaatgaaaaagggaatgatctttatgaacaggagacttcattttccatcctattactaggaaggctcgaagacactactgacgagcactgcattatcttctatgataaggaaaaggtcgagcttgtagaaggtggaaccttttggttgtttaagtctccctctttacctggaagcatgtcatgggggtttcaatacacaaaaggaatcaactattggacgctttcttcttggaagatcaagctctctgcctctgatgggattgccaaacacaggatcttcacattgattggatctttttcagagcctgggactcctgtaagcatacagacaccacccaaatcatatggaaatactgatcagggtttaatgaagaaattgaaagactttgatggacttgcaatgtcaataggcaatggccatgctgaaagtgcagagcgtagaggtgaaaataggctgtcatag

SEQ ID NO: 68110 - DNA, 969 bp, Glycine max
  Peptide Sequence Number=SeqID_159795
atgtcgttccccttcaaccactctcacgccacccacacccaccaccgcagggacgacgacgacgacgaacgacccaccgtttaccctccgccgggaaactccttcagcaacccgccacctccgttctacggcgtccctcaaccaccaccccctcagccggagacccacgtgttccattccgctcacgtgacaccaggacacgtgtcccatgacttcaacaactactccgctcccccgcctccacccccttcccaccatcatcatgatcgtcatcatgactccttcacccacgcttacccacctgctcccgctgcagctgattaccccgctcacggaggcagcagtaccaccgtgcaccacgtggctcacgagtctcaccaccacaccccccattccgctttctcctcccacaacaacgcaccccccaccactgttcatcacgtgagccaccaggttaacaccggtggtctctcgaccaaacccactgtcagggttttcaccaaagctaatcccaatttctctctcaccattcgtcgcggccaagtcattctcgctccctccgatcccaccaatgagtaccagcattggtataaggatgagaagtacagcacgagggtgaaggatgaagaggggtgccctgctttctctttgatcaacaaggccactggtgaggccttgaagcactccatcggtgctactcatccagttcggctgataccttacaagccagactatcttgatgagtctattctttggactgaaagccgtgacttaggagatggccacagagctataaggatggtcaacaatgttcatcttaatgtggatgcttttcatggcgataagaattctggaggtgtgcgtgatggcactacaatagtcctctgggactggaacaaagtgtctcaagtctcaacatttggtcagaggattcctaatgattccgaagttatactatctactcaatag

SEQ ID NO: 68111 - DNA, 432 bp, Glycine max
  Peptide Sequence Number=SeqID_159796
atggaagacgtggacgcggctgccggagctgccggcgtcgaagatgacggcgtaggagccggcggatttctcgacgggggatactttccggttaacgagggcgtagcctccgacggactcgttagagatgctggacggcatgacgtagaggacgaaggtgatgaggagaagcgggatcgccacgacgagcagcgtcccccggaaccggtagatcttgtcggcgagggactcctggcggccggggcgcttcagcattttgctggactcgaactccggcgagtgctggtcggcggcgtgcgacggcggagagttgctgctggcctggccgtcgaagagctcagcggaggacggcgaccggtagcggatctgaccgttggaggaggcggcgggcggaggctccagctcggtgtcctgggattgattctcaactaa

SEQ ID NO: 68112 - DNA, 99 bp, Glycine max
  Peptide Sequence Number=SeqID_159797
atggagttgctgcgaaagataaaggagaagagaggaatattccaaggatatgccaaaggcatattagcatattccaaaaatatgccaaagacatcttaa

SEQ ID NO: 68113 - DNA, 90 bp, Glycine max
  Peptide Sequence Number=SeqID_159798
atggcacgagcaagcatgccagttggagtctggtgtgaagtaggaagcttgagtcagattaggcatttgagagttgttcacccgttgtag

SEQ ID NO: 68114 - DNA, 1077 bp, Glycine max
  Peptide Sequence Number=SeqID_159799
atggttagaaccggaggttttggtcgaactttaggcagggttataggaaaagtcttggggagagaagataatccttcccctgttgctgaggatgttcatcacgtggatgacacagttgacaaggtcttccaacaacctcaagaagaagttgatgcccagggtttttcaggtaggccgcatgacacatcagttctgactggctatgctaatcatgttgcaatcattgtttggaatggagagctatcctcccatggaaggaatgttcagaaattcgggaggcctactgtagagattgaagggttagttgctgccacaagattaagtcttatgatcgcatgttcattgaacactagcaatcggggacttatatcggcttttgcggataggtggcataaggatactagcagtttccatcttcctgtaggaaagactcttcatgttgacgaagcgatgttgttgttagtgaagttactcgaagtcaatgcaaatgaagtcagagaagagacagtacagtttcatggggcatatagtacaacacacgtgcatttggtgttcttggacgcctttcgagacctcactcagagtggaagctatgcatggggagttgtcgccttagtgcatatgtacgataatttgaatgatgcgtctaagagcagcggcaaacaacttgctggatatatcacactattacagactattcctccaccctctccgggttcaagattatgcttagaagatattgatgacagatggatgcacatctctgagtatcttgcaccgcccgaggatctagtcaggcatccacctattgtgcaagatgacacatatgtcaaaccagatatgcctcagtacctggtggcgacaacagttatggaggaagtacgtgcacatgcatcttctcagatggagcaacctcgacatgtagtggcttgtcaagaaatacctgaaaggttggagtggttgttcaacctaaggatagtgattgaagacacagaaacatacaatgtcatggaagactgcctaagaatcgctagaggtgtgactacggattgcaatgtatatgtgcggtcacgatga

SEQ ID NO: 68115 - DNA, 219 bp, Glycine max
  Peptide Sequence Number=SeqID_159800
atgagaagagaaagggaattgtaccggatacgttgttcttccgaggaaaacaacgtaggagatgatatggagggaggaattttggttgtctacgctttggatgctccttggcttcgagttccgatgactgcggatgaagtcgaaacaccctttcacttctttaatgggggacacactgtaatcgattacatagttcctgtaatcgattaccagaactaa

SEQ ID NO: 68116 - DNA, 225 bp, Glycine max
  Peptide Sequence Number=SeqID_159801
atggctgttcctccttcagctatcattgttgagctttcagcagttggggtttctagcatcagttctcgcctgctttcttcactccggatgatggctatcacttcattaagaacaggattcacaatttcagccacgggtgagatcaaggctgcgatgagtaatgaagacagcaatgaaggctgcgataggtttaaaggttgcgcagcaatgagggctgcgacttag

SEQ ID NO: 68117 - DNA, 141 bp, Glycine max
  Peptide Sequence Number=SeqID_159802
atggatttcgatttcatcatttcaaggatgggttttgctcctgtcgagactactgctgttgcagagtcaattaaccagaagaaaaaggccaatggcatagggaaggagtggaggagtgattttgaccaaattgttagttga

SEQ ID NO: 68118 - DNA, 189 bp, Glycine max
  Peptide Sequence Number=SeqID_159803
atggtgaaggagattgggagcctcagtagtggttcaagcaacaattggagagtgaactacacacgctggtggtggcgtgttcgaaaaattgtgtgtgggggcttggctggagtcgcttgtattggtggtctgacctcgatcagagttgcggtcaacccaggcgaggactggatcacaacctacttctga

SEQ ID NO: 68119 - DNA, 1033 bp, Glycine max
  Peptide Sequence Number=SeqID_159804
atgaaaaagagcagaggtatgaagatgagagagaaacagggtgagggagagagagacagggtgagggagaaagagagaaacagggtgagggagagaattagggtgagagagcgaaacagggtgagagatacagagacaagggtgagggagcgagtgggagctacagagggcaacagaaggcgaggtcgagagagggagccggagtcaacgcacagaaggagagacaaccaccatcagcgattctcttcacgacgttcttccgctcgaacatggaccaacgaggatgcaggctacaatcatcataacggagtcgaagtgagatggagtacggacaagcaagaggaatacgatcatactaacaatcatggtgtatggcacgaggtgtcacacagacgaaaaaggagattggttgaaatcaggggcagcatggagagcccaaaatggcaggagagaaaggtgacttggagagacaagggagatatcacgacattctatttctctagattcccggagggagtcaaggagggtgatctatggcagatttttcagaaatggggaaaggtatgggaagtctttatccccaagactaagaacagggaaggtcacagatatgggtttgtaaggtttaaagaggtccaggatgaacgaagtttggagacacaacttgataccaacatctatatcagtgggatgaaactttttgtgaacagtccaagatatgagagggggagggtgcttcgggtaaaacagaatgctacatccacacagaaggtggcacatactcacaaaatgcatatggagaatcaggaggaggtgaaaccaaaaggccctgggaccagaccgcgttcgtttgtggaggtggtaagacaggatatgcaaggagacgtagcctcttatcggaagaaggaaccccccctttgtacctcaatggccatgcagagaccagtggtcttgagctcacgtatggagtccaacgaatggctacagaaggcttgggttgggaaactgaagaatagaggaatgtttgagaaag

SEQ ID NO: 68120 - DNA, 546 bp, Glycine max
  Peptide Sequence Number=SeqID_159805
atggagctgcatgctaatatcccaaaatatgggagacagacaccaacacaagtagctccgggagctaaccttaaggggcagcatgagagaaatggaaatgaagaacacaacatcgaaccacacagctgcgaaagctccgcatcctcggtatatcttgacattgcaccagacaacacgaaatggcttgacgaagcttgggtaggccgactcaaaaatccaaccatgcttgagagacttgaagatcatctactgtgggatgttggagcggatcgactccagagtagaacaaatgctaatagaagaaaaccacgatggtgccccgatgttccactcattggaaaagtggagtccgatcctgtgttcgggcttcaggctaactgggtacaatgctggggtattccgatagtggcttgggatgccaaacagatccagaaaatagtggccggcatgggagacatggtggatctcgacaatgatggtgaggatgtttggaggagggatagagcaagggtattaattaaaacgccatggaagcctgctatctag

SEQ ID NO: 68121 - DNA, 804 bp, Glycine max
  Peptide Sequence Number=SeqID_159806
atggtacttaccactcttgattctgctgtacattgggcaacttcttcaccatgtggtccagtgcatattaactgcccatttagagagcctttggaaagcagtccctgcagatggttgtcaagctgtttatctgggttagacttgtggatggctaatgctgaaccatttaccaagtatattcatatgcaattgtctcatacttgtataaatgctcctggtgaaatgactgaagttttaaatctgattctaagggccaataatagtcttctattatttggtgcaatccatacagaggatgagatgtgggctgctctacttttggctaaacaccttcagtggcctgttgtagcagatatcttgtctgggttgcggttaagaaagcttttaacttcttttcctgatattgaaagaaactttatatttgttgacaatcttgatcatgctcttctctcagattctgtcaagggctggttagaggttgatgtggttattcagtcagtgacaaacaaaggccatcttggcaatatgggagaaggtgtcattgtagtcgagtccaacgatctcagtgtagctcttggctacatgccatgccttcagtcattcaatctgtccattgggtccaactttaatggtaaaggcctagcgacaaccaacaagggatctgtccattggggcagatacaaaggcatagtgggatttgggaaggtgaaagacgatgagtctattgcaacaggaggaatgattggagtaggagatgaaggaccaatcccttcaatagagggtgcttccacatgtgttggttga

SEQ ID NO: 68122 - DNA, 621 bp, Glycine max
  Peptide Sequence Number=SeqID_159807
atgaccaaaggtttggtgagaggatttagggcaacttcagtgagccagaatccagcttcgaacacagctcccaaaaggacactttcagcgaaagggaggttggttctccaaaccggcgcctccaccacaatcgccgcacccacatcttggggtggccgtttctggggcagaacactctgctccgaagactccaccgacaaattctcctgtgtcaccgacgactgcggctccggcaagctcaagtgctccggaaacggcgctgcgccgcctgccaccctcgccgagttcaccctcgacagagccggaggcctcgacttcttcgacgtgagtttagttgacggctacaacgtgccgatgctggtggtgccgcagggtggctccggcgagaagtgcaccgcgacggggtgcgtgggagatctgaacggcgcgtgtccttcggagcttaaagtgatgggagcggatgggagagagggtgtggtggcgtgcaagagcgcttgcgaggcgttcaactcgccgcagtattgctgcagcggcgcgtacggaacgcccgacacgtgcaagccattggcttactcagcgatattcaagagtgtgacaccctctaccccgacatatatataa

SEQ ID NO: 68123 - DNA, 489 bp, Glycine max
  Peptide Sequence Number=SeqID_159808
atggctactcttaatgctaatgtatcatgtaacatccctgatttttttacttcttggcaacacttacactatgacacttcacacggtggaacttcactcaacatccttgttggtcagaaccctccaccgatcaaaaccctttgtagggtgttacaccctaggcattcaagagtgaagcacattgctcaaatggttaggaatcattccagaaagatagtgccaaaggctcttgtaaaggaagcaccaattcctaaaatgaaggcaatcataaagctatttatgcccattgaagacttggatgatgattggacacctctacctccacctccaccttttgaaccttacaagcatggtgaaggtgccatggaagttattgaccttggggaagataagtcccatccaactatgaaagtctccaacttaacttggtactaccctgttgatgaaccttatcaacctatagataaagcttcttgcaactgtctttaa

SEQ ID NO: 68124 - DNA, 618 bp, Glycine max
  Peptide Sequence Number=SeqID_159809
atgcatatgagttctggtgctgagaaggttaaatttgctgtgcccctactggacatgaacataaacaagatggtggcttgctgtccctggagatattcccagaagatattcttacaggttgtatatcctgttggaagaaaatatatgtcagcgccttcagctgctcgcctgaagttagtatcttctcctgagctgaaagccgtattttccattgatgatgtcaagctacctccttggttggatgggatgtgtttggcagaatatctcccaaatctggaagaatatcttgggaagcaggctgtttcattgattgaagttagaaggcacttcattgaagcattatccagtccgtttggaaggccagttgaagctgatgctgtatcttcccgtgacacttattctcaaattgctagggtcttttgcaggaaggcaacttttcttgctgcatctggtgttttcacgttcctgaagcagaagaaataccgtgtgacagaaatgttgggatccaattgcaagatatgggacttgagttccacattggaatcaggactagtcgaaaggcccgtgcatagccagcctacatgggcactaggactgcagagtatggtgggatgttag

SEQ ID NO: 68125 - DNA, 384 bp, Glycine max
  Peptide Sequence Number=SeqID_159810
atggatttggatttggggtacttcaagagatactgcatggtcctgagcgacattgctattgttcttccagaggttttctctggccatgttcagtggcctggggtcaggcctactattcttgatgaagagggtgttgttattgctgcaaaggatgccaggaatagagctaatgatgatgaagataatggaggagtttatgttaaagttggtcaagctatagaggaggaccaggatgaagggcttggtctcaaatatggccatgtggaaaaagggagccatgccattcactcaactcgcccaacgagtaaatccctttgggtggaagaaattgcaattccatttgggaattttgaagaactccccaagcaagttggccttaactag

SEQ ID NO: 68126 - DNA, 132 bp, Glycine max
  Peptide Sequence Number=SeqID_159811
atgacgtattctagagagaggaaaaccgtacattgccagaagaagtggaacaaggtcccccaagctaatccgtacaaggtggataagtgtgtggatattatacattgtgcatcaaatacaaccgtgaattaa

SEQ ID NO: 68127 - DNA, 477 bp, Glycine max
  Peptide Sequence Number=SeqID_159812
atgggggtatcacctcgcctccgccttgagtttgatggattgaggataggaccgactgggaatgaggatgggatggattttggaaggcagggtataagaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 68128 - DNA, 489 bp, Glycine max
  Peptide Sequence Number=SeqID_159813
atgtctatgtccgtatccgtgtccggtgtttgtgtcaaagtgcgtgcttcatggactgaaagtgacaggaaactgaaatctaaacagaaaaaggtaagcgtcaaacatttgcatgtgaagacaaaggcagaacttaaagaagctatgtgtgtagcacaacatgagcaaatggactgtatggttgaaattgagagttccattaatgccaatgccaatttccacaggattgcacttgaagctccgccaacatcaacatttgttagtgatggttgtaaggaattctatagagaaggatttattttatctttagtgcttgaagagggaagtgttggttatggtgagaatgatcacctttccgtaatgggtagttcaaggtcaaatggcaggcctggatctggtagaggtctgcactggggaaggttgatcatggtctggacctcagctagaggagttggtacaggtgccactggttggtttaggagacattga

SEQ ID NO: 68129 - DNA, 750 bp, Glycine max
  Peptide Sequence Number=SeqID_159814
atgcttgagcagaaaacaatgcgtgagtttcttctacgaatcaaatgcatagttgatgcgcttgaattgtgtggagatcctattcttctgcgtgaacaacttcacacgattgttgaaggcctactagaagagtatggtccagttatcgaaagttacaattcatcctcgaataagttcaatcagaaaatcaatccaattattctggaaatcgtggtgacttcgatcgtggcggtggctacagtcctggaggcaatgattttgatcgcggcggtggctacagtcgccgaggcaatggctttggccatggttaaagtcgtcgtggtggcgacagaggcagcagtggttatgcaaattttcagtgccaagtttgcttcaagtcacacagcagcggtgtgtcattttcgctatgattatgattttcagccaaatgcgtctctcactctgatggaaccaatgtttcaaagcaattcatcaaacaccttcggttcaaaacagaatcagggaactaattctcacatagactctcaacctagtgcaatgctgtcaagtttgttccacattattccaactgtagtagttgcaacgaggacgtcgacgaccactgatagatgcacaattattagaggagtgagaaacaagggtagagtactccctggtagacgtggaagagtttccaaaagtatgcggtgtggagaaacacaacaactgctcctaaaccatgtcacaggtaggaacaatgggacccgatag

SEQ ID NO: 68130 - DNA, 183 bp, Glycine max
  Peptide Sequence Number=SeqID_159815
atgattggggattattcttataagatcacttattggaaacctcctcgtccttctacgcctccaggtagtcctattcacttctcattcgattctgatgactccagtgatgagtttcaacagaagcttgatgaagaagtttccgaacaaaaaagggagaaaaagctttatctcaaagtcttatga

SEQ ID NO: 68131 - DNA, 1113 bp, Glycine max
  Peptide Sequence Number=SeqID_159816
atggcccaagggtgggggttggtggacaaggttaacaaagacgtcgtcagagttgatggttgtggtagcaaaagggaaggagtggggggaagtgagttaggaagtcaggttgtggagggagaaagaagcaaagtggttgctgtagaagaagttggggatgaggttgcagcagctatggatttggcatccaatctcggtggcaagattgacaaagccgaagttctctctgccgttcagaagtatgagaagtatcatgtttgctatggaggtcaagaggaagagagaaaagctaattataccgatatggttaataaatactatgatcttgttaccagcttttatgagtttggctggggggaatctttccattttgcacccagatggaaaggagaatctcttcgagagagcatcaaaagacatgaacacttccttgcttcacaacttggactgaagccagggcagaaggttttggatgttggatgtggaattgggggaccattaagagaaatttctcgattcagcttaacttcaattaccgggttgaataacaatgagtaccagataacaagaggaaaggctgacttcatgaaaatgccattaccagacaacagttttgatgcagtgtatgcgattgaagccacttgccatgcaccagatgctcctggtcaatgttttgctgcttatgaatggtgcatgaccgattcttttgatccccaaaacccagagcaccaaaaaatcaaggcagaaattgagattggtgatgggctacctgacattcgattgactgctaagtgtcttgaagctctgaagcaagcaggttttgaggtaatatgggagaaagatctagcagtggactctcctcttccttggtatttgcctttagacaaaagtcatttctcactgagtagcttccgtctaactgctgtcgggcgacttttcaccaaaaacatggtcaaggttctggagtatgttggactggctccaaagggtagtctaagggttcaagatttcctagagaaggctgcagagggactagttgaaggaggaaagagagagattttcacaccaatgtacttcttcttggcccggaagcctgattcagacaggaactaa

SEQ ID NO: 68132 - DNA, 456 bp, Glycine max
  Peptide Sequence Number=SeqID_159817
atgggttctaaggaaacagagttctggaaagacagacttgaaaaagtctgggaaaaaaggggtgacattggaacacatattcttcacttagagatgcaaaaagtgaagttggaaaagctcaatctcacaaatatctggaaaataggtttttcaagtattggtcatttttcttactcatcttggtatatcttgcctgaagaagaagtgtacgcacttggcgtatatggagataggaaaccagagatcaaggagttccctttatggcagattgttgctctcaatcctaataagtctaatgttgaagttgaatcttcttccatggtcgttcaagtatatgatccttcattctctcgtgcatatgtttgtatgatcgaggatgaacttgtcaaaacaagggaagcacttgctcaagcattaaaggattgtgctcatgttgaaaaagaggctcgaaagtga

SEQ ID NO: 68133 - DNA, 627 bp, Glycine max
  Peptide Sequence Number=SeqID_159818
atggacattgaagagtgtgtgttacattgggaaaaacatgaaagtgggattggaattgacgtgtcaaatagtgagtggaggattggaagattgaaagcaatggttgagatagagaataaagccaacgatgatgcagaagatggggtcgaagagcacaatgtagaagtgaactccggctctgatactggtcgtgattgcattggagcgagtgttgtcatcaactgcttctctggagacatcgacgggaggaggggaggtgccatgggaaggggaggcggcatgattttggttggtagtggtgacttcgcaaaggaagaagatggagaggttgcaacgtgtttgatcatggcggcctcgaggcagtctaggctggcagaggaaggtttggcatctgccattggagggcggcaggacaagggacctccttactacactaaaggtggtgccgccagtagaataggcggcaaaagtgttctacctcccatctcgccattccttctggtgatacaacctatcccgccatttgtgttggcgagacatccctcagaggccatgccgccatacgtgctggcgatacaccccttcccatttcgctattcaaattggcgggacatgagttggcaatga

SEQ ID NO: 68134 - DNA, 213 bp, Glycine max
  Peptide Sequence Number=SeqID_159819
atgagaggagtgcgatggttttccctatgccgatgggcatttccaggaggcagtggcccttggcgtcgaggaaatggtggagagaggacattgggaagagaagagaaggcagtgggaagaggagagagggcattgaaaagaggagaacaagaagatggctatgtaaggcctgtgagtttcttgtgcaaaatgagtataccaaatgttaggtag

SEQ ID NO: 68135 - DNA, 228 bp, Glycine max
  Peptide Sequence Number=SeqID_159820
atggcagcggaatggagaaggaagagagagaggagacgtcacttcaaggagaagatgagtctagaagaagctcaccaccataggaggccatggataagagcttggaggaaggagatgaatgaagggagagggagagaagagcacgaaattttgtgctctaaaagagctctgaaatctgaacccactaatccaagatcaattccaagattctccactaagtgtgcttag

SEQ ID NO: 68136 - DNA, 1380 bp, Glycine max
  Peptide Sequence Number=SeqID_159821
atgaaactcatttacctaagcttgatgagtcaaagactcaaggacagtaggaacaagcttggaagaagaagaagcaaagcagaactctcctccctcaaggtagaactcgtgcaaaaatgttggtttataattagcaatgtcactttttgggtaggctgcagcttctcgcttctcagttcagtgcccagagtagaggctagagctcccctcagaaaatcgaacacctcggtagggttagggttttcgttttggtgcagagccatggaagccgcagtggtcgacccgggttccagcctcctcaaagccggttttgcgattcccgatcaagctcccgccatgataattcccacccagatgaaacgaatgctcgatgatgggtcaatgaccgataacttgacattcgatgacattgctgtcgatccggtgtgccgaggttatgtcagagattgggatgccttggaggatttgctgcattatgtattgtatactggccttggatgggaaatgggcaatgaaggacagatactgttcacggatcctctttgtactccaaaggctaacaaggaacagttagtgcaactaatgtttgaaacattcaacatatcagggttttatgcctccgaacaagcagtgttgtcactatatgctgtaggacgtatctctggatgcacagttgacattggtcatggaaaaatagttaatttgattattcctcctcgttatctcacagaggatgatcgtgttgctggtcgtatcaaccctgattatgaagcatgggaggttcaagatcaaacgctcctgacttggtggatatccttgacatggtgtatttggcaccatagaaacagaatcattttctcaaatgacagctttaatgcctacaaattgatggaggacgctgtattcctatgttggacatggtttaagaatttggaaaaaggatttcatactccattccacttctggtccagcaatattagggaagatattgcaccagtgattgagggtgctgttaaccacattgcctcaagaagatttgagtttggaggtgttgatctaactaatttcctggctcaagaacttggcaaatccaatccgctagtgaatatcagcatctctgatgttgagaaaataaaacagcaatactcttgctgtgctgaagatgaattagcttatcagaagaccaaaggttcctgccctgtggagacacatacccttcctgatggacagggttctgagagatttgttgtcaccatacctgttttccgaaggaatgatgtggtgaatgagatgggaaacatagaggtggtgtacgaagttattggtttcctacttgttgaatgttatcatagaggtggtggaaaggccatgaacctttga

SEQ ID NO: 68137 - DNA, 264 bp, Glycine max
  Peptide Sequence Number=SeqID_159822
atgttttccaagaaggagggaatgatgagaatcatgaacctggccaaatacaggctaaaggcccaagtggagaaggacgaaggctcaagtggagaaggacaaagccccgagtggagaaggacttatcaaggtaatccttgtggcgtctacccagacttatcttccttcatcggaagtggcgtctaccctgacttatcttccttcactggaagtggcgtcaaccaaaaactctacagcttgtatcaagcgatccgtgccccgtaa

SEQ ID NO: 68138 - DNA, 306 bp, Glycine max
  Peptide Sequence Number=SeqID_159823
atgtcccaatatcacatcctatcagagcattgtgttccaacatcctcaagcatgaggttctccatagctatccacctaaccatctacttccacgaacacaaagttcgagatcatcacacgatccaaacacaaatagcacacagggatgaaaaacctcatcgggcacccaggagtacaaggcaagacagaccacacactgggagaccagtcagggtcacactgttttgtgagaatgctccaactatttggggtcaacataagcttaaaggaacactcaaacagggtatatttactcccaaggcctag

SEQ ID NO: 68139 - DNA, 381 bp, Glycine max
  Peptide Sequence Number=SeqID_159824
atggctcaacctccacctcgtgagaggactcttagggagatggctgcacctgatttaacttatgaaagcttgtgcattcaatatcctgatgagggtgttccatgcaacatggagaggagtatgattgatgctgccaggggtggagcccttggtgttatgactcctattgaggctaggaatttgattgagaagatggcttccaactctcaacaattcagtaatgctgctggtccaagcaagccatatgttcctcctccaatgaagcaacagcagcaacaacaacaaagacaacaagcaattgaggcccctcctcaaacttccttagaagagttagtgaggcaaatgaccatccagaatatgcaatttcagcaagagacatga

SEQ ID NO: 68140 - DNA, 1737 bp, Glycine max
  Peptide Sequence Number=SeqID_159825
atgcagcaaaccgcagaggccctgcgcgattttaccgcccgttatgtagcgcactggcagcagcagcacggccattttcccgccagcgcagagctgtacggcgtgccgtcgccctgcatcattagtgaactggatgagcgcgttctgtggcagccgcaggactttaccctgccagcctcgctggcagccgttgagcgcgcactggatattcagctgcagccggacctcaccacgttctataccacacaatttgccggcgacatgcacgcgcagtttgcacagcagtcgctgacgctgctgcaggtgtggagcgaggacgattttacccgcctgcaggagaacctgattggtcatctggtgatgaagcgccgtctgaaacagagcccgacgctgtttatcgccacgacagattcggagcaggatgttatcgcggtgtgtaatctgaccggagaggtaattgtggagcagccggacttttctcgcagctcttgtaagagatctctcacaactggtgtgcgagatcgccagaacattgcgcagacttccggaagtccgcaattcaccactggcaggaagccacggattgagagacgttcaggaaaatgtcagccaggcggcaggaacgtaacggagtttacgtcacagggaaggcttcaggatgaagcaggacactccggagcgacggaaagcgcaggaacagttgtcatggatgagcagggagcacagcggtggcgggaatgctgcaaacgaaccgggagcactgtcgaagcggtgatgcgcgaacacggccactggcagacgcacgccccggcggcggaagcctttaatagcacgcaacctttctgtctcgataccctgcagccgctcgaatggctgcagtgggtcctgctgccgcgcatgcaggcgctgcttgacgccggcgccgcgctgccgcaaaacttcgccgttacgccttattatgagatggccctgccgcccaccacgccgtgccatgcagcgctgctgctgacgctcagccagcttgatgcgctctggcttgatcgcaaagagaaagtggtggtgatgcagacggtgcgcgatcagattggtcagcacgtatttaccgcgcatcgcctcgatcgtcccacgtctggcgtgctgctgatggggctctccagcgaaatcgggcggctgctggcgcagcagtttgaacagcatcagatacagaagacctatcacgcagtggtgcgcggctggctggacggtagcgcaacgctggattatccgctggtggaagagctggataaaattgcggacaagtttgtcacggaaccgcgcgcgccgcagccggcggtcaccgattatcgcgcgctggcgcaggcggaactgccggtggctatcggcaagtaccccagcgcacgttatacgctggttgagctgtcgccgcacaccgggcgcaagcatcagctgcgacgccatatggcgcacctgcgtcatccgattattggtgacagctcgcacggcgatctgcggcagaaccgcggtgccgcagcccactttggcatggatcgactgatgctgcacgccagtgcgctgacgctaacgcatccggtgaccggcgaaccgctggtgattcgcgccgggctggatcgtgtctggcagcagatgctgcaatcgtttggctggcagcagcaactgcccgaggtgccgagggttgagtttgccgctgaggcagtccaggataagccgacagaataa

SEQ ID NO: 68141 - DNA, 2298 bp, Glycine max
  Peptide Sequence Number=SeqID_159826
ttcgagaatcccgccgatgtcgttgatgttggcgcggcgaatctgctcggccgattccatgacaatctgcgtaccgataccgtcacgcgagaacagttcctgcagcagtgcgccatcttcctgatagctaatcagatggctgcggcgcacgccgctgcggcaggctttgaccgcgccacgcaggaacgcacgctcggaaatgatggtgccttcgcggtcggttacgccctgttcggagcagaaaccgatcatcttctcggctttcagcttaatcgccagctgcgtcgccacctcttccgaggtcaggttaaagctttcgccggtcaccgagaccgctactggacccagcagcacaatggcattgttatccagctgacgatggatcgcctcttcgtcaatccggcggatgcggccgctgtggcagtaatcgacgccgtcatccacgcccagcggctgagcgatgatgaagttaccgctcactacattaatatgcgcgccctgcagcggcgtattattcaggctcatcgacagacgcgccgtaatatcgagcttcacgcgggtgtgtttgtgataaatcggctccagctgctgctgcgcgaggctggcatcgatctgcggccgcgcgccataaaccaccaccaggcgaatgccgagactatgcaacaggccgatatcgttaacgatgctggagaagttctcatgctcgatggcctcgccacccagcatgatgacaaacgtcttgtcacggtgggcattaatatagggaacggtatggcgaaaaccctgaaccagttcggtgcgctgtggttgctgagcgtgacgcgcagcggttttgcggccagtcagcacattgtggccgtgcgcatctggccatcctcgacttactcgcgcgtgacgctggaatccaacgtcgcgctgcactataagcagttcacgctgagcaatcccgaacggctggtgatcgatatccagaacctgcatatcaacagcgcgctgaaaggcatcgataagctggtgcgggtggacgatccctacattaaaaccgcgcgcgtcggtcagttcgatcccaccacggtgcgcgtggtgctggagctgaagcgcagcgtggcaccgaaaaccttcaccctcgatccggtcgccggtattcgccaccggctggtggtcgatctctatcccagccagtcgtcacaggaagaggatccgctgctggcgttactgaaggattacaaccagggtgaactggagcgcgatcaaccggcgcaggcgccgctaccgggtaaagccgggcgcgatcgaccgattattatcatgatcgatcccggtcacggcggggaagatcccggggcgcacggcaagtacaaaacgcgcgagaaagatatcgtgctgaagattggacgctatctgaaagcgctgatcgacaaagaacgtaatatgaaagcttacatgacgcgcaacgaagatgtgtttataccgctgcgcgtacgggtcgcgaaagcgcgtaagcagcgcgccgatctgtttgtctcaattcacgccgacgcctttaccagccgggcggcgcgcggctcttcggtcttcgcgctctccaccagcggcgcaacctcagccgctgcgcgcttcctcgcccagacgcagaacgaagcggatttgatcggcggggtcagcatgagcggcgatcgctatctcgaccacaccatgttcgatatggtgcagcggcagaccatcagcgacagtctgaagtttggcaaagaagtgctgacgcgcatgggccacattaaccacctgcataaacgcacggtggatcaggccggctttgcggtgctgaaagcgccggatattccgtcgattctggtggaaacggcgtttatcagtaacgtcgaagaggagcggaagctgcgtaccccgcgctatcagcatcagggcggcagcgatgccgctttttaccgggcgcagaaacaaaaaaacacccgtcagggtgttgtgatgttcttccgcagaagaagtggttgcgggggccggattcgaaccgacgaccttcgggttatgagcccgacgagctaccaggctgctccaccccgccccgacgagctaccaggctgctccaccccgcgtccgtctgtcgcgctaagcgacttgccacattgtctcttcatcacgaagaattggttgcgggggccggatttgaaccgacgaccttcgggttatgagcccgacgagctaccaggctgctccaccccgcgtccgtggatgcgcactatacaccgggtgtatgatgatgcaaccccttttttgcgttaa

SEQ ID NO: 68142 - DNA, 201 bp, Glycine max
  Peptide Sequence Number=SeqID_159827
gccaagggcatattgtggcactgtcacaattcaccgtgtggtgggcattatggcggaagcaaaacagcagccaaggcccttttccttcatcggcagggaatgagtatattctggtggttgttgatgatgtatctaaatgggtggaagctatggccactgcaaggaatgatgctaaaactgtggtgattttctcgatttggg

SEQ ID NO: 68143 - DNA, 171 bp, Glycine max
  Peptide Sequence Number=SeqID_159828
atgaggccaagtcatgaagtgctaaaagtgacagttgagcttagctcatcaaagaatcttgatgcaatcctccctaggaaggcaccagtcactagagccatgagcaagaggctccaagaggattgggctagagctactgaagaaggccctagggttctcatgaacctcagg

SEQ ID NO: 68144 - DNA, 438 bp, Glycine max
  Peptide Sequence Number=SeqID_159829
atgtttgcacattcgattaaaggctgtcgtcccttgggacggacgtgtggggtgctaataccttccccgtgcgtaaatacaactcccgaacctttcaacttaaaagttcgtagatcgcgtcttttcctgtttttccgacgttttcctcaaataaacgttggtggcgactccgcgcgtattcctttcgtggaatacgcatcccgcgagtcacgcgtcgccctcccgccgaagggtaggtttgtcatcatcaaaaagggggagattgtggaagcaaagcttttcaagtttattttgatgatgccaaagactcaagtcaagaatcaagagtcaaacaagtttcaagaatcaaagagtcgttcaatcaagaatcaagattcaagtgaagattcaagagaagacttaagatatgcaagaacttcaagaaaagcatcaagataa

SEQ ID NO: 68145 - DNA, 282 bp, Glycine max
  Peptide Sequence Number=SeqID_159830
atggaggagaaagtaaagctgaaaattagtggaggtttaaggagcacctacttgaagctcttgtgctctgataccacttgttggaagcttgcttatgaagcttctatggaggctggatctttgagcttcaataaggagaagcttcaccaccaagagagtggcttggataagaagcttaaagaggaagcttcaatggaggaagagaataccagagagagggggaggggggggggggcgaggtgtgggaattggaggagattagagagagaagttgaactttga

SEQ ID NO: 68146 - DNA, 231 bp, Glycine max
  Peptide Sequence Number=SeqID_159831
atgcagccaatacttctatccgtgggaggactgccttcgatagcggaaggaaaagaaaaactcgatctcattgaagagagattgagagccgtcgaaggattcagtgattatccttttatggacatgactgacctgtgcctggtgcctgacgtcatcattccctcgaagtttaaacggtcatctggtatactaaccttgaagcttcccgtatccacacttggaaggatctga

SEQ ID NO: 68147 - DNA, 603 bp, Glycine max
  Peptide Sequence Number=SeqID_159832
atggctgaatcaatgaaaaagagaaagggctcttcctccacctccaccgctgctagccatcaccgccacgaaccatttgaagcacccacagcaccagttcctccttcctttcaaggtgttccttttgagggcactattattgatgactggaagtttgattattctagtcatgatgctcgccgtatggtctgtaatgaccaggctgatatgaccggcagattgcttgctgggtcattaacctttgattgtcgcatcatgcactacatcattgttcgcattttgttaccccatttgtctaatcttgctcaagcctctgaggaggacttgattctcatgtgggcttttcttaccgatcgtcagatcgattgggcccacttggttaggtattacttgcctccacctattcctgatgaacgtgccccatctcctccaccaccaagggttgattcctcttctcttttgaccaaagtcctcatagaactttgtgctcttcgagcttttgtaggtgaacgatttgatgcgatggatacttgccttgatgcaatggatgcacgctttgatgggatggttacacgaggatcactagtctcaaagatgatatga

SEQ ID NO: 68148 - DNA, 563 bp, Glycine max
  Peptide Sequence Number=SeqID_159833
cacccgcgacgtgttgactttgactgacttaaacatggctgatgtggttgatcaagacagtaacatagtgtttttccatggtgtgtcacagtatgtcacagacggtgagaccttggtgtccaacagtggagtttttgagcttggttttttcagcccgggaaaatccacaaagcgttacctggggatttggtataaaaatattactagtgatagagctgtttgggttgcaaaccgggaaaaccctatcaatgattcctcaggcatcttaacattcagcaccacaggcaatcttgagctcagacaaaatgactccgttgtttggtctactaactataaaaaacaagcacagaatccagtagcagagctcttagacactggaaattttgtggtaagaaatgagggagacacagatccagaaacgtactcgtggcaaagctttgactatccttcagatacacttttgcccggaatgaagttgggatgggacctcagaaccggtctggaacgcaaactaacgtcttggaagagtcctgatgatccatctgctggagatttctcttggg

SEQ ID NO: 68149 - DNA, 279 bp, Glycine max
  Peptide Sequence Number=SeqID_159834
atgccacccaccaggcaccctctggacccggataagtctaacagggccctggggttttcggcgttgatcacgggcctctgccagtcattcggggttcccgtcaaccccagtaaggtgatccgacttccgatcactcgggccttcatcgagaagtactgcacacctaggcaggcacagggtgatgcacatcaggctgcagacgctccgccaccacctcatcaggccgatcccgctggatcactaggcatggagcgttatctacagcatttggttcgctag

SEQ ID NO: 68150 - DNA, 338 bp, Glycine max
  Peptide Sequence Number=SeqID_159835
tcaacactcaggagcgcaggttgcttgagcaaacagacaaatggcttacactcacattccggtggaagttgaataagcaaagatgtgttcgtgagaggatgtccattttatccatatcatttagcattgtaactgtggattcaacaagcgattctcctcaaatttcagccagcccgtatcaattagacttcacactttatgcttcggggtcatacaatgctcaatggaatgccctggggctcctccatgataagcacacgttgcgttcgagtcgtatcctcagaaaaatggaggtggtcttcgtcattggaagtgcggtagacaggctttgtggttga

SEQ ID NO: 68151 - DNA, 189 bp, Glycine max
  Peptide Sequence Number=SeqID_159836
atgcggggttaccatatggttacccgcaccttttgtcaatcaggggcaaacgtgcccgatgacgcaaggagagtaacatcgtcttctgcaccttttgtcgtcctgacccgtgatgtcaggagcaaacgagcccgctggcgcgcggagacttacatcatcttctgcaccttttgtcgtcctgacccgtga

SEQ ID NO: 68152 - DNA, 634 bp, Glycine max
  Peptide Sequence Number=SeqID_159837
ttatccagaactacgtaggtctgagttcctcattggaggatacgtaggagcaagagcctcgcttttgtcgaccgcaccaccttttgttaccatgacccaagagctggtagcctgcggagacaccttacggttatccgcacctcgtcattcagtgaccccaagtgtgattgacgagcagaggccaatgtggtctgagttcctcattggaggatacgtaggagcaagagcctcgcttttgtcggccaccttcacaagttctgtcatgctgacacaggagtcacgtgacatgcggagatacccaagtgaggcggcgagcccgatgacatgcggagacaacttatggtcattccgcacaccttctgccattcagacacagtcgtgtccgatggcacgcagagacaaattatggtcattctgcacccttttgtcatccagaggcggcgggcccgatgacatgcggagacaaattatggtcattccgcacaccttctgccattcagacacagtcgtgttcgatggcacgcagagacaaattatgtcgtgtccgattgcacgcagagacaaattatggtcattctgcacccttttgtcatccagaggcggcgagcccgatgacatgcggagacaacttatg

SEQ ID NO: 68153 - DNA, 583 bp, Glycine max
  Peptide Sequence Number=SeqID_159838
gactacacgtcctcctcttcagaagactacacgtcctccccttcagaggactacacatccttaccttcaaaggactacatgtcctcacctttataggactacatgtcctcgccttcagaggactacacgtcctcgccttcagagggctgcatgccctcaccatctgagggctgcatgccctcaccttcagaggactacacggatgcaccccgtctccttcagaggactatacgtcctcgccttcagagggctgcacgcccacgccttcagagtactacacgtccttgccttcagaggactacacgtcctcaccttcagaggacttcacttcgtcgccttcagagggatacacgccctcgtctttagaggactacacattctcgccttcagagggctagacgccctcgcctttagaggactacacgtcctccccttccaaggactacacgtcctccccttcagaggactacatgtcctcacctttagaggactacacgtcctcaccttcaaaggactacacatcctcgccttcagagggctgcacgccctcccctctcagggctgcatgccctctccttcatag

SEQ ID NO: 68154 - DNA, 466 bp, Glycine max
  Peptide Sequence Number=SeqID_159839
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgttttctccctggcggctccctcgtgcgctctcctgttcctgcctttcgggttaccggtgtcattccgctgtatgggcgcgtttgtctcattccacgcctgacactcagttccgg

SEQ ID NO: 68155 - DNA, 910 bp, Glycine max
  Peptide Sequence Number=SeqID_159840
gctccgtggttgtttccggcaacctgccgtctaaagatggtaagtacagcctgtactgtgcggttatcgtgaagaaagtggacgcgaaaacccgcggttatgttgagatcaagggtaccgctatgtacgataatctgaaaagtctgggcattaccaatcctgatgaaattgatcgttacagccttcgccaggaagccaacaacgacattttaaaaatctattttcacaaggacaaaggagagtttttcgccaagagcgtgaagtttaaatatccacgccagcgtaagaccgtcgtcgcagacggtgtaggacagggatacaaagaggttcaggaaatcagccccaacctgcgttatgtgatcgatgaactcgatcagatctgccagcgcgaccgtaccgaagtcgatctcaagcgtaagatccttgacgatctgcgtcaccttgaaagcgttgtgactaataagatcagcgagattgaagcggatcttgagaaattaacgcggagagggagaaaagcattacgcggtcagcttcaccgcttcgctggaaaagttatccgcgggttcgaacttcagctccagagaggccagcagtgcgctcgctttgtcatggaactctttgagggtatattccaggcgatcaatcacttcctgatcgttgatggtggtggcctgccagttgccgtctttattaaacaggccaaactggtagctataggtaaaacgtttctcctcagcttccatttccatccaccagccccagaattcacgtttttcgggtgcaggcttcacgttgacgcaaacagccaggcagtcgaaaaaaaagcgattctcttcacactgctcttctcgaatatacgggccgagagccataaatttcttaatcagcctacttttcgggtgtccactcg

SEQ ID NO: 68156 - DNA, 408 bp, Glycine max
  Peptide Sequence Number=SeqID_159841
atggcagccgctaccaacacaactagggaagcggaaccggtgctacagcctgcaatgaactctagccgggacagaagcacgacaggtttcaattggagacttcactccccgtaccgctacagacaatttgagctaagcccctaccttcaaggggcaactccctcctcatgccgactaccctctagaggaagacgacgagggagatgcccatttgggccctttacttcccccaagggagccgacacccatgagttgccctggccaaacataatccaccatgccccgtctcaatccgcacccgttagggaacccgttcccatttcaaaagacaaaggaaagatcaatctgcttgaagagaggttgagagcggtggaagacctcggcaactatcctttctcggagcagtag

SEQ ID NO: 68157 - DNA, 183 bp, Glycine max
  Peptide Sequence Number=SeqID_159842
atggaaaatgcaaaagggaccacaccgaaagcaacaacaaccaaccaaaacgaaagaaacaaagcacagaaggaagaaagcgcagtaaaaagaagcgtgaacggatgtccgattcaggcacataatataccgagaagctcaaaattaaacatggaagcaaaaggcaaattcaaatggccataa

SEQ ID NO: 68158 - DNA, 483 bp, Glycine max
  Peptide Sequence Number=SeqID_159843
atggctcacaaattctattttgaagcacttgatcaaagtcaaagagatgttattaaggcgaaatcaagttctgataaaatctttgatggtaaagttatggtatttggtggagatttccggcagattctgtcaatcattcctaggggtagccggtctgacattgttaatgcaactataaattcatcttatctatggaattattgccatgttttgacactatcgaaaaacatgcgtttagaagtcaatatagatgcaacagacaaagaagaaactttagcttttgcacagtggatccttgatattggtgatgggattgttggtgaacaaatggaatatctaagtgctgattatgtggacaaatcagaaacactagagagttctcatttccgatcactcacaacagaatttcttaattcattaacaacatccggtctaccaatcatagcatcaaaatcaaaattggatcacctatcatgttgttaa

SEQ ID NO: 68159 - DNA, 438 bp, Glycine max
  Peptide Sequence Number=SeqID_159844
atgtcacggaactttacggattgtgctacaatgccttctttgacttccggcatgtcacgaaacttcacgaattgcctaacgatgggtgccaagtacctcgaagtggtcaaacgagggttgcatcccaataacggatggtccccagacgaaattagggttaaggaggagcctcagttgcttgttgtctttgttgtggctgttgctgttgttgctgcattggaggaggaacatatggcttgcttcgaccagcagcattatgaaaaggagggacaaacttttgttgttgtggaggacttgtccatctcaaatttggatgattcctccaacctagattgtatctattgcttgaaaggtcataattattctgttgttgttggttttgcaactgagggagtctattataaatgtttgcagcataagcttcaagtcactcattga

SEQ ID NO: 68160 - DNA, 591 bp, Glycine max
  Peptide Sequence Number=SeqID_159845
atgagatttaaatcaaattgggctttctattattttggaaattgttcatacctcacaaacgggacttcatcttctcagcaatgtggtcccttggttagtggctttcttcacaaacatgacttcatcttcatctttgttcacgtgtacatgttgtggcattcctcttgtttagtggtccttgttatcttcgaaaacaagataggaggcatgagtttcaaattaaaattgcatcacggtggtttctttcaaagagaccatgtgatgcaatatgttgggactagcaattatgtaagtgtcattgatatagatgttgacaagtggtcattctttgaagcaattgggattttaaaagaagactttggatatggtgatcaaccaataaggctatggtggaaaggtggtgatggtgattataaggagatgaccatagacaatcatgcattggagttgtctaattatgcgattgctaacaattgtgaggtggagttgtttgtgaaatgtgctagtggtaatgaggggattgtggatgacaatttttctgctcccatgaacacaaggtttgagatcattacaggatccaaacacaaatag

SEQ ID NO: 68161 - DNA, 156 bp, Glycine max
  Peptide Sequence Number=SeqID_159846
atggatgatagttttgttggtgaaaggaggttgttgtatgaaaatgttggatcattgaggtccaggttgttgtacggtaatggttgtggagacgaagacggtagttgtggttgtggagacggaaggtgtggatgtggaggcggtggttgtgcttga

SEQ ID NO: 68162 - DNA, 450 bp, Glycine max
  Peptide Sequence Number=SeqID_159847
atggcgaaaagggcaggtgccagtgtgaagttgacatggttggcagacttgtatcattggcatggtgagtcagggttgtgtgtttgggttgacacaacttatttgttgcacttgattgacaatacgatatttgccaacaagtcttcgactcacatccatgtcacctacctcatgtacatcgacaacctggatgcttgccacgagtatgcatggggagtagttgcactgacatacctctacgatcatctctcctatggaagccaatacaccagcaaacaatgtggaggttacatgacgttactcatggttttccacccttataccattccgtcgaaggatggaccaccaccacgtggttctatggcatcagaagctatgcagagcttgttggacctcagagttgtgccaaagggcacgagtcatcatcaactcatacatcaagctttgtaa

SEQ ID NO: 68163 - DNA, 939 bp, Glycine max
  Peptide Sequence Number=SeqID_159848
atgtcgaccttcggagccgccgcgaatacgaatcccaacaaatcctacgaggtagcccaaccaccctctgattcaatttcgagtatttgtttcagtcccaaagccaatttcctcgtcgctacttcatgggacaaccaggttcggtgttgggagataacaaggaatgggactgttgtcaacagcactcccaaggcttccatttctcacgaccaaccggttttgtgctccgcttggaaggacgatggaacgacagttttttctgggggctgtgacaagcaggtcaagatgtggcctcttatgtctggtgggcagccaatgactgttgcgatgcacgatgctccagtgaaagacattgcatggataccagaaatgaatcttttagccacgggaagttgggacaagaccctgaagtattgggatactcggcagtcaaatccagtgcatactcaacaacttcctgatcgttgttatgcaataacagtgaaacatcctctgatggtagtgggaactgctgatagaaatctgattgtcttcaacctgcaaaatcctcagactgaatacaagagaatcgtatctcccctgaaatatcagaccagatctgttgctgcttttccagatcaacaaggttttttggtacatcacacttttgcaactgctggatctgatggtgcttttaatttctgggataaggacagtaaacagagactcaaggctatgcaaaggtgtagtcagcccataccttgcagtacatttaataatgatggctccatatttgcttatgcggtttgttatgattggagcaaaggtgcagaaaatcacaatccagctacagcaaagaactacatatatttgcacttaccacaggagtctgaggttaaaggcaagccacgagctggagcaacagattttgaaactggaatcaaaagatcggtcatttaa

SEQ ID NO: 68164 - DNA, 615 bp, Glycine max
  Peptide Sequence Number=SeqID_159849
atgaaaaattcttggtggggacaagagttacacccttacaatcaatatgaagaagaaagaactcctactcttgaaagtgtgttcacggaattcacggcataccatgctacctctacaaccaatcaaaactcaatgcaaaaccatgaaattcaggttggcaagagctactccatggaaaattatcagtgggagcaagagttacaaccctacaatcaatatgaagaagaaaaaaattctaatctggataatttgctgatgcaattcaaggaagtcactgaatctactcaacaagcatttaaaagtctagaaattcaagttgaaaaagatgaagagaaaagtgaggagaaagcacaacaatgggagaagtactcacaagtagaaattcaacaagaaagtattctccaagtcaataaccctcctcatcaactgattgtcaaggaaaaaaggcatggagaacatgcaaaagccttaagtgtcattctttccttgatcactagcacttctcttgcaatgatgtggaaggttcttccaaaatacatgagtatcatggcatctctagctaagaggcgaaaatgcaaggaagatgtattctttgtgaccttcatgtcaccttga

SEQ ID NO: 68165 - DNA, 339 bp, Glycine max
  Peptide Sequence Number=SeqID_159850
atggatgaagatacaccaagagaagttggtgtctgtgatgataatggaggttggcggttaaatagattttctcaatacctgcctgatgatattaatttgaaggtaatgcgaatgacctctccggactccaattccgagggggagcaaaccagtgatggtttattctctgtgaaaacggcctatgaggtggtggttaatccattaccgtcccataatcataggctgtttagttgcctacagcaatggagaggcacagagagaataaggatgttcctatggaaaatctgccatgaatcaatcttaactaatgtgaggaggatgaggatgtatgggtattag

SEQ ID NO: 68166 - DNA, 2307 bp, Glycine max
  Peptide Sequence Number=SeqID_159851
atgtctcggaaactcgacagccctgtgcagactcagatggctgtggcagtgataaggagcagtccacttgggagagagtaccacgggaagcaacccgcgggtcggaggcgcgtgttcgtgcagacggagaaagggtgtgtgttgggtatggatttggatcgtggtgacaatgtgcacactgttaagaggaggctgcagcttgccctcaatgttccggttgatgagagttatctcacttttggggatatggtcttcaagaatgaccttagtgctgttcggaacgataccccccttttgctcactagggggaagaatactcatatgcctaggagttcctccaccccatgtctatcgccaaaggggagggacattgataaaagtgggcctattgagatattgggacagtcgaatcggcttgatgggatcaagcacatgatcaaggacattatgaaggcgattaagatggggattgaaccgattccggtgcatagtgggcttggaggtgcttactatttcagaaacagtaagggggatagtgttgcaattgtgaagccaaccgatgaggagccttttgccccgaataacccgaaaggttttgttggcaaggcgcttgggcagcctgggctgaagcgatctgttcgggtcggggagaccggatttagagaggttgctgcttatcttcttgattatgatcattttgctaatgtgcctcctactgcgttggtgaagattacccactcggtgttcaatgtgaatgatggtgtcaatgggaacaatttatggaggaaaaggctgtttagcaagattgcgtctttccagcagtttatccctcatgattttgatgccagtgatcatgggacatcgagcttccctgttgcttctgtgcatcgtatagggattttggacattaggattcttaacacggataggcatgctgggaacttgttggttaggaaacttgatggcatcgggagttttggtcaggtggagttgattcccattgatcacgggctctgcctgcctgaaactttggaggatccatattttgagtggattcattggccacaggcttccattccattctcggaggatgagcttgcctatattgaagatcttgacccttatcatgattgtgagatgctgagaagggaactgccgatgatccgagaggcatgtctcagagtcttggtgctgtgcactattttcctcaaggaggctgcggcttatggcctttgccttgctgaaattggagagatgatgactagggagttccgcaggggtgaggaggagcccagtgaacttgaggttgtttgtttggaggcaaggaagatagtggtggaaagagacagggaggaactgtctcccaggtctgagatgagagatgatgagtttctgtttgatatagattattatgatgaatttggatcagattttacgccaaagatggcaatagatgaccctttaaccagagcaacttttctgcctgcacttgggaatgggcagtctcgtaacccgctttccaaattggatgaatgcattgaggaggaagaggaggaagaggaggaagctgagggagaatctcctcaggggtttgttacttctgctgctgaagaaaaaatcccaagtgtttcagaactttctgtgtctctgaaaaataccatgttagatgggaaaaaccagaatcagcagaaatattcaggaggaaaggtggagaatggtcattttgcaaatacatcatctggtcacaagagtgccaatgagcagcttcctccaagcataagctttgtggatgtgacagaaatgaccgaggatgaatggccattgtttctggagaagtttcaagagctgctgtatccggcatttgccaagaggaaatccataaccttaggtcagaggcagagacagaggcttgctacaattgcgacaccagtacttaaaaaccttgatgttgtgactgaaattgcagggactcgccaatggagatggcgagttggacacgtggcggcacctggtggactcgccagtggagttggcgagttgctgtccacgcggcgggtcccgtcattcgtactggcgaaatgtttttttacggaatttttttttaacttcaaacggtacgaatggcgggacccgccacgtggacagcaactcgccaactccattggcgagtccaccaggtgtcaccacgtgtccaactcgctatctccattggcgagtcccctccagaaacagacctccctaggaaaaagtttcaaaacaaccccctccctaggaaaaagtttcaaaacaacccccttttgggaataa

SEQ ID NO: 68167 - DNA, 218 bp, Glycine max
  Peptide Sequence Number=SeqID_159852
ctccgcttgatctcgaggacagtttgaattgcagaagcaagatggtcaataagggcgagaataatagctcgttatgctctacagttaaatctttatttgtgtccatttttggtggaaacgtgaagacgggtaaaagtgcagcacctggtggacctgtggccaccatggttgctgcgtcaaagcatttctcctcacctcacaaggtgcggtttggttga

SEQ ID NO: 68168 - DNA, 1482 bp, Glycine max
  Peptide Sequence Number=SeqID_159853
atgagatatgaaacactaatcaatttggtcattggaggggtcaaggatgagaaattcaaagggttgataaatgatggcataaagggtgatcacaaactcagatttcttatgcttgctcgtaggagatcatcatttttgaagctttggacacttcgagttgcatttgttatgctgctttggaccattgtagtgcaattcaaaggccttggtgacatggtaacaccatccatgttcaagactcgttcttctgcctcctctctaccacctcaaaggatttacgagaataataatgggtatctaatagtttcttccaatggaggattgaatcaaatgcgagctggaatatgtgacatggttaccattgcaagatatttaaatgttacactaatagttcctgagctggataatacctccttttggaatgatcacagccaattcaaagatatattcgatgtggattatttcatcaattcaatgagagatgaggttcggatcctgaaagagtttcctccccaacaaaagaaggtggaaacagagtccatctattccatgccacccattagttggtcaaatatgacatattactatgatgtgattcttccccggataaaatcatatgggatagtacacttcactaaatcggatgcaagacttgcaaataatggaattcctgaggaagttcagagacttagatgccgagtgaactaccatgctttgagatttgttcctccaattgaacaattggccaagaagattgttaagattcttaaggagagagggcctttcttgtcacttcatctgagatatgaaatggacatgatagctttcactggttgcaatgaaggatgcaacaaggaagagattgatcagttaacaaaaatgagatatgcttatccatggtggaaagagaaagagatagattctgagaagaaaagaaaagatggtagttgccctctgactcctgaggaaactgctctaacactacgtgcattggacattgatcgtaatattcaagtttatattgctgctggggacatatacaaaccagagaaaagaatggcaagtctcagagaagccttcccaaatctggttaagaaggagacattattggaaccctcagagcttgatcctttccggaatcattcaaaccaaatggcagcattggattattacgtgtcaatagaaagtgatatctttgttccctcatacaaagggaacatggcaaaactggttgagggccacagaaggtacttgggattcaagaagacaattcttttaaacagaaaaattctggtgaaactcatagaccagtacaaaaatgggaccataaattggaaccagttctccacttcagtgaaggtagctcattcagaccgtgtagggaacccaagtacaagatcagtggtgcctggaaaacccaaggaagaggattatttctactcaaacccacaagagtgcttgtcaccagttgatggaccttaa

SEQ ID NO: 68169 - DNA, 246 bp, Glycine max
  Peptide Sequence Number=SeqID_159854
atggggggtcactattcaagagaaggaaaaagaagaaaatggggaggaataaggtgggtccatttgatccgaaacgcaacatcgactccgcgaccgctgcgatctggttttggagaaacagcgacagtaggggagggggtggtagtagtggcagtgtggagctggtggaggagttggtcggggactggtgggggtggtttggggggttttggagaagcagcaacagtgacgtcgttttttatttaa

SEQ ID NO: 68170 - DNA, 105 bp, Glycine max
  Peptide Sequence Number=SeqID_159855
atggtggagagtaaggctacgcgaaggagccgtggaggtcgtggtgacgtggtggagcatgaggagagaataaaggttaaagtatttgcaagttatgcgaggtga

SEQ ID NO: 68171 - DNA, 363 bp, Glycine max
  Peptide Sequence Number=SeqID_159856
atgattaaaaattataggactgttatatataactgttattataactctgtcgtcctcatctgccacctcccatccaccgccagtttactggaggctctagatgttgatgttatgcacgaaggggtgcagaacctggtgataccaatacaaaaccagtttgaatctgtgaactccaacaacgtgcaccacaatgacaacaccacctactgttggctaactcaagaggacgtgttccgctacctcctcaactcaattggtgtgttttccccaacatcggggaaccccatcaacaccttaggcgtcattgacacacaaaaccttttgaagagagagaaagaaagagaatcacaagaaagagagtaa

SEQ ID NO: 68172 - DNA, 1083 bp, Glycine max
  Peptide Sequence Number=SeqID_159857
atggcttttaatacccgtggagtttcaattataaggaagctcctcgtctcagcggcgacgctaccaccactggcctcggcagcggcgccacaatgcgagttgaagtatgagggagggtgtcgcgacaaggcggaggcgctcaagttgaaaatcgtggccatattctgcatactggtgaccagtatgattggcatttcgctcccgttgttctcccgcgcagttccttcactgcaccctgaccgcgacgtgttcgtcctcgtcaaggctttcgcttcgggcgtgatactctctaccggttacatgcacgtgatgccggactccttcgatgacctcacatcgatgtgcttgccggaaagaccctggcggaagtatccgttcactactttcatcgccatgctcgccgcggtcttcactctcatggttgattccttctccattaattacttcaggaagaagcttactacttctaccgctgaatccaccacagcttcttcccttgaagccggcgagaacaaggaaggagacatgttcggtcatggacattgtcatggccatgtaaatggacatcgtggagatgggatgagcgtgaatggggaacagttgctgcgttaccgtgttgtggctcaggtgttggagatggggattgtggtgcactcggtggtgattggtttgtcattgggagcttcgttgaacccgtgcacgattaggcctctcattgctgcgctctgctttcatcaattgtttgaaggaatgggcttaggtggatgcatacttcaggctgaatatggaatgaaggtgaaggctataatggtcttcttcttctcggcaacgacgccgtttgggatcgcgttggggatcggattatcgaacgtgtatagcgacgcgagtccaactgcgcttattgtggaagggattctgaacgctgtttcggcggggcttttgaattatatggcacttgttgagttgttgggcgctgatttcatggggcccaagttacaaggcagaacaaatgtcatggcttgggcttttgtggcagttttgcttggggcagggggcatgtcagtgatggcaatatgggcgtag

SEQ ID NO: 68173 - DNA, 599 bp, Glycine max
  Peptide Sequence Number=SeqID_159858
tatcccaagaatatccctgcatcactcttgggatccatctttctcctttgctctctatctgccaaaatgtaacatggacttccaaagatgtggaagtgcttgacagttggcttcctccctttccagatttcatacagtgtggttggagtccctcttctaagtgtgactctgttgtggatgtagcatgctgtgttcatggcttcagcccagagattatagggaagttctttggcatgaagcatgaccctagcagcctcttgcaaagtcctgtttttcctttcaactatgccattttgttgtggtgtaatggctgcagagaactcatgaatgatgccttcagatgtgcagtattcagtaaacttgctgttttcaaactctctgccatggtcactcctgattctcttgatgacacagtctttttctctttgaagcctaggatcttagactcaactccatgggagcttgtaggcctaggatcttcttcatcaatggattcctttgcttcttggaagataaatggcagcggaatggggaaggaagagagagaggagacgccacttcaaggagaagatgagtctagaagaagctcaccaccatag

SEQ ID NO: 68174 - DNA, 795 bp, Glycine max
  Peptide Sequence Number=SeqID_159859
atggctatctctattaagacccctgaagaaattgaaaagatgcgcgtcgccggtcgtctggccgcggaagtgctggaaatgatcgagccgttcgtgaagccgggcgtcagcaccggtgagctggaccgcatctgtaatgactatatcgtgaacgagcagcacgcggtttccgcctgcctcggctaccacggtttcccgaaatccgtctgcatctccattaatgaagtggtgtgccacggtatcccggacgacgaaaaactgctgaaagatggcgacatcgtcaacatcgacgtcaccgttatcaaagatgactaccacggtgacacttcaaaaatgttcatcgtgggcaagccaacgattcttggcgagcgtctgtgcaaagtgacgcaagagagcctctacctggcgctgaaaatggtgaaaccgggcattcgcctgcgtaccatcggtgcggcaattcagaaatttgtcgaggcagaaggtttctccgtggtgcgtgaatactgcgggcacggcattggtcgcgtcttccatgaagagccgcaggttctgcattatgatgcggatgacggcggcgtagtgctgcaaaaagggatgacctttaccatcgaaccgatggtcaacgccggtgattaccgcatccgtaccatgaaagacggctggacggtgaaaaccaaagacagaagcttgtctgcacagtacgagcatactattgtggtaacagacaacggctgcgaaattatgacgttgcgcaaggatgacaccatcccggcgatactgacgcacgatgaatga

SEQ ID NO: 68175 - DNA, 597 bp, Glycine max
  Peptide Sequence Number=SeqID_159860
atgaccgatctagacacgggggacttagacaaatgcgagttgtacatcgaagaaaatccttcccacctggttgccctagaaatagtttatgagggatccacagtcgttcacaacatccttttgttgcatggccaagtgaaggttggtgttgaggaggttaaagatgcagatgctcccgttcttgtacccactgacgatgttattttagtggggcaggcacttaacaccttccttgcttggccaacacatctcgtcaagcgtttactagaacaggtagttgtgtctctagcaaaacctacagatgggctggatcctcaggttacttgggatgttaccatgttcggggtgtttaatcaagactttcccttgtacataaagcacgaagatctatctgaaatagcacacgatggtcaatgcctcagcatctctgttatacaattgtggattttaattcaaaacgcgatgtctaccttaggaagtttcaggaataattgggaaacatattttaatgatgttagaccattagaagcagatagattgaaggcacttcgcatccagtgggcacagtattatctcaaagttagaaatcaaacttag

SEQ ID NO: 68176 - DNA, 847 bp, Glycine max
  Peptide Sequence Number=SeqID_159861
gcggttgttgagcgaatttgccgataaagttttagccgaattgaacgccgcgctgcatacggaagcgtcgccggaagctcgccgccaacaggtcgccgagctgcgtgaggcgctgacgggggtcgaaggggccgaagagctgctcaccgatgcggatgcgttagtcgagaaatcagtctggcttatcggcggtgatggctgggcctatgatattggctttggcggtcttgaccatgtgctgagcctgaccgaaaacgtcaatatcctggtgctcgatacgcaatgttactccaataccggtggtcaggcatcaaaggcgacgccgctcggcgcagtcaccaagtttggcgagcacggcaaacgtaaggcgcgcaaagatctcggtgtgagcatgatgatgtacggtcatgtctatgtggcgcagatttcgctcggcgcacagcttaaccagacggtgaaggcgattcaggaggcggaagcctatccgggcccatcgttgattatcgcctatagcccatgcgaggagcacggctacgacctggcgctgagccacgaccagatgcgccagttgacggcaaccggcttctggccgctgtaccgcttcgacccgcgtcgcgccgatgaaggcaagctgccgctggcgctggactcgcgcccgccgtcggatgcgctggcggaaacgctgctcaacgagcaacgcttccgtcgtctgaacgcccagcagccggaagtcgccgagcagttgtggaaggacgcggccgccgacctgcaaaaacgctatgatttcctggcccagctggcagaatgcgctcctttagcatggccgtacttccacccaggaagttaa

SEQ ID NO: 68177 - DNA, 226 bp, Glycine max
  Peptide Sequence Number=SeqID_159862
atggaatgccccggggtattcccatggtacgtgcaagttgcgttaggatcataccactttgggaaaagggggttgctagatcttcccgggagttattacggccatttggttggcgatgagggacggcaagaggtcttcgtacgtcattgggagtggggtgaattctggaattggcttcgagggaaagttcctcattgcgttggaattgttggccgggcgagccgtg

SEQ ID NO: 68178 - DNA, 470 bp, Glycine max
  Peptide Sequence Number=SeqID_159863
atggcatcttcatcgtcatgtccatcaaatattaaaattaagtctggcccgattgatggtgacgtattatggatgcaagctaagcatgtttcagaacatgtttggaatggggaagaagaccgcaaattacacatcagacgagttgtccccacttatcaaggggaagaagaaataccaaagcaaattttttctttccttcgacaatctggtctacgtgtggatggtttaccattaattggtccaacaaatcttaattgggctgatttatgtgaggaattattgggagtcagaccacaagaaggtgaaattaaaggtagtgtggttaaattaagttggttggctcaccattttgcacaaataaataaccacgacgacaaagaacaagtacgaaggtttacccgtgcatggatactaagattcattggaggtgtcttgtttgttgacaaaagcagtaacaaagtttcgctaag

SEQ ID NO: 68179 - DNA, 324 bp, Glycine max
  Peptide Sequence Number=SeqID_159864
atgtcatcatctacatgtcgaagacgacaatgtcttcagtcattgcatgccttcaaaaggcgacaatgtcttcatttgcatttcaaagaagacaatgtcttcacatcaaaaacttcaatatccttttctgatgaggacatgatcaagagcaagggcaaggatccacttgaaggacttggagggcctatgacaagggctggagcaaggaaagccaaggaagctcttcaacaagtgttgtccatactatttgaatacaagcccaagtttcaaggagaaaagtccaaggttgtgagttgtatcatggcccaaatggaggacgactaa

SEQ ID NO: 68180 - DNA, 458 bp, Glycine max
  Peptide Sequence Number=SeqID_159865
ccacaagacacccagtggacccgaagaagtcaacagggctctggggtttccagctctggttacgggcctctatcagtcctacagggtgcccgtcccccccagcaaggtcatgccatcgtgacatagggatcgcgcccgcaagacacccagtggacccagagaattccaacagggtcctggggtttccagctctgattacgggcctctttcagttctacggagtgcccatcgcccccaacaaggtcatcaagccccctactaaccgagctttcattaagaagtactgcgcccccaggcaggcgcagggcgagacaccacagcagtctggggatggccggcagcgagcaacagatgcactgccaccacctttaaagcccctcatctcatctacaaaggctggagcgttgcctacgacccgtggccgactagcaggcgaccaagtccaaagccaaaggtaa

SEQ ID NO: 68181 - DNA, 279 bp, Glycine max
  Peptide Sequence Number=SeqID_159866
atgcctgatagcacgcagagactaacgtcgtcttctgcaccttttgtcattcagggacaacgagtcgggtggtgggcggagataccttatggtcatccgctcctttcgtcgaccgagaggaacgaattcggtagtatcaggatgatgtcgattttttactctcgttgtccagaaacattcaagtccaacgacgcgcggaactcttctctgctgggcagagatgattgggtgcaatggcaaagggaagtgtcgtggttgcctaactttgtcgttttctaa

SEQ ID NO: 68182 - DNA, 270 bp, Glycine max
  Peptide Sequence Number=SeqID_159867
atggtggaggatgcacgaacaacgctaggcaatcaattcctcgggcaccggactcaatggtggaggatacatgtatggcaatcaattcatggggctcagaataagatggtggaggatgcacgaaaagcgctgggcaatcaattcgtggtgctcgaaataagatttgatgatggagggtgcacgaacagcggtaggaaatcaattcgtggggctccagactcaatggtggaggatgcatcaataacaatgaattcatggggctccgaataa

SEQ ID NO: 68183 - DNA, 195 bp, Glycine max
  Peptide Sequence Number=SeqID_159868
atgtgcttgatggcagattcaatggatgactcttcaaccattgaagaaactgaggtgtgcccaatagcaagggactcactatggtacttggatagtggctgctctaggcacatgatgggtgacaaatccaaacttactgactttttgtcaaaggaagaaggatatgtcacttttggagataacaataagggatga

SEQ ID NO: 68184 - DNA, 179 bp, Glycine max
  Peptide Sequence Number=SeqID_159869
atgtctcaagagaggactagtttagaggaatactttctcgaggcatcaactcttaaaagtaaccaaggagtgatggctggacggaatgatcgtgcgatagctaatgctctccaagccttagctcaggctatagggaatccaaataggggagaagttgttggagttgttgagtaccaagg

SEQ ID NO: 68185 - DNA, 159 bp, Glycine max
  Peptide Sequence Number=SeqID_159870
atgggggagtggtggagacagtttaagtctgatttgacatcaaaatgggcatttgtagctgacaaggacagtgttgatggcattgtatgtgaaaagtacgaaattagcaaggagaagtggacccagttttatcaaagtcgcagagacccttcgtgggag

SEQ ID NO: 68186 - DNA, 516 bp, Glycine max
  Peptide Sequence Number=SeqID_159871
atgaccacaatgatggaggccatgatgagcatgaagaagataatggaagccaatgcggttacagttttcgctaccagtgctgttgctaaggcaaagatttggaaagtacgggcggccccccattatgcgcaaattaaaaacaggcatgccttcccaccatatggcttgcctcccaactatacaccacccaatgtggcatacattcccaatgaggatgtcaataactccgctcccatactcattgaaagccaacaacctcaatctgatcatgcacatgtctctcaacccatgggggagacgcatggaatgccccaccacaatctagccgactttgagccttgcctcgaatatgccactgaagggcaagcagttggtggtatactcctgcgaaacactttggagggccctcagtatcacccacaaccacacctcttgcccacaacaggtaaaatccctcctgtaatggaaggaaagggaaaagttggatcatctagaggaaaggctcagggccattga

SEQ ID NO: 68187 - DNA, 168 bp, Glycine max
  Peptide Sequence Number=SeqID_159872
atggagctagtccaagtgatagaggtgacgtcatctgaggaagaccccgaggaggacccgaaggagctacctcctgagcctgctgacgtcatgtcggcatttgaggcagactctacggaggagagcggtcctggagggatagcgactagcagaggttcttcatcatag

SEQ ID NO: 68188 - DNA, 242 bp, Glycine max
  Peptide Sequence Number=SeqID_159873
tgtgcatcctactctccctgaacattttgtgccttttgaacatcctgagcattctgttactagtgagtctgtgcattctgtggttggtgattttgaacatcctgattttgagcattctgattttgcgcattctaaaaatatggctcaacctccacctcgtgagaggactctaagggaaatggctgcacctgatttcacttatgaaagcttatgcattcaataccctgatgaggatgtcccaa

SEQ ID NO: 68189 - DNA, 465 bp, Glycine max
  Peptide Sequence Number=SeqID_159874
atggaatggaatggaatggaatggaatggaatggaatggaatggaatcaacgcgagtgcaggggaatggaatggaatggaatgcaatggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 68190 - DNA, 264 bp, Glycine max
  Peptide Sequence Number=SeqID_159875
atgactaaccgcttgagatatcttttgtttgcccttacaaagattcaaaggactaaccgcctgagaattctttgtcccaacacattgaagggtacatcctttgtgagagggtacatctcttgtggatcagttcaagtggagggtacatccacttggtttttcaaagagaacaaggaagggtacatcccttgtggatctttggcttgtaaaggattttacaaggttgaaagaaatctcaagaaccgcaggttgcttggggactag

SEQ ID NO: 68191 - DNA, 270 bp, Glycine max
  Peptide Sequence Number=SeqID_159876
atgatgagtgtgttgagcggtgcaaccctcttttgtaaaatcactcatgcgcccaacatcttcaagattcgtgtagatagggactcattaggtagtaatcaaggggttcccatgaaaattaagagaataaagatcattcctgagtggcccactccaccaagtgttgatgaaaaaagcccaatagagtttcaagaacctcgggatttgaggtcaaatccttttcaagggagagggaatgatgcaatcctatctcgcaagggcattggatag

SEQ ID NO: 68192 - DNA, 594 bp, Glycine max
  Peptide Sequence Number=SeqID_159877
ggacaagtggatattgaattaaatgaaactggaagacaacaagcagttgctgtggctaatagactatccagggaaccaaagatctctgctatatattcttctgaccttcaacgggcttttgaaacagcacagataattgcagtcaaatgtggagggctagaggttgtcaaggatttggacctaagagaaagacacatgggggatcttcaaggccatccttatcgtgaattagcaacaactaatcccataggttacgaggctttggagtctaagaatgatgatcgagagctccctggtggtggagaaagttttgttcaactgtttgaacgctgcaaatctgcgttgctgaaaattggaagaaaacataaaggggagcgagttgttgttgtcactcatggggcatccatcgaaactctttacaggtgggccaatgcaacaggaaggtataaagggaaaatagacaatgcatccatcgctgtttttcgcttgtacggtgaggataaatggaccttaaatatgaagggtgatgttagccatctgtgccataatggatttctgcaacctggttttgagggtgacacaactactacttag

SEQ ID NO: 68193 - DNA, 342 bp, Glycine max
  Peptide Sequence Number=SeqID_159878
atggttagtagtgtacaggttgacttaagtgatgtaaacatcaaagtgctcatttgggtcactgacaccatcgtacttctcgatagtcaagggtatgtgtcctgccgaacactaacattggtggcctttgacatctcaaaggtcgtcaagaccgactaccctcttgtagttgtgcattctcctagcgaagggtcattacctcttcagcgtgatgccgatgcatatccactacttgcactgataatctcttcaccattggggataggtcaatttggtcctccacgtgcgattcttcatgctgatgattcccaggttgttatgttgcagctgtgtttgttctag

SEQ ID NO: 68194 - DNA, 237 bp, Glycine max
  Peptide Sequence Number=SeqID_159879
atggcagatgatccgactcagacccttatggactacctcaatcctactttgggggaaaccaatacgatccaactcaccgatctacctgaggaagtcacatttgaactcgagcatgggacaagcttggatgctgcttatgggggcaacctcatgttaaagacccatgttgatgccatcaaatcattgaagacatgtgctttaacccctacaacaactcaacagataggacgattatga

SEQ ID NO: 68195 - DNA, 171 bp, Glycine max
  Peptide Sequence Number=SeqID_159880
atgtatggcgatggagaaaagaacaagaaagtgaagctacaaactctgagaaggcaatataaactgctttacatggaagagaaagaatcgattgcagattactttgataggattcaagaactggtcaatgccttgaggtcatgtaaagacaagatctcagatgaacaagtg

SEQ ID NO: 68196 - DNA, 324 bp, Glycine max
  Peptide Sequence Number=SeqID_159881
atgtcatttttttgttggagagaaaggagaagaatagcggcgcggaaagtggaggaagaagaagaaccacaacgaggagaaagaagcgcaacgcaaagaagcagaaggagaatgaaggagaccaccacgaggaggaagaagtgcaacacaaaggaagaagcattgcgacagaacggcggaattactatagcacgaagaagcgtagcacgaaagaatgactgtagccatatttatattaatagggtgaatgacattttagctctttcacctaggatgttgggtgtcccagtaaaactactaggtgcccaaagtaataccctctag

SEQ ID NO: 68197 - DNA, 204 bp, Glycine max
  Peptide Sequence Number=SeqID_159882
atgccaaaagttggaaaaacaacttctatggaggctggatctttgagcttcaccaccaagatgagccatggggtgagaggagacgccatggggaataagccatggaagagggagtttcaccaccaagatgagccttggataagaagtttggagaggatgtttcaatggaggaaaagaaagaggggaggaggagcacgaaattga

SEQ ID NO: 68198 - DNA, 72 bp, Glycine max
  Peptide Sequence Number=SeqID_159883
atgcctgtacaagttgactggccaagagtccaacttccttctatagggggtgatacttttagtactgtttaa

SEQ ID NO: 68199 - DNA, 72 bp, Glycine max
  Peptide Sequence Number=SeqID_159884
atgacggattcatggacatggagatcccttgtatcgaaagtcttcctaccagatcctgggaggcaattctaa

SEQ ID NO: 68200 - DNA, 519 bp, Glycine max
  Peptide Sequence Number=SeqID_159885
atgggatcgagtcaggtgccctggcttaaaaagaggttctatcaagtcaagatcaagagcctaggagtcaccagcctaaaagagttaggacagttgatggagattctggaatgccctctgggaggaaggaaactgtatcttttctcagggttctatccctccttggctacaatttctaaaatagtcaaaatctcgacactggaattagaccgggggaagcaagtagaaaatggggtggttggagtaccaaggaaatgtttggaagcaaaggcgagaaccttggcaagtcaagacgaatgggctcttttcatggatgtcctggtgctcttgatcttcggagtggtcctctttccaaacgtagatgggttggtggacttggcagcaattgatgcttttctcgcctttcacgatcgcaaggaaagcccggttgtcgctatcttagccgatctatatgacacattcgaccgaagatgtgagaagaacagtgcaaggatcgcttgctgtacaccagccctctac

SEQ ID NO: 68201 - DNA, 435 bp, Glycine max
  Peptide Sequence Number=SeqID_159886
atggctattatgtattcaaggtgtgctgacattgatgaggcacaagcattgtttgatggggtgagggtcaaagctgtgtctacttataattccatgattggaggattggctttgcataggaagagcattgaagcagttgtgttgtttagtgaaatgcttaaggagagggttaggcgaaatggtataacatttgttggggttttgaatggttgcagccatggagggttggtcgatctgggtggtgaaatatttgaatcaatggaaatgattcgtgggattgaagcagaggaagaacactatggttgcatggttcaaattctcggtaagatgagggtagtagtcataggtcattggaagcaatttcatactgctagtacccagctcttggttcctttcgagattgattatagtctgatttcgaaaccaatggactag

SEQ ID NO: 68202 - DNA, 228 bp, Glycine max
  Peptide Sequence Number=SeqID_159887
atgattaaaatagaaattagaaacaattcacctgtgtcgcaacgtgcccttcgcgggcgggcgaaggcgaggctcacgggtgcgctttccaaaggaggaaagatgcgcggagtcgccaccaacgtttatttgtggaaaacatcggaaaaaccgaaggaaaccggtcgacaaaagcggggcttttgctcctacataccctccatcgaagaggaaatcagacctacgtag

SEQ ID NO: 68203 - DNA, 1893 bp, Glycine max
  Peptide Sequence Number=SeqID_159888
atggagaaggctcaagctacttcaaatattgaatcattagttgttagagatgctcatcaaaccgaaggcctttccttggtcagtctggcttcgctaaaggctcgtcaaatccaaggttcatcctttgtaagtcttgcttctcaaaagcctcgtcaaacccaaggttcgcccttggtgagtcttgcatctccaaaggctcatcaaacccaaggcttgttaaacccaaggttcactcttagtgagcatcgatgcatatctacaggcttgtcaaacccaaggtctacctttgtcttgcctctccaaaggcttgtcaaacccaatgttcgctctcgattagtctcgcttctccaaagacttgtcaaacccaaggctagtcaaacccaaggtccgcccatggtgagtctcatagctccaaaggctcatcaaacccaaggtctgccctttgtgagtgtcgctcctccaaaggcaaacccaaggtccacccttggttcgtccttggtttgtctcacttctccaaagggtcgtcaaacccaaggtccgtccttggttagtttcgcttcgccaaaggcttgtcaaacccaaggtttttccttggttagtctcgcttctccagaggcttgtcaaactgaaggcttgtccttggtgaatctcgctttgccaaaggcttgtcaaactcgtggtccgcccatggcgagtcttgcatctccaaaggctcatcaaacccaaggtctatccttggtgagtctcacagctccaaaggcttgtcaaacccaaggtccaccattggttagtctcgctcctctaaaggctcgtcaaatccaaggtctgcccttggtgagtctcgcatcctcaaaagctcgtcaaacccaaggtttttccttggttagtcttgcttctctagaggcttgtcaaattgaaggcttgtccttggtgaatctcgcttcgccaaaggcttgtcaaactcgtggtccgaccatggcgagtcttgcatctccaaaggctcgtcaaacccaaggtctttccttggtgagtctcacagctccaaaggcttgtcaaacccaaggtccaccattggttagtctcgctcctccaacggctcgtcaaatccaaggtccgcccttggtgagtctcgcatcctcaaaagctcgtttaacccaaggtctttccatggtacgtctcgctcctccaaaggctcgtcaaacccaaggtccatcccttatgagtcttgcttcttcaaaggctggtcaaacccaaggctcgtcaaacccaaggtatgcctttttgagtctcgctcctccaaaggctcgtcaaatccaaggttcgcccatggtgagtctcgcaactccaaaggctcatcaaacccaaaatccgcccttggcgagtctcactccttcaaaggctcgtcaaacccaaggctcgtcaaacccaaggtccacccttggtgagtcttggatctcgaaaggctcgtcaaactcgaggtttgtccttggtgagtctcgcttctccaaaggctctttaaacctaaggtgtatccttggtgagtctggcttctccaaaggctcgtcaaaccctaggcctattgttggtgagtctcacttcgccaaaggctcgtcaaatccaagatccacccttggtacatactcctacaaaaacctaagacatgcttttggtgaaagccaacttaactactcacaaacatcaggggaaaagctctgcaagacgaaaggaagcaacaccaagatgattgacaagagcttcaaccaggttgaaacaaaacctgagaagattttgtgtcatctagctttttatttcatacaaagacatcaagatcctacttcctacaccgccaaaatctcacttatcaaggtggcctatccttactaccacaagtaa

SEQ ID NO: 68204 - DNA, 576 bp, Glycine max
  Peptide Sequence Number=SeqID_159889
atgggaaatataaacttggctgcatcattgaaaaagaaaggaagaaaaaaatatcgtagggaaaggaaagtaaagcaacctcttttggttccttctagaagctttgcgggccttcctcttgatcttgtcgtctttgttctcagagaaccttctgcgtttgcactcctgaagcacaccggctttgaggacctccttcttaaaggggttgatgattctgtcctcgggctcgtcctcgcccaccacgatctacacattgaagtgaagaatgttggaaagggagagtgcaatgcagatgctgatgttgtcacggcaaccgctcaagaccgctacctccctgtctccttcaaccaggccatcagcgcaacgatgtcgttcttcaccgcaatttttgcgtttttgatcacatgcaagaaggagactggggtggtgttcggtatcgttgtggcgggcaacagtgaagaggagaagacatcaccacctctctctctctctctctctctctctggcgcgatggagacgatggaggccttggtagggacgttagggttgctgctggctgcatttgcaaataaataa

SEQ ID NO: 68205 - DNA, 711 bp, Glycine max
  Peptide Sequence Number=SeqID_159890
atggaagagttggtcttcctacttttgtttgttgaccacaaagtggtacctggagatatgtcgtgggggtcaggagaccttggggacgtcaggcgagctcctggcagtcaaccaataaaagaacaaagtccacgaagcaaggaggcttgtgtggcggctggccagctatgtatcttgggtggtatctggaaattagcctctggtaatcgattaccattcggtgatagggcactggtaatcgattaccagttgggtgtaatcgattacatagcgctacctactactgcgctgttgatccatgatcgcgttgtgatggagtgcctagagggtgtttgggagaccctcgaaggcaatgagaggtgccgattctatgacacaattcgactcactgctacttcattagtacattcggaagaacccgcacgcacacttcagcagcctgtggagtggatactacctacacctactccatatcgactagttgagttggttcaagtgataaaggtgtcatcctctgaggaggatcttgaagaggacccagaggagttacctcctgaacctgctatggacgcccttgacttacctgaggatgataaagacccactcccggatgttgattctccagaggatattatgtcagcatctaaggcagactctacagaggagagtgatcctggagggatagcgaatagtgacgacccttcatcgtag

SEQ ID NO: 68206 - DNA, 492 bp, Glycine max
  Peptide Sequence Number=SeqID_159891
atgcccgggttgggtcgggattggtcaagcttggttttgggcaatagcaccctacctgacgtccccaaggtggcggtcgggcgatggtgcacaacaagttttccacatccacaatgcgcgcataaacccatcatcccctgttgcccacctccaactgagctcacgtactcccatgtagcccatatcctcgtttctctcaacaccgggtctccattaatcctcccaagcttccccaacatcaaaccaagcaaaacagggcaaaggcagaaaactctgcccaaaacaccaaccaaatcacatcttttctcacttaaagaccccagtaacaatcccttcgtcccacacgtagagacgcgcttcacgactccggaaatgccctccttttgcgatttggagcggaaatgggcaccaaaggttgaagctttgttgggcaacaatggtggaggaagaaaagaagaagaaggctgcgtgagagagagggagagcttctga

SEQ ID NO: 68207 - DNA, 587 bp, Glycine max
  Peptide Sequence Number=SeqID_159892
gtgcactgaatgatgattggaaatttgatttttctgtgcatgatgcccgccggttggtttgcaccaaccaagcggatatgaccggaaggctgcttgccggttcattggctcttgaaagccacatccttcactatcctattatgcatattttacttccaagatcttcaaaccttgcacaggtttctgaagaagatcttattgtcatgtgggcttttcataccggccgaaaaattgattgggcacacttagtccgatatcgcatgcataaggcattgcgattaaatgctcctttaccatatccacatctagtcactcttttccttcaacactttaacatccctcttgattctaaaccttatgttccaatcaagagatccttcttgatcggtgcttttgtgggtgctaaacccaatgatgatgaaggacacttaccagtaggagaggattattctctccttcagagtattttggacaggtttgatggacttcaaacctatgttggtgaaaggatcaccaaggttgaaggaaatgtcactttcatccgcacatgctttgatctaccaccaccaccaccaccatcatcttag

SEQ ID NO: 68208 - DNA, 1035 bp, Glycine max
  Peptide Sequence Number=SeqID_159893
atggtcgaagaccggtggcgaggggtggtgagcgatgttaactttgccgtagaagtagatggtccacacccaatactctgtgccgtgatacaagggaatattgtagcagtgcttcttgacttggcgctttctggaggtagtgggaaaagaggacaggtcggagctagtgagggcagggacgatgccaatgtcctagttgaagggtggggagagactgtggaagaagaagatgtcgtcgtcctcgaattcgccgtgtgcggggtgcaagctcctgcggcggaagtgcacacaggagtgcgtgttcgcgccgtactttccgccggacaacccacagcggttcgcgtgcgtgcaccgcgtgttcggcgcgagcaacgtgtcaaagctgctgagcgagctcagcgtggcgcagcgggacgacgccgtcaagtcgctggcgtacgaggcggaggcgtgtctgcgcgaccccgtctacggttgcgtgggcttcatctcgctcctgcagcagcacctccgtcaaatccagacggagctccacaacgcgaagaaggagttggcaaggttcttttagccaatccagggatgttgcaacatggtggtattgttgtgcctcatttacatcaaccagtgttcaacgctctgtccaaccagatggttggacagaacgttggacagcaggagtttctagaaactcagcaaatgtttctcgcaaatagggatcatcaacatcagcagcaacagcaacaacaacatgttatgcttcggagctacgaacagcaagagtttatgaagtttaataatggtgtgtttgagcctagtgttggtggagggtttgggaaccaagcggaggagttcttgtctccttccttggctcttggaaatttcgagaatgttgagtcttaccagatgcaacagcaaggggaacaacatcatcccattgaggcgcagttgctcctctcgccacagcaagagtcacaaggacaacatcagcaacaacagtgtgcaagtgaggatgggaggaatgttgttcctgcttga

SEQ ID NO: 68209 - DNA, 188 bp, Glycine max
  Peptide Sequence Number=SeqID_159894
ctttcgaagaagttacgaaaactcacggattgcgaaaaacacctcctttcaatttccgtcacattacggaattttcacggatcgctgagttattgggccctatactcgggtctatggagacatgggaagtggaggttgatctgtggtcatgctgggtctccaactcgcttgataacagtgaagcttaa

SEQ ID NO: 68210 - DNA, 153 bp, Glycine max
  Peptide Sequence Number=SeqID_159895
atggaagatcttgaagatgttgtgatctacacaccgagggttcaagggagaggtaaaattttagggaattgcatttgcatagtgtttgtacttggttctataatggtggatgttcaaagggatcttagaacaattggttgtaggtcttcttga

SEQ ID NO: 68211 - DNA, 312 bp, Glycine max
  Peptide Sequence Number=SeqID_159896
atgactgggatggctgaagaggagactaaggagaagaaaagtagaagcttaacactaaaatccttcataccatctagtgataagagagatgaagaaagtgcaaaaggttctgagagcgagaatctaacattgattgttagaaagtttaagtttctaaagaacaagaatctcaaaggaagatccatccaacataagaagaactttaagaagaatgactcaacctcctctaattttacttattttgagcgtggcaaatcgggccacataaaatctgaatgctccattagtattataatgtcgattcaaatttga

SEQ ID NO: 68212 - DNA, 1410 bp, Glycine max
  Peptide Sequence Number=SeqID_159897
atggcattggcacatgattttgagaggagtgacccatggaacaagtgggaaccaaagcttgtttttgggtacaagagaacacaaaagtgggcgctagttggagcttacctttgggccaaaacggtagcaaatgctttgaatgtatgggggtttgcccaaattcacattgacatttgcatttcagaagaagtggagatggctccgaaaaagctttccacaaagaggtccaggagcgacgcccatgaggatggctccagcgcccccatggagtttgacaatcaccggttccggagtgccgaacaccagcagcgcttcgacaccatcaagggatggtcgttccacagggagaggtgtgtccagcttagggaggacaagtaccctgacttccaggaagagatagctcgcaggcgttgggaacgactagtgacccctatggctaaattcgacctggagatagtcatagaattctatgccaatgcttggcccactgaggagggggttcgggacatgcactcgcgggtgaggggtcactggatcccctttgatgcagatgccctcagccagttcttgggtgacccgctgattttggaggagaaccagcagtgtgagttcagccagaggaggaaccaggcagacggcttcgatgaggaggccatcgcttggctgctgtgcatattggggcaggatttcacccggacccctgcgtggaggcgagtatggatcatgcgcaccagcatgactaccctgacccagatatggatgacattgctgctcagcaatgtcttgcctagtgaccacaactccgacctccctctgcctaagtgccagttggtgtatgccatcctgacacggatgagcgttcacgtggcccaggtaattgctgacgccatttatttgtttgcagggatggcgcctactaggcaccctttggacccggagaagtttaatatggccctggggtttccgactttgatcacgggcctctgccaattctacggtgtgcatgtcgcccccaacaaggtaatccaaccaccgatcacccgcgccttcatcgagaagtactgcacgcctagacaagtgcagggtgacgcacatcaggctgcgagcgcaccgccaccacctcggcaggccaattcggctggaccattgagcacggccaaccaccgtggacaggtgcaattacatgagtgtctctaccggttcaaccttagccaacagaggcagggttctgccccttttgtatgccctaccccggagaagtttagggatgaggtcgcatggcccggagactggcccgatgcccagacagagatggagcctgcagaatcccccggtgatgaggatgaatcccatatggatgaggatatgactaacctgctcagttttttgggagggagcggagccacatga

SEQ ID NO: 68213 - DNA, 402 bp, Glycine max
  Peptide Sequence Number=SeqID_159898
atgccctctagcttcgcggacttggtattcaccggagaaaggatcgaggtgggtttgaagaggggaaagtttgattacgtctccaccgcaggtgccagcggtaggaggaccggaacagctgaggcaaagaagaaagagggagatgcccataccgtcacttcaacacctgtgtggcctaagccgccgcaaaccccccacggtacccaccaatatgcacaacatcacccgagttttgcagcttgcaccgggggctcttccgacttagcgctcgcccagccaagggcgcccacacccccacagaggagggctcctcaggctccggctccaacccagcctcacccggccaacaatgcccaccttggcgcgggctccaacacggcgaggaacttttcgtcaaggtag

SEQ ID NO: 68214 - DNA, 456 bp, Glycine max
  Peptide Sequence Number=SeqID_159899
atgaggcttcattgttatcaagcgagtcagagacctagtatgaccacaaatcgacctccactccttgtggctcacatagacctagtccccagtggagttgccatctgttgcaacctaccctacgatggaagggcgaggcaaaacgccaaaggtgtgtcttctaaagagaaaacacgtgggagtcgccaccaacctttattggaggaaaacattagaaaaaccaaaaagaggtatgcaaatattgaaaagacagttccttcaccttctggcccttggaacccctcctcaacttccctagcacacctatttatatgtgtcgcaacctacccttcagcggaagggcgatgcgaggctcacaggtgcgtcttccaagtaaggaaaacacgcagagtcgccaccaatatttatttgaggaaaacatttggaaaaaccaaaaagcgggtctacgaactttaa

SEQ ID NO: 68215 - DNA, 225 bp, Glycine max
  Peptide Sequence Number=SeqID_159900
atggccaaaatacaaggcccaaacgaaggaaaaacctattctaatatttacaaagataagcgggctcatacttggttcatgggctcgaaatctaccctaaggctcatgagaaccctagggccttcccttggatctttggcccaatctacttggagtcttctatccaatgcccttgcggggttagttgaaagccaaaggaaagaattaaggaagcattggacttga

SEQ ID NO: 68216 - DNA, 660 bp, Glycine max
  Peptide Sequence Number=SeqID_159901
atgcattcctatgaagcggtgaaggtgctggtggcagcgctagtggaagtgctagaaagagagacgacgatggtgaaggagaatgcaacggaggaagagaaggcgatgatagggaggccaggagcgtgggaagaaggaggggtattacgtgggaagaaggacgcagtgactgcgttgtgtttgattgtgcgagaagaaggaacgacgactgcacgatatgcgttgtgttcaatgacgaaggacaataaggtgagggcgggggtcatgagggcgctaatggagttgatggtggacttggggtcaagtatttcatacttggtgagcctagtggtggtggcggtggcagaggggagggtggcgctggtggaagaaggggggcttccagtgctggtggagatagtggagattttactggtatgtaacaattgtcttagtgtccagaagtttggaactaaagataacccattattgatcgagtgttttgatttcaacagcagtggcaatcatgctataatggaggttggcgaagttattcaattttatgattcagataggcagagtttcctgcttaggacattggaggaaagctacctggtggctgtaggagttgaaggcataatggaagcttatgccagtgctttacacagtgtcactctctga

SEQ ID NO: 68217 - DNA, 315 bp, Glycine max
  Peptide Sequence Number=SeqID_159902
atggctaggagactccaagaagattgggccagagatgcaggagaatgcccaagggttctaatgagccttaggggaagacataggtcacatcttagacctcactcccatagaagagaaaaggaaagaaagcctcaagaggctagcattaacctcccatacttctatgggaaggacaatgtagaggctaacttagattgggaaataagggtagagcgacaacttaaaaggaagtctactttaaaatcttatggccctcgatcactcttatccaaagaaagaccaaggtcaaggcatcttaggggtgacaccttctaa

SEQ ID NO: 68218 - DNA, 324 bp, Glycine max
  Peptide Sequence Number=SeqID_159903
atggaaaaagaggataccagaaccatagaaaacacaagaggaagaaagcagaaggaagaaggaagcacaaagtggagcccggacgttgcagagtggcaatgggaagaatcaaaagaattctcagactgtgtcattttgaattctttgacaagggagaagggagacacaaaagaattcaggcggttagtcccttgttcttttggaaaagagagaagagagacacaaaaagaatttaggcggttagtccttggcgaattctttttggcaaagggagaagagaatgaaaagatgaatagcacaagttttcaaggtttagaaaactag

SEQ ID NO: 68219 - DNA, 102 bp, Glycine max
  Peptide Sequence Number=SeqID_159904
atgaaggaatgtgaaggaaggtccttcctgcatggagtaacaggatgcgtcatcttagatagaattggaatcttcaatacaaggatagcgcttccagcataa

SEQ ID NO: 68220 - DNA, 201 bp, Glycine max
  Peptide Sequence Number=SeqID_159905
atggaggttgaggaatctttgctggggttatggctaccattgcattatcgagcagataggggagcttttttctggaaaattccttccttagttggtgctttggttggtgctttggcaaactttgtggttgatttagaggtggcctttgtggatgattacgcgttcttggctgatagggtggtgggtaatgagaagggctga

SEQ ID NO: 68221 - DNA, 549 bp, Glycine max
  Peptide Sequence Number=SeqID_159906
atggcgcctaccaggcacccactggacccggataagtccaacaaagccctgggatttcccgccttgatcacaggactctgccagtcgttcggagtccctgtcgcacctagcaaggtgattcggccgcccattacccgagcttttattgagaagtattgcacacagagacaggtccagggggatgctccgcaggccgcagacgcgccgccacctcatcaggccggtccatccggattgtttgatacggagcagtatttgcggcatttggttcgccagcaggcggccaaccaccaggcacatgtacagacccatgattgtctttatcaaatgagcctcagcctgcagagccagggttttacttcttttccgtgccctactccggaccagtttagggcagaggtcgcatggcctggagattggcctgaggcccgagcaggagagtcgccagcagaggcaccagcagaggctcccgacgaggcagatgaggcccgtgaggacgaggagatgaccgatttacttgatttcttaggagggagcggggccacatga

SEQ ID NO: 68222 - DNA, 999 bp, Glycine max
  Peptide Sequence Number=SeqID_159907
atgaaatttattatttcaagtggtgaattgcagaaggctttgcaaactgtaagtggcgtaatatcaagctctcaatcgagaccgatcttagaaaactatcttttcgaattaaacgaaacccaggttaccattacagcatctgatggcgaaacaactcttgtaacttctttggaagtaaagtctgatgattcgggtaaatttgctgttcctgctaaaatttttcaagattttatcaaaacatatggtgaacaaccgcttacattttctgtaaaggataatgctgagggaacgggtagccagctggaaattttggatgaaaaggataatttcgcagtagcattggataatgcggatgattatccggagcttcctgaatttgatgcttcacaaagcgtgaccatgtccgcaggagttttattccagttcggggaaaatgagacgaattttgtttctacagattcccacagactggttgtttacaaaagaatggacctgatgaacgtagaacctatggagttcatcatgcctaaaaaacctttaaatattttcaaaaatatattggcaagttccaacgaagacgttactatcgatttcaatgagaacatggctaaatttacttttggtaaacatatctggatatgtagactgattgacggaaaatatcctaactatactgcggttattccaaaagaaaatcctaatgtattaacaatcaacagaaacctgctattaggtgcgatcaaaagagcatcgatcatgtctaataaatcaaccaatcaggtaagatttaaattatctgccaacatccttcaccttcacgcagaagatacggaatatgcaaacaaagcagatatgcagatcccttgtgattataacggagaagatatcaacatcgggtttagctctaagtttttaacagaaatgttgactattcttggttctgacgatatcacaatgaaaatgtctcagccaaacagaccgggaatcattgacctctga

SEQ ID NO: 68223 - DNA, 351 bp, Glycine max
  Peptide Sequence Number=SeqID_159908
atgtcctcatcttcagaggactacaggtcctcgccatcagaggtttgcccgtcctcgcctttagaggactacacgtcctcgccttcagaggactacatgtcttcgcatttagaggactacacgtcctcaccttcagaggattacacgtccttgccattaaatggctacacgccctcatcttcaagggccgcacgccctcgccttaagaggactacacgtcttcgccttgatagggctgcatgccctctccttcagaggactacatgtcctcgccgtcagagggctaaaggccctcaccgacagaggacaacacgtcctcgccttcagagggatacacgccctcacctttag

SEQ ID NO: 68224 - DNA, 303 bp, Glycine max
  Peptide Sequence Number=SeqID_159909
atggtggcccgagtaatgttggggaatggttacgagcccggaatgggtttaggcaaggacaacggcggcataactagcctgataagcgccaaaggaaatcgtgggaagtttgggttaggctacaaacccacacagacagatataaggaaaagcggaagtcaaggctcgcgattaagacaacaagacgaaggaaactcgccctgccacataagtaggagctttataagcgtgggtctaggggacaaaggccaagtcattgcaatatgcaaagatgatgccccgagtgggtcgaatttggtatga

SEQ ID NO: 68225 - DNA, 177 bp, Glycine max
  Peptide Sequence Number=SeqID_159910
atggctacagccaggtgggcactcaagcatcctgtttatggcattgtgatattacggttgggaatttacacagacagacccaacgtttccaagacgacgttcctaaatgaaaaactctacacggttccggaatttcaacaaacattattgacaacaacgaaacaagtaccgacgtaa

SEQ ID NO: 68226 - DNA, 123 bp, Glycine max
  Peptide Sequence Number=SeqID_159911
atggataagagcatgaaggtaggagaagataagtggggggagagggggagagggggagagaggaacgaaattttgagagagagaagagggagaatgaggagaattatatgcaattgggcttga

SEQ ID NO: 68227 - DNA, 270 bp, Glycine max
  Peptide Sequence Number=SeqID_159912
atgtcctcttgggggaagaaaaccgtatctttttcttccctccttgagcaagattgcagttgtggtcaggggttcggcatgagagttggatcgtgtaaagaaaactcgaaacggcgtagtgggcctaccacggaagtacttggaaggcaaggcaagggatatggcgaatcaagaggagtgggtcccgtatgtggacatattagcattgctaatctttggggttgtcctctttccaaacgtggacggtttggtggacctagccgcgattga

SEQ ID NO: 68228 - DNA, 249 bp, Glycine max
  Peptide Sequence Number=SeqID_159913
atggctgggacgccacaattggtggcagcagagcaaaagttggattctagtgaacctgtccatggtcttactagagatattgttataactgtcatagcctatatgcttccctacaggttaggtatggcaggacgtggtagggatcataaccgtgatgtcctcgaccgcatcacagttgtgctggaaactctagtgcaggaacttgatgtggagccggcagagtatcggggactcatggcttttccgtaa

SEQ ID NO: 68229 - DNA, 120 bp, Glycine max
  Peptide Sequence Number=SeqID_159914
atggacacccgtctccgtgtgattggtgatcccatgaacggaggttcaacgggggtgggggtcacaacccactctttgaggattcacctagtgagtgtggtggtggggccaccactgtga

SEQ ID NO: 68230 - DNA, 684 bp, Glycine max
  Peptide Sequence Number=SeqID_159915
atggcttcagaaagttcaccaaatctgaccgcgacacataccgcgggttgtggagctccgacaaaaagcacgggtaaggtcaaaagcgttatgcgaacggggacttgtacgagaggtcgtggaagcggaacgtgcaggagggggaggggcgctacgtgtggaagaatgagaatgagtactacggggagtagaagagtggcgtcatttgccgccgtgggacgctcattttggctagcaggaaccgttacgagggccaatgggagaacggggttcccaagggacaagggttgggaaggaagcttccatttcgagaagttctggacaaggtttccgactgaaggatctaagattacgctgccggatcaatcagtggagttccgctggaaggactactgccctatggtttttagacaattgaggaagctttgtattgaggaagttattgtgatgggcaatcttttctgctcagaatatcaaatccataaacgatttgacttgaagggatcttcacatggccagacaacagataagaccaaggagattgatgaaactaccaccctcaaggacctggatctcaactttgtgtttcgtctacaaaataattggttccaggatttcatcaattcaacattgcgaatcccaccactggttgtcagaagaagctggagatcgatgatgacctga

SEQ ID NO: 68231 - DNA, 612 bp, Glycine max
  Peptide Sequence Number=SeqID_159916
atggcttctagaaagagaaagagcattggtacaaggccgacatctcagtatgacacaaggagattttcttcattagatgcttggaccaaatacactgacaatgttctaggaagaaacattttgcctgaaaggaaagtagagctttatcacactgagctagatgactttaaggctgagttggagaggcgtaatttccataaacgcctcatcaatttagccgataggagcatagacctgactttggtgaaagagttctatgcaaatttatacagttctgaggaccgtccaccaaagcagtccaaagtcagaggtcatttggtgaagattgttactgatagtctcaatgcattcctggagacacctgtggtattagctgagggagagactcttcccgcatactccagatactgcaggttgcctatagatttcagagagatagaggctgctttatgcatacctggccgagggttcatcttgaactctgagggccatcatgggaggattctcaggaaggatttgactacactagctcaagtgtggagtgtcctctcatactccaacttggcccccacatcacatacctctgatctgacagtgacagagctaggctga

SEQ ID NO: 68232 - DNA, 288 bp, Glycine max
  Peptide Sequence Number=SeqID_159917
atggctccaaagaaactctccacaaagaggtctagaagagacaccacaggagaaggatccagtgctgcctcagggtttaatagtcatcgtttccagagttccgagcaccaacatcgctttgaggccatcaggggatggtcattccacagggagaggcgtgtcaagctcagggaggatgagtacacggacttccaagaagaggtagctcgcaggcattggacacctctggtgactcccatggccaagttcgaccccgagatagtcctagagttctacgctaatgcctag

SEQ ID NO: 68233 - DNA, 867 bp, Glycine max
  Peptide Sequence Number=SeqID_159918
gtggctatcgtttcgctgacgattactgagaaaggttattgcatcgatccggccaccggtaaactggatccagcccagccgcgcatcgttcacgatctggaaaacccgacgctgccgcagtcggctcccggtattttagttgaagcgctcaatcgccgccgcgaacgcggactcgctccctttaccatactctcctgcgacaatattcccgacaatggtcacgtcgtgaaaaacgccgtcctcggcatggctgagaaacgaagccaggagttggcaagctggattgctgaacatgtcagcttccccggcaccatggttgaccgcatcgtcccggccgccaccgaagaatctttggcggagattgcctccgtgctgggcgttgacgatccctgcgctatcagctgcgaaccgtttattcaatgggttgtggaagacaattttgtcgccgggcgtccagcctgggaaaccgcgggcgtacagatgaccaacgatgtcctgccgtgggaacaaatgaaactgcgcatgctcaacggtagccactccttcctcgcctggctgggctacctggcggggcatgcgcacgttagcgactgcatgcaggacgatgttttccgccatgccgcccgtcgcctgatgcttgatgaacaagcgccaacgctatcgattaccggcgtggatttagttgcctatgccgacagcctgataacgcgcttcgccaatccggccttaaagcatcgaacctggcaaatcgccatggacggcagtcaaaagctgccgcagcgcatgctcgatagtatacgcgttcatctggcaaacgacagccgctggccactgctggcgctgggcgtggcgggctggatgcgttac

SEQ ID NO: 68234 - DNA, 1077 bp, Glycine max
  Peptide Sequence Number=SeqID_159919
atgtgtagagaacctcgttgcaccagctggttttgtgttgctgactctgcctttcaatatgaggtatctgatgactcagttcaagctgattggcgccagacatttgctgatgcatcgggaacctatcatcactttgagttaattgtaggagatggttatgttacaatcacaaaaggggaaagtatcagaaggttctttgagcatgctgaagaggccgaggaagaagaggatgatgattcagttgacaaggatgggaatgagcttgatggagaatgctcccgtccccaaaagcatgcaaaaagccctgaacttgctcgagaatttcttctagatgctgccactattattttcaaagaacaggcatgtttagcactagttgaaaaggctttcagagaaggaacagcacgtcaaaatgcacacagcatatttgtttgtcttgcactaaaactgctggaggatcgagtgcacgtggcatgcaaagaaatcattaccttggaaaagcagatgaagcttcttgaagaagaagaaaaggaaaaacgtgaagaagaagaacgcaaggagcggagaaggacaaaggaacgggagaaaaagcttagaaggaaggaaagactaaaaggaaaagaaaaagaaaagaagtgttctgaatcaaatgatgctcttggttctcctgaaatctcaaagaaagaattgtctgcagttgctgatatggagcaaaatactcctattagctgcagtaatttagttattgaaacagatgaaactaatctattgagggatgattctcctaacatcgaagatgaagaattctctagtgagtgtagtactttgaaaccacaagacctctcttatgatgattgtgaggaagaaatttcaaatgcagaagatgagatgggtcagtctacaattgaacaatcaatgttttctcatcgaaaactaagatgtaggaaagaatttcaacttgatatgcctatgaagtggtctgacagacgacgatatgcagttgtttcagaaaatagtgtgatggtttgcagatctgagccaagacattatggagagagttttgtgacatcatccagg

SEQ ID NO: 68235 - DNA, 561 bp, Glycine max
  Peptide Sequence Number=SeqID_159920
atgggtgaccaagaggagacacaggaacagatgaaagttgacatgtcgactttgaaagagcaaatggcttccatgatggaggccatgttagggatgagacaactcatggagaataacgtggccaccgctgccgctgttagttcgcctgccgaagcagacccaactctcccagctaccgcacaccatcctctcccaaacacggtaggacgagaaaggagcacactggggcacatcagcaacccccatgtgggatacaaccgggtggcttacccttatggactaccacctaattacacgccaccagtcatgcgtgatgacgcgggtcatgtcccttcgcccatccttgaaggggagcctcctcgacagtcagacgaggttcacaaggatcatagagagtatgcccaagtagacaacgatttctaccccccggtcctcatcgagggtccagcacccaacgtactgcctcaacccaacctcccagcatggccaatattcttgtccacagagggaccacccccggcagtggaagaaagaaggaaactcgatctcatcgaggagtga

SEQ ID NO: 68236 - DNA, 357 bp, Glycine max
  Peptide Sequence Number=SeqID_159921
atgtatcctttccaccgcccgcatcgggtcggccgcgccaggatgagtctgcgttatcgctggcattcaccctgccacgtgccggttataccgcagacgacgaacggaattcatcacgccgctgatgctggcgcgttacccggactaaccggtgccttgtcgattaacccattgatttactccggcaaagccagccgggaaaagtgtttagaaaaccgaattgatgacgatggcggctttgtctgcaaagcggctggtcagggcgcagagcccagggttatggaccgacctggaacgccaggtgctgacagtgtgacggtgcaaacaatcacaggcggaaaatatgactacgcttaa

SEQ ID NO: 68237 - DNA, 1010 bp, Glycine max
  Peptide Sequence Number=SeqID_159922
gcggccgtcctgctgcgcgccaggaagagaatcgtcgctctggtcctcgcagcacccgtaataatgaagagagcggtcgtccgcgcaccgctcgtggtgacgatgccgggcgttcgcgtggtccacgtgacgatgctggccgttcgcgcggtccgcgtgacgatagcgcgcgcggtcgtcgcagcgatcgggacgatcgcggcttcagtgattcaccgtggcgcaccgtgtcacgtccgcctgtcgccgctgaagcggatgcgggtgacgaagcggccagcagcaagccggttatcgacccggaactgattcgccgtcagcgtcaggaagagacgcgcgtgtatggcgaaaacgcctgccaggcgctgttccagagccgtcccgaaagcatcgtccgtgcctggttcgtgcaaagcgtcacgccgcgcttccgcgaaaccctgcgctggctggcagcaaaccgcaaagcctatcacgtggtggacgacgccgagctggcgaaagcgtccgggactgaacaccacggcggcgtgtgcttcattattaagaagcgcatgggcatgccggtggcggaatggctgcagcaggcgcagagcaaagactgcgtactggcgctggaagatgtcagcaacccgcacaaccttggcggtatcatgcgcagctgcgcgcactttggcgtcaaaggtttgctgtccgcacggcctgaaggtggtgcagagcacgtccaggcaatcagcggcgaaagctttgctgcgggtctggaagcgttccgcaaagccggttacaccatcgtgaccacgtccagccacgccggtacgccactggcgcaggcggcgctgccagccaaaatggtactggtgctgggtcaggagcgtgaaggtctgtcagacagcgcattccagcagggcgatatcagcctgtcgattggcgggaccggcaacgttgaaagcctcaacgtttcggtcgcgaccggcattctgctcgccgaatggtggcgtcagaacgcataa

SEQ ID NO: 68238 - DNA, 540 bp, Glycine max
  Peptide Sequence Number=SeqID_159923
atgaccaatcttacacagatatggatgacgttgctacttagcaacattttgcctagcgaccgtaatgccgatctcccacttcggaagtatcagttggggtcgcgccaacaagacactcagtggacccggaggagcccaacagggccctgggtttccagctctggttacgggcctctatcagtcctacagggtgtccgtcccccccagcaagggatcgtgcccgcaagacacccagtggacccgaagaagtccaacagggtattggggtttccaactctgattacgggcctctgtcagttctatggagtgcttgtcgcccccagcaaggtcatcaggccccctactaaccaagctttcatcaagaattatggcgcgcccaggcaggcacagggcgagacaccacagcagcatggggatggccgacagcaggcaactgatgcaccgccgccacctccaaagcccctcagctcatctacaaaagttggagcgtttacgacccgtggccgaccagcaggcaaccaagtccaaagccaaaggtaa

SEQ ID NO: 68239 - DNA, 222 bp, Glycine max
  Peptide Sequence Number=SeqID_159924
atgaggccagataagccaaagaaaaatgagaacattgaaagacagcttgaagatctggatgtgccattgtttcatctgctaacaatcactactgccacgaataatttctcgttgaataataagattggacaaggtggttttggacctgtatataagggaaaattagtggatgggcgagaaattgctgtcaagagactttcaagtagcactggacaggaataa

SEQ ID NO: 68240 - DNA, 369 bp, Glycine max
  Peptide Sequence Number=SeqID_159925
atgaagaacaagccccctctgagccaagacgaacaacagctcttcagagagtcggtggcgggcgcgaaaaagctgcgccaggacaccatcgtccaccgcccgccgaagcccaaggtcaaacagattgccccgcagcggctgctgcaggagcaggtcgatgccagctattatttttcagatgaataccagccgcagttggaagaagaaggcccgacgcgctacgtgcgccccggcagcagcccgtatgagctgaagaagctgcgacgcggcgattactcgccggagctgtttctcgatttgcacggcctgacccagctgcaggccaagcaggaactgggggcgctgatcgccgcctgcaaacgcgaacac

SEQ ID NO: 68241 - DNA, 1020 bp, Glycine max
  Peptide Sequence Number=SeqID_159926
atgagcgatgcttccatctatgctttcctggcgatgcaagaagcgatcgcgtcttccggcctgaaggaagaagagtatcaaaacaacccgcgcgtgggcctgatcgccggttccggcggtggttccccgcgcttccaggtgttcggcgccgatgcgatgcgcagcccgcgcggcctgaaagcggttggcccatacgtggtcaccaaagccatggcttccggcgtttccgcctgcctggcgacgccgttcaaaatccacggcgtgaactactccatcagctccgcttgcgcgacctccgcacactgcatcggtaacgcggttgagcaaatccagctgggcaaacaggacatcgtgttcgccggcggcggcgaagagctgtgctgggaaatggcctgcgagttcgacgcgatgggcgcgctgtccaccaagtacaacgacacgccggaaaaagcctcccgtacttacgacgccgatcgtgacggtttcgtcatcgccggcggcggcggtatggtggtggttgaagaactggaacacgcgctggcgcgcggtgcgcacatctacgcggaaatcgttggctacggcgcaacgtctgacggcgccgacatggtagcgccatcgggcgaaggcgcggtgcgctgcatgaagatggcgatgcaggatctggatgcgccgatcgactacatcaacgtgcacggcacctccacgccggtgggcgacgtgaaagagctgggcgcgattcgcgaagtgttcggcgacaataccccggctatctcctccaccaaggcgatgaccggtcactcgctgggcgccgcaggcgtgcaggaagcgatctacagcctgctgatgctggagcacggctttatcgcgccgagcatcaacatcgaaaccctggatgagcaggcggccggcatgaacatcgtgactcagccgactcagcgcgagctgaccaccgtgatgtccaacagcttcggcttcggcggcaccaacgccaccctggtgatgcgcaaactggcgaaataa

SEQ ID NO: 68242 - DNA, 2883 bp, Glycine max
  Peptide Sequence Number=SeqID_159927
ggcacgccggcccggcgctgtacagcacgctggcgatcaagggctacttcccgctggcggagctgaagaccctcaaccaaaacggcacgcgtctgccgagccatccggaccggctgcgcacgcgcggcgtggacgccaccaccggttcgctggggcagggcgtgtcgatcgccgccggcatggcgttgtcccatcggctggcggggcgccgcaatcgggtgttcagcatcctcggtgacggggaactgaacgaagggcagtgctgggaggcgttccagtttatcgcccaccacaatctgaacaacctgacgctgttcatcgattacaacaagcaacagctggacggcgcgctggacgaggtgatccaaccgtttgatctggccgccaagttccgcgccttcggctttgaggtgcagaccatcaagggcgacgatatcgcggcgctgttggcggcggcggcgccggcgcgcggcggcgaacagcggccgctggcgatcgtgctcgacagcatcaaagggcagggcgttgcctatctggaaaacctgtcgaactctcaccacctgcgcctgacgccggacgtgcagcaggaaatcgaaaaagccatcgccgaactggaggccgcccatttggaaaacgacgccgtcgaaatgcgcaaagtctacgccggcgcggtgcgtcggcagattgaggcgggcgcgccgatcatcgcgctggaggcagatctgatgagctcgatggcgatggacggcgtacacaaggatcacccgcagcacgtgatcaactgcggcatcatggaaggccaatgtgatcggcgtcgccgccgggctgtcgctcaccggccgggtgccctgttcatgtcgctggattatcagcgcaacaacgtcaaggtgatcgcctccgacgccggggtgagcgcctgccacaacggcggcacccacatgtcgttcgaggacatgggcatcgtgcgcgggctggcgcattcggtggtgctggaggtgaccgacgccaccatgttcgccgacattctgcgccagctgatggatctgcgcggcttctactgggtgcgcaccattcgcaagcaggcgacgcgcatctatcaggagggctcgcgctttaccatcggcaagggcaacctgctgcgcgacggcgacgacattacgctgatcgccaacggcatcatggtggcggaggcgctgaaggcggcgcagaggctggcgcagcagggcgtcagcgcggcggtgatcgatatgttcaccctcaagcctatcgaccgtgaactgatcaaaacctacgcggccaagaccgggcgcatcgtcacctgtgaaaaccacagcattcataacgggctgggatcggcggtggcggaggtgctggcggaagagtgcccgacgcagatgcggcgcgtgggggtgaaggagcgttacggccaggtgggcacccaggcgttcttgcaacaggagtatggcctgaccgccgagcatattctggaggccgccgggcaggtatcaggccttggcggcggcagcgtcagcctgggaagactggatcgccgtcagcgcaacggtgtagacgatatcgtcaaccggctaccggtgagttcggcgccttgcgatcttggcaacgtcggccatgatggcggcgtcgtattgcagcgggccgtcgatgatcagatccgggcgtttttcctgcgccagacgggttgcttcgcgcactttctcgacgtcgctgcccgcgccggagttgccggtggagtaggagatcatcgccacgcgcggctcgatgccgaaggccgcggcggaatccgcagactggatggcgatttcagacagctgctcggcggtcggatccgggttgatcgcgcagtcgccgtagaccagtacctggtcaggcagcagcatgaagaacacggaggacaccagcgagctgcccggcgcggttttgatcagctgcaacggcgggcggatggtgttggcggtggtgtgaaccgcgccggagaccagaccgtcgacttcgccttgttccagcatcagggtgccgagcaccacgttgtcttccaactgctcgcgcgcgaccacttcggtcatgcccttgctcttgcgcagctcaaccagacgcggcacgtagttttcacgcacggcgaccggatcgacgatttcgatgcctttgcccagctcaacgccttgcgctgccgcgacgcgctggatctcttccgggttgccgagcagcacgcattccgcgatgccgcgttcggcgcagatggccgccgctttcacggtgcgcggctcgtcgccttccggcagcacgatgcgcttgccggctttacgcgccagctcggtggcggtcagcgagtcgatccattcggtgttgatgtggctggccacgtagttctgcactttctcgatgcgctggtggtcgtccgccggcacttcgaggttgaagctctgcaggctcagcgaggtctgccaggtgttggtgtcgaccatgaacaccggcaggccggtctggaaggcgcgttcgcacagcttcttgatcggctcgtcgatggcgtagccgccggtcagcaggatggcgccgatttctacgccgttcatcgccgccaggcaggcggagaccagcacgtcaggacggtccgcggaggtcaccagcagagagcccgggcggaagtgttccagcatgtgcgggatgctgcgcgcacagaaggtcacggacttcacgcggcgagtcatgatgtcgccttcgttgaccacgcgggccttcaggtggcgagccatgtcgatggcgcgggtggcgatcagatcgaagctccacggcacgcagcccagaaccggcagcgggctgttggcgaacagctgcgcaggatcgacgtgggcgatgctggctttg

SEQ ID NO: 68243 - DNA, 399 bp, Glycine max
  Peptide Sequence Number=SeqID_159928
atgggacgcattgtgttgttacccgtagttagatttctcgtgaaagagtctaccctctttcttttatttcttgtagatcgtgatggcagcgcaattaatccaagatcgagtggagatggagtgcctagagggagtttgggagaccctcgaaggcaatgcgaagtgccgattccgtggcacgattcaactcacgcttacttcattgtggagccagtccaagtgaaagaggtgtcgtcatctgaagaaaaccctgaggaggacccagaggagttacctcccgagcctgctgtggatgctcttgactttctagagggtgatgaggacccactccccgaggtagactctacggaggagagcagccctggagggatagtgactagtggatactcttcatcatag

SEQ ID NO: 68244 - DNA, 99 bp, Glycine max
  Peptide Sequence Number=SeqID_159929
atggcgaggacgtgtagtcctctaaaggtgagaacatgcagtcctctgaaggccaggacgtctagtcctctaaaggtgatggcgtgtaacccttcgatg

SEQ ID NO: 68245 - DNA, 162 bp, Glycine max
  Peptide Sequence Number=SeqID_159930
atgaggctaagtcatgaagtgctaaaacgcgcatccaccactaagcgcagcttcaacgcgcttagcgtgacagaagaatctggcagggcatcaatatcaaggtcgtgtgctaagcgcgagggtggcgctaagcgcaacgtcaggaattcagagcctatttaa

SEQ ID NO: 68246 - DNA, 291 bp, Glycine max
  Peptide Sequence Number=SeqID_159931
atgggacctctccaaaggcaagccttccgcaaagtgtacgggaagattctagatttgaccgccgcggaagtagttacggaagctgtcgtatccctcgcccaatactatgacaagccgttgaggtgtttcacgtttggggacttccaaatggtaccgactattgaagagtttgaggaaatattaggatgccctcttgaagggagaaaaccgtatcttttctccggctttcttccttccttgagcagattgcagctgtggttggagattcagcaaaagagttggatcgcatga

SEQ ID NO: 68247 - DNA, 261 bp, Glycine max
  Peptide Sequence Number=SeqID_159932
atggaggataatgtcgctcatgatggagacatgttcaagctcacggctaacaactactcatattggaagccgatgatggaggatcatctatattgcaaggatttgcttgagcccatcatctacaaagacaatttttggattgtcgattttggtgcttccttccatgttgctccacatggaagtttcttctcatcctaccaaagcggtgactttggtacggtgcaaatgggaaataagataggagcaagatcgttgggatag

SEQ ID NO: 68248 - DNA, 450 bp, Glycine max
  Peptide Sequence Number=SeqID_159933
atgatggaggccatgatgagcatgaagaagataatggaagccaatgcggttgcagttgccgctaccaacgctattggtaagcacgccttcccgccatatggcttgcctcccaactatacaccacccaatgtggtgtacactcccaataaggatgtcaataactccactcccatactcattgagagccgacaacctcatcatgtacatgtctctcaacccatgggggagatacatgaaatttcccaccacaatctagccgacttcgagccttgcctcggatatgccactgaaaggcaagcagttggtgatatacccctgcaaaacactttggagggccctcagtatcacccacaaccacaccccttgcattccacaacgggtaaaaaaccctcatgctatggtagaaatgggaaagttggatcatctagaggaaaggctcagggccattga

SEQ ID NO: 68249 - DNA, 96 bp, Glycine max
  Peptide Sequence Number=SeqID_159934
atgggggtaatgcaatttggtcctaaggtgaagttctctctaggctctagccaacataggggtgtcctacaccttctaccatacagagcttcataa

SEQ ID NO: 68250 - DNA, 759 bp, Glycine max
  Peptide Sequence Number=SeqID_159935
atggtggccgttcggcaacagcagcccgacgtgttccccttcggcggtaaagcgctgcagaatgcggctgacgcccagcgatttcttgatcagcgtctggtaactgtcttctttgaaagcgatgtcttcgatacagggcttgcggcgcccgtagcggtgctgcgccgccagcaaggcatggaacagcgtctgcggttcgcgcgtatccattcgcgcccgcatcatgatctgcatcagccgatcgcccgccagcgcccggcgttcacgcgcgcgcggcgcttccggcatcggcagcgtggtcggtggcaagatgcggatgctgatttgcgggaaccagcggatcttgaacaccccggccatgcggccgaacgggctgaactcggggccgtcgatccgcaccggcaccacgattttcatcagcgcgccggtcacggtgatgcgcccttcaggaaacaccacgatcggccgcccctgctcgaccatgcgcaccagttgcttgatggccatcggcttggtgggatcgagcgagacgaaatcaatgtagggccgcagccagcgcataaaccagctctcgccgatgctggcgaacagcgccagcaacacgccgtcgaggaaagagacgtggttcggcgtaatcagcagtttttgcccgctcgaagtgctgaacgtccccttcgacccgaacccgaaacagcaggcgaaacagcgcgcgcagcagtgaaaagatcatgcccttctcccttggccatggaggcgtaa

SEQ ID NO: 68251 - DNA, 567 bp, Glycine max
  Peptide Sequence Number=SeqID_159936
atgtaccacttattcttcttttttccaactggtccctcatttgaatacgattcaacaacaccctccaagcaaaaacttgcacttgggaagggaccttggccttccataagatatcaaacaaattttgttgttcactttaaaggcaagttctacaacagaaaatacatatttctaacagagaatttgcatccttcaacgcttttccacatccatgagtcacttccttccaccttcaaattggctctttctagcatggtcatcaattgcacttctgactctagctcccattccctcaaacttctcctccaccgtggtttccaattccatcaaccttcctcccaaaaaatcccatttacaacactattacatcctaatctagctagggagactaagaataaacataggaatagcctcattaaaggaacctcagctagccatttatccctccaaaataagctccttgtaagcaatgagttcatcgactctttacctagtgtagcgccttcatcttcaattatccttgaaggccaattgaggcaatgcaaagcctcagtttgtcagttgtaa

SEQ ID NO: 68252 - DNA, 573 bp, Glycine max
  Peptide Sequence Number=SeqID_159937
atggacgaaaaccagtggatgtgtgatagtatgatgtctgaagaagtttatatgaatgttgaaaatgaaaaagatgttggctttaaagtagaacatgttgattgctctgatgcctttaaaacttctcaattgcttgttagccatgatgaagttttacaatgggctcgatcgttggctcatgacattggatttgttgttgttataatgaggtcagacaccaatattggtgttcgaggaagagtctcatttctgttgatagcttgcgaaatgagtgccagttttgagaggagaatgatggatggtgaagatgataatgttgtacgtgacttgttctggagtcatcctgatgaacagtttcggggtcttttcatgaaagttgattcactccccgaggttattgtcaccgacagagatttatctttgataaatgcagtgaaaactgtatttccggatgctacgaatttgctgtgttggttccacattgacaagaatgtgaaggcaaagtgcaaatctcctggttgcttaaaagaatgcatgggattatatgatggaggcttgggggagtttggttga

SEQ ID NO: 68253 - DNA, 324 bp, Glycine max
  Peptide Sequence Number=SeqID_159938
atggagaaccatattgacctggctttggtcaaggagttctactccaacttatatgacccaaaagaccgctcccccaggcagtgtaaggtgtgggggaagacgattaagttcgatgccgccacattgaacacctttctagagaccctagtgatgcttgagtcaggggagagatactcagcatactcccgctactgccacactcaccttggccatcaagctattgtagccaaattatgtttactagggcaggggtttgttcttaatgctgagggggctccgtggaagcttttgaggaaggacctgaccaacctcgctcagacatga

SEQ ID NO: 68254 - DNA, 408 bp, Glycine max
  Peptide Sequence Number=SeqID_159939
atgctgctgaaaggcttgctcagcgagccagattggctaagcgagactcatccgcttagcgaggaagtcagttcgctaagccagaacaaaactctagagaatgttgagccagagagcagcgtgcagccagctcgcccaacgaggatgttgtttcttctcgaacttagcgcgtccaagcccattttgagtattggaaaatgtttgaagtccttagaacttggtaaagcagctagaagtaaaactctagcaggggacttagctccattggacttggagattgaagctacttgtggaagaaacaacacaacaacgaaaagaagagagctacaagataggacagctaacctcagtggcgagagaattctgtcatctgaatcttcctcatcattccctactaagttgagataa

SEQ ID NO: 68255 - DNA, 972 bp, Glycine max
  Peptide Sequence Number=SeqID_159940
atggcatcgttcgggcagatgcagtcccagtttcagtcccagatgcaatctcagggacttgcacttcctccggagcctctggttggtccctcaggtcctcgagtaagcacaaaggagagttgtgttgatgcctcaggaaacgatcctgagacgggtgactcagataggtgcggcttgtacattgaagcaaatcctgcctgcctggttgccctggggagagtttatgagggatccactgttgttcataacactcctttgttgtctggccaagtaaaggtgggtatggaggaggttaaagatccaaatgctccagttcctgtacccattgctgaggtttccttagtggggcagacaattcacaccttccttgcttggccgacacatctggtcaagtctttatcacagcagcctgttgtgtctccggcaaaaccacctcaaaagccggatccggaggtcgatgatccgctttatctgatgacattgaccatcccagagattttcttgaggccttaccaggttacatgggatgccactgtgttcgaggtctttaatccagacttcccgctctacataaagcacgaagacctctccgaaatcgcacacggtggtcaatgtcttagcatatcagttttacagttgtggattctgcatctgactgaaacaactatgcgaggggggaattctgatatctatggattccttgagccacagtccattcagaggccagacaactaccttaaggggataattaacagtgctttaaaaggtcttgatgatgctccacagcctaaatcaaaggctcctgctaggtggactatcgtcaagggaagtactgagtgcggctattatgtcatgcactggatgtccaccatcattttaggaagtttcaggaataactgggaagcaaccattggagccagagagattaaaggcgctgcggatccagtggacacagtattatctccgagttag

SEQ ID NO: 68256 - DNA, 777 bp, Glycine max
  Peptide Sequence Number=SeqID_159941
atggataagatgcttagggcaagccagaggttttttgacctgagtgaggaagaaaaaagggagtacgcaggagggaaggtacttgatccaataagatatgggacaagcttcaatctcatggtggacaaggcgcttttctggagagattatctcaaatgtcatgttcaccctcactttaatgttccttccaaaccccatggttttagcgaaactgtggatgaatacatcacaaagagcagggaagtggttggagagttgctaaaaggaatatctctaagcttagggcttgaagaaaactacatacataaaaggctgaatgtagagttgggctcccagtttcttattctcaacttttacccaccttgtcctaagcctgaacttgtaatgggcctgcctgcacacacagaccatgggcttctgaccctcttgatggaaaatgagcttggagggcttcaaattcaacataagggcaggtggattcctgtccatgccttacccaactccttccttatcaacactggggatcacttggagatactgaccaatgggaaatacaagagtgttcttcatcgtgcagtagtgaatacgaaagccacaagaatttctgttgctacagcacacggggccccccttgacaccagtgtgggccctgcaccggagcttgttggagatgaaaatcctgctgcataccgtgccatcaaatacagagattacatacactttcagcaaagcaatgaactggacagaaggtcctgcttggatcatattcggatttga

SEQ ID NO: 68257 - DNA, 264 bp, Glycine max
  Peptide Sequence Number=SeqID_159942
atggcaaagctcagagattcgagcaagagtctggtcaggacttgctcgaatcgaaaagagaggagagtctttaagaaggtattcccaggttcaaagaagtatttgcgaagtacaaagctaagacaagaaagaggacttcgaatcattgggcgattcgaactggtgtatactcgagtcgaaatcgaggcagctagatttctggacttagcacaatttccgacaaaacttcacaaaatcaacttcgacttcgagcaagatggataa

SEQ ID NO: 68258 - DNA, 432 bp, Glycine max
  Peptide Sequence Number=SeqID_159943
atggctactgaagaacccataataagagataatgttaatgacttcagtaatgacgagcaacaacatgattttgatgaacatggtgaaccaaccaatcaaagtgagtcatcttcatattttgaaactattagtagccaattttctgaaaatcgagagtactcaaatccttatcaaaggacaacaagtgttaatacaaatgacttttatgaagggttgacatttgaatcaaaacaagccgttgtgaatgccattaaacaattccattttatgcattcatttaattttgatgtggtcaagaacaagagtgacaattacctgcctatatggttcacagctgctcaacactttgtaccaagtaccatagtaaaatacgaaacttcatcttcaatggaggaaggtgacgataaccctcctagggtgattcttaaccat

SEQ ID NO: 68259 - DNA, 480 bp, Glycine max
  Peptide Sequence Number=SeqID_159944
atgggtttacatcagttgtggacaattttgatgaagtttccagagcctccctcggcgatgcctggtgggacccatcgggcattagggagggtcgtggcatgcgttgtctttgccgctagagacgcccatgccgaggtagaggaggcctttgtcagcaacaaggttcatgtagtactcgatgttctcgtaccacttattatcgtcgtcgatgatgcaatcgtcggggtcgaggtggtcgaagaaggtggcgatggtgtggtcaacgggggcactggccttgacaaggatgatgacagatctaggacgctagaaggagataatgaagttgcgaggggtgtattggcccgtgagagggagggagcctttattgtgtgcacaatctacgatctccacctcgagggtgatggtcttgttggtcaaagtcttcactcagggaagagaaagggagaacgaagaagtgggggaagcgtagagtggtga

SEQ ID NO: 68260 - DNA, 132 bp, Glycine max
  Peptide Sequence Number=SeqID_159945
atgaggcccagcccaacactcgcgctaagcgcgcatcaggcgctaagcgagcaaagaagacaggcgctaagtgaggcgttgagctcgaagatgcagaatccgttatgcgcgctaagctcggctacgagctaa

SEQ ID NO: 68261 - DNA, 189 bp, Glycine max
  Peptide Sequence Number=SeqID_159946
atgttccttatattcaacactagtgctttgaaaggacttgatgatactccacaaccgaaatccaaggctgttgctaggtggattgttgttaagtattttaatgaagttagaccattggaagcagagagattcaaggcacttcgcatacagtgggcacagtattatctaaaagttagaaatcaaacatag

SEQ ID NO: 68262 - DNA, 585 bp, Glycine max
  Peptide Sequence Number=SeqID_159947
atgtctgcagatgatacttctctggtaataaagatgcttatgcaaatgttgcaggacttggctacgatgaagacgattggctggagtaaacaatgtggtggtctttattacatgtctcctttgcaaggaacacctgtctctcatcaagtacatttgacaccatggatcattggtctacaattaagccaacccatcaacctcaacaaccagagccatcccataccaatgaatctgagttgcctatcaatacacatgaagcaccttccactacctgaaccaactttaaccaattcaaacacatcaaattcttcaactccttccattccccaagttcgaaaatccattcgtgagagacaacctccaacatggcatagagagttcataatgcccaaaaaagtcaatcgatcttcctcacaatcaacttctagaacaagtactcgttatcctctttctaattgcctttcatactcttgcgtttcttcaacccattttgcttttttagctaacattaaagcccatacggagccacactgttatgatcaagctgtccaagatccacattggcaagcagcaatggatgcataa

SEQ ID NO: 68263 - DNA, 552 bp, Glycine max
  Peptide Sequence Number=SeqID_159948
atgagaaagcgatttttgcagaactcgaacccaaaatccctaaatcttcaaaacttgatttctccctcaactctcaaccaaatcatgtcccacaaagcccaaaattcatcttttttaattctctttcacttccaccaattaaaacttccaaaaacacctccaaatggcaaaaccatcgaaaaagcgaaagggggttgcgacttcatcctcagtctctggaacacgaagccacggaacatccaaggcgcagacatctcaaattcctccctccatataatctcctacgttgttttcctccgaagaacaacgtatccgggttcacttgatgatgagtggaagtttgatttctctgtgtctgatgcccgccgaatggtttgcaccaaccaagtggatatgaccagaaggcttcttaccggttcattggcattcgaatgccgcttcatgcactacttgattgttatcctactccctagatcttccaaccttgcacaggtttctgaggaagatttgataatcatgtgggttttcttaaccggtcgtcaaatccactag

SEQ ID NO: 68264 - DNA, 317 bp, Glycine max
  Peptide Sequence Number=SeqID_159949
gtgcaaatgtaatctcttccttcggataccgcaaagagagggatggctcttgggtgaagaaggatgctccagtacaggccgctgaagaccgctctccatcaccacattctcagagagatgactcttcatctcttatgcacaacattcttgaaaggtttgatggacttcaaacctatgttggtgagaggtttgatgctttggaacgacaagtggacatgcgattcgacaaaatggactcaaggatcacaaaggttgaagaagatgtcaccatcattcgcgactgccttgatttacctccaccacctccatcagtttag

SEQ ID NO: 68265 - DNA, 558 bp, Glycine max
  Peptide Sequence Number=SeqID_159950
atgaccactcttacacagatatggatgatgttgctacttagcaacattctgcctagcgaccataaataccgatctccccctgtggaagtatcagttggtctgtgccgtcatgacatagggatcgtgcccacaagacacccagtggacccggaggagcccaatagggccctggggtttccagctctggttacgggcctctgtcagtcctacatgggatcgcgcccgcaagacacccagtggacacgaagaagtccaacagggtcttggggtttccagctctcatcacgagcctctgccagttctacgaagtgcccgtcgcccccagcaaggtcatcaggccccctactaatcgagatttcatcaacaagtactgtgcccccaagcaggcgcaaggatagacaccacaaaagcctggggatggccggcagcgggcaacagacacaccgccgccacctccagagcctctcagctcatctacaaaagctgaagcgttgcctacaacccgtggtcgaccagcaggcgaccaagtccaaagccaaagataagcaaaagtactag

SEQ ID NO: 68266 - DNA, 231 bp, Glycine max
  Peptide Sequence Number=SeqID_159951
atggcagcagaatggagaaggaagagagagaggagacaccacttcaaggagaagatgagtctagaagaagctcaccaccataggaggccatggataagagtttggaggaagaaggagatgaatgaagggagaggaagagaagagcacgaaattttgtgctctaaaagagctctgaaatatgaactcactaatccaagatcaattccaagattctccactaagtgtccttag

SEQ ID NO: 68267 - DNA, 156 bp, Glycine max
  Peptide Sequence Number=SeqID_159952
atcagtttagggcctgaggtcgcatggcctggagattggcccgaggaccagacggaagaggcacctgcagtagctcccgacgatgcagaggacgcccacatggatgaggagatgacagacttgctcagcttcttgggaggaagcggagccacgtga

SEQ ID NO: 68268 - DNA, 297 bp, Glycine max
  Peptide Sequence Number=SeqID_159953
atggccacaatgatggaggccatgatgagcatgaagaagataatggaggtcaatgcggttgcagttgctgctaccagtgccgttgctgaggtggacccgactcccccatctggcctcaaccaaataaatcacgccgtcttggatatggtagggaagagaggcaaagaattgggaagtacgggtggcccccattttgcctctgcacccatacccattgagagccaacaaccccaggctgatcctggacatgtctctcaacccatgggggagaaatatgaaataccccatcacgaataa

SEQ ID NO: 68269 - DNA, 207 bp, Glycine max
  Peptide Sequence Number=SeqID_159954
atgttggggaagcttgggaggattggtggggacccggtgttgagaggaacgaggatatgggagtacgtgagctcagttggaggtgggcaacaggggatgagtggtacctggagatatgtcgcaggggtcagaagaccttggggacgtcaggtggggtgctattgcccaaaaccaagcttgaccaatcccgacccaacccgggcatag

SEQ ID NO: 68270 - DNA, 810 bp, Glycine max
  Peptide Sequence Number=SeqID_159955
atgtgctgcgcgcgcggggctatcagccgtttatcgatctgctgcgcgccaatatgcgcgattgcgggggcgctgcgcatcgatcacgtgatggcgctactgcgtttgtggtggattccctatggcgaaggtgccgacaaaggcgcgtatgttgcctatccggtgcacgacctgctggcgatccttgcgctggagagtcagcgtcagcgctgtatggtgatcggtgaagatctcggcaccgtgccgcaggagatcgtcagcctgctgcgcgaccgcggcattttttcgtggaaggtgctgatgttcgagtgcggggaggaggggcagttccggccaccggcagcctatccgcgccagtcgattgccagtgccagtacccatgatttaccgacgctgagtggattctggcatgccgccgatctgcaattgcgcgagcagctggggctgtttactaaacgcagcatgctgaaggcggccatcgcggaccgcgatcggcagagaaccgcgttgctgaacgccctgagcgaggcgcaagccattgatgcgcgcagcaaaaatcgcgccggccagcgtctgacgcctgcgctgaatcagggcgtgcaccgctttctggcgtttaccgacagcgccctgctagggctgcagccggaggactggctgggaatggagacgccggtcaacgtgccgggcacggtagccgaataccccaactggcggcgcaaactgcgcgtaccattggagaagttgtttagttaccggaaagtgcagcggctgctggcgatcgtcaatgaagggcgtaagaagccgtaa

SEQ ID NO: 68271 - DNA, 410 bp, Glycine max
  Peptide Sequence Number=SeqID_159956
ccctgggatttcccgccttgatcacaggactctaccagtcgttcggcgtccccgtcgcacctagcaaggtgattcggccgcccatcacccgagcttttattgagaagtactgcacgcagagacaggtccaaggtgatgcaccacaagccgcggacgcgccgccacctcatcaggctggtccagtcggatcgtttgatacggagcagtatttgcggcatttgatgagtctcagcctgcagagccagggatttacttcttttccgtgccctactccggaccagttcagggcaaaggcaggagaggcaccagcagaggcaccagcagaggctcccgacgaggcagatgaggcccgcgacgacgaggagatgaccgatttacttgatttcttaggagggagcggggccacatga

SEQ ID NO: 68272 - DNA, 599 bp, Glycine max
  Peptide Sequence Number=SeqID_159957
cgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaaagggtcgtcgatgggtccagaactgaccggctcgcacgtgattggtctcgagcgtggctcatccaccattttatcacggcgaagtcggccatgaacccagatttcaaccaaccacgaggcgggtgctcgcggaggttcagcatacaccccgcgcagcaacattgttacatgtttgcgttggggaaacgatgtgtgacacccaggcaggcgtgccctcggcctaatggcttcgggcgcaacttgcgttcaaaagactcgatggttcacggggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 68273 - DNA, 402 bp, Glycine max
  Peptide Sequence Number=SeqID_159958
aggactacacgtcctcacattcagaggctacaagccctcgcctttagaggactacacgtcctcaccttcagaggactatacgccctcgcctttagagggttgctcgccttcgcctttagaggactacacgtcctcaccttcagagggcaacacgtgctcgcctttagaggactatacatcctcaccttcagagggctacacgccttcacattcagaggactacacgtcttcgccttgaggactacacgtcctcaccttcagagggctactcgccctcaccttcagaggactacacttccttaccatgaggactacacatcctcaccttcagaggactacacatcctcaccttcagaggactacacgtcttcacctttagaagactacatgtcctcgccttga

SEQ ID NO: 68274 - DNA, 483 bp, Glycine max
  Peptide Sequence Number=SeqID_159959
atgtctaagcatcctcctcatctatcatatggaaaacaagggaatcagagagagcaacaacttctccagatagggaatcagagagatcagcagcttgtccatctgggggaatcagggggagcaacaacttctctagatggggaatcagtgatgataataatatttggagatgggggaactgcttcaagcttaggagaacatggattcgccactggagattatgggttagctggcactggttcaacccgtgcaggtgtgggctcaggaggagcagcctcgttgggtctcaccgttgaaggtagagctccaggccatgctacttgcttaaggaactgctccatagttctaattggcctttgcatagggactaaggtttgggagctctggacatccggtcctattgttgctgccggaggagctggagttgatggtgaagggatgtcatctgctctggccctttttctcgatgccatctataaataa

SEQ ID NO: 68275 - DNA, 400 bp, Glycine max
  Peptide Sequence Number=SeqID_159960
cagcttcgtcttctccgcgagaactccttgctgcaggccgccgttcgtgacagatgcgtcgctgccggagctcgtcgccgccgtttgtgccggtgcgtcgctgccggaggtcatcgcggctgcgtgcgcggacgccattttccgccaccccgccataaccgccacgatcgccatggctatggcggtcgccatggcgccgccatcccaaacccgccacgccaccgctattcggtggcgttttttcgaaaaaccgccatggccgtcatttaacaacactgctctgatccactgtaaccatttgggagattgtgggtctttcaccttggggattagggcaatgaatgaagcattgcagccctttggaaagatgccgttgacatggaattcgtcaaggaaccag

SEQ ID NO: 68276 - DNA, 172 bp, Glycine max
  Peptide Sequence Number=SeqID_159961
atggccaagtttgatccggatatagttctagagttttccgctaatgcttggcccacggaggagggcgtgctggacatgcggtcatgggtaagaggccagtggattccttttgatgcagacgcccttagccagttcctgggagaccccctagtgttagaggagggccaagaat

SEQ ID NO: 68277 - DNA, 66 bp, Glycine max
  Peptide Sequence Number=SeqID_159962
atccaacagatttcgggtccatgggctatgtacgagcccacttatctttgtaaatattacattaag

SEQ ID NO: 68278 - DNA, 877 bp, Glycine max
  Peptide Sequence Number=SeqID_159963
gatcccactccgaggactacatgtcctcaccttcagaggactacacgtcctcgccttcagagggctacatgccctcgcctacagaggactacacgtcctcgcctttagagggctacacgccctcaccatcagagggttgcacgcccttgccttcagagggttgcatgtcctcgccttcagagggctgcatgccctcgcctttagagggctgcacgcccttacctctagaggactacacgtcctcgcgtttagaggacaacatgtcctcgccatcagaggattacatgtcctcaccatcagaggactgcacgccttcagaggactacatgtcctcgcctttagaggactacatgtccttgccttcagagggctacacaccctcaccatcagatggctacacgtcctcgccctcgtagggctacacgccctcacccttagaggactacacgtcctcacttttagagggtggcacgtcctcgccttcggagggctgcacactcccttgcctttagagggctacgctagtttccttttatcagttcctgggccaccccctgatcctggaggagggccaactatgcaagtacaaccagaggaggaggctatcgtgcagctactatgcataccggggcaagatttcacccgtgccgctgcaaagagacgagtgtggatcatgcgcaccaacatgaccactattacacagatatggatgacgttgctacttagcaacattctgcccagcgaccgtaatgtcaatctcccattgcggaagtatcaacacccagtggacccggagaaatccaacagggccttagggtctccagctttggttacgggcctctatcagtcctacagggtgcccgttccccccagcaag

SEQ ID NO: 68279 - DNA, 294 bp, Glycine max
  Peptide Sequence Number=SeqID_159964
atgggcctgaaatctaccctaaggctcatgagaaccctagggccttctcttgcatctctggcccaatcttcttggagtcttctatccaatgcccttgcagtaaggtgtcggaacctacccttcggtaggagggcgacgcggggctcacgggtgcgtcttccatgggaggaaaatgcgtggagtcgccaccaacttttattcgaggaaaacgtcggaaaaattggaaaggtttggtctacgaactttaagcgtgaaaggttcgggagttgtttttacgcacggggaaggtattag

SEQ ID NO: 68280 - DNA, 174 bp, Glycine max
  Peptide Sequence Number=SeqID_159965
atgccgatctccccctgtggaagtatcagttggtctgtgtcgtcccgacatagggatcgcgaccacaaggcacccagtggacccgaaggagccatggggtttccagctcgggttacgggcctctatcagtcctacagggtgtccgtgccccccaacaaggtcatgccatcatga

SEQ ID NO: 68281 - DNA, 152 bp, Glycine max
  Peptide Sequence Number=SeqID_159966
atggggttttggggagatatgatgggtaatcttggtttttgtgatgatgtttgtgatgtttatatgctgaaattgctgatggagtctgttagagatgaagggtgtaaatccagtttgaacaagtctaaacagatgttatggactggtgtgag

SEQ ID NO: 68282 - DNA, 182 bp, Glycine max
  Peptide Sequence Number=SeqID_159967
ttgagccggttcaagtgatagaggtgtcatcctctgaagaggatcttgaagaggacctagaggagttacctcctgaacctattgtggatgcccttgacttcgcagaggatgatgaggacccactccctgatgttgattctccagaggatattatgtcagcatctgaggtagattctacatag

SEQ ID NO: 68283 - DNA, 216 bp, Glycine max
  Peptide Sequence Number=SeqID_159968
atgagggtgactgggtttggctccatcttaggaaggatagattccctactgtcataccctaatttcgtctgggagtacttacggggggtgcaaatagcaaccaaacccgcttgggccttcctaagggttccaaaagaaggcggtgccttctggtggaagcaaccctgctcacctgggcgagctgggcgacaaccacctccctcttttctcctataa

SEQ ID NO: 68284 - DNA, 482 bp, Glycine max
  Peptide Sequence Number=SeqID_159969
cccaacatttcattggagacccatccttgtggaaatataggtctgcaaaattattatcaaaccttaagtatagaaccttagcagattataggtggtacaaagatactttcctaactagggtcttcacaagagaagatagtcaacaacctttttggaaagaaaaatttctagccggtcttccaagatcattaggagataagactaaagaagaagttaagaaacttaacttagaaccagctattgaagagcaaataaacaatttgctcatagaaacctcggaggaagaaacagaaacttcatccttcgtgctctccgacgaaaatctaaacataatccaacaagatgaccaattatcatcaaccgatgatgatggaaaaatcaatactttaacaagagaagaagatctcttgtttgaggcaatcaattctataccagatcagcaagaaaagaaggttttcaggaaaaactcaagaaaacattag

SEQ ID NO: 68285 - DNA, 228 bp, Glycine max
  Peptide Sequence Number=SeqID_159970
atgagggacggcaagaggtcttcgtacgtcattgggagtggggtgaattctggaattgacctcgggggaaagttcctcgtgttggaatcggcgccaaagtgggcattgtcgatcgggcgagtcgtggctgtacgggtgctgaattggaggagttctcggtgcgagcttaaaagctcggatgatgttgcgcatactgatgcgtaccatgagaggtctgcgggggcttga

SEQ ID NO: 68286 - DNA, 273 bp, Glycine max
  Peptide Sequence Number=SeqID_159971
atggaaggcataataatattaatgatgtttcaggttgttgtttctgctcaagaccatattatgtgcattcagactgagagggaagcactcctccaattcaaggctgcacttctggatccctatggcatgctctcttcttggaccacttctgattgctgccaatggcaagggattcgctgcactaacctcaccgcccatgttctaatgctcgaccttcacggtgggttcaatccctcgtcaacttggaaatctctcccagttgcagcatcttga

SEQ ID NO: 68287 - DNA, 144 bp, Glycine max
  Peptide Sequence Number=SeqID_159972
atgccggtgtcggctgaaacaaattcggttgtgctcgaacgaaaaaacctagccgaccttcatagaaatgttcgatcggcgtcatccggtgatgcttcttttttaaacctcgatcggtcatctttcctgaccgacgtcggctag

SEQ ID NO: 68288 - DNA, 186 bp, Glycine max
  Peptide Sequence Number=SeqID_159973
atgaaaagaaatgttaaagtttccctaacgtatgtgctgattggaccgacaaaagaaagtgacagaagtactttgaagaagaaacttccgattaggagttctgacaaactgggccccatcccacgacaagttgcaccaaaccaaaatcaaggattcgtgatcccaaataaggattttgaattctaa

SEQ ID NO: 68289 - DNA, 297 bp, Glycine max
  Peptide Sequence Number=SeqID_159974
atgggtgaaggggacgacatcgaagagcttgcggaggagagcggagttgttgaggtcggcgtcgacgacgaagacgtcggcacggtcaaggaggcactggcgggcgcgcttgagggaggggtcgtggtagcagttgaagttgttgaggccgaggatgtcgtcgccgcgatgcttgagggagagggagacagggagtcgacgaagacggcaatgtcggtaacaaggacggagaggctggaaggagaggagctacggctagacttggcgatgtgcttctcccagtgggagccgctctag

SEQ ID NO: 68290 - DNA, 1032 bp, Glycine max
  Peptide Sequence Number=SeqID_159975
atggaggtgatgggtagtcgttggacgacaatggtgctaattatgtcagtggcgatggtgcagtgtggtgtgatgagtattgacatagataaagtgatgaggcaatacccagagtacagcagattcagcaagtacctgagccaaacgcagttggccagagcaatatgcgggaggccaagcgtaacggtgctggcagtggataacaccgccatgggtcctctggaggggaaaccagtggaccacatcaagaacatcttgagagtccacgtggcactccaatatcttgaccttgacctgcaggacaagcaaaccatcgccctccccacactgtctcagggagtgctcttgaagatcaacaagggcgccgtcacctttgtctctgctactcatccaaacgccgtcgtccgcgccagattgatcaaacccatcatcgtctctcaatcccacaataatatctcagttgtccaagtaaacagcctcataatcccccccaccaatcccaatgctctaatccccctaataccacccgtgcctcttctaacacctgttccggtcatctcccctctgcctataatcacaccggttccggttgtacctcctgctcttccaatcaattccccggcgccagtagtatcgccggtgcttccggtgaatccccctgcgccagtaatggcaccaacagtgccagttctaacaccggttccggtcatctcccctctgcctataatcacacctgttccggttgtaccaccttctcttcccatcaatcccccggcgccagtagtatcgccggtgcttccgatgaatccccctgcgcccgtgcctgtagttcctgttccagtagatgggggggtttccactactcctggcgcagatgaacctaaccaagaagaagaagagaagaatcatgatgctggcaatgggaagataaaaggaggattgagtatggttggaccatacaaagatcctccagaagggaaactgcttgcgcttatggtggttttctataacttcaccttcggttctctgtag

SEQ ID NO: 68291 - DNA, 1296 bp, Glycine max
  Peptide Sequence Number=SeqID_159976
atgggaccgaatccgaataaacgggttgaagttgaacaggaaaatcggtggacgggtgaagtgaagatgcctgcggatgttgatcaatgtgaagcaatccaccatggttcggccggcggaggagacgccgcggagggcgttgtggaactccaacgtggatttggtggtgccgaacttccacacgccgagcgtgtgatgaaggaggctctgagcaaggtcttggtccctttctacccaatggccgcacgcctccgccgggacgacgacgggcgcgtggagatatactgcgacgctcagggcgtgctcttcgtggaggctgagaccactgccgccatcgaggacttcggcgacttctctcccaccctggagctccggcagctcatcccctccgtggattattctgccggggtctcattaggtgttggtatgcaacaccatgtagcagacggagcatctggtcttcactttatcaatgcatggtcagatgttgctcgtggcttggatatttccctccccccattcattgacaggacactactccgtgcccgggatccacctcttcctgtttttgatcacattgaatacaagcccccaccagccactaagaagactactcccctgcaaccctcaaaaccattaggctctgacagtactgctgttgccgtctctactttcaaattgacccgtgaccaactgagcaccctcaagggtaagtccagagaagatggcaacacaatcagctacagctcttatgagatgttggctggccatgtatggagaagtgtctgtaaggcaagagcacttcctgatgaccaagaaaccaaattgtacattgcaaccgatggacgggcgaggctgcaacctcccctcccccatggttactttggcaatgtcatcttcaccaccactcgcatagcagtggctggtgatctcatgtcaaaaccaacatggtatgctgctagcagaatccacgacgcattaatacgaatggacaatgaatatttgagatcggctcttgactatctagagctgcagcctgatctaaaatcccttgttcgtggagcacatacttttagatgtccaaatcttggtatcactagctgggcaaggcttccaatccatgatgctgactttggttggggaagacccattttcatgggacctggtgggattgcatacgaggggctatctttcataatcccaagctcaacaaatgatgggagcctgtcgttggcaattgctctgccgcctgagcaaatgaaagtgtttcaggaattgttttatgatgacatttga

SEQ ID NO: 68292 - DNA, 858 bp, Glycine max
  Peptide Sequence Number=SeqID_159977
atgggttccgttctagaggacaagatagaccgtcatagttttcacgaccaccacgacgccgacgatactcccttagcatcttcctcttctaaagtcctccaacaattacacagcttcgattttgaggacacaagcgttgtagatttgcggagctcatccatctttaacacaacacgtatcagcaggagtatatacgtcgtcttaattaaagccaagatcaacctcttgcttccctttggtccattggccattctcctacattatctaactggacaccatggatgggtctttttcttcaccttattggggattactcctttggcagaacgcctcggttatgctaccgagcagcttgccttctacacaggacccacagttgggggtctgcttaatgccacattcggcaatgcaactgaaatgattatatcaatttatgcattggaaagcaatatgataagggttgttcagcaatctttactcggttcaatcttgtcaaatatgcttctagttcttggctgtgcattctttactggtggcattgtccactacaaaaaagtgcaggtttttgataagacttcacattgtagtccgcctttgcaacaggcagctgctgttgtcaattctgggttactcttgatggctgtaatgggaatactatttcctgctgtgctttactttactcactccgaagttcatcaagggaagtcagtcttatctctttcaagatttagcagctgcataatgctactggcctatgcaagctaccttttctttcaacttagaagtcagcaaaatgtttatagtccagttgacgagggctcatttagtggccaggataactatcttatcctcctgtaa

SEQ ID NO: 68293 - DNA, 471 bp, Glycine max
  Peptide Sequence Number=SeqID_159978
atgcaattagcgtcaaatggtgacaaggaagaatgttcagaaagcgaacccatcttgaatcatcaccatcttcatttgcaaccaaccggagaatcctccttttcctgtgaaattatccctattcctcctgctgcagctacttttaacgatgatgatttacaaaacgtccgggttgatgagacttgtcatctcgtaaatgcagatcagccacaatgccgaatatgcctcgatattggaggagaagatttaattgccccatgccattgcaaaggtacacaaaagtacgtccacagatcatgtctcgataattggagatccaccaaggtgtttggtgaatttatgattctgcaatacttactgacttctcatttcttctgttgtactaggagggtttcgctttttctcactgtacagagtgcagagctgtcttcatattacgtgcaaatgtcccaccagatcggtggtggttga

SEQ ID NO: 68294 - DNA, 192 bp, Glycine max
  Peptide Sequence Number=SeqID_159979
atggttaggattagaggcctaggccgtgccttaggtaggcgaaggccgaccgcattcgtacgcaggcaacgagtacctgtcactgttgcgaacgctgagccagtggtacctgcggttgaggctgacgtagttgcggatgagccgatggtagaagctgacgtacaagacattggtgcagacaccggtgcatag

SEQ ID NO: 68295 - DNA, 633 bp, Glycine max
  Peptide Sequence Number=SeqID_159980
atggttggacatgtttttaaagttaccttatacaaaaggctactttgcatgatatcaaggtatgctttaaatcagattgttgctgagtatgagcatgtacattatcctgacaaaaatccttctcgttgtggatttgttatgagaactactcacggtcttccatgtgcatgtgagctatccaaatatgttcttgagcttgatgtttgtggcaaagcaattctaaagagtaaactctgggaaattatctaccctgatctaaattctatgggtcctcctccagaaaaggtcaacaccaaagtcaaacgtagtgcatcatcttctgaccagggcattccaagaaggactatgcagatgttggatcaatttcatctgttctttcacgattccattgaaaacattgttaatgtaaaagctgacggaattaaagatttgaggaatatcaacctctttggtagcattgacagatttgaggaattaaagagatccctagttgatgaattattcatggttactatggataagtggatggatataaccgacatgagatatgtcattgcatcaaagtataatgttatccttggtgaaggaaccagcttgcctgggcgagctgatgactttaggactaagccttag

SEQ ID NO: 68296 - DNA, 195 bp, Glycine max
  Peptide Sequence Number=SeqID_159981
atggagacgaaagaagggaaagagagaggaggaagtagtgggagaaaactaagaagcttaggcttgttgaggcggaatgagagtagcagtaatggcgataatggtggtggtggtgacgatagtggtggcaacgatggtgacggtggtggtgatggtgataataatagttgtctgatggtcgtgatgacagtatga

SEQ ID NO: 68297 - DNA, 336 bp, Glycine max
  Peptide Sequence Number=SeqID_159982
atgttgtcccaactttcccaacacactttttttattctcctcacaacccaacaagaagtttctttggatatcgatgatagccttacccacactcataggaaccttaaagaaagaaagaaaaaacaaaggctagcagttggtgtctcgataagcgaggcttgtgcgcttagcgagaatcatgcgctaagcgagacactcagcccgcttagcaagttggtagaatatgagaagcatctgtgcgctcagtgcatcatcagctcgctcaacgagacatttgtctcttcctgcgctaagcgcgcccagctcgctcagcgaacattcacttactcacgctaa

SEQ ID NO: 68298 - DNA, 249 bp, Glycine max
  Peptide Sequence Number=SeqID_159983
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaggagctctgaaatctgaacccactaaatccaagatcaattacaagattcctccactaagtgtgcttaggtgtcatgaggcttga

SEQ ID NO: 68299 - DNA, 279 bp, Glycine max
  Peptide Sequence Number=SeqID_159984
atgtccgagagaaaaaggagacagctaatggcagagagattcatagcgctttcagctattatacctggcttgaagaagatagacaaggcctctgtactgagtgaagctattaattacgtgaaacaacttaaaggacgcatagctgtgctggagcaagagagtagcaacaagaagtcgatgatgatctttactaagaagtgcctccaatctcatcctcattgtgaaaaaaactctaatcacgtgctccctcaacctccaagtcgaagcaataggtcctag

SEQ ID NO: 68300 - DNA, 630 bp, Glycine max
  Peptide Sequence Number=SeqID_159985
atggccgacgactccctggtcgtcgaccttctcctccgcctccaccgctctccgcctccgccgccctgcctcaacctccactggacggtgcgtcagcgccgctccagatccgctcacaacaaagcggagtccaccagggccagccccaccacgccgctctcatggagcggcgccacgtcagcaagcggcggcaacctcgatggctacgaggagtccaaaccatcccagacctcaagatctaagcctgtgcctgtgcatgtggtgtggtgtggtcttggtgatagttgttggtattcgcgaggggtagattctccgccaggggaactggcatccttgcgtctcactattcagaaacatagagccacaaatgaaagcataaagagattgaagaattctagtgctgctgctacggcctctgaggtgtctgggaaagctgtgaatggcccatttcaatttgtaaaatcagagtgtcatccatctaattccgtcacacatgacgattcacctgtttgtgcagcaaatgcttctcccaaagcacaagataatattggtaaccgagaatctacattcgtgctccctgatctaaatttgcctgccgatgaggatatcaacgccaatgtcatgcattga

SEQ ID NO: 68301 - DNA, 645 bp, Glycine max
  Peptide Sequence Number=SeqID_159986
atgaagaatacacccaggataggaaaagggagaactcagggatatatatggacaacaacgaggaaataccctcaacacctactttttggtggcttcattaataataataataggaattgcaagaagtccctcctgaagagttgtaggtgtttcagtgtggaggaatggagcttagaagatggaggtttaccggcggtgtcatgctcattggcactgccacctcctccaccaggggtccctcttgcaagaaaggttggagctgagttcatagggaccttcattctcatgttcacaggcactgccgctgccattgtcaaccaaaagacaaatggctctgagacccttattggatgtgctgccaccactggcctcgccgtcatgattgtcatctttcgccaccggccacatctccgctgctcatctcaaccctgctatcaccattcccttagctgcattaaagcacttcccttggaagcatgtgcccatggggtttatcaccctttcatgcgtggtggagtcaccgttccttccggaggatatggccaagcttttgctttggagttcattattgccttcaacctcatgttcgttgccaccgacaccagagctgacttgggtttttggaggagatacaaaaaacagtga

SEQ ID NO: 68302 - DNA, 539 bp, Glycine max
  Peptide Sequence Number=SeqID_159987
aaatcgacggcgctgatgagttgctgaaagtactttctggcgacgtcttccttcatcttcccctttgcaaccttggcgaagagttcacctcctttgacgtattcgacaaccaggaagattttggccttgctcatgacggagacctcgcgtttgatctgtttgacgagcctctctttctgctgaagcctctctttttttatgactttgatggccacgctctcatttgtgctgaggtttctgccgtggtacaccttggcgaagttgccctgtcccagcaatttccctatctcgtacttgttgaagaggatgttacgggtgctgcccgtgcgccggtccatgtcggggctggggtgggagagacccagatcgaagggcttcatccttttaatgatgaggagggtgtcggaaggacacaccacgttctggagaaagcatttggagggattgaaaatcttcatggttgcatgcagggggagacaaggaaaagaaagggtctccctttgatcttatgcttgactcggaagggtgccagtgaatga

SEQ ID NO: 68303 - DNA, 87 bp, Glycine max
  Peptide Sequence Number=SeqID_159988
atgattcatgaagatgatgacaaaggtgatgacaaaaagctcaaaggtcaatcaaagaatgagttcaagattcaagaggaaagttga

SEQ ID NO: 68304 - DNA, 741 bp, Glycine max
  Peptide Sequence Number=SeqID_159989
atgagtctcattccgcatgtaaatatattttccatgcctgaggttcacactccccagaaaatcagcatgcaacagggacaggcagatattctcatatctaggttccctgaccctaactatggtgtcaaaatggtaaattttataataactcccctcacctatcgtgagctctctatcagttcttatttgcgtcacttagaggtctctctctcgtttgagcttgttggtccaacgcaagtctctattatgccaaaacgaatggaatttagcataggcttcaaaaacaagattaaaggcaacattcagggtcaaataccattgtcaaaacataagggactgaggggtattcataagggactgaggggtattttgggttctacagaaaagaaacatctttttgaaattccgatcacgccaatgcgaccggggttcagtgaatgccgcaaaaacaacctcaaggacgtatttataaccttcaactttcacatagcaggccttctgggtactcagcgcacttcctctcggttggaaatgggcttagcgcagctttgggccgctcagcgcaattcccctcgattggaattgcgcttagtgcgccctcttgcttatcgggagaacaaaagttattatttacaagatcccaacggtcaaactgtcgaaacatatcttagggataaccagacaaaatttgaagactatccaatggttaacgaatccgatataatgatttcattgaactag

SEQ ID NO: 68305 - DNA, 345 bp, Glycine max
  Peptide Sequence Number=SeqID_159990
atggatgaacgaattagacagatcgctgagataggtgcctcactgattaagcattgcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataa

SEQ ID NO: 68306 - DNA, 339 bp, Glycine max
  Peptide Sequence Number=SeqID_159991
atggctagacaatggcttctcatgacacatgataggggaaaggaatggtatttgtcataccctaatttcgtccggggacctttgcttggtggcatgcaacttttgtttgaccattttgaggttgaagggggctgttttaagggtcctataaataggtcgttcttgactggcgatatccccctagtggagtcgccaactgtcgcaacgtgccctttgcgggcgaccgagggtgaggctcacgggtgcgctttccaaaggaggaaagatgcgcaaagtcgccaccaacgtttatttgtggaaaacgtcggaaaaaccgaaggaaaccggtcaaaacgataa

SEQ ID NO: 68307 - DNA, 237 bp, Glycine max
  Peptide Sequence Number=SeqID_159992
atgacaaggagtaaaaggtttgtggtggctgaggatgaggatagtgttgtgcataagaagaaaattgttgacaagaaagatactgatggcaagaaaagtgaggtgataggtgaaagtgtggaagtaccatatcatgtggtaccttccaagaaagaaaaagatcgtcatttggcgaggtttttagatattttcaggaaactggaaataactatgccctttggagaagctttgcagtag

SEQ ID NO: 68308 - DNA, 375 bp, Glycine max
  Peptide Sequence Number=SeqID_159993
atggtggggtacacaccttcaagctttgcggatttggtcttcgccggggaaagggtcgaagcggatttgaaaagaggcaaatttaatcattctgctttgatgaatgagaaaactggggcaaataaagaggatgagaaagagggagaaacccatgctgtgactgccattcctatacggccaagttccccaccagctcaacaccaacattactcggccaatatcagccattctcattacccaccacctatttatccacaaaggccatccctaaatcaaccacaaaacccacctaccacacaaccaatgctaaacaccacctttagcacaaaccaaaacaccaaccaagaaatgaattttgcagggaaaagcctgtag

SEQ ID NO: 68309 - DNA, 321 bp, Glycine max
  Peptide Sequence Number=SeqID_159994
atggtgggttacacaccttcaagttttacagatttggtcttcgccaacaaaaggatcgaagtgggtctgaaaagagtcaaatttaatcatcctgctttgaggaatgagaaaactggggcaaatgaagaggatgagaaggagggagaaacccatgttgtgactgccattcctatacggccaagtttcccaccaacccaacaatgtcattacttagccaataacagcccttctccttccccaccacccagttatccacaaaggccatccctaaatcaaccacaaagcccacctaccacaaccaatgctaaacaccacctttag

SEQ ID NO: 68310 - DNA, 384 bp, Glycine max
  Peptide Sequence Number=SeqID_159995
atggcggaaccatcacagaagcgaaaggacacttcgagtcggagtcaacggcattctgggtcacaggaaccgccgattccttcctccattccctctagatcattgttttcatctgaggaacaacggatacggtacacaaacctcttttcgtctcattccattattgacccaaaattcattgatatggatttcttttcaaatgagagttttgaatgctttcaagcatttgaaaactccaatcttattccattcatgtctttaaaatttcctgtttattctgatttagtcaaaactttctattcaaacttagaaatccaagaaggcaccctaatgtctcaagtttatggaattaaaatggtcattgaccaatccctattcttttaa

SEQ ID NO: 68311 - DNA, 321 bp, Glycine max
  Peptide Sequence Number=SeqID_159996
atggcaccacatagagctgaagatttagtatttgttcatagcaacctacgacttctctcaaggaatactccacaatatcatcaagagaaaactaaaatgtgggatgtagctggagatgattttgggtcacttgatgattgtggtattcttgaaattgctagtttgtctttagatgaactagagttagaggccatgtccgtgtcctacattttcaacatttcaggtgtccacatgtccatgtccgtgtcgtatccggtgtctgtgtccgtgtcggtgcttcatagcatgagacagacacatcacaaaggtaggaagcagtaa

SEQ ID NO: 68312 - DNA, 810 bp, Glycine max
  Peptide Sequence Number=SeqID_159997
atgcgcggcagcagaaactgcgcgccgttcagcgacagcagctgcagcgaatacaccgccgttacgatagctggcgagcgtgatgaccagcatggtcagcagggcaatcgactccggaacagcaaagcgcagcgacgccgcggcgatcagcaagccggcgaaggtgccgagcgcgcggtgctgaatgcgcacgcgcgtggcgctgtagccgttctggctgacaaacatgatggtcatcagaatccagtagggcttgggaatattgaagaacagcgccagcgcgctgccgaacatcagcatcacgcgcaaagcgcgccgccgtccgcagcgcggcagattttagcgacaggtagctgcgcagcgccggcaacagcggcaggcggcgctggcgatcggccatcaggcagaaattaccgaccggattatccgggtgctgccgggcaattttctccagcgcgccgagcggcttctccatgtggaagcgttccggcagctggtgatagagaatggcatcggccagcacgcgcagccgctgaccgagatatgctcctgcagatcgagcgcgacctggaaagcgcgcgtcaggcgtttatggctgttatcacggctggcggacagcatatgcatctggtgggtgtattaggcgtcgcagtaatcggccagctcgcggtacagcaggctgagggtctcgcgcatcggctgctctttccacagccagaaccagaaccagttaaacagcccgtaccacagcgtcccgccgatatacagcagcggcgggacccacatcggcatacggccgacgaggcttaa

SEQ ID NO: 68313 - DNA, 1251 bp, Glycine max
  Peptide Sequence Number=SeqID_159998
atgcataaaaaatcatgcaatggcaaacggaagttacgtattgaggaaattcgccagcagctgatgcccctgctcgctgagaatgctctccggatggaactgcacgccctcgagcggcagcgtacgatggcggaagcccatgatctcatcggcaacgccgtcgcgcaggctccaggcggttgcggaacacgccctggccggtgtgctgcaccgcagaggttttgccatgcatcaccttgcgcgcgcgcaccacctgcgcaccgtaggcctgggcgatggcctgatggcccaggcataccccgagaaccggcaaccgtccggcaaagtggcgaatggcttcgagcgaaatgccggactgatccggcgtgcaggggcccggcgagatcaccagatgactcagcggcagcgccgtcatctcttccagcgtcatcgcatcgttgcgcaccacgcgcacctgcgcgcccagttcacagaagtactggtagatattccagtaaaaccgccgctattctacgcattttaacgcgccggactcaccactttcgcaaactgcgcattgagcggcgcgagatcgccgccaacgccagcgatgatggcctggtgccagctttcaggctccagcttatcccagttcagcagatagcccgcgtgcagcgccagctgttcgaaaaagatgcgctgtgcccgcccgttaccggcacggaacggatgcaggacgtagatttcacagtagtaatgcgcgatgcgtgccacgaaggtctgcgggtcgaggtcgcacaggccctcttcctcctccagtgcgctcatcagcgcattgccctcgttctcgatatactcgcaatggcaatagggcgtgtcgtcgcgccagatgtcgatggtacgcagttcgccggcccagctgtagatatcctgaaacagcgtgcggtgaatatggcgcaggtgcggcaggccaggcgtggccggtccgagcgccagcgtggccagccgcgccgcgctgaatgccagctcggctttacgcagttgcgccacgtcgtgaatttccagcaggtttttcagcacgtcatcgttgtgccacaaatagggatcgcgcaccgccaggctgttatccgccatattgcctcctcagcgaggccagacgatcgtccgcctgggcgctctcgacggcaggttcattcagcgtgtaaccggccagtttgcagctggcctgataattggccgcacggcgcctccggcaagcaggatgtgccctaa

SEQ ID NO: 68314 - DNA, 1179 bp, Glycine max
  Peptide Sequence Number=SeqID_159999
atgacaaaccgtaatcgtattggccttacctggatcagctttttctcctatgcgctcaccggcgcactggtgatcgttaccggtatggtgctggataatattgcccagtatttccagctgcccatctccgagatgagcaacaccttcactttcctaaacgccggtattctggcggcggtgttcctgaacgcctggctgatggtgattgtgccactcaagcgccagctgatctttggctttgtgctgatgatcctcgccgtggccgggctgatgaccagccataacctcacggtgttctcgctgtgcatgttcgtgctcggcgtggtcagcggtatcaccatgtcgatcggcaccttcctgattacccatctgtacgatggtcgccagcgcggttcccgtctgctgtttaccgactcgttctttagcatggccggcaccatcttcccgattatcgcgggcattctgctggcgcgcgcgctgccgtggtactgggtttacgcctgcattggcgtgatctacgtggcgatcttcatcctgacgctgatggtcgagttcccggtgctgaagagcgaagccgcggtgcagggcggcgaaaaagagaagtggggcatcggcgtgctgttcctgtcgatcgcggcactgtgctacatcctcggccagctcggcttcatctcctgggtgccggaatacgccaccaaatcgatgggcatggatatcgccgctgccggtcagctggtcggtaacttctggaccgcctatatggtcggcatgtgggcgttcagcttcctgctgcgcttcttcgacctgcaacgcattctggtggtgctggcgctgctggccaccggcctgatgttctggttcgtgaaaaccaccgatgccagcatgctgcactggatcattatgtcgcttggcttcttctccagcgccatttacaccaccatcatcacgctgggctcgctgcagaccaaagcgtcatcgccgaagctggtgaacttcatcctcacctgcggcaccgtcggcaccatgctgaccttcgtggtcaccggcccgatcgtggcgaaaggcggtgcccacgcggcgctgtccaccgcgaacgcgctgtacgcggtggtgttcgtgatgtgtgtgctgctcggctttgtcaccaaacatcgccagcacgctcaccagaccgcctga

SEQ ID NO: 68315 - DNA, 285 bp, Glycine max
  Peptide Sequence Number=SeqID_160000
atgggcgcgcgcgtggcgtttaaacccaatgcgattagctggacgcgcggtactgccgaacgcggcatcaatccggcgaccgacaattgccagggcaaaccgcgcctgagtgccgccagcggggccggacaggatcgtgatttcagctttcgctatggcttcaacgtgcactgtggcaatcaggcgtggggaccggcaccgggcgcggtactgagcgtgctggccgacggcaacgcgcggctattctgggatggcgcagagctgacgctgcatcgggtgaagtaa

SEQ ID NO: 68316 - DNA, 196 bp, Glycine max
  Peptide Sequence Number=SeqID_160001
atgtcacggaacttcatggattgtgccacaatgctttcttttgacttccggcatgtcacggaacttcacgaattgcctaacgatgggcgccaagtacctcgaagtggtgttgaggaaaaaagcctagagtttcaagaaccttgggatttgaggtcaaatccttttcaacggggagggaatgatgcaatcctaccct

SEQ ID NO: 68317 - DNA, 216 bp, Glycine max
  Peptide Sequence Number=SeqID_160002
atgccgatctccccctgcggatgtataagttggtctgtgtcgtcccgacatagggatcgtgcccgcaagacacccaatggacccggagaagtccaacagggtcctagggtttccagctctgattacgagcctctcaaggtcatcaagccccccattaaccggactttcatcaagaagtactacgcccccaggcaggcgcagggcgaaacaccatag

SEQ ID NO: 68318 - DNA, 237 bp, Glycine max
  Peptide Sequence Number=SeqID_160003
atggtaatcgattactcctttgtaaaaaccagtttgaaaaccatcctggtcactagtaatcgattactaccaaatggtaatcgattaccagagagtaaaaactctgttagtcttttgagtctagtgatcaaccaagaagcaaattctgcttcttgcaatgaacccaagaaacgttggtcccttgtgttcagtgttcaaccaagaagatcttctcttgaaaacaatcaccaagagtag

SEQ ID NO: 68319 - DNA, 201 bp, Glycine max
  Peptide Sequence Number=SeqID_160004
atgtctttgtgtcttattcggcgagcattcgctaagcgcgacactcagtggctaagcgcgaggaagaatccagaagaagatgagctggcagtttcactgagcacaacgctccaggtcatcaagcgcaccgcttcagctcattcactaagccaaaatccacttatgcgcgctaagcgattcagatttgtgctaagagcatga

SEQ ID NO: 68320 - DNA, 183 bp, Glycine max
  Peptide Sequence Number=SeqID_160005
atgagggaggaggaactaacagatttgtggtcaaatcctcttcaaggggaaggggatgatgcaatcctccctaggaagggactagtcactagagccatgagcaagaggctccaagaggattgggctagagttgttgaagaaggccctagggttctcatgaacctcaagggctccataatgtag

SEQ ID NO: 68321 - DNA, 223 bp, Glycine max
  Peptide Sequence Number=SeqID_160006
gtatgctttaaaccaaattgttgctgagtttgagcatgtaagttatgctggtattgacagttcttattatggacgtgtaatgagaactactcacggtcttccttgtgcttaccaagggttatttgagcccaaagtcatcataaccaaagagatggaaatcatatccaagcggtttgaagagtttgatgtttgtggcaaagttactctacaaagtaaactttag

SEQ ID NO: 68322 - DNA, 360 bp, Glycine max
  Peptide Sequence Number=SeqID_160007
atgtttaggcatgaatatcaagagaatgggggcaatgtggcatgccccattacttcaaaatgcaccctaggcctaaggccatcccttacaacccctcaattcaacaaaaacaagcaacaattcaaggataaatccctcacgcttttgagcaaatacatgcaacttagagcaccaaaatacatcaatggaaagctagagagcccaagaatgaggtgcaggggtgctcgcccaggcgagctcagctcgcccaagcgagctaacctacactttttttttaggggagacgatactaggctgccttgcaacgacgctttccatttgtccagagctaggcaagggacgacgacccatcggtcgtga

SEQ ID NO: 68323 - DNA, 123 bp, Glycine max
  Peptide Sequence Number=SeqID_160008
atggtgaaagcacgagaaaagagggaggtggttgccgcccagctcgcccaggcgagtaggtttgcttccacgagaaggcaccgccttctggtggaaccccctggaaggcccaagttggcctag

SEQ ID NO: 68324 - DNA, 546 bp, Glycine max
  Peptide Sequence Number=SeqID_160009
gctgatctttggctagtttctcgcatggacatgaacataggagctcttatttctggccagataacttctatagcccagtctaacacttctagacttcggtttcctgctctgatcaccgcactatgtagagccagaggggttgtctctgacagccttacttttgagcgcctgagcccggtcattaacttggcctacaccaggaagaactattggaatcccgaggatctaacagtggtggcacctccaggatctattccttcagttgagaagttcaaggagatggtagcctggcccgggacccaaccttctcttcgcagggaagatgaaggttccacaacccaggtacctcagcatgtggaggatgagtcatctgaggccaccatcccagagccatttgttataggggaggaggcaggtgagacacaagtgagacaggtagctgctgccactcctgagatatctctgaggccacttcagagcctcctactccagtggtggacctaccctcacctcaatgtacaacagacccttccactcctattctag

SEQ ID NO: 68325 - DNA, 651 bp, Glycine max
  Peptide Sequence Number=SeqID_160010
atggcgttgcctgagcacgggctggtgacctatacctggggcaatgtcagcggcatcgatcgggccagtgggctggtggtgatcaaacccagcggcgtaccttatgaaacgatgcgggctgaggatatggtggtggtgaatgcgcgaggtgaggttgtcgaggggcaactgcggccttcgtccgatacgccgacacatttggcgctgtatcgggcgttcccccaactcggcggtgtggtgcatacgcactctacccatgccaccgcctgggcgcaggcgggtgaagcgataccggcgctcggcaccacccacgccgactatttttccggcgacattccttgtacccgtgggctgacggcggaagaggtggcgcgggaatatgagctgaacaccggtcgggtgattatcgaaaccctgaaagggcgtgaaccgctgcacattcccggcatcctggcgtatcagcatggcccgttcagttggggaaggacgccggatgaggcggtgcataacgccgtggtgttggaggaggtggcgaaaatggcgtggatcagccgggatattaaccccggcctgaaacggatcgatgactatctgctggaaaagcatttcagccgcaaacatggcgccggcgcctattacggccagcgctga

SEQ ID NO: 68326 - DNA, 459 bp, Glycine max
  Peptide Sequence Number=SeqID_160011
atgactaatgcaaactgtccgcaagaatcattgcattcagtcttaaacggaaatctaaggaagaaggatgaaagtcaggaaaacaatttcaaggatgttgtatcagtctgtttactattaataaacacaactattagggatgttgaaaagggaacttttcccaaaagctgccttttaaatgtagaaatttcgacatctcctttgagtaacaagggcttcaaattaaccaagcaaagtatgtggagatccactccaaactggctagctgtttccaccagccattatccaaccggtcatttcttggccaatcaaggtggccttggtcttcagtttgcacagcttggccaagatgcttctgtagctgtcacagtgactccactgtctatttctcctcatattgagactgttattcaaatggcagcttctgattggatttctgttgtgcttcttggtgaataa

SEQ ID NO: 68327 - DNA, 237 bp, Glycine max
  Peptide Sequence Number=SeqID_160012
atgaagaaaagaaaaaagccagcaacaaggcccagcccagatgcctcacttagcgtgcagctcacgctgagtgagccaggagacacaggcgctaagcgaggcgttaagcacgagagttggtacttgcgcttgaaacagaatgtgctaagcgagaggagctcgctaagcgcgagatccaacagaacagagtgtgctaagcgagaggtgcccgctaagcgcacgatctacacgtgctaa

SEQ ID NO: 68328 - DNA, 306 bp, Glycine max
  Peptide Sequence Number=SeqID_160013
atgctgaaggttatcttttggttgtcgatactcatttccagattgccattctccataactaccacgcagttggcagttagcatgaagggtctgcctaggataagaggaatttccgcatcttcttctatgttcatgatgacaaaatctaccgaaaagggcatcaagttgatgcttgctcctaagtcaatgagagccttccctattgaatcattccctatggtgcaagggattgtcacgctcccggggtctttgaattttttagcagcttcctctgtatcactgcactacagttgcctcccaccataa

SEQ ID NO: 68329 - DNA, 1419 bp, Glycine max
  Peptide Sequence Number=SeqID_160014
atggcaactaggaaattgttgaacattgttgtagatggaaactcggccttgggtccttattggcccaaaattgtttcagattatctggaaaagatagtcaggtcactgattggcaacccaagaggagagggagtaaatccttcttgtgaagttggtttaatattgtacaacttcaattcaaccttaggtttggactacgtccaatgtttcaattggacaaaagatgttgatcaatttttaggctttctggcatatttacctttcaacggagataatttaaatcaacataccattgtaaaaggtttggcagaagctttagtgatgttcccgaaagatgattactttaagtgtgaaagacattgtattcttgtggcaacgggtgaacctgttactaggagcatgctagtgtctttacctgtggttaaggaaggaaaatttatttcaggacaattcataactttagatgccacctttttgagggtggctaaaatgtttggtccggggaattatctaaaggaagacactcccatcaccaactatggaaatggtcagatcactgttttattgtcaagaaattttaaggaggcacactatgccgtacttatcccacaggaaacagcattagaagaggaccgtttaacacggcttttagaacaagaccatcaaatttatttagacgaaattcttgaagaaatgctgaggtcatccacttccacgactggagaagggtcattacctcaaaacaattcagattcagggcggcttgaggaattaaatgcgtggtattctccaggagtcggtgcttcttcatttgttcctactgcacgtgttgatgttggtgctagttctggtggtattgctggtcctagtgctagtactgatgctggtgttgttgccggtgccattgctagttctagtctttattatggtagtcatcatcaacaatttccaaagcaccatcactttgaaatgactgagatcaatcctactgcaatgggagcaaacacttgggcttctccagcgctagtgatgcatgaatataatcaggcaattttatggcctaaaccaccaacagattttatagactacgtacaggcatgggagggatgtttggttggaaaaattcactctggtacatcccttaatcaagcaaaggcctttaggagactaacatcatctgtcattctttcacatcagtggtcaaacagactgaatatcgccctcttcttttccaaaacggctgtcacatataccatgacgattaatggtggacctattgattatttgttctttcaagtaactcaattcgataatcttgagctgtacgaacatctcatgagtaacgatttgctatttcactgtcacaggatatggtatttgttcaacgtcccaattagtgaaagcaagtgcaagtcatga

SEQ ID NO: 68330 - DNA, 399 bp, Glycine max
  Peptide Sequence Number=SeqID_160015
atgtatgcagccatggatatgtcgctcgacggcataatcaagaacaacaaaaaatctggatccggaagctcccgtggtcggaccctaccctttggatccagacctactcgtcgattccccaaccgtgccgccaaccgcaccgcaccttatgccaccgctagggtggtcactgcaaggaggttcgtacttgcaagttgcaaggtgcttaaggtggtgacttttagtccgttggtgttcacaagtggtgttcctctcaatagggagttgtggactgacgagtacttctcaattattgctgatattgttggaggagtgtggttgaggtggtggcttcaagctactgtttcattgtcaaacatggaaatgtttgttgccgaaatgagaagtgactcattctag

SEQ ID NO: 68331 - DNA, 357 bp, Glycine max
  Peptide Sequence Number=SeqID_160016
atggagctgttcccgaaagaggaggattccactctattatcacatgaattttgcatttcttgtttggctacagctaggctcttgatgattttggctaggtactgcttgtgcgccaaggattgtaagttaagaagatggatacttttacaagtgttagagaagatatttccaagatcagttaactcaaaacatgcaacaagacctccaattagaatgccattcagaaaagtagagaactgcaatcaggtcatgaaaattggtaaacaacggagattctcactagtgaatctagctggtaatgacattgtgcaaggaaataagaagctcactcttggtaatctcttcatctcactatag

SEQ ID NO: 68332 - DNA, 633 bp, Glycine max
  Peptide Sequence Number=SeqID_160017
atgaatgtcttgacagcacatgatcaagggtgggaacaggagttaagtccttacaatcaatatgaagaagaaagaactcctaatcttgaaagtgtgtctgaggaattcatggtataccatgctagctcaaaagccaatcaaaattcaaagaaaaatcatgaaattcattttggcaagagctactcaatagaaaactttcaagggggaccagagttacaaccttactatcaaaatgaagcagaaagaggttccaatctagataaattgttgatgcaattcaaggaaacaactaaatcaactcaacgagcactccaaagtgtagaaatccaggttggtgagctggcagaagaagtgactcaatttatgtccagacgagaaaaatactttgaagaggttgaagctcaaaaggaaagccttgtaaaagagcatgagtcaagagaaaaagataaggaacaagcacaacaacaatgggagaagtactcaacagtagaaaaccatcaagaaagtattctccaaatcaataaccatcctcatcaacaaattgacaagaaaagaaggaaaggagagcatgaggaaaccttaagtgccattctttctttaatcattaacacttctcttgaaatgatttggaat

SEQ ID NO: 68333 - DNA, 339 bp, Glycine max
  Peptide Sequence Number=SeqID_160018
atgatggttggtgttaatggtgaagggaagactacatctttgggaaagctggcctatagattgaagaatgaaggggctaagatattgatggcagctggtgatacatttagagcagctactagtgatcagttggaaatatggggcgaaaggactcctctttgcatatgcaagggtaaggctgcgtacaacatccctcccccataccttcgcatagcgaagagcctccgggcaatggggctaatggaagagttcatttcctgtaaaaggcctgttgctaaagtcgttcctggtgtacctaatctggtaaatgttcgggaattgctgagcactagatcataa

SEQ ID NO: 68334 - DNA, 162 bp, Glycine max
  Peptide Sequence Number=SeqID_160019
atggtgcttcttgcggtggtggagcagtcaaaacatcatgctctaagtgactcaacatcgatcgagaacgatgtcaatggggatgggatcatggtcaatgggggagacggtgctagggttgatgggggaggcaagtattcagtttcaaaaaatgacatctga

SEQ ID NO: 68335 - DNA, 270 bp, Glycine max
  Peptide Sequence Number=SeqID_160020
atgcagatccaactcaatcaagtctacatggagggtatgatgtggcaacagttcaagtacatggaagcatttgaagttcttatggcacaagtttctcccctacttgaggagcaatacacgggtttcctcctcgacgacctccacaaggatatatgcatggagattttggccttggaacctcccaattgccactgcttgggctcagtggcatgcctcattgagtgcaaactagatcgctctggttggcgcgcttctactcctcaacgatga

SEQ ID NO: 68336 - DNA, 879 bp, Glycine max
  Peptide Sequence Number=SeqID_160021
atgggggtaatgataaagatgaatgctaactggactggcattgggttggagatggatgtggttggagatgaggcgtggaggagatggggtggtggtgattgggttggtttgggtatgtgggtgagatggaacatagccaaaactccattggggaagattgagaaattacgcaacttgagcctatatgaaattatgagtactcccatcatccatcagtatcgtgacttggcgatgggggggttgtcgactacggttttcgggagagtggtggggaagtcatgggaggcaaggggtggtggtagctccaagtcgtcattggcaatgaacaaatgtaacttgggtggacctgttgttggtcttggagcaaggaccattggagaagaagtaggtgctggtggtggaggaattcggggggactatcggcggtcaagaagtttgtcttcttggagtttggcaagcgttatagtttgcaacaaggacaatggttgtaacgcctgcacctcccggcaaagatctggaagaagacctgatagaagcatctcaggagaaaggcatgagtttgaacaaggcttcatgagagccatcataaaaggaaggcgccctccatgtaaaatgatgccaccgttaagcatttgttgcccaacaccgcttgcactagggagtgagggtgactgtgagggtggcaagatgctgcagaacggaatcaatcttgttatccatgtgttggctctgagtaaggcgaagaacaacctcgttgaggttttcgatagaggcttgtcgagtgttatgctcaggcatggtagcaagcccaagggcagggtggaatttagacatagtcctggaggtgtgttggtggtttgtgcaccctcttgggtctag

SEQ ID NO: 68337 - DNA, 240 bp, Glycine max
  Peptide Sequence Number=SeqID_160022
atggcttcaaaatatacatgtggaacgggtgaattttttaggatggtggcagtgaaaggtgataggccactggcccaatacgttccaggatgcagaaaggaccatagaaatgctttaaaagtttcatctaaaggcctcgagatactattcaaggacacgattgagtacctcggtctggccatcagcttttgggtgatactaagtgctcattctcagcttagttctgcagagacaaaataa

SEQ ID NO: 68338 - DNA, 186 bp, Glycine max
  Peptide Sequence Number=SeqID_160023
atgtctaatgatcccttacatgggattagaggttgtatgataaggtccaagactaagaggatgaagcaagctttgcaaggcttgattctaaagatcaaagaggaaagagaccaatgtgaattaagggttgcacctaattgggacactcctctacaaattgatgaagatgctttgggtccaacttga

SEQ ID NO: 68339 - DNA, 873 bp, Glycine max
  Peptide Sequence Number=SeqID_160024
atggaggagggttgtctcgtgggaaatttggagctgagggggaatgcgaaagttattgggcctgagcaagtggtgaaattgtcacagaaggtggtggcacgtattttgttgggcgtggggtttgaaggtgccatggaaggttctgttgaggacttctctgaagtattgagcggacgaatatgtaaaacaagaacaaatttgagagtgcttgctgatagttacaagaagcagtgctcagccattgagcttctgaagatgttgcttaaaacagtggggtttaggttatgttcgacatggtgggtgcagagatgtaggttgctaacaaaagctaatcatgctctaaggcaggctaccttgggaaccttaaattcacttatagttgcttatggtgataagattgttttgtttgcttatgaagttattatcgtagaactgtcgagactaattagtgattctaacttgcatatgatagctcttgccctggaactctgttgcacattaatgggtgacaagaggtcaaatcaaagtattggtttggccgttagaaacaaagttcttccccaagctttaacattaattaaaagctcattgttgcaggggcaagcactttcggctttgcaaaacgtttttgctgctttagtctattctgcaaatactagtattgattatgtgttggagtcattatttgcctctgctaagccttctccacagtctggtggcattgctaaacaagctttgcattcgatagctcagtgtgttactattctatgccttgttgctggtgatcagaagtgttcatctacagtgaaaatgctcactgacattctcaaggatgacaacagttctaactccgtaagcttttctcttcagtga

SEQ ID NO: 68340 - DNA, 405 bp, Glycine max
  Peptide Sequence Number=SeqID_160025
atggattgctcagcgcgcatcagtggatttcgacttagcgcgtgcttttctcgctcagtggatggactaaagcggcataaagaataccatcaatcagaagctcttccagctatgcatcaatatcagatgcccccaggcgaggctcacaggtgcgctttccaaaggaggaaaagatgcgcagagtcgccaccaacgtttatttgtgggaaacgttggaaaaaccggaggaaaccggtcaaaatgaaaattctaagttcaggagttgtatttacgcttgaggaaggtattaacacctctcacgtcgacaaaagcggggcttttgctcctacgtaccctcctttggagaggaaatcagacctacgtagttctttcttcagagtgaatcaagcgattctttttacttga

SEQ ID NO: 68341 - DNA, 351 bp, Glycine max
  Peptide Sequence Number=SeqID_160026
atggtgtgtgaacacagacggattttcaacctccatttcactcctccgctggaacaacaagcatgcagcaaacccctactggcagctagaatgcatgtctggactcttgaactcacacaggccctgcttgatgcttccacctcttgcagcaatacatcttccttcttgcggttttcatatgacaattttaagaaggttcggccctccattgcaatggcctatccttccggttggccttggctttcatggcaagcatccaaccatggtaccggtttcttgctaaaggtgattttgttcatggagacgagctttcattctactacaggccttgtgacaatatttgggaagtag

SEQ ID NO: 68342 - DNA, 561 bp, Glycine max
  Peptide Sequence Number=SeqID_160027
atggaggacaaagtttccaagccaattgaccaaaagccactgaaagagtctttgctcttagtggtgttgaagcctcagtgtttgatgacccaatccaagaagttaaacttgcatgtgtcttccttaaagtttgatttggttgttgacatgccaactagtggtcctgttactacttttgatgaatccatgaaagagaactcccaagtatacatgatgatagctagcttgaaacttgagagtggtgtaacagtgagtgatgtacctatagtgagagattttcctaagttagctaagcttgaggaactgtcataccctaatttcgtccggggatcatccattgttgggatgcaaccctcgtttgaccacttcgagatgttcctccagaaggcggttgcttctagaggaagcaacctagctcgcctgggcgagctaggtggcaagctcctccttccttttcctataaataggggaaggagggaagaacaaaaatgttcaacactcctgattttcaaccgttcttcgtcgttcgtcgttcgtcgttcgttcttcggtcttcaaccg

SEQ ID NO: 68343 - DNA, 312 bp, Glycine max
  Peptide Sequence Number=SeqID_160028
atgataacaaaagatgatgacaaaggtgatgacaaaaagctcaaagatagaatcaagaacacttcaagattcaagaggaaagttgatttcaagaatcaagattcaatagatcaagatttcaagactcaagattcaagagatcaagattcaagactcaagattcaagaatcaagagaaggcttaatcaagataagtatgaaaaggttttctcaaaaattgagtagcacatggatttttctcaaaacatgtttaccaaagagtttttactctctggtaatcgattaccagattgttgtaatcgattaccagtag

SEQ ID NO: 68344 - DNA, 552 bp, Glycine max
  Peptide Sequence Number=SeqID_160029
atgggagtagggttccggcaggagatgactcgtcttactggctggatacatattttggacagcatcaagaatggtgttggtctccctctcaatcatgttgctgctattgaaccacccaataatgtcactatagcaacctcaggaggatcagaagtgtgcttcccttcaaatgccactccagaggatctttttgaccatttttgtgacggtgctctgagtaacggctccagtaagctatctaatgggaacaaaacgagagttttggttaattattctcaggaaaggggggcacccactctgaatgaaggccgtgattttgatggtgaagaaaggtgcagcaaaagggctcagcttggtggctacaataatgaccggccttattatggtagagggaattatcaaggcaaggagagggagaggtgttttagtaataataggaagaggccgcggggggatagggatgaaattgataggagggataaggatggtggtggatggaaaagagaacattatggtggtgatggtggtgagtcttggaatgatttggtgtaa

SEQ ID NO: 68345 - DNA, 670 bp, Glycine max
  Peptide Sequence Number=SeqID_160030
gttgaacctattcataggtcgaatcccactggtgggattgatcccttaggtgatttgattaagaattcgtatgatctttacgagaagcctcttgagttgttgtgggatggtactaaatttgggattctgaatgtagaagcatccttcttcataacatattctgataaactagaatgggaatgtttgtctattgatcttttgcctcattctgacatgttcacggatgctaatttagaccgctctgaagagggagcaaacctgagagatgaggatgctgcaaagcaggttcagttacatgtcacagaagctgttttccctgcattaagtgaaccaggattatatgtctgtctaaataggggaaatgtggatttcaaggctcagcagcgatcaactaaagctgctgggcgttctcttgtctcaactgttgtggaccacatatttctttgcattaaagacgctgttgcacctaggagaaagatgggtgatgctgatgctgaaggacctttgtctactagccctaatcagttagatggtgacaaagtaacaggagctaccaatcataaatcagtgaatttggagggaagcctgttggaaagttctggaggaaaaattcactcaaagggtgcaaatctcatggatcgttcaaatgataggatggctgaatctgatg

SEQ ID NO: 68346 - DNA, 291 bp, Glycine max
  Peptide Sequence Number=SeqID_160031
atgaatgacttggtttatgtgatgtataacttgaagttaaaaaagggatgtaatgatgaggatgagcaacctcaaggtgaaggtgatggtggcaatgttgaattagtgggagatgttagaggaagttcaaatgatctagttatagacgcttttgatctagataatttaagtttggtggaacctaataatgatgcacaatttgagaaagaccttgatgatgatggagatggtgatgaaagtgatgatattcttggagatgatcctattagaggattggacatgcttctttaa

SEQ ID NO: 68347 - DNA, 129 bp, Glycine max
  Peptide Sequence Number=SeqID_160032
tctgaggatgctccgatgactaccttagtacctatcgtggcctctatgtgtacctggtcatgtcttgacaagatcaatgcccctgtgttttcatgggatgcgtggacgggatctcccaccttgagttag

SEQ ID NO: 68348 - DNA, 153 bp, Glycine max
  Peptide Sequence Number=SeqID_160033
atggtagttgcagcaaacttcggaggtcacggtcatggcagagtcaatggcacaagattgatggccttaaaatcaaaaattgttttcaaaaaaggtcgtggtaaccttcaaatcaaagacggttttataaaaaccatcgttaacaccttctag

SEQ ID NO: 68349 - DNA, 375 bp, Glycine max
  Peptide Sequence Number=SeqID_160034
atgcctttcttggtgccatcatctccaacgaatcataaccatcgcaagagaacttccacttcgacctatgacactccaccgctaaaggtggttgacccatcacgattttatggggagttaacatacgcgccaccgcatcaacaacaacatttggtgttatctggtggaaaggacgatttgggagctttggctatgttggaagataatggtggttgtgtggttgtggtggatgagaagaaaggtgggggtgttgatgttgaaaagaaggatgatgatgatggtggtgtgggcgtgtggaccgtggaggctgtcgttgaaaaaatgaagacaatggtgtttggtgaaggagaaaggttggagaaggagaaagattag

SEQ ID NO: 68350 - DNA, 276 bp, Glycine max
  Peptide Sequence Number=SeqID_160035
atgggtgttgcaaaagtaacttattatcaagcatttgaagaaaaatacttggcattgaagaaggtcaatgtcaaggcatgggagtggctagaaggctgcactagtctcactatcaacccaaaagaacaattaagaaagaagaagcctaacaaaggaacaatgaacacaaaggctgaaaatgttcctatagttggaaatgacaattggaaaactgttggagataacaatgttggacatactgatgcagcaaagaaaattgtggttgatgacaactaa

SEQ ID NO: 68351 - DNA, 258 bp, Glycine max
  Peptide Sequence Number=SeqID_160036
atggggatggaagaggaagagggatggctaatggaggagaaggggagaatggctaaagatggagggtttcccttattagagatgcttaggctttggatgtattcaatagagagctctgagtctcagtgtctttctcctttgcttcctactccatttataggcctaagcgcaaggaagactctggaagaagatgagttgtataggttcgctaagcgcaccgcttcagtccatccgctaagagagaaaggaacgcgctaa

SEQ ID NO: 68352 - DNA, 276 bp, Glycine max
  Peptide Sequence Number=SeqID_160037
gtcgactctagaggatccccgaattctttgtcccaacacattggagggtacatcctttgtggtacaagtagagggtacatctacttgaggattgttatactgagaacaagaaagggtacatctcttgtggatcagttcaagtggagggtacatccacttggtttttcaaagagaacaagggagggtacatcccttgtggatctttggcttgcaaaagattttacaaggttgaaagaaatctcaagaatcggttggttgcttggggactggacgtag

SEQ ID NO: 68353 - DNA, 342 bp, Glycine max
  Peptide Sequence Number=SeqID_160038
atgtaccctcccttgttctctttgaacctagtggatgtaccctccactagaactgatccacaagagatgtaccctcttttgttctcagtcaaacccaaggagaagggagacacaaaggaattaaggcagttagtcctttgttcttttggaaaagggagaagagagacacaaaaagaattcaggcggttagtccttggcgaattctttttggcaaagggagaagagaatgaaaagatgaatagcacaagttttcaaggtttagaaaaccagaaaactttggaaagcttttggcacaaagaagaagaagaagttcaaagagattcagggcttgtaaaagattga

SEQ ID NO: 68354 - DNA, 219 bp, Glycine max
  Peptide Sequence Number=SeqID_160039
atggtgattttccaccatggagatgcagcggaagataaagaaaaagaggagtccaactaccctctgttagggggagacacctctaacgctggtaatgattatgctgcaaatgctggagctgatggtgattatgttgcggacatcgcaactgctcaaagagcttgggatccaagaccaactcaggatagaggcccacttttgatcaagactttaatttag

SEQ ID NO: 68355 - DNA, 1281 bp, Glycine max
  Peptide Sequence Number=SeqID_160040
atggcactagaattggtcggtggtgctcttctttctgctttccttcaggctgcgtttcagaagcttgcttctcatcaaattcgggacttctttcgtggaagaaagcttgatcaaaagctgctcaacaacttggaaatcaagctgaactccatacaggctctggctgatgatgcagaactaaagcagttcagagatccacgtgtcaggaactggcttcttaaggtcaaagatgctgtgtttgacgcagaggatctcttggatgaaatacaacatgagatctccaaatgccaggtcgacgctgaagctgaagctgagtctcaaacctgcacttgcaaggtaccaaatttcttcaaatcttctcctgttagttccttttacaaggaaattaagtcaaggatggaacaggtccttgaggaccttgaaaatcttgctagccaaagtggctatctaggtttgaaaaatgcaagtggtgttggatcaggatttggtggtgcagtatcacagcaatcacaatcaacatctttgcttgttgaacgtgttatttatggcagagatgatgacaaagaaatgatctttaattggctcacatctgacattgacaattgtaacaaaccatcaatattttctattgtgggcatgggtgggttggatgaatttgatgttttcaatgtaacaagaacaattcttgaggcagtcactaagtccactgatgatagtagaaaccgagaaatggttcagggaagaaatcaaaaggaatgggaagctttgcaaactcctcttaatgatggggctccagggagtaaaattgttgtcactacacgtgacaagaaagttgcttcaatagtgggatcaaataaaacacattgcttagagctgttgcaagatgatcattgctggcaattgttggctaaacatgcattccaagatgatagtcatcaaccaaatgcagacttcaaggagattggtacgaagatagtagcaaaatgtaaaggactgcctctggctttgacaacaattggaagtctattacaccaaaaatcatctatttcagaatgggaaggcatattgaaaagcgagatatgggaattttcagaagaggatagctctattgtccctgctttagcactaagctatcaccacctcccttcccgtctcaagagatgttttgcttattgcgccttattccccaaagattacagagtaggagtccagaagaagtcggtgaacaatacttcaacgatcttttgtcaaggtccttctttcaacaatcaagcaacatag

SEQ ID NO: 68356 - DNA, 318 bp, Glycine max
  Peptide Sequence Number=SeqID_160041
atggcaaataaagtctcagagctgaatgtggagggtccggaagaaactggggctgaagctagagctggtaaagatgaagctacagcaaatggagttgcagtagaagtagaaggagcaaaggtagggagagcagaagatggtggagcctcagacctcttgcccttagccttgcggggcccccaaaaagtgactgtggggtcgtcaaggctctcaaaagataacaaatcagaagttactcctttggccttgcacagggcagtgatgagggcagcaaaaccaagccgccaggagtcatgttgtgcgatcattgaaatctga

SEQ ID NO: 68357 - DNA, 291 bp, Glycine max
  Peptide Sequence Number=SeqID_160042
atgatatgcccattacgatgccatgaagagatgtatgatgcaatcaaggaacatgcgagagtgagtttgctatgtgccccccaattcaggaacctaatggaaaggatccaaaagtccacttcaagcaataattcccaagggtggtttcatggactatcaagtacaatgcatcaccaaaagaagaaaactctagatgaggcttcactatcatcaagcgagtcgaagacccagcatgaccacagatcaacctccactccttatggctcacatagacccggacatagggcctaa

SEQ ID NO: 68358 - DNA, 991 bp, Glycine max
  Peptide Sequence Number=SeqID_160043
atggcgatcgaggataacgccgtgcccgcctctgagttcacttttctgttccacgattatgaaaccttcggcaaaagcccgtcgctggatcgtccggcgcaatttgcaggcctgcgcaccgacaaagcctttaacgccgtaggcgaaccgcaggtgttttactgccagctcgcggacgattacctgccgcagccggaagcggtaatgatcaccggtatcacgccgcaggtggccaacgcgcgcggcgtgccggaagtggagtttgctcagcgcattcacgcgctgttcagcgaaccgcagacctgtgtgatcggttacaacaacgtgcgcttcgatgacgaagtgacgcgcaatatcttctaccgcaactttatcgacccgtatggctggagctggcagaacggcaattcgcgctgggatctgctcgacgtgatgcgcgcctgctatgcgctgcgcccggaaggcatcgtctggccggagaacgacgacggtttcccgagctttaagctggagcatctcacccaggctaacggcgtggcacacgaacaggcgcacgatgcgatgtccgatgtgtacgccacgctggcgatggcaaagctggtgcaggagaagcagccgaagctatttgagtttctgtttacccatcgcaacaagcagaaactgatgacgctgattgatattccgcagatgaagccgctggtgcacgtttccggcatgttcggcgcagcgcgcggtaataccagctggattgtgccgctggcgtggcatccggataacaaaaacgcgttgatcgtggccgatctggccggcgacatgacgccgctgctgacgctgtcgccggatgagttgcgcgagcggctgtatacgcgacacagcgatctgggcgatttgccggcggtgccgatcaagctggtgcacatcaataagtgcccggtcctggccccggccaataccttgcgcccggaagatgccgaacgactgggtatcgatc

SEQ ID NO: 68359 - DNA, 417 bp, Glycine max
  Peptide Sequence Number=SeqID_160044
atgaccgaccctctcgatgagtcgatctcttgctttctcatgagggtgaacccttgggtactagtacctatcaccttcaaagggcttcacgccttcaccttcagaggactacacgtcctcgtcatcaaggggctacacgcccctgccttcgtagggctacacaccctcacttttcgaggactacatgtcctcaccttcagagggctacatgccctcaccttcatagggctacacgctctcaccttccgaggactacatgtcctcatcttcagaggactacacgtcctcaccttcagagggctacacgccctcaccttcagaggactacacgtcctcgccttagagggctacaagtcctttccttcagaggaatacacgtcttcaccatcagagggctacacgccctcgccttcgtag

SEQ ID NO: 68360 - DNA, 219 bp, Glycine max
  Peptide Sequence Number=SeqID_160045
atgactacaccacccagccctcatcctcttaatgatgcatcatcacattctcctcctaacttgaagtggacaagaaaatccacacgcctgagatcattggctactagaccagttggggcagagagacttctggtccatgtggatcctacaattgggaaagacgatggtagccacaaaaagaagttaaaaacatatttggggatcgtcgctcgtgataag

SEQ ID NO: 68361 - DNA, 234 bp, Glycine max
  Peptide Sequence Number=SeqID_160046
atgggagcaagtcagcataggacaccggaattggggaatggcagccacaacatgggttcctttctaattctcatcctcttcatttgccccagttttctcattcatcaaagcaggatgatcgaatttgcctcttttctgacccgcttcggtcctttccccgacgaagaccaaatccgcaagcttgaagttgcatcctatccagagccatatcagaattatactgacattgcctaa

SEQ ID NO: 68362 - DNA, 381 bp, Glycine max
  Peptide Sequence Number=SeqID_160047
atgcctcaaaatgttctttacgatgccattgggatatatcaacggtgtggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 68363 - DNA, 141 bp, Glycine max
  Peptide Sequence Number=SeqID_160048
atggagaaactagcaaattcattttcagtgttagaactcgacgccgacgatagccatgttcccaccactgccgtgtgtttaatatcttgcaagttggtcgttcagtgcactgctccaatgctagagtgtatcacagagtga

SEQ ID NO: 68364 - DNA, 366 bp, Glycine max
  Peptide Sequence Number=SeqID_160049
ggttgttcatgtgtcctccactttcgagtttggagctgagtttcatgattgcctaagtgcggaccctcaaggcaatcctccatactccacctttgtcggagcaccatgcatgtcattgcctagcgctgttcatgtgtctccattatcaagtgcaaagcttctggtgactaggaagcacaagaaaaaagaaggaatggagacgagagtcatcatcacagaaagggtaggacggacgaaatcagtgtcctatctttgctttcctcttatctccgatgagaggtccacttgggccctccaaaagattctccagaaggttgttgcttctggaggaagcaaccttgctcgcctgggcgagctggacggcaa

SEQ ID NO: 68365 - DNA, 159 bp, Glycine max
  Peptide Sequence Number=SeqID_160050
atggataaccactcgggtatttctgcccgtcagcgtgactcaaatgtcagtatgacagatcttgtgagcgaggaagatgacgctttctgtcttacagatagcaatagaatgtttatgaaagtgcggacaaccacttgggtatctccgcatgtcacgtga

SEQ ID NO: 68366 - DNA, 537 bp, Glycine max
  Peptide Sequence Number=SeqID_160051
atgatgcggtgcgttggtgtgcaggcggatccagccatcctcgcacggatagtcaccggccagcgcatcccactgggcggctggcggacggttcagcggcgtcaggctgtgctgaaaccagcgcgaggccaggcggacgttgacgctgaccggggccggaggccccagcagatcgctcagcgcctggctggcgaggccgatgctggtggcggcgagttcgctaacggcaaaagccgaggggaagctgtcggtctgaagaaagtggatcgtcggcgcgtgttccgcaccccgcaatccctgccacagttgctgccacaatgcggcagcgcgttgagaatccatgctaaacctccggaaaacacgcaagcttcaagcatagcagagtggatcagcggcggcgcaggcgcggaaagcgggcatgcatgcgcaggttacgcagcagcgcgtaccacagcgtgtaggcgactattgacgaggcgagggcgctgtacaggatgccaaaccagccgcgccagccggcgtggctcagcgcggtaa

SEQ ID NO: 68367 - DNA, 1677 bp, Glycine max
  Peptide Sequence Number=SeqID_160052
atggagatcatctggtatcacccgtcactgaatccgcagccgtggctggacggcatgcgccagcgtctgccgtcggtgcgcatccgccagtggcagccgggcgacagtgcgcccgccgactacgccattgtgcgatcgccgccggtggagatgctggcgggacgggcgttgcgtggcgtattcgccatgggggccggcgtggacgaaattttgcggcagctgcgcacgcaccctgagatgctggctgacgcggtgccgctctaccggctggaagacaccggcatggctcgccagatgcaggagtatgcgaactggtgcgtgctgggctggttccgccgcttcgccgactatcaccagcagcagcgacaggcgctatggcagtcgctgccggaccgcgaacgtgctaattttaccattggcgtgctgggggccggcgtgctcggccgcagcgtgctggagagcctgcgccagtggggcttcccgctgcgctgctggagccgctcgccgaagcagattgccggtgtcaccacctttcacggccgcgaccagctaacggaattccttgccggcacgcagatactgattgatttgctgcccgccacgccggaaaccagcaacctgatcgatggcgcgtttcttagcgcgctaccgcgcggcgcctgtttcctcaacctcgcgcgcggtgcgcacgtggtagaggccgatctgctggcggcgctggagagcggtcagctggccgccgccgcgctggacgtattccaggtggagccgctgccagccgcgagtccgctgtggtctcatccgcgtgtcatgattaccccgcataatgccgccaccaccttgccgcatgaggcgatggactatatcgccggtgccatcacggcactggagcagggccaacagccgcgcgaggagaagaggatgtatcccgtcgatttacatatgcacaccgtggccagcacccatgcttacagcacgctgcacgattacgtcgctcaggcgaaacagaacggcctgaagctgttcgccattaccgatcacggtccggacatggccgatgcgccgcactactggcattttgtcaatatgcgcatctggccgcgcgtgattgacggcgtcggcgtgctgcgcggcattgaagccaacatcaaaaatcagcagggtgagattgattgcagcgggccgatgctggatgcgctggatctgatcgtcgccggcttccatgagccggtctatgcgccgcgcgacaaggctcaccacaccgaagcgatgatcgccaccatggccagcggactggtacacatcatcagccatccgggtaacccgaaattcccggtggatattcgcgccatcgcggaagccgccgcgcactacgatgtggcgctggagatcaacaactcgtcatttacccattcgcgtccgggcagtgaacctaactgccgcgcgattgcggaagcggtgcgtgacgccggtggacggctggcgtttggctccgattcgcacaccgcctttacgctcggcgatttcgaacactgcctgcgtattacgcgcgaagtggattttccgcaggatcgcgtgttaaatgtcacgccgcccgcaggacccgctgctggtgccgctgttcaccctgctgcgcgaaggcaaactgaaagatcagtggccgctggagcaggatga

SEQ ID NO: 68368 - DNA, 474 bp, Glycine max
  Peptide Sequence Number=SeqID_160053
atggggacaaggggttgcattagttacaatcccgttcatgccataagacagcttggctaccctatgagaggagcaccactagaggaagagcttgcacctattattgcacgaggtttcaataacaccaacatggaggcgactcaaaaggtccgcaaggcatgggagatggtgcaaaagaaggacaaggaactcagaggcagtaacaacgggcccatcggcggctaccataggtggttgaaagcccacatgcaaggtctggattggctcccgagtttgagaaccactaaaggggtggaagttgaagcaccggaggaagacgaagaggtgcaggcccttagggcagaactcgagaaagcccaaacagtcaaacaaaggttcaaatcagcagctcttaagatccgaaaggagaatgccaaactgagagacgtaaatatagctaccaccaaggccttggaacaagagacaaaagggctc

SEQ ID NO: 68369 - DNA, 222 bp, Glycine max
  Peptide Sequence Number=SeqID_160054
atgttgctaagtagcaatgtcatccatatatgtgtaagagtggtcatgttggtgcgcatgatccgaactcgtctctttgtagaggcacgagtgaaatcttgccccggtatgcatagtagctgcatgatagcctcctcctctagttgtgctcgcacagttggccctcttccaggatcagggggtggcccaggaactggtaaaaggaaactactggccccttaa

SEQ ID NO: 68370 - DNA, 672 bp, Glycine max
  Peptide Sequence Number=SeqID_160055
tcactagggttcaggaaagagtgtgatgtgctgagagacgtcaaaatgactatggtcaaagccttagagcgggcaactaaaagggcccgaaaggaagaatggagcaggaacaagttccgaggggctttatggggcagcagtaacgagcttaagcttagaagggctgagagggatgagtcaagattggaaagcatggtgttagaagataagttgaaggcttgtcaaagggcgaagagaagcaaaggctggaggatgaacgaacatgcgaaggtatcgactctgcaaatggaaagggaagcaaaagagagggtgatagaatcattgcacagggaagctatgaaatggatggataggttcgctctaactctaaatgggaatcaagagcttccaaggttgttagccagagccaaggcaatggcggatttatactcggctcccgatgaagttcatgggcttttcgattactgtcaacacatggaggtgcaaaggcagatgaagaccgacatggaggccatgaaggaccaaatgacctccatgatagaggccatgttgagtatgagaaggatgatggaggacaacgcggccgcagttgccaccaccagcatcgccgttgaggcggatccgactcacccatctggcataaaccaaacaagtcgtccaatcccagatgtg

SEQ ID NO: 68371 - DNA, 803 bp, Glycine max
  Peptide Sequence Number=SeqID_160056
gagttgggacggttaatgggacccctccaaaggtaatccttccacaaagtgtacggaaagattttagatttgaccataacggaggtatttacggaagccattgtatccctcgcccaatactatggccagccattgagatgcttcaccaagattgcagctgtgaccggagattcggcgagagagttggatcgtatgaagcaaactcgaaacggcgtagtaggcctaccgcggagatacttggaaggcaaggcgagggaaaagaacaacgcacggattgtctgttgcttgcccgctctttgtgtgtggttggtttcgcacctattccaatgagacataaggcacccgtgtccgcttcaaagttatcgctcgaaggaaaagagggagttctcttctcatgtggggactacccaaacgttccgttgatagggacgaggggttgtattaactataatcccgtacttgccataagacaattagggtaccccatgaggggagcaccgacggaagagagcctctcgcctttccttgtgagagatttcgacgtgcaaagtttcaagattgtacaaagagtccacatggcgtggaaaagcccgttaaggaaagataaagaacttaggggcatccgtaatggcatcatcggtggttatcatgaacggctaagagttcatacacgagggttagattggctctccaagttgaaaattgtcaacgaggagaacttcgaagctccagaagaggatgaagaagtccaagctctaaaatccgagctaggaaaggcaagactcaccaaagaaaagttcaaa

SEQ ID NO: 68372 - DNA, 591 bp, Glycine max
  Peptide Sequence Number=SeqID_160057
atgtcatttttgggagaaacaagcagtcagagcattactaactccatattagctttcattttaccaaatggatcaatcagttacaaccaaactggtgtttattttcaaagtctcattccaacaccaatgcgagttcctaacaactgttcttttgatacactcaagcgtagaatgcacaacacccttcaactaaccaacgatcaattactggatgaaatctactaccgacaaccattcatagatgcaggtcaacaatatttttttcaatctttacaattgaaagatgatgatgatgtttacacaatgttaatgtgcaatgagcaatactcgtgtattggccctatagaattattatgtaccattattagaacaccggatgctatactcaacttgcttcaatcaaccatcactcctactcatgatacaattatgtattgcaacgggaagtggaacataccacgtcaaggtgagtttttgggttactcctttactggaactaatccaataagatttggcatttcgtcgggatgtggcatggagaaactcaaggatttaatcaagcaagttgcaccttacaggtgttccccctaa

SEQ ID NO: 68373 - DNA, 520 bp, Glycine max
  Peptide Sequence Number=SeqID_160058
gttgtcccatctatggtgaggctcatgaaacaggccaatgtattcccactgaagaaaacactcaagaaattcattatatgggaaatcaacagcgacaagggtatactcaaggaggattttcaggcttccagcagggtcctgttagtcgcatccgctaagcacaacactcatgggctaagagcgaggaagaatccaaaagaagatgggctgtacagattcgctaagcacactgctccagttcatccgctaagcgagaaaggcgtgctaagccaaaaatcactaacggattcagagctttgcatgtctagggtttctagagagagaaaggtccaagttccagagagtgttgagagattttgctgtgagaagatctgtagagaccacaactcgaagcaggagccggcttcctggtatggaaagctaaatcctctgttggatcttccttgtagtggaaactggtctgactctaaagtccttgatagtgcagggctgagtagtcgtgctttcacgaggaattggg

SEQ ID NO: 68374 - DNA, 525 bp, Glycine max
  Peptide Sequence Number=SeqID_160059
atgacattcccttctaccttgaagcggacaagaaaagccacacgcctaagatcattggcgactagaccagttggggaagagagacccctagtccatatggatcttgcaatggggaaagccgacggtccccacagaaagaagttaagaacatatttggggatcgtctctcgcgataaggtagatgtgacatacgagaattggaaacaagtctctactacccagaaggacttgatatgggaggatattcaagtatttaacttaaatgttgcatccgacaaggacggtgtcgatgatactatttgtgaaaagtacgacattagccaggaaaagtggacccgattttatcaaagccgtagagacccttcgtggaaggatgagcaaaaaaaggcacaggccattcagaaacaaaacactgcccctcacgttttgtctcgtgggggttatgagcttcttgaaaagaaggtgatggatgagaagaaaaagaaacaattgaaggaagatgctcaatccagaagcactgacacc

SEQ ID NO: 68375 - DNA, 537 bp, Glycine max
  Peptide Sequence Number=SeqID_160060
atggtggaaccatcaaagaagcaaaagggttcttcgagtcgaacccaacgacattccgagactcaagaaacgcagattccctcctccatttcctcttcctcattgttctcatcagaagaacaacgaatacagtacacaaatcttttctcttctcgttccattattgatccaaaattcattgacatggatttcttttccaatgagagttatgaatgcattcaggcatttgagaactccaatctcattcctttcatgtctttaaaattgcttgtttattctgaattagttaaagtcttctattctaaccttaaaattcaagaaggcactttgatttctgaagtttatgggataaaaatggtcattgaccaatccctattctatgacttgacccaattatctagtgaaggtgtaccatttgaaggtacattgaatgatgattggaaatttgatttctctgtgcatgatgctcgccggttggtttgcactaaccaagcaaatatgactggaaggcttcttgccggttcattggcttcttga

SEQ ID NO: 68376 - DNA, 360 bp, Glycine max
  Peptide Sequence Number=SeqID_160061
atgaaggtttacgccacattcttagttacatgtgttaggtaccatgatgatggctatgagtcaaccataactgtaatcattgttatcaaaaggaatgaacgtgttttacggtgccttcgaatgcgtgctagagctagagtaatgagtgaagtagaggaggtgcaagaacggatgaaggccgacattgaggccatgaaagagcaaatggccacaatgatggaggccatgatgagcatgaagaagataatagaggtcaatgcaactgcagttgccgctaccagtgtcattgctgaggtggacctgattcccccatatggcctcaaccaaataaatcatccaacctcggatatggtaggttag

SEQ ID NO: 68377 - DNA, 276 bp, Glycine max
  Peptide Sequence Number=SeqID_160062
atgaacattcaagggaaacgtcgggtcaaactgaaactgggaataaaatcactcatagtgtataacaactcacacagattacacgcgcgatcacggatcaataggattttctcgagggtagtgtttttggagaggaaactgggtgtttcggtcttttcctctttgtttatgtggggcgggacatcgccagttgggagcgaccttgaatggcaatcacaaaggaagaaccactttgaaatgggttttccctttgtcggcggtcatttacctcgctga

SEQ ID NO: 68378 - DNA, 150 bp, Glycine max
  Peptide Sequence Number=SeqID_160063
atgacggtgaaaacctctgacacatgcagctcccggagacggtcacagcttgtctgctgcgcaactgttgggaagggcgatcggtgcgggcctcttcgctattacgccagctggcgaaagggggatgtgctgcaaggcgattttgggtaa

SEQ ID NO: 68379 - DNA, 315 bp, Glycine max
  Peptide Sequence Number=SeqID_160064
atggtactaaaatttcatgacgatccaacggtgaacgattccgagatcattgtttttctgagacaggtttggtgggctgcgggaaaaagaaaggattttgagaggagaaggagaaaaatgaaaatgagggaaagaagaggcaccaattaccaaaaaacggcagggggtgtatttagtaaaaatgggggtgcaaatagcaaccaggcccacttgggccctccagaagattcctccagaaggctgttgcttctggaggaagcaaccttggtcgcctgggcgagctgggtggcaagcttctcccccaattttctataa

SEQ ID NO: 68380 - DNA, 800 bp, Glycine max
  Peptide Sequence Number=SeqID_160065
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggtaagcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 68381 - DNA, 255 bp, Glycine max
  Peptide Sequence Number=SeqID_160066
atggagaggaatgatgacaaaggtgatgacaaaaagctcaaagatcaatcaaagaacaactcaagtgaatcaaagatcaatcaaagaacaactcaagtaaatcaagaagaattcaagactcaagaagaaagtttagagtcaagaatcaagattcaaggttcaagatctcaagaatcaagattcaaggttcaagatctcaagaatcaagatcaagattcaagaatcaagagaagactcaatcaagataagtattaa

SEQ ID NO: 68382 - DNA, 557 bp, Glycine max
  Peptide Sequence Number=SeqID_160067
gtgcactggccgatgattggaagtttgatttttctgtgcatgatgccgcccggttggtttgcaccaaccaagcggatatgaccgaaaggcttcttgccggttcattggctcttgaaagccgcatccttcactatcttattgctcgcattgcgattaatgctcctttaccatatccacatttagtcacccttttccttcaacatttcaacatccctcttgattttgaaccttatgttccaatcaagagatctttcttaatcagtgctgctgtggttgcgtcctttggttaccgcaaagagcgtaatggctcttgggcaaaaaagggtgctcaaccaaatgatgatgaaggacaaataccagttgaaggagactcttctctccttcaaagtattttggacaggtttgatggactccaaacctatgttggtgagaggtttgatgctttggaacaacaagtggacatgcgatttgatgcaatggactcaaggatcacaaaggttgaagaagaagtcaccatcattcgcgactgccttgatttacttccaccaccatcatca

SEQ ID NO: 68383 - DNA, 303 bp, Glycine max
  Peptide Sequence Number=SeqID_160068
atgtcgcgatggcatgaccttgccggggggtatgggcaccctgtaggactgatagaggcccgtaaccagagctggaaaccccagggccctgttggacttcttcgggtccactgggagtctttggtcatcttggtgcgcatgatccacactcgtctctttgcagcggcacaggtgaaatcttgccccggtatgcatagtagctgcgtgatagcctccctctctggttgtgctcgcatagttggcccttctctgggatcagggggtggccccggagttgataaaaggaaactactggccccttaa

SEQ ID NO: 68384 - DNA, 261 bp, Glycine max
  Peptide Sequence Number=SeqID_160069
atgaccggtttccttcggtttttcagacgttttccacaaataaacgttggtggcgactccgcgcattttcctcctttggaaaacgcacccatcaccatacaaatctttgtccttctttgtagcaatctggagtcaatgagcaacctgaagcttatgctgccaacacttataatagaccccctcagcagcaaaaccaacaacaacagaataattatgatctttcaagcaacagatacaatccaggttggagaaatcatctaa

SEQ ID NO: 68385 - DNA, 634 bp, Glycine max
  Peptide Sequence Number=SeqID_160070
atgacggaagggtgtggtgaagggttttgccttgcaaaccttcccggtgatgcttttagtctatgggggaacttctttgaggcaaagaaacaaatgatggctgatgccaagtttgcggggctgctttggtttagccattgcttaagtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggtttgttgggtgatttggaggggagggacgaatcaaagcgacaagggctgaatctcagtgggatcgtggcagcaaggccactctgccacttacaataccccgtcgcgtatttaagtcgtctgcaaaggattctacccgccgctcgatgggaattgcgcttcaaggcgtctcgtagggctaatccgcctcacggagggtcaccaacggcacgtggcctatggggggccggaggccccctacttgctg

SEQ ID NO: 68386 - DNA, 2193 bp, Glycine max
  Peptide Sequence Number=SeqID_160071
atggggagtagggctaggcaggggaggagattgcagacgatgatgaagtgcatgtgcctgagggagccgttgaagggagaagatgaaacggttccttcttctgattctcttgcaatcagggaattctattcttcaacggcaagtgggcgttctggccccgacggagaaattgagatgatggggtcgggttctgggaacatggatgaagccgaattgtccttgcgtgagagtggcatcatggacatcatggacaatgaggaagcaagagctttgttaggaaaagatgaatatcaggaaggaaatatagaagctgctttacatgtttatgagaggataaatataagtgctgtgacttccaagatgaaaatttcccttgccaaaagcagagaacaccgtaagaaacattaccattattatgctactcctccgatgtccatatacacggctggattactgttggaagcaattttcctaaaagcaaaatgtttgcaggttctggggaggtttaaagaagctgcccaaacttgtaaagttattctggacatagttgagtcttctttacctgaaggcttgcctcaaaacttcggtgatgagggtaaattgcaggagactttgagtaaggtagttgagctacttccagaattgtggaaacttgctgattctccccgtgatgttattttgtcttaccgtcgtgcactccttcaccgacggaatcttgatgcaaaaaccatagcaaagattcagaaagaatttgttgtttttcttctatatagtggaggggaagcaatcctttcaaatcttcgttcccatatggacagctcgtttgtacccagaaacaacttagaagaggctattcttcttttaatgattttgctgagaaaaatatctctaaataaaattgaatgggatccgtcaattttggaccacctttcgtttgctctatctgtttcaggggatttgacagctttagcccatcaatgggaagaattactccctgggactatcaatcgaagagaaagataccatgccttatctctttgttattatggtgcaggtaatgacttggtagcactgaatcttcttaggaaattgctgagtagtagagaggacccaaaacatgttccttctttgttaatggcttctaagatttgtagcatgaaccctgatcttgcaaaagatggggcaagcttagcttgcaaggtgcttgagaacttggatggaagatgtgatcagttggaaagtctttccagttgcttacttggtgtttcactttcagcacactcaaaaattgctatttctaattctgagagggttgagaaacaatctgaggcacttcattctctggaaactgcaagcaaagtgaccagaatgaggaatccccctgtaatatactacttgagcttagaatgtgcagagcaaaggaagttggatgttgcacttcattatgcaaaatgctttctaaacttggaagctgggtctaatattaaagggtggttattgttagcccggatattatcagctcaaaaacagtttttggatgctgaatctattgtcgatgaagctttgaaccagactggaatatgggatcaaggagagttactgcgaacaaaagctaaactacaaattgcacagggccaattgaagagtgccattgaaacctatactcagcttcttgctattctcctagttcagagaaaaacttttggttcaaagaagaagctgtataaggactacatagatcatgctaggaacatggaagtggaaatatggcatgatcttgcttatgtgtacataagtctgtcacggtggcatgatgcagaggtgtgtctttcgaaatctaaagccatcaaactatactctgcttctagatgtcatgcaataggtacaatgtacgaagcaaagggcctttacaaagaggctataaaagcttttcgcgatgctttgagcattgatcccggacatgttcctagcttgatctctactgctgtggttcttagacggtgcagtaatcaatcaaatcctgctatcagaagctttctgatggatgcactacggcatgacagatttaatgcttctgcttggtataatcttggcatttttaacaaggatgagggtacaattctagaagctgcagactgttttgagacagcaaactttcttgaagaatcggcaccagttgaacctttcagatga

SEQ ID NO: 68387 - DNA, 885 bp, Glycine max
  Peptide Sequence Number=SeqID_160072
atggcgaaaaacccgttactctgctcgatcgtcctcctcgccgtgctcgccggagccacctcagacgacggcgccgagctcgactactcgaagctctccggcattataatccccggcttcgcgtccactcagctccgagcatggtccattctcgactgtccttactctccgctcgatttcaaccctctcgacttggtctggctcgacacaaccaaatgggggactcgaacccgcatcctatccctccctcctttctcccttcaccatcaagccaaccttatatctcctgctgtgtatgaaattagctctaatgagctgcgatttaaagagttaagagtgtggtatcttctttctgctgtcaattgctggcttaagtgcatggtgttggatccttacaaccagacagatcatcctgattgcaagtcccgtccggatagtggtctttctggcattacagaacttgatccaggttatataacaggacctctttcatcagtttggaaagaatggattaagtggtgtattgaatttggcatagaagctaatgcaataattgctgttccgtatgattggagattgtcgccctccaagcttgaagagcgggacctttactttcataagctaaaaataacatttgaaactgcttacaaacttcgtggtggcccctctttagtttttgcccattcattgggtaatcatgttttccgttatttcttggagtggttgaagctagagattgcaccaaaacattatatccagtggctggatcaacatattcatgcctattttgctgttggagctccccttcttggtgcaatggaaaccattgaagcaacacttactggattcacatttggtcttcctatatctgaggttaccttttaa

SEQ ID NO: 68388 - DNA, 1176 bp, Glycine max
  Peptide Sequence Number=SeqID_160073
atggaagcacgttctgctttctctattgacagatcaaatgctaagcaactcaataacatggggatgtctgaagcatttccctcatcattgcctgcccttccatcgcctctagaagagacataccctaaattatctgattctaaaccagtttttatggaaaaagagcttaaaacaaaaccttatacacattcaagtcatttaacttccagcggagcagttgggcatatgttttcatcttctcctggatattcaactgatcttcatcactcatccttttcatctcatgaaaaacaacctagaaatactcattttatttcacagtcattaagtaacatggcttcattgccattatcttattcttcaaatagtgaaccgataccttctacaacatcaaccccttattccaatggaaacagtgtttcctggcatacagattccttgcctagctttctcgatttccctgccaatacctccattggtaatagtcaagtagaaagcagtgactgcaatatcatggcaactgaagagtattctaagcgaaatgattggcaggagtgggctgaccaattaatcagtgatgttgatcctttgacttctaattggaatgatcttcttgctgacaacattcaagatcttgaaccaaaggcgatgtaccaggtcgcaaaatcatcttctcaacttccaataggacaccaatcccaaagccatcaacaacttcctgcttcatctggagaaaatcgtgttggtgttgccccaacttcctcaacaaattctgcacctgccaagccacggatgcgctggacacctgagcttcatgaggcatttgtggaggctgtcaaccaacttggtgggagtgaaagagctacccctaaaggtgtgctgaagctcatgaaagttgatggattaactatataccatgttaaaagccacctacagaagtacaggacagctagatatagacctgagtcatctgaaggagctgcagagaaaaaactaagtccaattgaagagatgtcatctctggatttgaaaactggtattgagatcactgaagctctgaggctgcagatggaggttcagaagcggttgcatgaacagcttgaggcaaaacccccaaaggggctgcaactaaggcgggctaaggagtttccacaattaaggtggcttttccaataa

SEQ ID NO: 68389 - DNA, 402 bp, Glycine max
  Peptide Sequence Number=SeqID_160074
atggcggtggtagaagaaaagggccttgcaagtggaagagaggattacacccaagatggcacagtggacctcaaaggtagacccgttttaagatcaaatactggaagatggagagcttgttccttcatagtagcatcaaacctagtgcagtatctaacaaagaagctccacgagggcactgtgacatcttcaaacaacgttaccaactggtctggtacagtgtggattatgccagttgctggggcttacatagccgatgcctatcttggccgttattggacctttgttacagcatcaactatttaccttctgggaacgtgtttcttgactcaagcagtgtcactagcagcattgagacagccaccatgtgctccaggcgtagcagacaaggaatgccaatga

SEQ ID NO: 68390 - DNA, 2256 bp, Glycine max
  Peptide Sequence Number=SeqID_160075
atggcgcccaatccaagagtggtagcggcctttatggcaatgtcgaatctcgggattcatgaatcaaaagttaaaccagtgttgaagaaactgcttaaattgtatgataagaactgggcactcattgaagaagagagttatagggctctggctgatgctatatttgaggaggaagaaaataaggtgaacgagccagaccagaatattaaaaacaagcctatgactgctgaaatgtgttctggcttttcaaacattcaggacggagtagtggacgatgtagaagctcatacgcatgaggaacctgtgcggcctttgaagaggttgcgtttgagaggccaagagggtcaatctttgcgccctctgactagcagtggccccagctcagctgcatttccattgaaaatgcctaaattagaagacgggacagtgcctgagagtagttccagactgcagcctcaaagcctggctgcattatctgatggaaatgcaaggattggtgctcatcatgttcccccacaagatgctgttgtcgacaagggaaagaaacctatatcacctcaagttactcccagaaggagaaggtccctttctgaaccacttaaagagtcaacagttgaaggccgagctgctctgttggcaaataacaaaatgcctcatccatttattttgatcaaacccaaggatgagcctgttgatgatataccagattatgagattccccttgcagtgattcctcctgactctccaatgggtgcagttgaaaagcaagatgtccatgacactgttgtatcacaatgcagagatgaagacgttgaacatgaagatgtttttccttcctcaaatgaagaagcaacttctaatgtatatgtagctttgtcatctatgggagaggataaatgtgatcaatcatataggactactctgacccttatttctgtcctgaaattgttgagagatacgtgtgactgcatgttggaatttgctactgattcaagtaataactcacaggaacaatctgtaaagataacacaaactgatgatgtttcaaaggaatctgagaccaatgactcatcaattgtcagaggaaataaagattcagtcattgcaaatgggtcaatcagtgttaagtcttcttcggccgtggctgaacttcaagttcctagttctatacccagcccgagtgatccggatgatgctgtactggctcccaagaaggtcgcaatgaatggtttcttacaaagtgatggtggaaaggagctggaggatcctatatccccaaattcatgtactttagtggttgttcaaaaacatcagcttacaactgatgatgtaagggcagttcatgatgttaatgacctaacaaagggagaagaaagagtgaaaatttcatgggtgaataacaccactaatgatttcccaccactctttcactacataccccgaaaccttgtgttccgagatgcttatgttaatatttctctatctcgtattgggaatgaggattgttgttcaacttgtatgggcaattgtgtattgtcatctaatccatgttcttgtacaaataaaactgggggtgaatttgcttacactgcaaaaggcctactaaaggaagagttcttggacgagtgtattgccctcagccatgatcctcaaaattatttctattgcaaagcatgtccccttgaaagatcaaagaatgatgattgtttagaaccatgtaaaggacacttaaagaggaagtttattaaagagtgctggagcaaatgtggctgtgggaaacattgtggcaatcgggttgtccagcgtgggataacttgcaagttgcaggtgtttttgacttcagatggaaaagggtggggtcttcgtaccttagaagatcttccaaaaggcgcatttgtatgtgagtttgttggggaaattttgaccctcaaagagttgcacgagaggaacctgaaatatcccaaaaatgggaaatatacatacccaattttattggatgcagattggggttcaggaactgtgaaggatagagaagctctttgcttatatgctgcatcatatggaaatgctgctagatttattaatcacaggtattggaatttctcatgtttcaccagatgtttggatgcaaacttggttgagatcccagttgaagttgagggcccaactcatcactactatcattttgccttcttcacatccagaaaagtagcagcacaggaagagctcacttgggtgtgtgagtttggtttgtga

SEQ ID NO: 68391 - DNA, 1725 bp, Glycine max
  Peptide Sequence Number=SeqID_160076
atgggtgtggtggatgcaacctgtgcagattgtaatacagggccagagtcattagttcatgcaaaccgtgattgtacaaagtctgctgaagtttggcgctttgcttggggaagcacaagtctaccttcttttgtggggttagctacaggttttgaagtattgcaaagagcttcagctcttgtacaagacattaagagatcagcagtttggggttttcgcgcgctctcccttccttctcctggatctgctaggagaagcgctgaatgctctgagcttcaacgctgtttgttagagatggcgtcttcgtatcccggttccgttagtgccgcacaggttggttcctacttcgtgggacagtactaccagattcttcgccagcaaccgaatctcgttcaccagttctactccgattccagcagcatgattcgcgttgacggagactccgttgaaaccgcgcacgatgtgttgtgtccagctgatataggctttagcacatctgaacgaccctgttattcttgggatgcttcatcgtctctaatgttgccattaccccgagattctggatgtgtatcatggggggttgtggccagattgtggcttggggtatcatggcttgaccaatgcatgtttagcggttcgtttctgtcggttagaactgagctagtggctccctcaagcattggtcgtcttatgtccgatgaacgattgacactaaatgcttttgggctaggtgtgcttgtgatggcctcaggttttgtgaagataaaggatatcggtgggaagcggaagtttgttcaaactttctttcttgctcctcaggagaagggttactttgtaatgaatgatatgtttcatttcattgatgatggagtaatgtacccaaatctggtaccagtggcatccgaaacgattgacacacaaccacatctttctgcttctcttgctgagccaccagtttctgatttagcagtttcagactacggcttagaggaagaagccagggaatatgccaactcagttcatatagatgatgatccagtggacaagtatagtcttcctgagcaccagcagcagctacaagaagaacttgaaaccgaaattgtggtggaggaaacttccgtacaggaggcatctccaccaattcataccgttgcacacactatccaagaaccccctgttgctcttgtggaagagtcctttgaggagcctcctaagaaaacatatgcatctattttacgagtttccaaagggctgccagtgttgtcagctgctccaaagcatgctccacattctttcaaaagtgctccacctcctccagagttgaaccatgtagcacagcctgctgttcagcagtcaagctctgcatctatgtatgctcccgagtcagggaccgaggcagcagaagaaggctatgcactagaagaagatgaagtaacatctgtctatgttagaaacttgcctgctaatgttactgaagtggagattgaccaagaatttaagaattttggcagaattaagccagatggaatattcattagggtccgaaaggaaattggagtctgctatgcatttgttgaatttgaagacattattggtgttcaaaatgcacttcaggaaggggaagaggcagaggcagctatcaagcagatgctccgagagggcgttttggtggtaggagcatgggaaggggaggttatcaggatggttcagactacaccagactaa

SEQ ID NO: 68392 - DNA, 1170 bp, Glycine max
  Peptide Sequence Number=SeqID_160077
atgaggaacagaggtgttgttgaggataaattggttcttttgaagggtgtcagtggagcattcaggccaggtgttctcactgctctaatgggtgtcacaggtgcaggcaaaacaactctgatggatgtacttgctggtagaaaaactgggggatatattggggggaatatcacaatctctggttatccaaagaagcaagaaacatttgcacggatttctggatactgtgagcaaaatgatatccactctcctcatgttactgtatatgaatctttgctttattcagcatggcttcgattgtccccagaaatcaatgctcaatccaggaagatgttcatcgaggaagttatggaacttgtggaactgaaaccactaaggcatgcattagttggattgcctgctgcagctattgtcatgagaacagttaggaacacagtagacacaggaagaacagttgtttgtaccatccatcagcctagcatagacatatttgaatcttttgatgagcaaggagggcaagagatatatgtggggccacttggacatcattcttcccatttaattagttactttgagggaatcaaaggtgtcaataggattaaagatggctataatccggcaacatggatgttggaagtctcgacttcagcaaaagaaatggaattgggggttgattttgctgaggtgtacaaaaattcagagttatacagaatgtttgctgatatttggtcattggcatgttgtttgaggagaaacaaagcacttattaaagaactgagtactccagctcctggttcaaaagacctttattttccttcacagtactcaacctcctttctcactcaatgcatggcttgcttatggaaacaacattggtcttactggcgcaatcctctatacactgctataagatttctttactccactgctgtagccgctgtacttggtagcatgttctggaaccttggctccaaaattgacaaacaacaagatctttttaatgccatgggctccatgtatgccgctgttctccttattggcattaagaatgccaatgcagtgcagccagtggttgctgttgagcgaacagtcttttatagagaaaaagcagccggaatgtattcagctttaccatatgcttttgctcaggcaagcaaatcctcattttaa

SEQ ID NO: 68393 - DNA, 369 bp, Glycine max
  Peptide Sequence Number=SeqID_160078
atgggggagaagaaaattttgtctcttgtcatgtttgtcatcatggcttatggtttggcagtaacaccattcactgcatgtgatcaatttcatattcctaaaacttgctatgggtatgaagcattactttctatctgtgggacttatttcgctgttatcaagtacaatccaagttccttttgttgtgatgcagcaactattgcgtttcctaaagccagtcgtagcagtgaaagtagaaggggtttttgtaattgtttgcgggttattggaccacaattagattttgtgaaatcaaagcttacaagccttcctggtgcttgtgggattaaaccttctttttctatgcagtcatgtatatatggagcctaa

SEQ ID NO: 68394 - DNA, 2112 bp, Glycine max
  Peptide Sequence Number=SeqID_160079
atggcaagccacgattgtggtcaccttgtagtcccggacaccccaaaaagccttaaagttcgtggacccttttttaaaaccttggtgaatggttatttgcatgctaagtttatgatttcaaatttgggattggaggtcatatctagatttaagggtgaagggaatagagttatggcggatttagaaaatttgcttttggaggcggcggggagaacacgccattctcgtcaaacttcaagaagaggacatggcgatggtgggagtgactctagggatgatgattcggagaatgaacatgattatccaggtcgaaaggcctctggcttgcaagttccccaaaagaagtggtttgatccaatggaaagagatgatggtgagagaagtaaggatgaaggggatgatgatgttggtggccggtcttatcacgagggtgatagtagtgatgaatctgattttggtgatgatctttataagaatgaggatgacaggcataagctttctgagatgactgaacttcaaagagagatgatattgtcagaaagggctaccaagaagcatgataaagatttattggggaagatagcatcaaagcgtgagaagggaaagacaactgtagccgggaaactgacttcacctctcacaccatcccatgtgcgttcatcagccagatctgccaacaggtcaactgccaaggatggtgcattaaatgaattgcgtgcgaaacggttaaagcagcaggattcagaagcaaaccgcaggccaagtaaggcatctagaagttcagggcctgggcttgtttcaccaaagcacagacctttcccaagtcttggtagctcaagtgatagtgaaactgaaagtaagtccctgagtgataatgaagggtcaagtgatgacgacagaatcattgatagtaatgatgacaggataatgctaggatctgaagggcttttatttgagcatataaaagaaatcaccattcggagatcaaaacttgcaaaatggtttatggagcccttttttgaggagttaattgctggttgttttgtaagagttggtattggtcgctcaatgtcagggcctatctacgggctctgcatggtaaaaaatgttgatgccacagattgtgatcagcagtataaattagaagataaaaccacacacaaatacttaaatgttgtctggggaaatgaaacttctgcaacaaggtggcaaatggctatggttagcgactctcctccagaggaggaagagttcatccagtgggttaaggatgtagagcgaagaggtggccggatgccaacgaagcaagaagtggcagaaaaaaaagaagctatacaaaagaccaacttgtttgtttactcagcagctactgtgaagcaaatgttacaagagaaaaaatctgccaaaacaagaccactaaatattgcagctgagaaggataggttaaggactgaattggaaatagcacatagtaagaataataaagctgaagtgaagaggatcatgacaagattgctagaattggaggaatctcggcaagctaagacgatggatgccagggctttgaagcttgctgagatgaatagaaagaacaggtttgagaacttcaaaaatgcttctgaattgaagccagtaaataaagaattgaaagcaggggaggcaggttatgatcccttttcaaggagatggactagatcaatgaattactacgcaggaaaaccagctgaagaggctgcaggtgaaattaatagtgccagtggtgcagtggctgatacaggcagctaccacacgggagcatctgagaccgtgacggctggtatggcagctactactgcagctttgaaagctgctgccggtgctgggaagttagtagacacaagcgcccctgtggatcaagggacagagtcaaattcgctgcacaattttcagctgccaatatcattagctatactccaaaagtttggtggagctaaaggagttcaggcaggatttatggcaaagaaacaaagaatagaagcaacagtgggatttcaagtcctgaaaaatgatcgtcagaagcatgcactgacattaacagttagtgattacaagagaagaagagggcttctatga

SEQ ID NO: 68395 - DNA, 2460 bp, Glycine max
  Peptide Sequence Number=SeqID_160080
atggactcaaaagaagaggctgaacctcatgaggataggcccacatcgccaatgcgggtcctgcagcaattatctgaaggggcattcagagttgctggggaagcatttcacaatatgtattcgggtggtgggtcaagcaaatcacaaatggggcctggtgcacatagacgaagtcaaagtgaacttgttactagaggagttgagcgtactaatagctttcagaaattaagatctcatgtgcataaggcttggcggtggggtggcagattccgccaagaagtttccccggcgagtttcaacccggaggtcatggccaaccagaaacggcagtggtatcagcttcatcctagaagtctggtgtctttgtgtaccatacacatatttgtcagaaatggttgtgtacattataaggagccaacatcgctctttgaacattttttgattgtggggctgcatccagatgctaatttggaagatgtggagcatgcatttgtaagaaggaaaaagtgggaaaaggaaaaacctgaatttctagattacaaaatgttacagcaacaaaggccaccagaaccaacattggaacctcagttgctattcaaatatcctcctgcaaagaaactaacaatgcgtatgaaggatttagctcccttttgctttcctgaaggtgttaaggcatggctgttggagaggactccgtctctaagtgaactaaatgaacttgtctatggacaggagcatttaggaaaagatgatctttcatttgtctttacaatcaaggcagcagacaatacaacactttatggagtttgcttacatgtgcctgaaattgttcagaggccccctggtatcttaggcatatcatctcctttttctcatccctctggggcatgcagccgttttctggtttctgcacctcgctgttactgtcttctgactagagttcctttctttgagttacactttgagatgttaaacagtctcattgcacaagagcgcctgaataggataactcagtttataaatgaggtgacaatcactggcagcactccatcaacacccaaactaggtgatcaaatgagttcgaatgctaactctccggatagagagtcatttagtgactggatggattgtgcaataccccttgatggtgcagctattattactgctgctgctgcagggattatatctgatgatgaaatcatacagttatcacctaaaatatgggattctcgctgtcaatctcctgttagggatgtagacaaggatggcaggaagaatctgcaagatcatgataattgtgcttttgaggccccagaaaatcttggttctatagaaagaatgcatggaatttgcgaaaatgaccaagtttctccaaaagttggaacacctttttctgctcggagtcgtgtcttggagcgtcttggaagttccgaatcacttttcagtccagttagaagcatggcatcagataacgaggaagattttttctcaaacaatgaaagagattacggggacgaattgttaatggaatgggccatggagaataagaatgatttgctacagatagtgtgtagatatcatgctgaacctattccacctcgaggaagtgaattagtcttccaccctctcgaacatttacaagctattcagtacatacgacattcagttgcttctcttgacttcagcaatgattgttcaaattgttctgaaccagctcaggacaatgcaaagctggcagctgccgaggaagccctgtcattatcagtatggacgatggcaactacttgtcgagttctgtcccttgatagtgtgctggcattaattacaggagttttgttggaaaaacaagtggtaatagtgtgcccaaatctgggtgttctatctgccactgtgctttctcttattcccatgattcgtccatttcagtggcagagtttattgctccctgttttacctgggaaaatgattgattttcttgatgccccagttccatatattgttggcatacaacataaaccagatgacttgaatatgaaaactactaatcttgttcttgttaatataccaaaggatcagattacaatgtgtcacttaccaagacttccacaacatagagagcttctctctcagttgactccaattcatgctaaactttcaaatgaaagatcaattgctagaaagcatcctgtacataggtgcaacgaagtacaggctgaagctgcaacacagtttttgaatataatgtggcactatttggaatcactctgctcagatctgaaatctcacacgatcactagtgtacaatcaaataacgacagggtttctttacttcttaaagatagcttcattgattcatttcctgcaagggaccagccattcattaagctatttgtagatacacagctcttcactgttttatcagactcacgtttgtcaagctttgagagtggcgagtcatag

SEQ ID NO: 68396 - DNA, 4743 bp, Glycine max
  Peptide Sequence Number=SeqID_160081
atggaagaactagatttccgatggtcttctcaaatacattttctgaaaacactgaatgtttctaacaatggggctgcggctgccaatcctgtagttgggtcccatatttgggtggaggatcctgatgtggcttggatagatggtgaggtcttggaggttaaaggagaagaaattaaagtcctttgcacttcagggaagacgtactttgatttcttgaacatgaatgactggtgggaatctttcaagtatagcataatgaagatatgtgtcttgttcaaagttgttgttaaagcttccagtatttatcataaagatacagaagtcccaccaagtggagtggatgatatgagaaagcttgcatacctgcatgaacctggagtcctagataatctgagatcaagatatgatataaacgaaatttatacttacaccgggaatatattgattgctgtgaaccctttcataaagcttcctcatttatatgatagccatatgatggcccaatataaaggagcagcttttggtgagctaagtccacatccctttgctgttgcagatgcagcatataggcttatgataaatgagggaatcagccagtcaatattggttagtggtgaaagtggagctggtaaaacagaaagtaccaagttgctcatgaggtatcttgcttacatgggtgggagagctgctgctgctgaaggtagaactgttgagcaaaaggttctggagtccaatcctgttctagaagcctttggcaatgcaaagactgttaggaacaataattcaagtcgttttggtaagtttgtggagattcagtttgaccagagtggaagaatatcaggagctgctatcaggacttatctgcttgaaagatcacgtgtttgccaggtgtcagatccagagaggaactatcattgtttctacatgctctgtgctgcacctccggaggatgttaaaaagtacaaattaggagatccaagaatgtttcattatctgaatcaatcaaattgctttgagttggaaggggttgatgaatctaaagaatatagggatacaaggagagcaatggatattgttggaataagttctgaggagcaggatgcaatatttaaagttgttgctgcaattttgcatcttggcaacattgaatttgcgaaagggaaggagatagactcatctatgcccaaagatgaaaaatctcggttccatctacagactgctgctgagcttttcatgtgtgatgcaaaggcacttgaagattctctttgcaaacgtgtaattgttactcgtgatgaaacaattacaaaatggctggatccggaagctgctgcactcagccgagatgccttggctaagattgtgtacacaagattgtttgactggttggttgataaaattaataattctattggtcaagaccccgagtcaaaatccttaattggcgtgctggatatttatggttttgagagtttcaagactaacaggcaatacaatggtaattctgagagtagagctaccccaagtcagagaatgaactctggattcccaattctaaccaatttcctcctccatgcaagtgcgcaatgcttgactggggattactctaatggacaaaagctttttgagcaattttgtattaatttgaccaatgaaaagcttcagcaacattttaatcagcatgttttcaaaatggagcaagaagaatacaaaaaagaggaaattgattggagttacattgaatttgtggacaatcaagatattctggatctcattgaaaaggtaacttatcaaactgaattgttcctcgacaagaacaaggattatgttgttgcagagcaccaagcacttctttatgcttccaaatgcccctttgtatcgggcttgtttcccccttcacccgaagaatcttctaaacaatcaaagttctcttcaattggttcacgatttaagcaacaattgcaatctttacttgaaactctcagtgccactgagccacactacattcgttgtgtaaaacccaataatcttcttaagccagcaatttttgagaataaaaatgttctgctgcaactacgttgtgggggagttatggaagcaattaggataagctgtgctgggtatcctactagaaaaacctttgatgaatttgtggatcgatttagccttcttgcacctgaagcattggctggaagttctgatgaggtcactgcttgcaagaggattctaaagaatgttggacttgaaggctatcagattggtaagacaaaggtgtttcttcgagctggtcagatggcagaactagatacccgcagaactgaaatcttggggaggtcagcaagcattattcagagaaaagttcgttcctatttggcctgccaaagtttcatcttgcttcgtttgtctgctgtgcagattcaagctgcgtgcagaggacaacttgcacggcaagtgtatgagggaatgcggcaggaggcttctagtttagtgattcagaggtgcttccgcatgcatattgcttggaaggcatacaaagatctgtatacctctgctatctctatccagactggtatgcgggggatggctgctcattgtgagctacacttcagaaggcaaactaaagcagcaattgccattcagagccactgccggaaatacttggcacaacttcatttcgcaaaattaaagaaggcagcaattacaacgcaatgtgcatgcagaggaaaagttgctcggcgagaattgcgaaagctcaagatggctgcaagagaaacaggagctctccaagctgccaaaagtaagcttgaagagcaagttgaagaccttacattaagattgcagctggaaaaacgtttgcgggttgacatcgaagaagcaaaagcacaagaaaatcaaagattacaatctgctttgcaagagatgcaacttcagtttaaagaaactaagctacttcttgaaaaggagagggaggctacaaaaaaagcagctgagagagcggctgtcatacaggaagttccagttgttgacaatgctttgttggagaagctcagaagtgagaatgagaaactcaagaacatggtgagttcgctggaaaagaaaattgatgaaacggaaaaaaggtatgaagaggcaaacaaaattggtgaagaaaggttgaagcaagctttggatgcagagtcaaaagtaatccatttgaagactgctatgcaaaggcttgaagagaaattcatagacatggaatctgcaaaccatattcttcagaaacaatctctattaaactcatctgtgaaaacaatagcagagcacctgtcttccccattggacgagaagttagaaaatggtcaccatgcggcagaagagcaggaagctgttgatacatttgttacacctgtgaaacaatttggtactgaatcagacagtaaattgagaagatcttacaatgaacgacaacatgagagtgttgattcacttgtcaactgtgttatgaaaaatattggattcaatcatggaaaacccattgctgcattcaccatttacaaatgtcttctccactggaaatcatttgaagctgaaagaactagtgtatttgatcgcctcatccaaatgattggttccgaaattgagaatcaagacgacaatgatcatatggcctattggctgtcaaatacttctgcgttattgtttttacttgaacaaagcctgaaatctgggagttcagcaaaagctaccccagctagaaaactgcctaatccaacatctctttttggaagaatgactatgggtaaattgcagagttttctttcatccccttcttctgccaaccttgctgctcctccagcagatgttgtacgcaaggtagaggctaaataccctgctttgcttttcaagcagcagctcacagcctatttcgagaaaatatatggcatcattcgagataatttgaagaaggatttaacaccggttcttgcattatgcatccaggcaccaagaatatcaaagggagggttacgttctaaccgatcccttgctaaggactccccagtagttcactggcagagtattattgaatccctcaatacactcctctgtacactgaaagagaactttgtgccaccagttcttatccaaaagatctttagtcaaacattctcatatattaatgtgcaactcttcaatagcaatggggaatatgtgaaagctggattagctgaattagagttgtggtgctgccaagcaaaggaagagctccaactaattgcctggagcacaaacttgcagtatgcagggtcatcttgggatgagcttaagcacataagacaggctgttggattcttgggatggattagaaggagattagggatattgatatatgcatggtcacttcagctcactgcatctcaatgttttcctttccatttttcttcccctcaccttctggttctgcttctccagatcttgagtgtccagcagctatatagaatatgtacactttactgggatgctaactacaatactcgaagtgtatctccagatgtcctttcaagcatgaggatgctaatggctgaggactccaacaatgctcagagtgattctttcttgttggatgacagttccagcatccccttctcagtggatgatctctctacatcactgcaagagaaggacttctcagacatgaaaccagcagacgagcttctcgagaatccagccttccagttcttaaaggagttggcgcaggaagcttag

SEQ ID NO: 68397 - DNA, 333 bp, Glycine max
  Peptide Sequence Number=SeqID_160082
atgagtcatggcccgagaagaatgagaagaaaagctataaagaaagaagatccaagaaggcgtatattgcttgggacgacaatgactcatccgatagttcggagaaggagatcaaccttctatacaaggactatgaaagtgatgagcacatctctcaagaagtttaagcaagaaaaacaaaatcaaagaagcgcaagggttcttcgagtagaagccaacggcactccgaggctcaggatactccaattccttcctccatttcctcctcctcattgttctcatcgaaagaacaacctttttattctaaccttgaaattcaagaaagtaccttga

SEQ ID NO: 68398 - DNA, 495 bp, Glycine max
  Peptide Sequence Number=SeqID_160083
aaaaggtcttcttggttgaacactgaacacaagggaccaacgttccttgggttcattgcaagaagcaggatttgctccttggttaaacattggactcaaaagactaaccgcttttgggtccattacaagaagcggatttgcttcttggttgattactggactcaaaagactaaccgcttttgggttcattgcaagaagtgggaggggattcctttgtggttcattgcttgtaaaggattttacaaggatagtggaaatctcaagcaagttgcttggggactggatgtaggcatgggttgtggccgaaccaaggaacatgagatggaattgcaaagactcaatcaaaatgagaaagaacaagcaaacatatgtttaatgaccaagaatcatgaaagcgatgaggaggatccgttaaagaaaaagtggtacatagacagcagatgctctaaacacatgacgagagatgtctcaaaattcacaactatctctccttag

SEQ ID NO: 68399 - DNA, 426 bp, Glycine max
  Peptide Sequence Number=SeqID_160084
atgaatatagctttaccaagtaacacaagttccccgagatttcgatactcaggtcataccgttttatactacttgcgcgatctggtgcacttaccgggttcgaacaagtttttggcgtcattgtcggggaacttctttctctttggaaaatctcccacaggcaatttagttcctttggacttggagattgaagctacgttaagaaggaacagagccgaaaggagaagaaaactactgcaagacaggacaatagcgtccattcttgaggaagaaactcatttttctgattcttcatcatctgaatcaccatcatcaagggcatccgcttcaaacttaccagaggccgttaccatggctgatgaacaccagcaaagggttacccttgaggactactcaagcagggaaactattccaaggattacctaa

SEQ ID NO: 68400 - DNA, 312 bp, Glycine max
  Peptide Sequence Number=SeqID_160085
atgaagcttctttcttgggagacccttctgttcttccttttgagggcttatggccgaagggttgaggttttggcccaaaaggcttacggaaggccggacatgacatatgtcagggtatttgtttggactttgcttcctccaaggaagtcaaacaggtcggccatgtcctcatccccctgggcttcgtccccacctctggaatcagtgtctgtcgaagtctgtgtcggcttgcgggaccgcactggaaccctcttcagtggtgcccttcctggacttcttcgcggggagcttcttcagaactatttccggtga

SEQ ID NO: 68401 - DNA, 349 bp, Glycine max
  Peptide Sequence Number=SeqID_160086
atggacgaagatcaatgggcgtatgacaatacgatgtctgaagaagttgatatgaattttgaagatgaacaatattgtggtgtgaatgaaggacatgttgattgttcaaacgcttttaatacttttcagtgggctcgaacggttgcccatgaaaacggttttgttatagtaattatgaggtctgatacatatactggtagtagaggaagaacttcatttgtgttaattgggtatggaaggagcggtcagtacaaatgtaggaagaaagaattttttagaagagacacaagcactaagaaatgtggttgtccctttaagctttgtgggaaatcagtacatggaaaagaag

SEQ ID NO: 68402 - DNA, 333 bp, Glycine max
  Peptide Sequence Number=SeqID_160087
atggtgaaagttggaacctcttacgtgcgatcaacgtctcattttcgccaaaagttgggcccagggcttccccggtatcaacagggacaccaggatttatttattctgcgaagtgatcttccgtcacaggctgtccctcctgttcagctactgacggggtggtgcgtaacggcaaaaagcgccgccggacatcagcgctggcaagctgcgcaactgttgggaagggcgatcggtgcgggcctcttcgctattacgccagctggcgaaagggggatgtgctgcaaggcgattaagttgggtaacgccagtgttttcccagtcacgacgttgtaa

SEQ ID NO: 68403 - DNA, 243 bp, Glycine max
  Peptide Sequence Number=SeqID_160088
atgtatctttttaaaaatctttggcatcatcaaaataatcttggaagctttgcttctacacttatcagtgatggtgggtcacatttttgtaatgcacagttgcagaatatgttggggcactacaatgtcaagtataagatggtctatgggaaggcatgtcatccaccgatagagatgaagaacaaggcttactgggctctcaaattcctcaattttgatgaatccttatcaggggaaaagtga

SEQ ID NO: 68404 - DNA, 672 bp, Glycine max
  Peptide Sequence Number=SeqID_160089
atggggtcggaccaagcatcatcttttaagaaaaggttctatcatgtcaaagtcaagaatctagaggtagccagcttgcgaaaactggggcagcagatggatcgagttcaacatcaggctttcagcaaggtatatgggaagatttgggatctggcgatgaaagaagtgtccgctgaagccatcgcatctctcacccaatactatgaccaatcactcagatgcttcacttttgaggactttcagttagcaccaaccatagaggagttcaaagggatcttaggatgcccgataggaggaaggaaaccatgccttttttctgggtactatccttctatggtgagaacaataggagtagtcaagatcttggaacaaaaattagatcgagtgaagcaaagtaggaatggggtagggggaataccaaggaaatgcttggaggagaaggtggaaactctggccagccaaggagagtgggcatcattcatcggcgtattagcactgctagtgtttaggacagtactattttcgaatgtagacgggctggtggatctagcaacaatcgatgcttttcttgcttatcaccacgacaaagaaagcccgatcattgctgttttagcaaatgcgtatgatacattcgacttaagatgcgaaaagagcagtgtgaggattgtttga

SEQ ID NO: 68405 - DNA, 406 bp, Glycine max
  Peptide Sequence Number=SeqID_160090
atggtatatcgtgttcgcccaagcgttgatgagtatgataagttaatagagtttgtctgcttggagggtttggattgggaaatggaaaaaaagctacatgaggaaatgaaaaggagtggtttctgtctcaagggcatcacaaggggtttgattagagttgtcaaggagacggagaaggaggttgtggaggctgagaacattgctgcagtggatgagcctgtggtagctgcagacgtacatgcatctggtgcagacgctggtgatgaagctaagggatttccaggtgggtcgcgtgacccatcagtgcttacggagtatgttgaccatgttgtagttagcgtatggaatagagaggaacgtcctgaattgaagttatcctcccacaggaggaaagtgctgaaatttg

SEQ ID NO: 68406 - DNA, 222 bp, Glycine max
  Peptide Sequence Number=SeqID_160091
atgtcgtgcttttctcttcctctcctttcattcatctccttcttcctccaagctcttatccatgacctcttatggtgtggcgtctcctctctctctcttcctttctccattccgctgccattcatcttccaagaagcaaaggaatccattgatgaagaagatccaaggcctacaagctccaatggagctacaccatgtggtatcaagagcatcttcatctag

SEQ ID NO: 68407 - DNA, 393 bp, Glycine max
  Peptide Sequence Number=SeqID_160092
atgctgaagataggaaattcgggtaaagttgtgataaaacaagacatgaagggaagaaggcataaatatgggtttaacaacaacaaacgtgagaaggcagagaagaaaagggtggtggatgatgaagctggcgacaaacatgagctgtatgaaatcatgggttctccacctgcctccactcctcgtcctcgtcctccttttcctccttctcctcctcctcctcctcctcctcctcctccttcggacgcatcggctttgccgtctgccgtgaagcggacacgcaaagcctcacgtctacgatcgttgtccactagaccacctagtgctgagagaccagtgatgcatgttgatcttgctaccgggaaggccgacggcccccacaggaagaaataa

SEQ ID NO: 68408 - DNA, 825 bp, Glycine max
  Peptide Sequence Number=SeqID_160093
atgaccactctagctcaaacatggagtgttatttccttttctaagctgattcctacctcccacacatctgatgtgaccttggacagagccaagttcatttgtggtatcattgtgaagatggatatgaatttggggtaccttatctcccaccagatctctcttattgcacaacatgatacatccagacttggattacttgcctttatcataactctatgtaaggccagagaagtccaatcagattctagatccctagagaacttgagccctgccattaacttggcatatattaagaagaactgtttgaatcttgatgatccaacagtgacatttagaaggccaaggaaggccaggggtaagagatcagaggtccccactacttcagcagcaccagagacaccaactccttcttcttccatagctccagtacctctcattcagactccagctattcctccagcatctacacagataccacttccaactcctttatctgtaggactttcagatttttcatttacaccacaaatgctgcactccatgctccagagcttacacagggggcagtccattatcatgcagagccttcagggcttgggcttgccatccgttatgagcatggatgagtttgatgcacaggtggcctggccaggagcccaaccttctccttttggagggggtggggcctctgcagctcaggagcctgaaccagaggaaccagcagtagcagcaacagagggagaggatgagctcacccctcctgagcccttttattttgatgcaggtgtacacatggctcaggaggaggagacttccatagactag

SEQ ID NO: 68409 - DNA, 342 bp, Glycine max
  Peptide Sequence Number=SeqID_160094
atgtgtgtgttggttcacttattgcaaaacagggaggaagagaaggcgatgatagggagggggagagtgattatgcatctggtgaagcttctagatggaagggaattgcgcgggaagaagaatgtggcgactgtgcagtacgtgctgtgttcgacgacgaaggagaataaggtgaaggcgcaattttcgaatctaggcccttccaaaacattttggaagctggggatcttaagaaggaagcaacctagctcgcctgggcgagctgggcgacaacctcctcccctttttttgttgaaaaatggcttccagggcatccgtaatgcttccgtaaaattcccgtaa

SEQ ID NO: 68410 - DNA, 496 bp, Glycine max
  Peptide Sequence Number=SeqID_160095
atgggtttgggtaagaacaacggcggcagaaccagcctggtaagcaccagaggaaaccgcgagaagtttgggttaggctataaacctacgcaagctgacataaggaaaagtatctcggaaaggaagaacaaaggccaaagcccatggttgggacagcaagccggaggggccctgccctaccacatcaatagaagctttataagtgcaggtttaagatacgaaggccaagtcgccgcgatatgtgaggatgactccccgaggagatcggatttggtacgaccatgtcctcctgatactaatacccgggacccggccatcaatttcgagcaagaagcgggtcggattgagagtgaagaggacgaggatgtggggcttcccccagagctggagaggataatcgctcaggaggaccgagagatgaggcctcatcaagaagagacagaactagtagacttaggaaccggcagtgggaaaaaggaagtaaagataggcacgg

SEQ ID NO: 68411 - DNA, 273 bp, Glycine max
  Peptide Sequence Number=SeqID_160096
atggttaagcgcattatgaatgtacacatgtgtcgcaacgtgcccttcgcgggcgagcgagggcgaggctcatgggtgcgctttccaaaggaggaaagatgcgcggagtcgccaccaacgtttatttgtggaaaacgtcgggaaaaccgaaggaaaccggtcaaaatgaaaattctaagttcgggagttgtatttacgtttgaggaaggtcgacaaaagcgggacttttgctcctatgtaccctcctttgttgaggaaatcagacttacgtag

SEQ ID NO: 68412 - DNA, 651 bp, Glycine max
  Peptide Sequence Number=SeqID_160097
atggccccaaggaagcttgcctcaaagagatctaggaaggataaagcggctgaaggaaccagttccgctcctgaatatgatagccatcgtttttggagcgctgagcaccagcagcgcttcgaggccatcaatggatggtcatttctccgggtgcgacgcgtccagctcagggacgatgagtataccgacttccaggaggagatagttcaccggcagtgtgcatcgctggttacccccatggccaagtttgacccagacatagtcctcgagttttatgccaatgcttggcctacagaggagggtgtgcgagatatgcgatcttgggtgaggggtcagtggatccttttcgatgcggatgccctcagccaattcttgggataccctttagtgctggaggagggccatgagtgcgagtatggccagaggaggaaccgggccgatgggtttgataaggaggccatcgcccaattgctgtgtataccggggcaggattttgcccggactgctgcggggagacgactgcggatcatgcgcaccaacatgactactctgacccagatatggatgacgttgctgcttagcaacatccagcccagcgatcataattctgacctcccctgccgaagtgtcagctggtgtacgccatcctga

SEQ ID NO: 68413 - DNA, 789 bp, Glycine max
  misc_feature (753)..(753): n is a, c, g, or t
  Peptide Sequence Number=SeqID_160098
atgacccgcacgaagaaaataggggaaatgacgactgaggccgcaaaggaaatcgctgaaaagatcgattcctttgaggagcaggcgacacagggatccttcatcccccatggacgtcaggatgttctcaccactgctattggacgtccagagcaccctggacgtgtccgtgctactggagccggtgtcaccatcaagcaatacttcggatcggctccacggacatcttgtggctcctcctcactgcctcctgaagaattacagcagctgacccagcaaatcaaggaccagctagaggagtccatcacagaaaaagtgactcggcagctcatggcatcgtttagccagatgcagtcccagatgcaatctcagggacttgcactgccaccggagcctccacttggtccctcaggaaacgatcctgagacgggtgactcagataggtgcggcttgtacatcgaagcaaatcctgctcgcctggttgccctggggagagtttatgagggatccactgttgttcataacactcctttgttgcctggccaagtaaaggtgggtgtggaggaggttaaagatccagatgctccaattcttgtacccactaatgaggtttccttagtggggcatgcaattcacaccttccttgtttggccgacacatctggtcaagtttttatcacagcagttgtgtctctggcaaaaccacctcaaaagccgaatccggaaggtcgatgatccgctttatctgatgacnttgaccatccccgagcttttcttgaggccttactag

SEQ ID NO: 68414 - DNA, 294 bp, Glycine max
  Peptide Sequence Number=SeqID_160099
atgactaaagcacgtcaaaagggggtactgaaaaaaaatgggggagatgcttgccacccagttcgcccaggcgagcaaggtgacttcctccagaagcaaccgccttctggaggaatcttctggagggttcaagtgggcctgaaccttgtggattacataatcatcccctttttgacttacggaatgttacggaacctcccgaattgtgcaacgatgcttccttttgagttccgacatgtcacggaacttcacaaattgcctgacgatgggtgccaagtacctcaaaatggttaa

SEQ ID NO: 68415 - DNA, 1849 bp, Glycine max
  Peptide Sequence Number=SeqID_160100
atgacgttgttgcgctgtcatgtgcgtgttgcgtatttaatactaatcgctggtgctatttctgcaagcgatgctctgctgcgaagcagtaataaaaggaatgtctttgatgtgctgcatgccaaaggcttcataaaatttgcgtgcgcgcacgttctcgcccatcacttccagccacagatagccttcctgcttatcgcgcgcggcgtggataatgctttcgaacatgcgccggccatagtttttaccggtttcctgcggattgaggtagagcttattcagctgggcaccgctcatgccggagtccggtaccggcgtattccaggtcactttggcaaagccgatgggtttgttggtttcggcaatcagccagctttcgttgggggctaccaggctgctgcgcagttcggccaggccgtactctttgtcgatgaattcatccagctcggcttcggagacccacatatgtttgaagtgggcgctgtaggtcatgcgccccagctgatgcagcagttcggcatcatcaggctgcgcgttgcgtatggtgaattccatgccagtcttccttcagtttttatgttttatcctgcgttacggcagagtgggggtgtcagcgggcatcctgcccgtacaggtgacccgtcattatgcgcgaatcaaaccgggtgtcatcccttttgcgtggctgatggtcttattgctgaggtgcagcgcatgcccgatctcagtcatgcggcgcggacccgccagccagcgcagcagcgtgaactcgcgctcggtcagcacatcggcgttgccgtgcggtgcggcgacggtggcaacgttttccggcgtcagcaccgcactgaccagcgtcgccagcgggcattttttactcaggatcagcgctttcttcaggtagcgggcgacgtaattcagcacggcttcatcgctgatgtcggtgagaatcaccagctcgacgcccggtgttttgagctgcatcagcagcaggctacgcagcgtctcttccaggcagcttatcatctgcccggaaaagtagaggcgcagaccttccgtaatccagcggtcgctatccatagtgaagatgttcagcattgtttcctcctgtgctcgcggttaacccatttgaacggaaaccgcgctgagccgatatcagacggcctgcgtcagggggacaacaggcaagccgggtgtcagctcctctgtatggacatgaataatatgaaaagaaaaacgcttcccctggttctcggttgtaccctctcgttatccacgctggcggcgcagccgccagccgaacactatagcgtcacttttcctcaggggacgcgcgtcagctacagcggtgcgttcgccagcgcgtttccggagggtttgccggtaggcatcggttccggtttgctgtttaccggcaggcagggagatacgctcaactttgtgaccgtcaccgatcgcggaccgaacgccgactcgcctgacatgggtaaacaggagtcgaaaattttcgtcacgccggacttcgcgccgctgctgatgaatatccaggtgaagaacggcaaagcgcaggcgacggacgcccgaccgctgcacgacgcaaagggtaatattaacggcctgccgctgcagaatggcgtcatcgggtcaaccaatgaaatcgcgctaagcgataagttgcacgtgctgcagggtgataaccggggtctggatacggaaggcattacgctggacgggaagggcggatactggctgtgcgatgagtatggtccgttcctgattaacgttgataagcagggcaggattctggcgattcacgggccgcaggccatggacggggaaaaatcgatcgcag

SEQ ID NO: 68416 - DNA, 384 bp, Glycine max
  Peptide Sequence Number=SeqID_160101
atgaataaaggcttcatagcagttaaacagcccgtgtcgtccggtgagcagatagccctccagccagccctgacactgatgctcgctgagaatttccatcacccgaccgtcacgcgccagctgctcatcatacggttcgatgtctgccatccagctgcggctggtgacgtcaaagaccggcgtcaggcgattcgaggcggtctcatctggcccgaacagacggaagttatcggcgttgcgctgaaaaatcgcgctgaggtagtggccgaactgcttagtggcttcgccgcgctggctgcccggcgcgccggtgtcgagcgcaaactcgcggatgtccggcgtgttgagcgtgcggcgcagccgtccgccgttggcatagggtga

SEQ ID NO: 68417 - DNA, 276 bp, Glycine max
  Peptide Sequence Number=SeqID_160102
atgtcggagaatcactctctctattctgcgctgccggacacggaactggcggcgcattttcgcgatgccggagtggcattgagtgaagaggccgcggtactgaatgatgtcattcgtagcgtgctggccagcgaaggccgccgacacaggacgaagcgcaggcaagtgtgctgcgcagaacgctggaaattgtggtgggttatacgccagacgacgcctgaggtagtggtccccgcgcaggcggggatcggttcagtgcataagatctgccagtag

SEQ ID NO: 68418 - DNA, 408 bp, Glycine max
  Peptide Sequence Number=SeqID_160103
atggagttcgtctctaccacttatcgattgaggtcgaagaaaactaggaaaggaaagagtcccggaaagggtactccagggcgttgttcttctttctccttctgcctgagttcgtctttgtcgcaaactgggctgcgcttccgtgactgcaacgacattgtggagttcgtctttgtggagttcgtgtctgccacttatcgattgaggtcgaagaaaactaggaaaggaaagagtcccggaaagggtgggaatcgattttggaagtccattgtgcttggctttaagactcccagagaagccatcgaagttgcttgcaagtgctatgagacatgctggaggcatttcaaaatgggtcccattctcctgtccagtgtggtgccttgtctgataaagagtgtggtggtttga

SEQ ID NO: 68419 - DNA, 294 bp, Glycine max
  Peptide Sequence Number=SeqID_160104
atggttaaatgtaattcggctgcaacaccaactgaggcaggtcttgtacttgaaagggagggcaaggaagacaaagtcgatgaaattgagttcaaacaaattgttggttctctcagatatacgaaaagacccagaatccgtcatctcctagctgttaagaggattctaaggttcatcaaagggaccgttaatactagaattctatttccaaataaagacaacagcaaaagggaggaatcttttgtttatgggaaagggaaaaatcaaaacaattctcagactgtatcgttttga

SEQ ID NO: 68420 - DNA, 477 bp, Glycine max
  Peptide Sequence Number=SeqID_160105
atgcactacatcattgtttgcattttattaccctgttcgtctaatcttgctcaagcctctaaggaggacttgattctcatgtgggcttttcttaccgatcgtcagatcgagtgggcccacttggttaggtaccatatgcataaggcattatggaccaatgcaccacttccgtatcctcaattagtcactctttttcttcgtcactttcaaattcctctagatgatgaaccttttgttcaagtcaagagatcttttgccattggtgttggagcgagagatgcttcctctactcttatgcatgaagtcctttatgagctacgtggccttcgagcattcgtcgctgactgttttgatggcatggatagtcgcctggatgccatgcatgcttgttttgaaggcatggctacacggattactcagcttgaagacgacatgggtttcatcctccattgcttcgatccaccggctgccccatag

SEQ ID NO: 68421 - DNA, 411 bp, Glycine max
  Peptide Sequence Number=SeqID_160106
atgttgagtcagcatcccaatatgttaaactacactgactctgtgataaagagagaatctcctctatccctgcattacaaactgtttgaggggacacatgtcccagacattgtctcgacatctgtctcgacatcagggaaagctgctgcttcaggtgctgtgtccaaggatgctctgattgctgaactcaaggacacatgcaagatgctggaagcaaccatcaaagccaccacagagaagaagatggagctagaactgctgatcaaaaggctctcagagagtggcattgatgatgaagacgcagctgaggaagaaggagaagcagctgaagaagaagaagaagctgctgaggaagaggaagatgcagcagaagagacagaatcagatgatgattctgaagccaccccatga

SEQ ID NO: 68422 - DNA, 165 bp, Glycine max
  Peptide Sequence Number=SeqID_160107
atgggtcattccatcctcagtgccaagtccaaatccgtacagccaagaacaatttctacggcttccttccagacctggaaatttgtcccattcaatattgggatagaattcacttgggcaacatttgcagcactggacatgcaaataaatggaaatgatccataa

SEQ ID NO: 68423 - DNA, 1959 bp, Glycine max
  Peptide Sequence Number=SeqID_160108
atggcaatcaaggtcattttgcatgatgtgattgacattgatgatgactctgaggatgtagtgattattggcgaaaaagttaacaatagtaacaaagggaagactattgacgccattcatgatgatcatcaagttgtgaaaacggctgattatacttactctctgcctgctgtggaaaattttggatcagttagtgggattgcatcttctaacaatttcccttctgtgtcaaataatttaatcaatattgatggtcatggttctgatctatcatatgacgatgatgactactttgatattttgtcggaagattatatggatgtagatgagtatgctttattacagaaacactttgataatgtggatatacctactggaattgaagcaccttttacttggttgccaccagactatgtcgtaggttcgaagaagactggaaataatacattgtatccttggcatcatatgcaatctaatgctaataaaagtcccatgacaccctcttctcagccctctttatcattagagccaactaactctgaaattcaagcatcttcatggggtgctattaacattccaatcaaaatgggtaatgttgatcactcttctggagtagagttgtcttctcaatatatttctgaacctgccccttctaagaaatcagctacttcaaaactcagagggcgtacttcaaatgcttcattaggagtagagtcatctaagtctcactggtcttcagggcctttccatagtaaaaagaagcctgcttcaacataccatggttttaattaccatgcagaggccgcgaagatgccacatgcaggtgagctgccatattgggggcaatttaaaagtgctaagaaggaagctggcagtagcatttcatccctttcaactttcattgaacatcatggatcattgtatcctccaggaatagaatcaggaaaacattggtgggagatttctcataatgctaaaccattttctacacatcttaataatattcctaatcatatttattatccatttgatcctcttgttgcccatcctgagcatgtgtttgataacaactgggttcacgattctgccagagatggatttaatggaaaaactgtggatggccctattgtgacaatcacagatgaagccaaagaggaaattctgaggaaattcagaagttttaaacaatttgacactgttgaagacatttcagaccatcacttttttcgcagtaattcttcaatgcatcagcctcccaagaattgggctaaaaaaatccaggaagagtggaggattttggagaaggatttgccagcttcaatatttgtccgagtttttgagtcaaggatggatcttttaagggctgtgattattggagcagaagggactccttatcatgatggccttttcttttttgatgttttctttccaagtgcctatcccaatgtaccgccgaaagtccactaccactctggaggtcttcggctcaacccaaatctgtatgcttgtggcaaagtatgccttagtctacttaacacctggtccggcagcaaaaatgagaagtggcttccaggcgtttcaacaattctccaggttctggtctctatacaaggtctaatactgaatactaagccttactttaatgaacctggatatgcacacatgagtggttcagcaaatggtgaaaagatgtcttttcagtataatgaggacacattcattctatcattgaggaccatgatgtatatgatacgaaagcctccaaaggggtggaggtgcagaggtgttaggaagtcccacatcacctccctccattcttggggtgcaacttatatatctgttgggcaacttcacttaatgtcaattagttttaagctgaaatctaacatgaaggaaggggtaggggggcaattaaagaagcaatgccaaggcatgcttgtgccttttgctggaagataa

SEQ ID NO: 68424 - DNA, 4551 bp, Glycine max
  Peptide Sequence Number=SeqID_160109
atggtcatgaattttcttctctccatcctcttttctcttttcactttcttctccttcaaccctgtctcctcctttgcctcacaaccctcttacaaagatcactgtgcttccactgttccagactcaacccccaccaccaaactcagcctcaagcatttccctcttggtgatcatcacactggttcgtacacaggaggtgatagcattattgatgttggtgcttcttggaaccgcttctccttttacctctcaaaaaggaacacacgtgcaactcaaaccccaaaccttttcaaacttgaaggaactgtatcatttagaagcaccaacacattcaatgatggtggtggttcatattatgggggccaacgccgttaccgtaaaggttacgtaaccttcaagcttgaagggttttggcatgcgtcttcagggaaggcttgcatggttgggattgggagtggttattccaaaaaaggtaactctctcaatgtgaatgctgtttttaagctcaataatgtgttcaatgcaagcaacatcactagcttggttagtggaagcttggagagtttgagtcctcaaaaggatgagaactactttgaacccatttctgtgttgatgtttccaaaaggaaattacagttacaccttggattccatagaagttgccaacgagttctctcatgggagtgatgctgagcaaggattagcattgaatttaaattcattgagtttttgcaaacctcccctctcttgggggattaggagactccaattggagtactcacttgattgccgttcttctaagaattgcacttctataagtgggagttttggtaaacttccatctctaatgtctttgacaagcactggatgttctcttactactgagaaacataggttgagggttcaagtggaattttcagatattggttcttattggattaaccaaagttttgacccaaaagctatgttagtaggggaaggatggtgggatgagaagaacaacatgctgtgtgtagttgtttgccatgtcatgggcaactcatcatcattgtctggcactcatgttggtgattgctcaataagactaagattgagatttccctcaatttggtcaataaaaaacactattagcatagtggggcaaatttggagcaacaagaggccaaatgattcaggacatttcaagatggtaacatttagaaatgatgaggagagtggggtgggaggccatggcttaaagtatgagtatagccagctagaaaaggttaacaaatcatgccctaaacacaagcctaatgacaaggggaaaagatatcctgaggcctattctgatgacatgagatttgatatgtcaattagagagtccaataaaagggtagcatggggttattcagcacccttagctgttgatgatgaattttatgagtctggcatgtatgcatcttcttattctttctcaagtttctcaactgaagttcctgatggaaccctcaacatcaacgacaacaatggtagcttatttaacatgagctacaagattagcctctcagtgatatcatattcaaagataggggacaatacttctgtgtttaatttgtcctctgagagagtgaagatctctgcagaaggagtttatgatgccggagcaggaacgttgtgtatggtaggttgccgtgaccttctctcaaacacaaacactgagataccaatagctcattctgtggactgtgagattctactgaagtttcagttcccatcattggacacatatgatggaggctacattaagggaagtattgaaagcacgcgtcatgaatctgatcctctttacttcaagcgtttagacatatctgcagtggcatattatagggaagcagcaagaagaaatgtttggagaatggatgtggaagtgatgatggctctgatatctacaactctatcatgtgtttttgtggggttgcaactcaacaaggtgaagaaagaaccaaatttgctccccttcatctcccttattatgatgtcaattcttactttgggtttcatgataccccttgttctcaactttgaagctcttctcactcaaaatcccaacaacacaatgcgggtgtttagaaataatggatggcttgaggttaatgaaataagtgtgaggctgatcaccatggtggctttcttgttgcaatttcggcttctgtatctgacttggtcagcaaggaagagtggtgagagcaagaaagggctatggattgctgagaggaacagtgcttatgtcacttcactcttgtatgcagcagggttattgattgcatggttgttgaagttgaagaatggagataataaggattctgtgtatgtccctatgtaccagccttcaccttgggagaacatcaagtcttatggtggtttggttttggatggttttctcttgccacaaatcattttaaacctgtttttaaacatgagagacaatgttctttcattttctttttactttggaactacttttgtgagactcttgccacatgcctatgatctttacaggactcacagtgatgctgccctagatagtcgatcatactactatgctgatccaagtgaagatttttactccactgcttgggatattgccattccattgggagggtctaaggtatatgaaaaggtgcctgaaaaggtgcctgtggttactgaatcagaagctgaaaccggtaagtatcttaatttggatgctgtgtttaagcttgataatgtgttcgatgcaagcaatatcactagattggttagtggaagcttggagagcttgagttctgaaaaggaaattgccaatgagttctcttctgggagtgatgctatgaagggtgagttctggtccactgccatttctagtgtctttgaaaggcatttttcgaatactggaaactattggattagcgagagtttcaatcctaaaactatgttggtaggtgagggatggtgggatgagaagaaaaacatattgtgtgtagtggcttgtcatatcataggcaacacttcatccttggccggcactcatgtgggtgattgctccataagactaagattgagattcccctcaacttggtcaatcaatagcactagtagcatagttgtccaaatttggagcaataagagtactaatgattcaggctacttcaacatgataaaattcagaaatgaagaggatggtagagtgggaattcaagctacaaagtatgagtatagcctactaaacagagttaagatgtcatgcctaaaacacaagcctgtgaagaacaaggggaaaagatatccagatgcctattcttctgacatgagatttgacatggcaattagagagtccaacaaaagagtagcctggggttattcatctcccttggctgttggtgatgagatctctacctttgatcagaatgtctcaagctccattgtagaagctcctgaggtagtactcaacagtggtggcttgtttaacattagctacaaaatcttactgtggtataattcaacctcaaatgacaagaattccctgcttaatcagtcctcttggtcagtgaggatttctgctgaaggaatttatgattccggagcaggaagcttgtgtatggtaggttgccgcgatattcacttgaattctctcaaaccaacagctcattctgtggattgtgagattgtagtgaagtttcagctcccaccattagatgcaaaaagtggaatcttcatcaagggaagcatcgaaagcacatgcaaaaagtcagattctctttacttcaaacctttggagttatcttcagctgcattttacactgaagcagcagaaaaagcagtttggagaatggatatggagaccatcatggttctgatatccaccactctagcatgtgtttttgtgggattgcagctgtatcatgtgaagagacaccccaatgtgctccccttgctctcacttgttatgatgacaatgcttactttgggctacatgataccccttgttctgaactttgaagcacttcttgctcaaaatcctaacaacaaaaactgtgtttgcaaatgttggagtgatgaaagcaataaaggcctttggattgctgagagaaaggctacttgtgtcactttacccttgtatgctgctggcttattggttgcattgctgttgaagttgaagaaagatggagatggggttccggtgattactccattgaaccaaaatcattcatcttgggagaacttaaaatcttatggtggtttggttttggatggctttctcttgccacagatcattctaaacctgactcataattatgctcgtgtagatagtgggtcatacttctatgcagatcctagtgcagatttttactccactgcttgggatattgtgattccattgggaggtatcttgtttgctatcattatctacttgcagcaacgttttggtgctcattgtattctgcctcaaaggttaaaaggatctaagttatatgaaaaggtgcctgtggttgcagaatcagaagctgaagtagagaccaccaacttgtaa

SEQ ID NO: 68425 - DNA, 216 bp, Glycine max
  Peptide Sequence Number=SeqID_160110
atggctggcgatccatggccaaggcaaatcgccattgccattggcgatttggccttgactgacgcgacgcgctctgcccttcactgccatggcaggcaccctcagctgttggaactcgccagtttgactggcggttcccaatggcttctgcaaatcgccattacggctagcggattagggtcatatcgccactgggtgtggcgggttgctcactga

SEQ ID NO: 68426 - DNA, 279 bp, Glycine max
  Peptide Sequence Number=SeqID_160111
atgtctcgaccatctgagaggattgttccacagactgcaagaacctcaaaactcgcttccaatttcctccacatctatcatacagctccctctgagaattcaaacccatccttgcaaagaaaactaagtgtgactcaaagaacctgcagaaagattcacagtgacagcaaccagcaactccccctttggatcacagcatcaaattttgagacgaaatctcaggcaattgaagcagcatatgaagaacacctcagaggggagaaaaacatgggaaattga

SEQ ID NO: 68427 - DNA, 477 bp, Glycine max
  Peptide Sequence Number=SeqID_160112
atggccaacacaatcctaaacctcacaacaattattattctactcatctctttggctctacacaattcccactttgttgtttcttcaactgatatagatcaagatcatgactttaatgaagaggaagaggaagagtatgttctagacactccaataccccatctaggaccaagaagcaggttcttggcgaccataataaagaaaggaagacagtgtgatcgtgagactaataatatatgcaacggggttcgagcgaacaaggggagagaccttcttttctgctgcaagaagcattgccgcaatgttcttagtgacaagaacaactgcagtgtgtgtggcaacaagtgcaagcaaggagaaagatgctgcaatggggtttgtaccaatgttttatccaatgtgcgccactgtggcaagtgcaacaagcagtgttcacctggagattcatgtgggaatggagtttgtggctatgcatga

SEQ ID NO: 68428 - DNA, 1046 bp, Glycine max
  Peptide Sequence Number=SeqID_160113
atgagcaaagccctgggagcaactacagaagaagacgaagaagacgaccaacaacatccacaacaagattgtttctacgactcacacgaccgtttactttcactctcttcttcatgctcttgttccaactccaactccgacaacgaaaacgacacccaagaccaccaaaacgacaccagcctccccaatttcaccaactacgacatatggatctctcaaccctcctccgtctccgaacgccgcacgcgccttttactttccctcggactctcttccctcacgcgctcaaaccctcgcgatcgcgcgtcccctctccgatccgtatccgacaccaccgcaaaccctaacaagccaccaaatccaaaaccacccccaccgccgccgccaccaccgattgaagagctgtgcacgattcgagatctcgataacgggaaagagttcgtcgtgaacgaattggagaatctgcgggaggttgccacggggcggcaattgacgatggaggagtttgagatgacggtggggcattctcccatcgttcaggaactgatgcggcggcagaacgttgaagaggcgagcgttgattccaatgcgggtggttctaaagtgaagaagaaggggacggggtggttgaagagtatcaagagcgtggcgagttcggtggcggggtatagggatcgccggagtagcgacgagagggacacgtcgtcggagaagggcgggaggcggtccagctccgccaccgacgacagccaggagggagggggcgcgtttcacgggccggagagggtgagggtgaagcagtatgggaagagttgcaaggaggtgactgctttgtacaagagtcaggagattcaggcgcatagtgggagcatttggagcattaagtttagtttggatgggaagtatttggcgagtgctggggaggattgcgtgattcatgtgtggcaggtggtggagggggagagaaagggggagttgttgttgttggatagggagaagggggaggatgggaatgggaatgtggatatgtttttggtggtgaatgg

SEQ ID NO: 68429 - DNA, 309 bp, Glycine max
  Peptide Sequence Number=SeqID_160114
atgtacaggctctcctcgtacttcatgtcaagggtgcatgttctggtgtttatttcatgggtgaagtacatttccatcagctactacaactaccagctctttatcgcgtctcagtatagcaatggcgagacatacccttgttctactggccagtgtcaagttgcggaatttccttctataaagcaaacagggtttcatttcaatttgcaggagcaagtcatggctgcatctgctctagtgataatgatgatagattacagacttatagcctatgttgctcttatgaggattggtgtgacaaagaaatag

SEQ ID NO: 68430 - DNA, 147 bp, Glycine max
  Peptide Sequence Number=SeqID_160115
atgtcagcaatatatgccacagcatcagagttaaagctggtcaacagtagcgaatccattgactgggaacaacttggtcctgcgtccaaggggagggaggacttagccagaaataataatcttcctctgattacttcatcggtatga

SEQ ID NO: 68431 - DNA, 420 bp, Glycine max
  Peptide Sequence Number=SeqID_160116
atggcaaattgtaggaaaaaaatttgcaaagagcccctttctcccaaacccataagagccacagggccaccatcaaaaccaccaaacaccaccctagcgccaccatcaaaccaccaaacacaaaacgttgatgtgcgagtgcgtaacttcaccagcggtgaagtgcagcgcctgcgcgaagtacgcgtccacgatctccgggaggagctcgttggcgaagtcgagattatccatggcgacacactccgtacattggaggagaagagcgaggagtttgagaccggacgactcgccgccgtgaggttcgggatcgaaggcttgctcctccgcggtttccgcggcggttattttgccggagaagttggttggcttgaaggaaggctcggcagagggttctggcttccgcggtgggagatctaa

SEQ ID NO: 68432 - DNA, 1686 bp, Glycine max
  Peptide Sequence Number=SeqID_160117
atggagaggaatctgcattttagaaagggaatgatgtttcagacgtgtatgccccgaaagatgctgctgaagattggcctgcacctaagcagattcattctttttattttcaagaaaaatcaagcccggtttcagatcacagaagcactgaaggcaaagcgggctgaacgagtagagttgatttctcaggtcaagtctctaagaggcgacagtaggcaatttcagagtattgtggatgagaaattgaaagagattggacctctgcagcaagcactgggcaagctgcggactacaaataatgccggccggggtggtttgtgttcatctgaggatgaacttaacagtgttatatatagtttacaataccgcatacagcatgagagcattcctttgactgaggaaaaacaaatcctccgagaaatcaaacagcttgaggggacaagggagaaagttattgctaatgctgcaatgagggccaaattacaggaatctatggggcaaaaagaagccattcaagatcaggttaagcttattggtggggatttggatggagtgaagaaagagagagaagcaattcggtccaaaatcaagcaaattgatgatgcactgaaagccatagacaaggatatccagtctctacaggaggaactgacagctgtttctcagaagagggacaaagcttttgagagtatacagcagctaagaaaacagcgcgaggagggggctgagaaggtggagaatggggagaacacctatttctaccaaagtcgtacggttctgaacaaagcacgggagctggctgcaaagaaagatattaatgctcttgatgaagtttcacagacagaggttgagaaatttatggcactctggaacaaggacaaagcatttaggaatgattatgaaaaaagaattttggcctcattggatatgcgacagttgagtcgggacggacggatgaggaacccggatgaaaagccaattctggaagaaccaaaacctgctgaagctgaagcattaccaaaaatggctgcaaaacagccaaaggaggaacctaagccttctccacaagaaactttgcctgctcagaaagaatccaaaaccactcagaaagattccaaaaacaaggggagggatttgaaatccaaactggagagtaaggatgtagcagaaactgatgaatatgaatttgaaagtcccgaaaaggaggcccctgccaaagagcctgaaattgatccagcaaagctgaaagagatgaaaagagaggaggaaattgtgaaggcgaagcaggccttggaaagaaagaagaagttagcagagaaagctgcagccaaagcagccatcagagcacaaaaggaagctgagaagaagcttaaggaccgtgagaagaaagcaaagaagaaatcaggcactgcagccgtggccaaccctgaggacgaaccgaaggatgaagttgtcgaggttacagagccagaaaagattaacgatgatgtccaagccccggctccagtgaaggaaaaggtccaaaaggagagtggcatcaggtccaggggccgagcaagaggcccggactcgattccaaaagctattattaagcggaagaagtctaacaattacctgatatgggctgcagctgccaccttgctagtcctcctgttggctgtgcttgggtacatctatcttttttga

SEQ ID NO: 68433 - DNA, 240 bp, Glycine max
  Peptide Sequence Number=SeqID_160118
atgtctgatggtcctagaaagtctccgagaaagagtaatgttgagggaccatcaagagcccaacaagctaggaaatcaaacaacattcaatgttctacttgcaaaaaaacaaattatgatgctgctactaatgctcgaagtggaaatggtaatgttgtcgaaacacattcaattgcacatgtccatgctgaaaacattgaaccaagtagcacaagagcaattgcatcgtccatgctttaa

SEQ ID NO: 68434 - DNA, 246 bp, Glycine max
  Peptide Sequence Number=SeqID_160119
atggttggtgtgcttccaaagagaagaacactgatgcggcataggaagttgcaagggaatcaggacacgatggtgtactccatcacacctgaccacaacattcagtcaacggcgcaagacatgacccagttctatgtgtccccttacgcccacactcgatcaatgctccacgagctcagacggtatttcttaaagaagaagatcattggcgtgagggaagagttgcgagttcaagaacgggattga

SEQ ID NO: 68435 - DNA, 132 bp, Glycine max
  Peptide Sequence Number=SeqID_160120
atggtgggagcaggtttgaaaaaggatcttaaagtgtctagggttgtgccaggagggtgcgatgatttaccttacgggcaaggtctctggttcaagtccaggatggccaagctgcatcaaggaaaagaatag

SEQ ID NO: 68436 - DNA, 489 bp, Glycine max
  Peptide Sequence Number=SeqID_160121
atggggtacattcagacagttcctccgccaccggttcgtgattcgttgacaggtactgatatagacgaccggtgggtacaatttgcagatcatgtagcgcctacaggggagctctgtgtagttcctagacaggtggccccagactacatggagtggttttttcagatttcacacccctttgtgacgctgacggacaacactgctgagcccagacctgcgccttcccttcccactcatgatgatgacttcgtggagccacctgtcggccagattccagtcacgtcagatccccctgcacattctgtggttgattgcacagcatgtgtcaggatgggaaggattgttgagcatttggagcgcgtcatcaacctcaggatggtgactgcagggactgacttatatgatatcatggatctttgcttgaggatagctagagatgacgacccagatgacagtcttaggccacgacagagaccccgcatagattag

SEQ ID NO: 68437 - DNA, 381 bp, Glycine max
  Peptide Sequence Number=SeqID_160122
atggccagcagtatcattcacaacaaggacaatggagaaatcaccctggaaatcagtttaataaagaccatggtggtccatcaaataggccacctcaacaagggcctagtctctatgatcaaacaacaaagctggaagagactcttgcttagttcatgcaagtatcaatattgtccatcaagcagctttggagctaacactgagaagaatcctaaggaggagtgcaaggctgttatgactagaagcagattggccaccatgaatgaacgtgagaaaggaataggtgcagagaaacaacagctggtaactgacccaacaattgatccggtggtagaacccctgaatgaatatgaggaagaaatggaggtagaagatgggtag

SEQ ID NO: 68438 - DNA, 1143 bp, Glycine max
  Peptide Sequence Number=SeqID_160123
atggtggaggtctccacagaggccactgcctccctcgcccaatattatgaccagcctttgaggtgcttcacctttggggactttcagttaacacccacagtggaagagtttgaagagatcctgggatgccctcttggaggaaggaaaccgaaatgtttggaagcaaaggggagaaccttggcaagtcaagatgaatgggccccattcatggacgtcctggcgctcttgatcttcggagtggtcctctttccaaatatggatgggttggtggacctggcagtgattgattcttttctcgcctttcacgactgcaaggaaagcccggttgccgctatcttacccgatctatatgacacattcgaccgaagatgtgagacgaacagggcaaggatcatttgttgtacacctaccctctacgtatggttggtttcacaccttttccgccaagaggtgagacacgtttgcccgctagaaggccactgcttcatgcaccgagaagaaggaggcaaactgggaccgactcttagcaagcaaagaagaaccgtctgtcagttggttccccgatggaaagaaggaagaatcgggattcttattttatgcggaggatttccaaatgttccgttgatggggacaaggggttgcattaattacaatcccgtcctcaccataagacaacttggctaccctatgaggggggcaccattagaggaaggcctcacaccttttattgcgcaaggtttcaatagcaccaacacgggggtgcttcagggggtccgcaaggcatgggaaatggtgcaaaagaaggacaaagaacttaggggaagtagcaacgggcccatcagcggttaccataagtggttgaaagcctacgcacaaggtctggattggctcccgaatttgagagccactaaagaggtggagggtgaagctccgaaagaagacaaagagttacaagccctcaaaataaagcttgagaaagcccaagcagtaaaagaaaaattcaagtcagcagccgttaggatccgaaaagagaacgccgaactgagagacgtcaacatagccacaaccaaggccttggagcaaaagaccaagagggcccgcaaggaagaacatggttggaacaagttccaaggggctctgtga

SEQ ID NO: 68439 - DNA, 439 bp, Glycine max
  Peptide Sequence Number=SeqID_160124
gacaaagctagtcagaagaaactggcatagaacgctgaccaacctcatagaggggagcatagatgtggctctcgtgaaggaattttatgctaatctttatgtcctgaggggtaagcctctaaagcaagttagggtcagagggcatttaattaagtttgatgtggattccctcaacacttttctagagactccggttgttctagagctaggggtgactcttcctgcttactcccagttctgctcactgagaccaaaccctcaagagctggctgcccgactttgtatccctggtaggggatttgttctgaatgttgaggtcctaccatggaagctgttgaggaaggacctcactactctggcgcagacttggagcattctgtcttatttcaaccttgcccctacatcacacacttctgatctgaacttggatagggcatga

SEQ ID NO: 68440 - DNA, 246 bp, Glycine max
  Peptide Sequence Number=SeqID_160125
atgaattgcagggatggaaaagccgtatgcatcaatacgcagaaaatgcttgtacggcacaaacgggagaatttaatcctggaagcggaagagctactgaaaatgcgtgaaactatcacaagggtttatgtacaaagaacgggcaaacctttatgggttatatccgaagacatggaaagggatgtttttatgtcagcagcagaagcccaagctcacggaattgtagatcttgtagccgttgaataa

SEQ ID NO: 68441 - DNA, 186 bp, Glycine max
  Peptide Sequence Number=SeqID_160126
atggagtcaggtttttactctagtcgtccagagacatgcaagcctgacgacgcacaagattcttctctactaggcggggggcgatcaacttcgacggcgtggggaagtgtcgtggttgtcccactttatcgctttcaagacactgaagttttgttgacgcttctgatgccttttctttctttttga

SEQ ID NO: 68442 - DNA, 240 bp, Glycine max
  Peptide Sequence Number=SeqID_160127
atgatgacaaaggtgatgacaaaaagctcaaagatcaatcaaagaacaactcaagagaatccaagatcaatcaagaacaattcaagagttcaagataagaatcaagaagaattcaagactcaagaagaaagtctagagtcaagaatcaagaatcaagattcaaggttcaagatctcaagaatcaagatcaagattcaagactcaagattcaagaatcaagagaaggctcaatcaagataa

SEQ ID NO: 68443 - DNA, 207 bp, Glycine max
  Peptide Sequence Number=SeqID_160128
atggattcctttgcttcttggaagatgaatggcagtggaatggagaagggagagaggagatgccacttcaaggagaagatgagtgtagaagaagctcaccaccataggaggccatggataagagcttggaagaagatggagatgaataaagggagaggaagagaagagcacgaaattttgtgcattaaaagagctctaaaatctgaa

SEQ ID NO: 68444 - DNA, 297 bp, Glycine max
  Peptide Sequence Number=SeqID_160129
atgctgttctggagatgctggctgatagtgaggtgttcttttctgatatctattttagtcgttgttgtcatggcatgttccaaaatagatccttccaatgttgattgcaatgatgctacgcatgctgaatgtcaatttgtgtctgtcacagctgaccatgatccagttgcggggttacctttaacacccagaaagcggatgtcatctaatgaagccgatgatgggttagggagctctcaaatttcgccagcccaactatcgtctaacaaattaacaagacattctcataggagctga

SEQ ID NO: 68445 - DNA, 804 bp, Glycine max
  Peptide Sequence Number=SeqID_160130
atggatacctcagagccctacactggggcaatgaggggcatcgtgcatgaacctcaagtgaacctaggggtcatgacgaaagacaacgattggtacctcaaagccttacgctggggcaatgaggggcaccatgcatgcgcctcaaggctgcacgcccttaccttcaaaggactacacatcctcgccatcaaagggctacacgtcctcaccttcaaagggctacacgccctcaccttcagaggactacatgtcctcacctttagagggctgcatatcctcgccttcggagggctgcacgccccgcctttagagggctacgcttcttgggccacccctaatattggagggcgaccaactgtgcgagcacaaccagagagggaggctatcacgcaactactatgcatatcggggcaagatttcacccatgccactgcaaaaagacgagtttggatcatgcgcaccaatatgaccactcttacactgatatggatgacgttgctacttagcaacatttcatccagtggccacaatactgatctccccctgtggaggaatcgcacccacaaagacacccagtggacccggagaagtccaacagggccctggggtttccagctctggttacaggcctctgttagtcctacagggtgtccgttccccccagcaaggtcacgccatcatgacatagggatcgcgcctgcaagacacccagtggacccgaagaagtccaacagggtcttggggtttccagctctgattacgggcctctgtcagttctacagagtgcatgtcgcccctagcaag

SEQ ID NO: 68446 - DNA, 575 bp, Glycine max
  Peptide Sequence Number=SeqID_160131
acacgcaaagcctcacgtctacgatccttgtctgccagaccacctggtgctgacagaccagtggtccacgttgatcctactgccgataaggccgacggtccccacaggaagaaattaagaacatatttggggattgtcgcgcgtgataaggtggacgtgacgtacgagaactggaaggaggtggaatttgaaattccagaggcatctgacagtaggacgaaaacgaagttgcttcagactgtcaatgagagtggaggcagtttaaatcagacctcacaaggaaatgggcccttagacccttcttgggaggatgtgcacaaaaaggcacaggccatccagaaacaaaacactgccccccacgttttgtctcgtgagggttatgaatatttggagcagaagctcctggctgagaagacaaagaagaagctgtacagtcaggaagcattgatggcgtcatcgaccctccatccccggggggtacaaatagcaatctggcccacttgggccttccagatccttcctccagaaggctgttgcttctggaggaagcaaccttgctcgcctgggcgagctgg

SEQ ID NO: 68447 - DNA, 294 bp, Glycine max
  Peptide Sequence Number=SeqID_160132
atgttgtggaagcttggtgggattgatgggaacccggtgttgagagaaacgaggataagggctacgtgggagtacgtgagcttagttgaaggtgggcaactggagatgatggatttatgtgtgatttgtggatgtggagagtcgacttgcaccatcgcccgattgccacctagtaccacatatgacggagtggtacctggagatatgtcgcggggtcaggagaccttggggacgtcagtggggtgctatttcccaaaactaagcttgaccaatcccgacccaacccgggcatag

SEQ ID NO: 68448 - DNA, 649 bp, Glycine max
  Peptide Sequence Number=SeqID_160133
cgtcctcgccttcaaagggctgcacgccctcgcttttataggtctgtacgtcctcatcttcaaaggactactcgtcctcaccttcagagggctgcacgctctcatctttagaggactacacgtcctcgccttcagagggctgcacgccttcgcctttagaggactatacatcctcaccttcagaggactacacgtcctcgccttcagagggctacacgcccttgcctttagaggacttcacgtcctcaccataagaggactacacgtcctcaccttcagagggctacatctatggttacgtgcctatattagtcctaccgtgtgcccgtccccccagcaagggatcacgcccacaagacacccagtggacttggagaaatccaacagggtcctggggtttccagctctggttatgggcctctatcagtcctaccgggtgctcgttcccctagcaaggtcatgccatcatgacatcgggattgcgcccgcaagacacctagtggacccgaagaagtccaacagggtcctagggtttccagttctgattacgggcctctgtcagttgtacggggtgcccgtcgcccccaacatggtcatcaggccccctactaaccgagctttcatcaagaagtattgcgcctccaggtag

SEQ ID NO: 68449 - DNA, 240 bp, Glycine max
  Peptide Sequence Number=SeqID_160134
atggatatgctagttgatgctgagacatcttcaaaaatggatatcccagtttctgattcgaatcattctgctcaacatgaatctcaatccctctctgtgacagtagaacatgatcccttgcttggactccccttgacgcctacaaagcggcaggcatttcaggattgcgatgatgaaccagggatctctcaaatttcacttgcacagctttcatccaacaaattaaaaaaacatgcctga

SEQ ID NO: 68450 - DNA, 209 bp, Glycine max
  Peptide Sequence Number=SeqID_160135
atgcggggttaccgtatggttactcacaacattcgtcaaccagggggaaacgagcccgttgacatgcagaggctaacatcatcttctgcaccttttgccatccagggacagcgagtcaggtggctggtggagataccttatggtcatccgcacctttcgtcaaccgaggggaacgaattcgacgacatcaggatgatgttggtcgttcg

SEQ ID NO: 68451 - DNA, 291 bp, Glycine max
  Peptide Sequence Number=SeqID_160136
atggtgcaccctcccgatgagaatgtcaataactccactctcatactcattcagagccaacatactcaatcttatcatccacatgtctctcaacccatgggggagacacatgaaataccccaccacaacctagccgacttcaagccttgcctcggatacgccactcaggggcaagcagttggtggtgtaccctgttcgaacccgacaagtgcaccggattgcgcaagtagtatgaaatggtatgtaaacaaactattaaaaaggaaaaatcacgtgagtaatgatgtgtaa

SEQ ID NO: 68452 - DNA, 348 bp, Glycine max
  Peptide Sequence Number=SeqID_160137
atggtcgtcattgtcaatgcggaagcttgtggttacgtgagcatgaactacgaccaatatatagatgttgtttatacaaacgagcacatcttaaaagcttactccgcacaatggtggcctcttgggaatgaagcggctattcctccttctgatgacgcatggacacttatccctgacccaactacaattcgtgcgaaaggtcggccaaaatcaacaaggataagaaatgagatggattgggtcgaaccatctgagcaccgaacaaaatgcagtagatgtggagctgaagggcataacaggcatcgctgtccaatgcaatctgagcgtgggagttgttcaaatcgttga

SEQ ID NO: 68453 - DNA, 168 bp, Glycine max
  Peptide Sequence Number=SeqID_160138
atggggaggttcttgccacccagaggcttcttgaggaagatttctgagcgcaccccaattactaaaaattttacggaagcattatggaagtcttggatgccccggatgccattttttaatgaaatggaggtggttgctgcccagaggcttcttgaggaagattcctga

SEQ ID NO: 68454 - DNA, 151 bp, Glycine max
  Peptide Sequence Number=SeqID_160139
ggttgtcatcatcaaaaagggggagattgtggaagcaatgccttccaaggttattttgatgatgccaaagaatcaagagtcaagcaaattccaaagattcaagaatgaagttttcaagaatcaagtttcaagaatcaagattcaagaataa

SEQ ID NO: 68455 - DNA, 132 bp, Glycine max
  Peptide Sequence Number=SeqID_160140
atgttccttcatgggaagatgcccagtgttgagggaaggagcccagagtatgaagaacctcaagatttgaggtcaaatcctttccaaggtggagggaatgatgcaatcctaccccgcaagggcattggatag

SEQ ID NO: 68456 - DNA, 76 bp, Glycine max
  Peptide Sequence Number=SeqID_160141
atggggctaagctctagcttctttaggaatcttctcaaggaagcttctcaaggaggtgagcttagttatgagaggg

SEQ ID NO: 68457 - DNA, 170 bp, Glycine max
  Peptide Sequence Number=SeqID_160142
atggctaaaccaagcagctccacaaacttagcatcaaccatcatttgtttctttgcctcaaagaagttccccaatagattaaaagcatcatcgggaaggtttgcaaggcaaaacccttcaccacagtggcggaccgggccgaagtcccctggaagggggcgccagagagg

SEQ ID NO: 68458 - DNA, 47 bp, Glycine max
  Peptide Sequence Number=SeqID_160143
atggagcttacattagcggatttcctcgctaagcgagccagagagac

SEQ ID NO: 68459 - DNA, 633 bp, Glycine max
  Peptide Sequence Number=SeqID_160144
atgacctttcaagcaacagatacaatcccaggttggaggaatcatccaaatctaagatggaaaagtcctccaacacaacaacaacatgtccctcctttccagaatgctactggtccaagctggccatatgttcctcctccaatgcagcagcaacagcagtattcaaaacaaagacaacaagcaactgaggctcctccccaaacttccttagaagagttagtgaggcaaatgaccatccagaatatgcaatttcagcaagagacaagagcctccattcagagtctgacaaatcagatggggcagatggctactcagttgaaccaagctcagtcccaaaattctgacaaattgccttcacaaactgtgcagaatctgaaaaatgtgagtgtcatcaccttgaggtctagcaaccaaattcaagtgccttcaccagtagcagcacctgcacctgaacctgtcaagcttcattctacacctgaaaaagaggatgagataattgcacaaaagagaaagcttcctaacaaaaattttcatgcaggtggaccttcctctactaattctgacttaccgcagcctcttatcccccttccattcccacctagagcaattccaaacaaaaaaaattggaagtag

SEQ ID NO: 68460 - DNA, 426 bp, Glycine max
  Peptide Sequence Number=SeqID_160145
atggatcatgctgccgacaaggttcatgaagagtttcacaagccagttacggatcatgaaggtgccgatacgaagggttttccaggcaggccccaagatacatcagtgttgacgtcatatgttgattatgtggcatccagagaacgtactaagttgaagttggcctctcatgggatgaaggtgaaaaaagttggaaggcttgcactaagattgaagtgtgcagtaggctacatggagtgcttttataagatatttcacccattcatgagtccgccacatcttagggagcctcctagacatccactcacggtgcatcatgatacatatattataccaaatccacctgtgttgcctgttcacacagcaactatgctacaaccaactgtagttgttgatacagacatgcctcgacatgcagtgatataa

SEQ ID NO: 68461 - DNA, 270 bp, Glycine max
  Peptide Sequence Number=SeqID_160146
atggacagagaaaaaaacatgttcattcagcagggacgagagagaaccgaggatgcgtttgtcctttgtcgtgtcttagatcacattcacacacactcacacagtgagagagaagtggtttgtgtcagacatgcagagtttctttctggtgtgtacttaacgcatgggagagactatagagacgtgtttggaggtggtgactgtctcatcatgcgtaggggtctaccccttctagttccagctagtagccacttccctccttctctttaa

SEQ ID NO: 68462 - DNA, 276 bp, Glycine max
  Peptide Sequence Number=SeqID_160147
atggcttctcgcaagcgtcgtgccgtgcctacactaggggaagcgtccaactgggactcttcccgctttacgttcaagatcgcttggcataggtaccaagacaacattcagcttcgaaacatctttcctgagaggaatgttgaacttgggcctggtatgtttgatgagttcctccaggaactcaggaggcgcagatgggaccaggtgctgactcacctaccagagaagaggatcgacgtggctctggtgaaagagttctattcgaacactttatga

SEQ ID NO: 68463 - DNA, 720 bp, Glycine max
  Peptide Sequence Number=SeqID_160148
atgactattcttgcaaaaacattgaaattgttagctgttgggccaaatctcagtgtacctacttggaaaggatatgatatcaacaattattccttctacaccaagtcacaagatgataaaagtaccatgcaaaataatgggaacaagcctgacaggtgttttacgtccaagatcattcaagattttcaatggttctacaaggaagacccagcggtatccatgttcatgggaacacctccaaggtcccctctgcagttagatggtcactcaaaggctatgtctaggaagactagacaatccacacggctaagaagattgactttaagaacattggatcagcctagaccaacaattaacattgatgctggaactgggcgaggatcgggcccccacaaagagaagttccacaactatctgggggtcataactagagaaaagattccaattgtacatagcaattggaaagatgtaccagaatctctaaaggacctagtatgggatgacattttgacaaagtttgatatcccagaagtacaaaatgccaagaaaatggtcatgtcaacggtggccactagatggaggcaatttaaatcttccttcaccatgaaatttgtgtatgctaactatgagggacaacatagtcgtgatccttccataaaatatggtctagatccacaaacttgggagaaatttgctgcaacccgcaaaacccctaactag

SEQ ID NO: 68464 - DNA, 273 bp, Glycine max
  Peptide Sequence Number=SeqID_160149
atgcactgcacgaagaacttaacccttgctgccgcaaccgcgaactacggaattccgagcgaagaaactgattccaattttgatttcgattttagtccttgtccctttgccttggatgccaacacagacagaaaaacctttttggaggatgttccagcgggcgacaacatcgaattgtgtgcaaacacaccacatatgttgttgtcattgagagcacgttctgcgggaagcagaaaaggcgccaaattccgagaactcgagaagaagagttaa

SEQ ID NO: 68465 - DNA, 222 bp, Glycine max
  Peptide Sequence Number=SeqID_160150
atggaagcaaagaagcagaaaatgcgaggaaatgtgagcacagtgcagatgaatgccaatgatgagcaagatggtctcgctcagtgcaatgccatcccagagggatttaggcttagcgggtatgacctgcttggcccaattgacatgggggtccaagcaaagagctatttgcgcttagcgagactatgtgttgcacttagcgagctggctcgcttagtctaa

SEQ ID NO: 68466 - DNA, 501 bp, Glycine max
  Peptide Sequence Number=SeqID_160151
atggctagtgtcttttctgcatgttcaagttctgctgttcttttctacaggagaaactcctttccctcaaaaggatctttctttcacctcaaaaggcctctctctgccaactgtgtagcttctttggggactgaggtatcagtgtctccagcagtagacactttctggcagtggcttaaagaagagggtgttgtctctgccaagaccccagtgaagcctagtgtggtgccagaaggcctaggattggttgcactcaaagacatttctaggaatgaggttgtcttgcaggttcctaagaggctgtggattaaccctgatgctgtggatgcttcagagattgggaaggtgtgcattggattgaagccttggctggctgttgcattgtttctgataagagagaggtcaaggagtaattctgtttggaagcattatttcagcattctgcctaaggaaactgactctactatatattggtgggaaaacaaccacataggcacatag

SEQ ID NO: 68467 - DNA, 990 bp, Glycine max
  Peptide Sequence Number=SeqID_160152
atgcaatctcaaggacttacactgcctcccgagcctctggttggtccctccggtcctcgagtaagcacaaaggggagttgtgttgatccctcaggaaacgatcctgagacgggtgactcagataggtgcagcttgtacatcgaagcagatcctacccgcctggttgccctgaggagagtttatgagggatccactgttgttcataacattcatttgttgcctggccaagtaaaggtgggtgtggaggaggttacagatgcagatgctccagttcctgtacccactgatgaggtttccttagtggggcaggcacttcacaccttccttgcttggccgacacatctggtcaagtctttatcacagcaggtagttgtgtctccggcaaaaccacctccaaagcccgatccggaggttgatgatccgctttatctgatgacattgaccatcccagagcttttcttgaggccttatcaggttacatgggatgccaccatgttcggggcctttaatccagatttcccgctctacataaagcacgaagacctctccgaaatcgcacacggtggtcaatgtctcagcatttcagtgttacagttgtggattatgcatctcactgatacaagtatgcgagcggggaattatgatatctatggattcctcgagccacagtccattcagaggtttggacaatcacagtttgagtctgaaagttacataaaaacttggatgcagagttcaaaacgtgatgtctatcttggagcctacctaaatgggctagacaactaccttcaggggattattaacagcctaaatcaaaggctcctgctaggtggattgtcgtcaagacaaaaaggaagtactgagtgcggctactatgtcatgcactggatgtccaccatcattttaggaacttttaggaataactgggaagcgtattttaatgatcctagaccattggagctagagagattaaaggcgttgcagatctag

SEQ ID NO: 68468 - DNA, 1122 bp, Glycine max
  Peptide Sequence Number=SeqID_160153
atggcttctaggaaaaggaaagccacaacttccaggcctcaacctcactatgatactcacatattcacctctgaggatgcttggaaccgctacgatgacaacgttcttggccggaacatccttccggaaaggaacgtgaagctttttgtcacagagtttgatgagaattttatgctaatctttatgtcccggggggatatgcctccaaagcaagttagggtcaaagggcatttaattaagtttgatgcggattctctcaacacttttctggagactctggttgttctagagtcaggggagactcttcctgcttactctaggttctgcagactaagaccaaaccctcaggagctggcggcccgactttgtatccctggtaggggatttgttctgaatgctaagggcctgccatggaagctgctgaggaaggacctcactactctagcacagacttggagcattttgtcttatttcaaccttgcccctacatcacacacctctgatctgaacttgggcagggcaaggtttgtatatggattagtgatgaagatggacatgaatgttggagccctcatctctggacacacctcggatttccaaccctcatcactgccttatgcatggcctgaggacccagccattaacttgtcttacataaagaagaactgctggaacttggacgaccccacagttagctttctagggacccgcaagaccagggctagaggatctgagggtctatcttctgctactccccaaacatctactgcaccagctcttattccttcagaaccagttcctgctacttctaatccctccgctcagagcacagacctcatgatggcgatgtttgaggcctcctcagctcaagagcctcaactagatctagagactacacctgctgctcaggaggatgattcagaggtcactcccccagagtcatttgtactagaaactgatccagaggcagatctagtgattgcggaggccagtccacaggtatcactaatatctacaccagtgctggagctgagcacctcgcaaggatcaccagcatgcatgcctgtgctgcatttgaccgatgatgaggccatggatcaggacccaccacaggaccaatga

SEQ ID NO: 68469 - DNA, 376 bp, Glycine max
  Peptide Sequence Number=SeqID_160154
atggcttctaggaaaaggaaagccacaacttccaggcctcaacctcactatgatactcacatattcacctctgaggatgcttggaaccgctacgatgacaacgttcttggccggaacatccttccggaaaggaacgtgaagctttttgtcacagagtttgatgagaattttatgctaatctttatgtcccggggggatatgcctccaaagcaagttagggtcaaagggcatttaattaagtttgatgcggattctctcaacacttttctggagactctggttgttctagagtcaggggagactcttcctgcttactctaggttctgcagactaagaccaaaccctcaggagctggcggcccgactttgtatccctg

SEQ ID NO: 68470 - DNA, 327 bp, Glycine max
  Peptide Sequence Number=SeqID_160155
atgtcttgcagattaggcaacaatgacaactcgggtccaatcagcactggatttttgtatgtgccaggttggccttgcctcaagctagggcatctctgtccacacaggtttcattttcttgaccttctggaagccatggcaaggagacgtgattgtttcaatgtcagtgacggtcaagttgcagcagatttgtgttgcctgaaaatggaagttttcaatgtcagtgaagtatgcagcactgtggagagcatactacatttacccaatattcctgtaaataatttcccatcaccttttcaatcccgtgttaaaaacatcaaactttaa

SEQ ID NO: 68471 - DNA, 318 bp, Glycine max
  Peptide Sequence Number=SeqID_160156
atggatttacatcataataggtactatgatggtaggctctctgatcagcaaatggctttgctgcaatatcagcttgaaaatcttcattttttgagtgaggagattcttcgattgcaagagtgtctaagcaaatatgagggaactgatgatcggagcgcaccacagtgcatcaacagcaacaacaacatcagcattagcaacaatagcatcaggaaactcttgctaaggatgattctcaaggctcaggaggacagtagtagagttttattatggatttggatgaaaagaaagaagcatcattgtgcagatactggctga

SEQ ID NO: 68472 - DNA, 864 bp, Glycine max
  Peptide Sequence Number=SeqID_160157
atggcagaatcatcaaagaagcgagagggggcttcaacctctaccacggccactggaactcgacttcacggagcctccgaagcacagccagcaccaattcctccttctatatcatcctctacgttgttctcctcagaagaacaatgtatccggtacacttcccttttctcttctcgttccattatagaccttaagtttatagacttggagttctttgatgatgaaatgtttgattgtcatcacgcaattcataactccgggttaatccagtttatgtctttgaaacttccttattatcctgacttagttagagccttttattcaaatttagaaatacaggatggtactctaatttctaaagtgtatggcataaagatggtcattgatgagtctttgttctttgaattaactcagttatctagtgaaggtgtaccctttgagggcaccattgatgatgactggaaatttgaattttctagtcatgatgcccgccggatggtttgcaccaaccaggcggatatgaccgtcaagagatctttatctatcggtgctggtgtggtaacctcctttggataccgcaaaaagagggatggctcttgggtgaagaaggatgctcagccacaggcagcagatgaccgctctccttctcctcctcctcagatggatgactcttcatcccttatgcaaaacattctcgacaagttggatggtctccaaacctacgttggtgagcgttttgactcctttgacaaccacattgatgccattgatgcacgatttgcagggatggatacacgcatcactcagcttgaggaggatatgagtttcatttgtcagtgctttgaccttccaccaactacttag

SEQ ID NO: 68473 - DNA, 888 bp, Glycine max
  Peptide Sequence Number=SeqID_160158
atgagattccgatcccaacgaaacttagaaacttctccaagagcacgagctaattactattgttctaagtcaatcaacatccaaatccccataaacatctctagaaaggaactccaagagctaatctctctccaatgggtgatcaattacaagaagcacaaagagaatactaaactttttagtacctctcagcccactttcagaagatctatagatgggcttgtgaccacaaccttcaagaggctagatgaagctagtagcagcaactctccagaggtttttcattctttaatgataaaacctaaagtcaaagaagatagtaggatgccgatatttgcagtcaaagcagatggaagggtggtatatacgaataaagtgaatggacactttatttgggacattgctcctgaaatgtgtgattcagactgttcttgtcatgaacatgatggagacacaaacgatgaggcagatgataacgataaaagtgaaggaagatggaagccagaacccaggccttgtaaacctcctccaccaccacaaagaaaaagtgtcccaaaaaatgtaccacagacagggataaaaaagaaatatccagaagatcctttctggaaagagaaaagaatggctgaaattcttggatggaatcatccatctttgaaaatccttgagacacttataccttgtatgatgttttcttccacatcctatgaacaagagttttcatttcttgatagaaagacaaacccagtaacaaaggtaggaccagaagggaagcttaaatctcctagccaagttgaagaagtcttaaactggcagactgacaatgctagagcccaaaatcatctcttgaagaagatagatgagaagattgacaagatttatacctaa

SEQ ID NO: 68474 - DNA, 279 bp, Glycine max
  Peptide Sequence Number=SeqID_160159
atgtctcgaaaggttaacagtattgcagacattgatgactccaaagagacgtggaaactgggtgttcgaataacccacctatggactaaacagaggtctccgaagccctttatagaaacgatctttcttgacaacaaggggggcaaaatagaagcttgtgtaaaaaatccacttagtgataaatgggaagccatgctgatagagggcaaaacttattttgtccaaaactttgaagctgagatgaactcatgccattatagggcaacaaatcatcgttag

SEQ ID NO: 68475 - DNA, 1572 bp, Glycine max
  Peptide Sequence Number=SeqID_160160
atggctgagagaattggtgcttcttccctcaaggttgtttctagaaagtcattgcttttcttcttcataatgacatctgttctgttcatcatgtcttggttctttgttctccgatccacgagtcgtcctcatttcattgaccataacttgttgcccaattcaaagcttttctctaccttagatggttcaaagtctcatatgcagaagcaaaatgttgaatcttcgtttgggaaccgagcgattcttgtggatagtgaagatgtagaagaggcaagtgagacaaaagctcgtaatgggaaggaaaaactagtgaaacatgatggaaagaaatgcaacagaaatgatgaggttgttctcaaggttttcatgtatgatttacctccagagttccattttggactcttggattggaaaccaagtgggaatagtgtgtggcctgatgttagaactaatatacctggttaccctgggggtttgaatttgcaacatagtatagagttttggcttacattggatattcttgcttcagaatttccccaagcctctaaggctaggactgtaatccgagttcaaaactctagtgaagccgatattatatttgtgccattcttttcatctttgagctataaccgctactcgaaaagtaaaccgcatgtaaagaaaagcaagaacaagatactgcaagaaaagttagtgacgtatttgatggctcaagaggaatggaagagatcaggaggaaaggatcatttgattttagcacaccatcccaacagtatgttggatgcaagaatgaagttgtggcctgctacattcattctttcagactttgggaggtatcctccaaatatagctaatgttgaaaaggatgtgattgcaccttataaacatttaatcagttcctatgtcaatgacaactccaactttgatagccgaccgacattgttgtacttccaaggggcaatatatagaaaagatggggtaagaaatggaacaaaccaacctattgttttggagatgggaggtttagcgcggcaagagctattctatcttctgaaagatgaaaaggatgtgcatttttcctttggaagcattgggaaagatggaatcaagaaagcaacagaaggcatgcgtgcttccaagttctgcctcaacatagccggtgacaccccttcatcgaaccgattgttcgatgccattgctagtcactgtgtccctgtcatcatcagtgacaaaattgagctaccatatgaagatgtcattgattactctgagttctgcatatttgttcgtactagtgatgccatcaaagaaaagtttctaataaacttcatcaggggtattgccaaagaagagtggacccgaatgtggaacaagttgaaagaggttgaacatttctttgaatttcacttcccttctaaggaaaatgatgctgtccaaatgatttggcaagctgttgcacgtaaggttcctgctatgagattaaagctaaataggtttgagaggttttctaggtcccctccaagtacggacgaaggactaagatcaatacctgttccaaagaatttttggtga

SEQ ID NO: 68476 - DNA, 276 bp, Glycine max
  Peptide Sequence Number=SeqID_160161
atggaagaagaaaaagcagtgccgaactatgacgagctgacctgtaagggtgagagagctgtgtggttcagacaaggtctcggcttttcctcttcagcaccaaaggatgatgttccaaaaccctccgcctccttcctctccaaattcgtcaaagcctccttcgagtcgaagaagcaagtgcagctccaatccatccacgacaatctcaagaaaaagccttctttcgagtctagggtttcgagcagggatagggacagcgatagaagtagaagatga

SEQ ID NO: 68477 - DNA, 309 bp, Glycine max
  Peptide Sequence Number=SeqID_160162
gtggttgtcatcatcaaaaagggagaaaatgtaaatcatgaagattttcatgatgtcaaaaagatcaagccttggataatgaggcgtcatcatcaaaaagggggagaatgtggatcatgcattgttttgatgatgtcgaaaagaaatcacttgattgtcataatcaaaaagggggagaatgtgaatgtatgtatacatgattttgatgatgccaaagataagcgcttctcaagtttgatccaagtcaagaattcaaaaattcagaaaataactcccaagagtcacaactcttcagaaaataactcctga

SEQ ID NO: 68478 - DNA, 264 bp, Glycine max
  Peptide Sequence Number=SeqID_160163
atggacccgattcacccagccagtttcaatcaagtgaattgtccagtctcagatgtagtaggtcaaggaggcgaggcagtgaaaaatagcaagcattccttcccaccatatgggttgtctcctaattatacaccacccactgttatatacgcttatggtgagaatatcaacaattctgcacccgtactaattcagaatcaacaaccccaatctaatcatgcacatgtctctcaacccatgggggaaacacatgaagttccctaa

SEQ ID NO: 68479 - DNA, 213 bp, Glycine max
  Peptide Sequence Number=SeqID_160164
atgacagacattgtacttgcttgttgtatattgcataacttcttaatgggtgttgatgttgatgagaccttaattgctgaagtagatcgtgagttacttcaacaagagattgatagatcccaaccacaacaacaacgtgatgatgactatagattgggaacaattttaagggacgatgttgctatcagaatgtggaatgtttatccaatatga

SEQ ID NO: 68480 - DNA, 399 bp, Glycine max
  Peptide Sequence Number=SeqID_160165
atggcatctagcagaagtgggaatggaagagggataagaggctacgactttgaatggaggctcttgtctcttgctcaaattgcatattgtggatggtcattttccttactaactcttctaaggaaggttgaggaggagcctcagttgcttgttgtctttgttgtgactactgctgtattggaggaggaacatatggcttgcttggaccagcagcattatggaaaggagggacatgctgttgttgttgtggaggacttgtccatctcagatttggatgattcctccaacctggattatatcagttgcttgaaaggtcataattattttgttgttgttggtttttctgctaagggggtctattataaatgtttgcagcataagcttcaggttgctcattga

SEQ ID NO: 68481 - DNA, 276 bp, Glycine max
  Peptide Sequence Number=SeqID_160166
atggagacatgtccaacagtggaggagttgctacaacagatgatggatcatggccagctcgaggggtgctgttcccgaaaaacactagggccctatgatgttgtcagtgtgacccacatcggtcacatctttgcgacgcctgacttgttggcacgacccacaaacgacaaaggaaaagcaaaggtggttgaagaaccgaccagcgaagcaagtcctaccccagaggaggatgatggaagcttgcttgtggagcttctatggaggctggatctttga

SEQ ID NO: 68482 - DNA, 213 bp, Glycine max
  Peptide Sequence Number=SeqID_160167
atggagagatttgaggaattaaggatgtcactacatgttgatgggttaaccaaggtgactacggataaatggatagatataacagacatgggacatgtcattgcatcaagatataatgcgaagccatggccaactccatatattagcagaatgcagtatggcaagagctttgtgatgtttaagagagactatgttgacataaatgatgattga

SEQ ID NO: 68483 - DNA, 192 bp, Glycine max
  Peptide Sequence Number=SeqID_160168
atgtccgtgaaaaaccatgttgggcgcctaggagtacatgacaagacaaaccacacactaacagggtcaaactgttttgcgagaatgctccaaccatgtgggatcggcataggcttaaaggaacattcaaaccaggtgacccccaaggcctacactccgaagagtccgtcagggcctctccctcctgattga

SEQ ID NO: 68484 - DNA, 308 bp, Glycine max
  Peptide Sequence Number=SeqID_160169
gtatgccatccaccaggcaccctttggacccagataagtctaacagggccctggggtttctggcgttgattacgggcctttgccagtcattcggggttcccgtcacccccagtaaggggcagggtttcgctccttttgcatgccctactccagagcagtttggggctgaggtcgcatggctcagagactggcctaaggcccaggcaggggaggagcccgcaggatcccccggtgaggcaaaggaggcccgtatggatgaagaaatgaccgacttgctcggtttcttgggaggaagcggagccacgtga

SEQ ID NO: 68485 - DNA, 415 bp, Glycine max
  Peptide Sequence Number=SeqID_160170
atggtgaaagttggaacctcttacgtgccgatcaacgtctcattttcgccaaaagttggcccagggctttcccgtgatccttccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggccgacattggtcgtgaaatagccgcaactgatatttttcagccgacaatcaagcttatcgataccgtcgacctcgagggggggcccg

SEQ ID NO: 68486 - DNA, 339 bp, Glycine max
  Peptide Sequence Number=SeqID_160171
gaatcgcacacacacacaaagacacccagtggacccggagaagtccaacagggccctaggggatcgcgcccgcaagacacccagtggacccgaagaggtctaacagggtcttggagttgtcaagctctaattacaggcctttgtcagttctacggagtgcctgtcgcccccaacatggtcatcaggccccctactaatcgagctttcatcaagaagtactgcatccccaggcaggcgctgggcgaaacaccacagcagcctggggatggccggcagcgggcaacagacgcaccgccatcacctctagagttcacctcatctcatccacaaaaaggttag

SEQ ID NO: 68487 - DNA, 81 bp, Glycine max
  Peptide Sequence Number=SeqID_160172
atggggttgcgggacgccacattcaaggtgtcggactttgacaagtacaaggggactacttgccccaagaaccatctatag

SEQ ID NO: 68488 - DNA, 3645 bp, Glycine max
  Peptide Sequence Number=SeqID_160173
atggagtttgtgatcggccgcaccctgtcgaacgcgctgctgtcgatgggcatctatcaggatatcgacaacgcgctgaacgaaatggggttgagcctgggtgaactgctggaagaagagaacgaccctggcctcggcaacggcggtctgggccgcctggcggcctgcttcctcgattcgctggcgacgctggcgctgccggggcgcggctacggcattcgctacgagtacggcatgttcaagcagaacatcgtcaacggccaacagatggagtcgccggactactggctggagtacggcaatccgtgggagtttccgcgccacaacacccgctacaaggtgcgcttcggcggccgcgtgcagcaggagggcgccaaggcgcgctggctggagaccgaagaggtcgtggccatcgcctacgatcaggtgatccccggtttcgacaccgatgccaccaacaccctgcggctgtggggcgcgcaggccagtaacgagatcaacctcggcaagttcaaccagggcgattatttcgccgcggtggaggataaaaaccactcggagaacgtgtcgcgcgtgctgtatccggacgactcgacctcctccgggcgcgagctgcggctgcggcaggagtatttcctggtgtcggcgacggtgcaggacatcctcaaccgccattggctgatgcacaaaaccttcgacaacctggcggacaagatcgccattcacctcaacgacactcacccggtcttgtcgattcccgagctgatgcaccggctgatcgacgagcacaaattcaagtggctcgacgcctgggaagtggtggagcaggtgttttcttacaccaaccacacgctgatgagcgaggcgctggagacctggccgctggacatgattggccgcatcttgccgcgccacctgcagctgattttcgaaatcaacgatcacttcctcaagatggtgcaggaagtggcgccgggcgacaacgacctgctggcgcgggtctcgatcatcgacgaaaccaacggccgccgggtgcgcatggcgtggctggcggtggtggccagccacaaggtcaacggcgtttccgccctgcattccgaactgatggtgcagtcgctgttcgccgacttcgcccggctgttccccaatcgtttctgcaacaaaaccaacggggtgacgccgcgccgttggctggcgctggccaacccgccgctggcggcggtgttggacgactgcatcggccaaacctggcgcaccgatctcagccagctgagcgagatcaaagccaacgtcgattacccgagtttcctgcaggcggtgcagcgcgccaagcggcagaacaaggagcggctggcgctgtacatcgccaaaacgctcaacgtggtggtcaacccggatgcgctgttcgacgtgcagatcaagcgcatccacgagtacaaacggcagctgctcaacgtgctgcacgtcatcacgctgtataaccgtctgctggacgatccggagatcgatcgcgtgccgcgggtggtgatcttcgccggcaaggcggcctcggcctactatgccgccaagcagatcatccgcttgatcaacgacgtggccaaagtgatcaacaacgatccgcgcgtgcatacccagctgaaggtggtgttcattccgaactacggcgtcagcctggcgcagatcattatcccggcggcggatctgtccgaacagatctcgctggcgggcaccgaggcctcgggcaccagcaacatgaaattcgcgctgaacggcgcgctgaccatcggtacgctggacggcgccaacgtcgagatgcgcgagcacgtgggggaggagaatatctttatcttcggcaataccgccgagcaggtcgaggaactgcgccgcaacggttacaacccgcgccagtactatgagcaagacccggagctgcatcaggcgctgacgcagatcgccaccggcgtgttcagcccggaagagccgaaacgctatggcaatttgttcgactcgctggtcaacctcggcgatcactatcagctgttggcggattaccgcagctacgtggacacgcaggacaaggtggacgaggtgtatctcaatcaggacgagtggacgcggcgcgcggtgctgaatatcgccaacatgggctacttctcctccgatcgcaccattcaggaatatgcggatgaaatctggcacattcagccgccaggctttcactcgcgcctgctgcgcttcgtccagccacatgccgagcttggtgcggcgccagatggcgtcggccagctctacgacccactctttctcggtcaggtagcgcagttcggcttcatacagaccgtggccgaaatcttcgcccagatcggcgaggccgttggcgccggccaggatcagctcgctctggctaccgtaggtgcgggcatagcggcgcgccagcgcttccggcaaccagccgtgggcgcggcgcaatttggccgcgtagccgtcgcgatcgccgccgaggtcaccgcccggcagcgtggcgtttttggtccacgccgggccgcagcctgggtagtagtgggccagtttttccatcgcgtgctcggccagcttgcggtaggtggtcagcttgccgccgaagaccgacagcagcggcgccttgccttgttcgtcgtgcacgtccagcgtgtaatcgcgggtgatcgcctgcggcgaatcggattcgtcgtcgcacagcggacgcacgccggagtaagtccagacgatgtcgtcgcggcccagctgcttcttgaagtgatcgttgtacactttcagcagataagcgatttcgttctcgtcgatcttcacgtccttcggatcgcctttgtactccacgtcggtggtgccgatgatggagaactcgtcattccacgggatcacgaacacgatgcggtggtcttcgttctgcagaatgtaagactgcggctgatcgtgtacgcgcggcaccacgatgtggctgcctttgatcaggcggatgccgtaaggcgatttcagcttcaggccgtcgtcgaagaagtttttcacccacgggccggtggcgttcaccaggcctttggcgcgccaggtgaaggttttgccgctgtcgatatcgaccgcttccaccatccacatgccgttttcacgccatgcgcgggtcactttggtgcgggtgcgcacttcgccgccgcgtttttccacttcctgcgcgttcagcaccaccaggcgagcatcgtcgacccagcagtcggaatattcgaaaccgcgcttcaattcaggcttcagcaccgactctggtccaaagcgcaagcccttgctgcccggcaggctggtgcgtttgcccaggtgatcgtacaggaacaggccgatacggatcatccaggccgggcgcaggtgcggctggtgcggcaggcggaaacgcattgggaacgcgatgtgcggcgccagcttcagcagcacttcgcgccaccgtggatcagtttggaactggcggaagacgtagcacaggccaagtcttgcgcttccagtagcagtaccgacagcccgcgcccggcagcatccgccgcgatgccggcaccgttgatgccgccaccgataacgatcaagtctttggtttccacgtcatcttcctccagatgttcgaaatag

SEQ ID NO: 68489 - DNA, 1904 bp, Glycine max
  misc_feature (165)..(165): n is a, c, g, or t
  Peptide Sequence Number=SeqID_160174
ttcggcaacacggccgccgcgacgttcacatcgatatggtcgttgtgatcgtgcgtggccagcacggcgtcgagctgggtgatggcgaacgggtcgagtacgaatggggtggtgcgcaggttcggctgcagtttccgcaccccggccatgcgctgcatttggtgnccggttttcatcagcgggttgccgtggctctgcttgccggtgccacaccaaaaatcgacgcacaggttggcgccttcttcagacttgagccagatgccggtgcagcccagccaccacatggcgaaggtgccgggcgcgactttctcctgctctatctcttcgttcagccaagtgccccattcgggaaaggtgttcaatatccaggactcgcgggtgatgtcgttgactttactcatgggtctttcctcgttggtggtgatgaccaatgcaccgctgctgctggggctggttacactgctgggttacacgccggctccggcatcctgaccggcacgttcaaacccgttgtggcgaagttgtccgaggtatacggcatcaacggggcgatttcggacacctatgcttcgatgatggccaccatcgaacgtatgggggacgcctacagctgggtcggctacgcggtattgctggcattggcgctgaacattctctacgtactgctgcggcgtattaccgggattcgtaccatcatgctcaccggccacatcatgtttcagcaggtcgggctgatcgcggtatttttctacattctgggttacggcatgtggacgacggtattgtgcagcgcgctattggcttcactgtactggggcatcacctccaacatgatgttcaagccgacgcaggcggtaacggaaaacagcggcttctcgatcgggcatcaacagcagttcgcttcgtggctggcctacaaggccgcaccgtatctcggtaaaaaagaggacagcgtggaagatctgaagctgcccgggtggctgaacattttccatgacaacatcgtgtccaccgccatcgtgatgacgctgtttttcggcatcattctgtgctcgttcggcttggacactctgcaggcgatggccggtaaaacccactggagcatttatatcctgcaaaccgggctgatgttcgcggtggcgattttcatcatcgtgcagggcgtgcgcatgttcgtcgccgaattgaccgaggcctttaacggcatatcccaacgtctgatccccggcgcggtactggccatcgactgcgccgccatttatagcttcgcgcccaacgccgtggtgtggggttttatgtggggcaccatcggccaactgatcgccgtcggcatactgttggcgctcggctcttccatcatgatcattcccggtttcattcccatgttcttttctaacgccaccatcggcgtattcgctaaccacttcggcggctggcgcgcggcgatgaagatctgtctggtgatgggaatgatagagatcttcggctgcgtgtgggccatcaaactgaccgggctaagcgcctggatgggcatggcggactggtcgattctggcgccgccgctgatgcaggggctgagtctgggcctgtggtttatgggggtggtgatcgttatcgccctgctgtacatgttcttcgccggacgcaccctgcgtgcggaagaagatgctgaaaaacaatcgcaaggtgtgaatcattcggtcaacagctgtgcggtgggggaatacaaatccgagttgaacggggccgacatcatcattgcttccacccatgtcgccgacgaaatcgtcgtgagcggcaacaaatatgtggttggggtgcgcaatatgctctcggcggcggacttcggcccgaagctgatggaagttatcggcacgcattttccgcaagatttgaagcagtaa

SEQ ID NO: 68490 - DNA, 339 bp, Glycine max
  Peptide Sequence Number=SeqID_160175
atgcaaagaagatctactgaaggtgatttgatccccatcgatttggagattaacgctacttgcaggaggcgcaacgtagagagaattagaatatttttgcaggacttagaagcagcagcaactccagaagaagaacctcgatcttccgaggcgtcttctagctttcctattccaggacaatctcatacagatttaattgaaaaagttatcatggctgaagacccaaggagagtgaccctagaagattactcaagttcaagtgtgccacaatttttcaccagcattgcacaactagaggttcaggcacaaacaatcacatatcctccttctttgatatag

SEQ ID NO: 68491 - DNA, 326 bp, Glycine max
  Peptide Sequence Number=SeqID_160176
ggatcgcgcccgcaagacacccagtggacccgaagaagtccaacagggtcttggggttgccaagctctaattacgaacctctatcaatttacggagtgcctgtcgcccccagcaagggcatcaggccccctactaatcgagctttcatcaagaagtactgcgtctccaggcaggcacagggcgaaacaccacagcagcctggggatggccagcagcaggcaacagacgcaccgccatcacctctagagttcacctcagctaatccacaaaaagccatcaagcgtccagctcaagacgttaaagaagcgctaataggaggcaaccta

SEQ ID NO: 68492 - DNA, 120 bp, Glycine max
  Peptide Sequence Number=SeqID_160177
atggaggattgtgcggcatcagcaccactaagagcaaacactctccctgtagtccttggtcatccgctctggttattcagacttccactcatcttcttcctcctcagatgtgggcaactg

SEQ ID NO: 68493 - DNA, 654 bp, Glycine max
  Peptide Sequence Number=SeqID_160178
atggcgtgggtctacgccattggaggtgatgacgggtatttggggattgggatgggtggttttggagtggcggagacggtgatggtgggatctaggggtggtggcatttgttctggaggggggtatttagggtttggacttggaaggagaatgtttgagaaaaagacaacgtcgaagacgaagaagaaaaagaggaagacgaagtggaagagaaatagaagggtaaggataagtcatccccatcgaagagcttatggatttcgatcagttagtcgattgagcttctcttctatcaattactcagttttgatgctcattatgttgcttttgatgaaaataggaggaccagaagtgaaacttctagttgcaatgtgtgcttgtgagataactcgaatcagtgcacctgaagctccctacaatgatgaaagtctaaaggatatcttccagttgattgttggttcttttcgtggtctaagtgataccaatggttcatcctttggccggagagttttcatattggagactctcgcgaaatatagatcatgtggtgtgatgttggatcttgaatgtcatgatctagtaaatccagatgttattggaactttagaagaagatggactaaagtttgttgggaaggatgaaagtggaaaatga

SEQ ID NO: 68494 - DNA, 1086 bp, Glycine max
  Peptide Sequence Number=SeqID_160179
atgagggcgagccgtggtgcagcggtaaagttgtgccttggtgacttgttggtcatgagttcgaatccggaaacagcctctttgcatatgcaagggcaaggctgcgtacaatatccttcccccataccttcgcatagcgaagagcctctgggcaatgggtattcattcacttcaaactcaatggctaaagaaggtcataggaatcaatctgggaacaacttactcatgtgttgcagtatggcgggagcatcaccgtcgagacaagctgttatggcattcaaggttgttgccggtactaatgacaaacctatgatcatccttaactacaaggaagcgtttttggagaaacatgcaaagaatgaagtggttactgtgcctgcctatttcaatgattctcagtataaagctaccatagatgctggaaaaattgcaggcctaaatattctgcggataatcaatgaacccgttgctgcggcaatcatgcatggtcttgacatgaggactaataattgtgttggagagcgaaacattttcatctttgaccttggtggtggtacttttgatgcgtctctccttactcttaagggtaagatctttaaagttaaggccacagctggaaatggtcaccttgggggagaggacattgataatagaatgctggaccattttgtaaaggagatcaaaagaaaaaaaaaagtggacattagtgggaacctgaaggtgctgaggaggttaaaaaccacgtgcgagagggcaaaaagaacactctcacatgctgttactaccaacattgaagtagatgctttatctgatgccattgacttctgttcttcgatcactcgtgcaaagtttgaggaaatcaatatggagctctttaaggagtgtatggagacagtggataagtgtcttactgattctaagatgaacaagagcagtgtacatgatgttatccttgttgtggttcttcaaggattcccaaagtgcaagagctattgcaggacttttccaacggaaaggatctgtgaaagagcatcaaccctgatgaagctgttgcttatggtgcagctgtgcatgctgctttgctga

SEQ ID NO: 68495 - DNA, 444 bp, Glycine max
  Peptide Sequence Number=SeqID_160180
atggctgttgaatactatgattttgggcctcacaagatccaccatagttcagtgttctatacaagtaatctttcttttgcctttgtcaacctgcgtcctgctgtgacagtgaagcgtgttgctgatctcacagatgatgagacagtagatttatggctcatagcaaagaaacttggtaggcagctagagagctaccataaggcttcatcacttacattttgtatccaagatggacctcaagcagggcaatcagtgcctcatgttcatatccatatccttccccggaaaagtggtgattatgagaacaatgatgacatttatgatgatataaatgaaaaagagaaagagttgaatcgagcacttaaggtggatatagaaaggaaagacaggagcattcaagaaatggctcttgaggctgatgaatacagaaaatttgtcttttga

SEQ ID NO: 68496 - DNA, 360 bp, Glycine max
  Peptide Sequence Number=SeqID_160181
atggcgccttccggaagaagggttcttccgaaagtaataaaacgtattccggaagaacagattttccggaaagctcccgaaacacctcttccggatgacctttccagtggttctggaagcacttcccggaagaccctttcttccggaatgtttccggaagaactacttcttccggaaatcatggccagaacacgaggtttaggtcatgccataggtagacttgtaggcagagatagacctgatgatcaggatgatgttgatgttcccgagaggcgtaggcctactgcctcagcccgtaggctacgggttcatcagatgactatggagggacgtgatatggctaaggacgtgctgacatga

SEQ ID NO: 68497 - DNA, 231 bp, Glycine max
  Peptide Sequence Number=SeqID_160182
atggaatgtatcacaatagtcttcttcaaggatgccattgagaaagacatttttaacatcaagctgttgaagactccacttacccatttgcaacccacaggtgaacggttagaaggaagatcagtgagagaccaagttccattattcatcaaggcctcatattcagctttcttagctgctaaccatgttggactagagagagcagactttgtggccctgggttcagcatga

SEQ ID NO: 68498 - DNA, 1190 bp, Glycine max
  Peptide Sequence Number=SeqID_160183
gttacttgaaggagattcttagtggcatatacagaactataagtgtcagctcaaaaggagagcagtttttggcctcttctagaccagattataaacctcctttggttttgacattgactgctgaaatgcttggtgtagaagataatggaaacacaaaagaagaattcaaaactttatctacttcagagtcagaagggttttcagaggctgaggggcagctctaccaaatgcttttggaagaaagattaaagcttgcaagaagtgttggaacagctccatatgctatatgtggtgatcaaacgatcaagaaaattgctttgccaagaccttctacaaaagcaagactagcaaacattgatggtgtgaatcagcacctagtaacgaaatatggagatcattttcttcaagttattcagaaactgtcacaaggattaaacctatcattggatggggaagcaagggtcgcaacagcaagtttgcaaactaatgaagtaaggaaagtatctctagtaaccaacaaatccaacaagttgacaccggcaaagtttgaagcttggaaaatgtggcatgaagatggttgttctattcatgagattgctaactttccaggtagatcggctcctataaaagaacaaattgttgctgaatatctgctggaagctgctcaagaaggattaccttttgattgggctaggttcagcgagatgataggactaacacaagagatcatatcagaaattcagggtgctatttcaaaagttggatctacagataagctgaaacctataaaaaatgaattgccaaaagagataacttatcagcacatcaagacttatttgacaatgcgaaactgtggaatatccttagaagcaattcaatctggaagtatccagactgagaaagatggtgaacctgcacacaatgcttcaaatttgtcaggtcctactttagaaacatgccacgtggaaaggcattgtgaagacggcatttctgccataagttcaactgaaaaatgcaacttagaaattaacgaggtacctactctacccgtcaatggttccgaggctacattgagcgatgttttggaacacttcaacggatccagtgaagattccgtggttgaactgctaaattgccttgactgtaacttttcaatatataggaaaggtggcatctataggattatgtaa

SEQ ID NO: 68499 - DNA, 1197 bp, Glycine max
  Peptide Sequence Number=SeqID_160184
atgtggggtaggtggtggtggcgtgctggtggcggttttctgaggcaaagggtatcttcaattggtagtgttagccatggttatggggaaaagcttcatcctttggaccctcctttgttgggtttgaggggcgttgttgaagtgatgtgtggtggaagaaggacacctttatctgttgtgttgaaccaaatcaagaggggtgtatcaacttccactgggaatggtggtgtcagcaatggcaataatggaacaacagaagattctatatcattctctgaagccaagaagcttatgaggttggtgaatgtggagtcattgaagatgaagcttggtatggaagggaaggaagtcatttgctattctgagcttcttgaggcctgtgagagtgtggggattgcaaggagtcctgaggaggctgcagcatttgccagggttcttgatgaggctggggttgttctcctcttccgggacaaagtgtatttgcatcctgataagctgaagtatgtgctaatgagacatttcagagcagtgttcatgaaaacttccaatgtcgttaagtatagtcaattagttatatttcaagtgcactgtttaacatggcttatcatgcctcaacctgttttgatgcgggactattctttttgtttgaactggctactatgctttaaactcaaaccacagcagaacttagttattcaattctctatggtggtggatctggttcgaagagctgttccactggtgctgactgctgacaacgatcctatgagggaggagttgaagaaactgcaggacaagaaggaggaaattgatgtgttggcacatacgcaggcgcggcgcatcctctggtctggactaggatttggtgtaatcactgtcggcttcttcttccggctaacattctgggaattttcatgggatgtaatggaaccgattgcgttttttaccacaaccactgggttggtcataggctacgcctacttcttattcacttcaagagaccctacataccaagacttcatgaagaggctctttctttcaaggcagaggaagcttttcaagaggcaaaattttgacattgagagattcaaggagctccagtgcaagtgcaaaacacccttacatgctagtaccgttttaaaaaatcgcataggggtggaactggatcttgaagatgctttacatagagatcattaa

SEQ ID NO: 68500 - DNA, 192 bp, Glycine max
  Peptide Sequence Number=SeqID_160185
atggaaatgaaaaagaagaacaactcagtcaattataagaagaaagacaaaggtaaaggcaaggtggcaatagaggtaggggatgacttgagtgatttcaatgaggatgaggagggtccaagcaagaagggacacaagagaaaagaactttatcaattgatctcttcaattaagttacttgaattggtataa

SEQ ID NO: 68501 - DNA, 162 bp, Glycine max
  Peptide Sequence Number=SeqID_160186
atggaaaatggaaagcatgagaaaaatgacgaacaatgtccacctatggtgaaatttgaaaaggcacaaagccacaatggaaaaaggaagtcgaaaaaagcaaacaataaattaagccttggaaacatgaaaaacatgtgtatccgttgctgcacttactag

SEQ ID NO: 68502 - DNA, 1506 bp, Glycine max
  Peptide Sequence Number=SeqID_160187
atggttagaacaagaggtttagatcgtgccttaggatctggtagaggcagagacatgagtcaggatgcgcatcaacctgaagttcctcgacgtcgtaggccaactacttcagtatgtaggcaacaagttcattttcctcatatgactgaggacgttactcagacacctgaggatgtgcctcagttaaatgaggatgttcctcatgtgtttgacgctactccgaagatgacaggtatcgtcgatgctgcggacgcagagggagtggctactaatggtagtgaggggtcacctgctgctgatgagggattccctggtgggccacacgacccattggaacgaccagagctgaagttggtctcctatggtagaaaagtagataaatttgggagaccagcacctgagatagaaggcatgattgcggccaccagattgagtccactaataaggtgttcggtaattaccactgatcttggacttatatccgccttcgtcgagaggtggcatagggagaccagcaccttccacctgccagaaggagagttgacgatcactctagatgacttgacgatcactctagatgacgtgtcgtcactcctacaccttcccatcattggtgcgctgcatagcttcgagccgctggttacttccgacgcggtcatgctgttgacgaagctgcttgaggtcaactctgaggaggctaaagctgagacccgtcaggcatctgagcctcatgttcggttgtcctggcttcgggaggtgtaccagagtaggtgtcgggccaaacgatgggttgtagcagcctgcgcgtatctcctccacttggtcggttgcactcttttcgctaacaagagtgcaacacatgttcattgttggatatacgagcactttccgatggtgcatcagtgcgtcgttgatgatgcttatgctgaggcaagcccacgtgcctccaggtggcttacgagtaaggctcatatgacgaggatcaagggagccccatcccgggcacatatagaagctctgactatcacggacgtgtgctggatgccctatgctgagcaccggagattcgggtacattcagactgtccttccgccgcctattcgtgaatcgttgacgggtcctaatatagatgatcggtggctgcactttgcagaccatctagtgatcgcgggggagatctgtgtagttcctgaccaggtagcgctagactacatggattggtttttccagattttgcacccgttcgtcacgctgatcgaggacgatgctgagccaagacattcacctaccccacatgatgaggagtttgtcgagccacctatcccggaggttctagttgcgtctgatctccttacgcatttagtggttgactgccaaggatgtcaagcgatcactgaaagtttggagcgggtcatcaacctcaggatggtcactgaaggcactgagttatatgacatcatggctcattgcctcaagattgttagaggtgacgtcgtagatggaagt

SEQ ID NO: 68503 - DNA, 246 bp, Glycine max
  Peptide Sequence Number=SeqID_160188
atggtttgtgatggcggaggcgagggatgcatgactgtcatagcagtcgaggaagacaaggagagcaaggaagttagggatttgaagaccaacaaagaaatcaacgacagtgatggtagatgcaaatctagcaaaacacttggcatcgaagctccatatcttgatctaaagaaggctggcccaaggtcaccgtgcaactcagacgtgatctacctgcttcctgatctcaaagcactcagagtttga

SEQ ID NO: 68504 - DNA, 2607 bp, Glycine max
  Peptide Sequence Number=SeqID_160189
atggcgatctcggggaacgtgccaccgttgctagtgcagggagaaaaacaaaagaaggtaaagcttgatgatatgaagctttcaacatcagggttggggcagcagggacatgaaggaggggagaagaagtgtctgaattctgagctatggcatgcatgtgcggggcccctggtgtccctaccaactgcagggactcgtgtggtttacttccctcagggtcatagtgagcaggttgctgcaacaactaatagagaaattgatggacatattcccaattatcctagcttgccaccccagttgatttgccaacttcacaatattacaatgcatgcagatgttgaaacggatgaagtatatgctcaaatgacattgcagccattgactccgcaagagcagaaggatacatttcttcctatggaattgggcattcctagtaagcagccatcaaattatttttgcaagacgttaacagccagcgacaccagcacacatgggggattctctgttcctcgtcgtgcagctgagaaagttttccctccactggatttctcgcagcaaccgccggcacaggaactaattgctagggatctccatgatgttgaatggaaatttcgacatatttttcgaggacagccaaaacgacaccttcttactacaggctggagtatatttgttagtgccaagagacttgtggctggagattctgtgcttttcatatggaatgagaagaatcaacttcttttgggaatacgtcgtgccaatcgaccgcaaactgtaatgccgtcatctgttctatccagtgatagcatgcatattggacttcttgcagccgctgcccatgctgcagcaaccaatagctgttttaccgtattttataatccaagggctagtccatctgagttcgtcataccactttcaaaatatatcaaagctgtgtaccatacacgtatttctgttggtatgcgtttcaggatgctttttgagactgaagagtcaagtgtccgcaggtatatgggtacaataactggcataagtgatttggattctgttaggtggccgaattctcattggcgctctgtcaaggttggttgggatgaatcaacagctggagagagacaaccacgagtgtctctgtgggaaattgagccattaacaacattcccgatgtatccgtcattatttcccctcagactgaagcgtccatggcatcctggcacctcatctttgcatgatgggagagatgaagctactaacgggttaatgtggctgagaggtggacctgtagaccaaggtctcaattccctaaattttcaaggagctggcggtatgttgccctggatgcagcagagactggatccaactttactaggaaatgatcagaatcaacagtaccaagccatgttggcagctggtttacagaacttaggtagtggatatctcatgaagcaacaattgatgaattttcagcagccttaccactatcttcaacaatctggaaacagtaattctcctttgcaacttcagcagcagcaaccaattcaacaatccgtgtcttctaacatgctgcagccacaaacacatgtactgacagagaacctatctcagcacctccttcagaaaccacataacaatcaagaagtccaggcacaacagcagcaacatacttatcaagactcgctctcaattctgggtgatcagctccatcagagacaacactctggcattccttcatcatcatattcaaaaccggatttcttggattcgagcatgaagttccctgcttcagtttcccctgggcaaaacatgcttagttcactttgtcccgaaggaagtggcagtctcttgaatttatccaggagtggtcagtccttgctgaccgaacagttaccccaacagcaatggactcaaaaatatgcacctgtgcaggtcaatgcctatggaagcactgtgtcacatccacaatattccggaaaagattctgtaatggtgctaccacattgtaactcagatgcccaaaattctactctttttggtgtcaatatcgattcatctggccttctcctccccaccaccgtccctggttacaccacctcgtccgctgacactaattcatcaacaatgccattagcggagtctggtttccagggttctctatatggttgcatgcaagattcatcggagttgttgcaaagtgcagggcatactgacccagaaaaccagactcaaacctttgtcaaggtttacaaatcagggtcagttggacgctcacttgacatatcccggttcagcagctatcatgaactgcgtgaggagttggctcagatgtttggaattgaggggaagttagaagaccctcttagatcaggctggcagcttgtgttcgtcgacagggagaacgatgttcttctccttggagatgatccgtgggaatcatttgtcaataatgtttggtatatcaaaatactttcacctgaagacattcagaaaatgggggatcaagcggtagaatcccttgctctaggttcaggacaaaggctaaacggcactggtgctgagtctcaggacattgtttctggaccaccatcaatcggctcacttgagtactga

SEQ ID NO: 68505 - DNA, 183 bp, Glycine max
  Peptide Sequence Number=SeqID_160190
atggcgaggcgaggcgagactcggaacgagtcattattgactcgggcggttgtggcggttttcgccttcgttagacacgccgagtttgagatccttttctttcttttcttcttcatcgcttatcttctcttcaaagacatcgctcaaattttgatcccatgcccggggatctcaatttcttaa

SEQ ID NO: 68506 - DNA, 1110 bp, Glycine max
  Peptide Sequence Number=SeqID_160191
atggtggaaccatcaaagaagcgcaagggatcctcaagccgaagccaacgacattctgagactcaggaaacacagattccctccttcatttcctcttcctcattgttctcaacggaagaacaacggatacggtacacaaatttgttcttttcttgttccattatcgatccaaaattcattgacatggatttcttttccaatgagagttttgaatgcattcaggcatttgacaactccaatctcattcctttcatgtctttaaaattacatgtttacactgaattagttaaagccttctattctaacctagaaattcaagaaggcactttgatttctgaagtttatgggataaaaatggtcattgaccaatccctattctatgacttgacccaattatctagtgaaggtgtaccaattgaaggtacactgaatgatgatgggaaatttgatttctctgtgcatgatgcccgctggttggtttgcaccaaccaagcggatatgaccggaaggcttcttgtcggttcattggcttttgaaattcgcatccttcattatctcattgtgcgtatcttgattccaagatcttcaaaccttgcacaggtttctgaagaagatcttattgtcatgtgggcttttcataaaggccgacaaattgattgggcacacttagtccgatatcgcatgcataaggcattgcgattaaatgcttcattgccatatccacacctagtcactctcttccttcaacactttaacatccctcttgattctggaccttatgtgccaatcaagagatccttcttaatcggtgtcgttgtgattgcatcctttggttaccgtaaagagcatgatggctcttgggtgaaaaagggtgctcaacccattgatgaagaaggacatgtaccagttggagaagattcctctcttcttcaaaggatttttgacaagttcgatagtcttcaaacctttgttggtgaaaggtttgatgctctggagttacaagtggacatgcgattcgatgagatggatacaagaatcaccaaggttgaaggagatgtctctcatatccgcacatgctttgatctaccaccaccaccaccatcgtcttag

SEQ ID NO: 68507 - DNA, 390 bp, Glycine max
  Peptide Sequence Number=SeqID_160192
atgtccaacaattctccgcgtcgccgccacaacaacctcctccaccttcgtcgcctccgtcagaggcatgaacaagcgggggttttggttgagaaaggtttgagttttgagcttaaggcgcatacgtttgtggcatttttcgaggtagcgcagaaggatgacatggcttggctcgttgaggacttctttgacaacgcgagcacattgcttataacgcttgttcttgatgcttttagcagtgatgaccggatcaagattcattcaaggaagatgaatgttcacccagatgtccactttgaagaacttgcccggtccacagatgatttcaacagagcagatgcttctggaatggcagagtcactgaagtatgatttccttttggtcccttaa

SEQ ID NO: 68508 - DNA, 750 bp, Glycine max
  Peptide Sequence Number=SeqID_160193
atggctgcccgcaaggttaaactttctggaaagcctggaccattatgtccagtgcagtataaaagactagaaaaagaattccattttgctaatcaatggactcccatttggtgtggtgataacatgggcctgagatatgaggtccacatgtgggggaataaggttgaggtcaatttaggtgaatggacatgcacttgtggagtatggcaactaacagatgaggacaatgtcacaggacataagctaaagaggaaattggctgagtttacatgtggaaggtgtggccaaaccaatcataacattagaagttgtaaaaatattggagttcctgttaggccaaagaaatatgttgcaccatcaacttcaaatgaggatgaccacctattatctcaagatgaacaagctttgaatgaggctgaagaagctgctgctcatgttcaacaagatccggtggagattaatttatctcaacctcatttgtcacaagatagtgacatggagttgatggttgctgagtttgaagttcgaatagctgcacgtcttccatggtggcattgccgaatgaaactaccagaaaatgcacaacaactgccacttgcagacatggacaaatcaagagaacaagcagcagcgactgagcctcagagtagaagaagaagaagcaactcagcgtgggaagaagaagaagaagaagcaaccagcagcttcgtaaaccctaatttttttggggaagaagaagcaaccttgcgt

SEQ ID NO: 68509 - DNA, 1889 bp, Glycine max
  Peptide Sequence Number=SeqID_160194
ccttcagcaaggcatatgggaagatctgggatttggcaatgattgaagtgttcgcagaagccatcacatccctcactcaatactacgaccaatcactcagatgctttacttttggggactttcagttggcaccaaccatagaagagtttgaggagatcttaggatgcccattaggggggaaggaagacatacctctttggataccatggaagcgcttggaggagaaggtagaagctttggcaaatcaaggggagtggacctcattcattaacatgttagcactattggtgtttgggactatactatttccgaatgtggacgggctagtggatctagcagcgatggacgcctttcttgcttatcaccacgacaaggaaagcctcgtcatcgctgttttggcagatgcatatgatacattcgacttgaggtgcaagaagagcagtgcgagaattgtctgttgtactcctgctctttatgtatggttggcatcccacatcttttatcatgaaggtagatctgtttgtcctttacaaagtcattgcatgtgctccgaaaagggtaaagcaaattggggagaactcttggcagggattcccaaatgtccctttgatagggacgaggggagcttaggggaagtagaagatgtcatcagcggctatcacaagtggttgaagtctagaacgcaagggataacttggctcccaaagaaaaaaagtctaagtgggaaaaaggctgaaattcctgagaaaagtgaagaagtgcaagctttgaaagaagagctcaaaaagacaagaatggaaaaagagaagttgaaaatgacagtcattagggtcaagaaagagtgtgatgagctgaaagacatcaacatgaccacagttgaagcattagaaagtaatgagctcaagcttagaagggccgggagggacaaatcaaggatggaaagcatggtgctggaagatgaacaggcaaaggtatcggctctgcagattgaaagagaagcgagagaaagggtgatagagttattacatggggaagctatgaaatggatggatagattcgctctcactctaaatgagagtcaagagcttccgaggttgttagccagagccaaggcaatggttgacacatactcgtctctcgatgaagttcacaatcttttcaattactgccaccacatgaccgacatggaggccatgaaagaccaaatggtcgccatgttgagcatgaggaaaataatggagggcaacgcggttgcggtcgccactacaagtgccgccactgagatagacccgtctcacccatccagtatgaatcaagtccagagtaagcatccattcccaccgtacggcctacctcccaactatgcaccacccaatgttgtacatgtgcccaaggagaatgttgaccactccgctcccataccctttgagagccaacaacctcaatctgagcatgcacgtgttgctcaacccatgggggagtcgcatgaggtaccccaagaccacgctctggccgatcttgaggcttacctcggatatgccactaagggtattgcccacaaccgcaactacaacccttacatttttcggtgggaagatccggccatgatggaaagggaaaaatttgaccacctagaagaaaagttgagggccattgaaggaggtgggactacccttttgccgacatgggatttggcggctcaggtagcgcatccaatgatggaaagagaaatgataacaatgatagtggacacattaccaatgttgtactatgagaaaatggatcaaggaaggcctgagaagggaaaattcgattatgcggcttcaacaagtgttggcaatagaaggactggaacaggtggtgctaagaaaaaggagagagatgctgat

SEQ ID NO: 68510 - DNA, 1533 bp, Glycine max
  Peptide Sequence Number=SeqID_160195
atggaggtacgacatgactcaaatgattttaacaaggatgaagagagtccaatcaagaaggagcacaagagcaaagaactagatcaattgatctctttaatcaaggaattaggaaaacacgataaaaatgcaagtgcctctagaacaaacgactcatctcagaattgtatgcccctaaagagcatccttgaaaatataattgatttcctacaaaggaaagacacgagtgggctgtttgctgcaccaactaatcttgatgtggtggaaaattaccataaaattgtcaagcaaccaatggattttggtaccatgagagccaaacttcacgaggacatgtatacaaacttcaatcaattcaagcgtgatatctttctgatatgcagcaatgcaatgcatgctagtcctaagacatcaaaatatcatgaagtggctaaacatattaataggtatgcaaaggggatatttgaggctctgaatgcggaccttggactttttcattcagaactttccctcaacaagagaggtccaagtacaaagcaacaaaaggagaaattgatcagaaccccacgaagggttgctactaaatgtgctggtatggatacatgctcctcatttaacctgcattcattaatacaaaaagtttctcgaccatacataaaggtagtgagatggagaaacaatgctactcactctacggtacctgaaacagaaaagagggataagtattggcctccaagtaagccactggttgcagaagtcctaaatgctaagaagcccatcattcaattgaacgaaaatgtaagtaagtacaaagagagcctcctacggtttgtgaaggatttaggaccaacagctcaaaaagtagcagcaaaaagactagaagttgtttccctttccccagttgagaatgtgtcttcctttcatggacctattcaagagcctaccaatcaactgcacttaggaagtagcagaacaagcaacacaagactgtggaacacctctgctggtatacaaaacatgttagccgccggaatctccagcaatgcgtttgcctgcgtctgtccgacaagcatgatctcagggccgcctcaaccaaggttatcaggcaacagaaataaccttccagggtcatcacgcaatccaaatccatgtcttttgtctcagtcaatggcagattattcagtttcttgcatgccaagcaacaacctcactgagctactacctcttatgcatcagccaaggccaagagaatcaatgtatgccatgcctagcaataaccttacagggctatctccttttccacaccgagcaaattccgcgtccaggctgaaccccttgaggctctctcctcatggaccagtttctcaacaggaacaaaattcatcatttctacaaatgctcttaggaggtgaaaccaataattatggaggaggaggtgctcaaataggccagccagaagaggctcctccacagcttcctttggacaatgataatgatcatgatgaggtgcctgacttagaacttcacctctga

SEQ ID NO: 68511 - DNA, 474 bp, Glycine max
  Peptide Sequence Number=SeqID_160196
atgactccttggacatttgtagttgttaacttgactcttattgatcttcctggccttacaaagagggccaaccagattgtagatcttgcaacatctgatgcaattaaaatatcccgtgaagtggatcccacaggaagcggggagctggttttgtttggggaatctcaaatatcatcgatgactatttgctttcttgcaatgctagtagtaacctatgtggcaaataacatgggctatataggcaaagatttatcaccaactggcattgtgatagttgtgttgattatctgcaccattcttgggtttccactggcaataatagtgtcactgggaagtggaccatgggatcagctatttggtggaggaaactccctaacctttgttgtggcagctatttcagcccttatcagtggactcataactgtgttggctattcctcgatctggtgctcaaaaggctcgaagccatgtatga

SEQ ID NO: 68512 - DNA, 279 bp, Glycine max
  Peptide Sequence Number=SeqID_160197
atgtttgtattcaacagtgctttgaaagggcttgacgatactcaacaaagtaaattcaagcctcctgctaggtggattgttgttaaatgtaatagacaaaaaggaaacattgagtgtgggtattacgtcatgcactggatgtcaactataatcttaggaaatttcaagaataattgggaaatgtatttcactgatgctagaccattggaaccagagagattaaaggcgcttcacatccaatgggcaaagtactatttgaaagttaaaaatgaaacttag

SEQ ID NO: 68513 - DNA, 1530 bp, Glycine max
  Peptide Sequence Number=SeqID_160198
atggccaacgtggcctaccgcatggaacgccagctgcgtcagctgagcaaggtggaagtgctgggcaaaatcaacggcgcggtgggcaactacaatgcgcacatcgccgcgtatccggaagtggactggcatcagctgagcgagcagtttgtgacctcactgggcatcagctggaacccgtacaccacgcagatcgagccgcatgactacatcgccgagctgtttgactgcatcgcgcgcttcaataccatcctgattgattttgaccgcgacatctggggttacatcgccctgaaccatttcaaacagaaaaccattgctggcgaaattggctcttcaaccatgccgcacaaggttaaccctatcgacttcgaaaactccgaaggaaatctggggctggccaatgcggtgatgcagcacctggccagcaaactgccggtatcacgctggcagcgcgatctgaccgattctaccgtgctgcgtaacctcggcgtcggcgtcggctatgccttgatcgcctatcaggccacgctgaaaggtatctccaagctggaagtgaaccgcgatcgcctgctggatgagctggatcacaactgggaagtcctggctgagccgatccagaccgtgatgcgccgctacggcattgaaaagccgtatgagaagctgaaagagctaacgcgcggcaagcgcgtggacgcagccggtatgcaggcatttatcgacagccttgagctgccggaagcagagaaagtgcgcctgaagcagatgacgccagccaactatctcggccgcgcgattcagatggttgacgacctgaatcacgcacgtcacgtggtggctgaggttcccctgccagtgcatcacagcggagtgttaatctgcgataatgccctgctgcgccatcacctcgcagtccagttacgtgacatgggtcatcaggtggatgccgccgaagacgccaaagaagccgactatttcctgcaggaacacattcccgatatcgcgctggtcgatctcggcctgcccgacgaagacggcatgtcgctgattcgccgctggcgtggcgatgccattcgtcagccgattctggtgctgaccgcgcgcgaaggctggcaggcgaaagttgaagcgctggaagccggtgccgatgactacgtgaccaagccgttccacattgaagaggtcgccgcccgcttacaggcgctgatgcgtcgcaatagcggacacgcctcgcagattatctccatgccgccgttccaggttgacctgtcgcgccgcgagcttacggtgaacgacgcgccggtcaagctgaccgcgtttgagtacaccattgttgaaacgctgatccgcaatgccggtaaagtggtcagcaaagactcgctgatgctgcagctgtatcccgatgcggaactgcgcgaaagccacaccattgatgtactgatgggccggctgcgcaaaaaaattctcgcgctgcacccgaccgaagtgatcaacaccgtgcgtggccagggataccgctttgatctctga

SEQ ID NO: 68514 - DNA, 426 bp, Glycine max
  Peptide Sequence Number=SeqID_160199
atgcgccgattgttaccaactgcaaagcccatgcgaaaaacttctcaacgaattcaccagcataagcgccctgctgccccggcgcgccagcctgcgcggcgtgacacgcggccaaaaggtccgcgtcgcgtcatactctttaacaaacctttcgatgttctgccgcagttcagcgatgaggctggccgccgcacgctgaaagattttgtgccggtgagcgaggtgtatgccgcaggccgtctcgaccgcgacagcgaagggttgatgattctgaccaacgatggcgcactgcaggcgcagctgacgcagccgggcaagcgcaccggcaaaatctattacgttcagaagtggtgcctgaacccgcgtggctgtggccgcgcaccccgccgattcgcgagcgcaaagctatccccacctgctggctga

SEQ ID NO: 68515 - DNA, 1231 bp, Glycine max
  Peptide Sequence Number=SeqID_160200
atgaattacttacgcgacatacaaacgtttattgaaggcaacacggtgctctccgccaccttcagcctgctgctgttactggttgccggcatggtcacccatctgatctgcaagttcttcgtggtaaaagtggtgcgccgcgtgttctttagcacgcataaaaaccaggtgccgctggataaagacgtccggctctcagaaaagctgtcgaattttattccggtgatcaccgtctattacctgctgcagtttatgccggacctgcccgagcatctgctgatcgcggtgaaaaccatctgcggcattctgttttttgtatatctgtcgctgttctttaacgaagtgctggagatcgttaataactcctattcgcgtaagtcgaagcgtaagaaccactcgataaaaggctatatccagatcggtaagatcctggtgcacatcatttccgccatcatgattctggctatcatgtcgaacaaatcgccggtgattatcatctccagtctgggtgcggtcgcggcggtattgatgttagtgtttcagcacaccctgctgtcgctggtggccaatattcaggtgtcatcgaacgatgtgctgcagctcggcgactggattgaaatgccggataacggcatcagcggtgaagtgattgatatcgctctgcataccattaccatccgcaactgggacaatacgctgtcgcggatcccgaccaaaaatttcctgaccgaaacctacaccaactggcaggcgatgttctcctccggcgcgcggcgtatcatgcgcagctttcatctcgaccagacctcgattcgctttctcgatcagcaaatggtgcagcagatgagccagattcgcggcgtcagtgagcagctttcaatcctgatggatggccgcgatagcagcgtggtcggtgaccgctggtttgccgaaaacggcatcaccaacctcacggtgttccgtcactatctcaccgcctggctggcgcagcgcgacgatattaaaaaagatatgtatatcgtggtgcgcgcgatgaaaccctcaccggagggattgccggtagaggtttattgctttacctcctcggtgctgtgggttgattacgagaattcccagtcggcgatatttgaattcatctacgccatcgtcggtcagttttcgctgcggatttaccagcatccggccggcaatgatttctggcgtttgtcgcaggcgcgcgatagccagatcg

SEQ ID NO: 68516 - DNA, 678 bp, Glycine max
  Peptide Sequence Number=SeqID_160201
atgaaaccagacgggaggagattgcccgtttgctgcagcgtacgcgccacgatcgcgcccacgacgaacgcgatgaacagcggcgtcacgcggacgccctcactgctggccgcgatacgccgggtaccagctcaccaggaagtggcgcagatgatcaaaacaccattcggcatcgtccgcctgctggcagtaatagcgaatggtgaccttctcatagcggcgatggcgctgctgcagcggcgaccagctccagtccagcaccgcgcgcgcatagttgaccagcgcgtcgcgcggcatgctgtgctgctgctcctggcggcgcagatacatctcaaagaactgatcgagactctgtgtctcttcgctgctacagtccagcgtggggcggaacgccacatcgagaaagccgcacacgccgtctgcgcgctgctgccagtcacaggccagcgtcataaacaggccatcctgcagattaacctcttccagcagacgacgcaaattttcagaatgtttaccggcggcgatctcatcaatgcgatcggtttccagcgtcaggtcaaaaccgcacgggttgaccgagccatccgcgtctcgggtggccggaaaggggaaatcgatataaccgttattgtccagactcttttccataatgcaggtccgcagcatgacaaacgctga

SEQ ID NO: 68517 - DNA, 276 bp, Glycine max
  Peptide Sequence Number=SeqID_160202
atgaaacaaaaagaaaagaggaagaaagacctcgaaggtcggcatattatggtcataaagaagcacaaatcattcgtagagagcaaacatatcttttggaaacaagaaattgatgctaagagtttattttccaaaataaccgagataagaatggatggatttgttgaaccaatgaaagaacataatttggaaacgtgggagaaagaagaaggagagacgggggtcacttatttcaaatcgttttgggttggaactattgtgattgagatcaattaa

SEQ ID NO: 68518 - DNA, 180 bp, Glycine max
  Peptide Sequence Number=SeqID_160203
atggctgacaacaggcaacagatgcaccgccgccacctccaaagcccctcaactcatctacaaaagctggagcgttgcttgcgacccatggtcgaccaacaagcgaccaagtccgaagccaaagaaataatgtgggacatcccctttatccctgaaccgctggccaaacccacaccctga

SEQ ID NO: 68519 - DNA, 330 bp, Glycine max
  Peptide Sequence Number=SeqID_160204
caatctggagcaattgaacaggctttgaagcttatgctgcaaacatctacaatagacctccttaacctcagcagcaaaatcaaccacaacagaataattatgacctctctagcaacagatacaatcccggatgcaggaatcaccctaatctcagatggtctagccctcaacaacaacaacaacagcctgctccttccttccaaaatgttgctagtccaagtagaccatacgttcctcttccattgcaacaacaacaacaacaatagcagcatcaacagagacaacaatccactactgaggcccctcctcaaccttcattggaagaattag

SEQ ID NO: 68520 - DNA, 158 bp, Glycine max
  Peptide Sequence Number=SeqID_160205
gagaatctggcagagcatcagcatcaaagctaggtgctaagcgcgagatcagtgcgctaagcgtagcagacgccagggcacagaattccatagcagccacaggcctatttggggaaaagagccctagaagcagaaaagaggagcagcttgtgcattga

SEQ ID NO: 68521 - DNA, 771 bp, Glycine max
  Peptide Sequence Number=SeqID_160206
atgttcttgtgttctatgctgaagcctaaagtactaaacctcgaacccttaaggctgcacgccttcaacttcagaggactacacgtccttgccatcagagggttgcacgccctccccttcagaggactacatgtcctcgccttcagaggactgcatgtcctcaccttcagagggctgcacgccctcaccttcagagggttgcaagccctcgccttcagaggactgcacgtcctcgtcttcagagggctgctcgccctcaccgtaagaggactacgcgtcctcgccatcagagggttgcacgccctcgccatcagagggctgcatgccctcaccttcagaggactacacatcgtcgcctttagagggctacacgccctcgccttcagaggactacccgacctcaccttcataatgctgcacgccctcgcctttagagggctgcacgccctcgccttcaaagggcgacacatcctcaacttcagaggactgcacgccctcatcttcagaggactacacgccctcacctttagaggactacacgccctcaccttcaggggactgcacgtcctcaccttcagaggactgcatgccctcacctttagaggactgcacgtcctcaccttcagagggctgcacgccctcgccttcaaagggcgatacatcctcaacttcagagggctacacgccctcgcctttagtgggctacgcgtcctcactttcagtgggcttcatatccacaccttaagagaatttaaggtcctctgcccttaa

SEQ ID NO: 68522 - DNA, 312 bp, Glycine max
  Peptide Sequence Number=SeqID_160207
atgagtcaatccttgctttctcataagggtggacccttgggaactagtaccctcaccttcagaaggctacacgccctcgccatcagaggactacacgtcctcgccttgaaagggctacacgccctcgccttcagagggctacacgccgtcaccttcagaggactacacatcctcgccttcagagggctacacgccctcgcctttagaggactacacgtcctcgccttcaaagggctacacgccctcgccttcagaagactactcgtcctcgccttcagaggactacacgtcttccccttcagagggctacat

SEQ ID NO: 68523 - DNA, 282 bp, Glycine max
  Peptide Sequence Number=SeqID_160208
atggctaccaaaggttggagctttgttggagcttcaatggtggaggaagaagaagagaatggcaacccacaagaagaagagaaaaatctgacctttgaaacgctaaaatcctgcctcggtttgcgtgtcatttctctggttccagtccctcgcgtttctctgcacccgtcggggccagttttcgaaagtaagcaatatgtatatcaaaacgctcaaaatgaaaccacgaacatggttcagaggttggttttgttaaattttaagttgcacgtaaaacgatga

SEQ ID NO: 68524 - DNA, 177 bp, Glycine max
  Peptide Sequence Number=SeqID_160209
gtcgactctagaggatcccactgcagagccagggctttacttcttttccgtgccctactccggaccagttcagggcagaggtcgcatggcctggagattgacctgaggcccgggcaggagaggcaccagcagagactcccgacgaggcagatgaggcccgcgaggacgaggagatga

SEQ ID NO: 68525 - DNA, 330 bp, Glycine max
  Peptide Sequence Number=SeqID_160210
atgagtgagataggaaggtttggaagtttgggaatggaggtacggcgcaaggaggaaggggctgtgcaggagattctgaaaacgaggaggcagcctactggtaatcgattacatgaatactgtaatcgattacaggccatctgttttggtgtaatcgattacaatattcatgtatacgatcaagaaggataccatagtcagataattgttgcttcatccataaaatttgtgcacaacaactgccggcagaaatatattccgcttcagctgtggacaaagcaacactgttttatttcttactatgccatgagacaagagcggatccaatga

SEQ ID NO: 68526 - DNA, 1308 bp, Glycine max
  Peptide Sequence Number=SeqID_160211
atggtcgactggcgccggattgtggttacggtggctgagcgcatcggcaaaacccatctcacctatgcgcagggtgccagtgcggagctggtggcgatggccaccattggcgcagccgatgcctttggtttaccggtgtcgaccacccatgtgctgtcgtccggcgtggccggtaccatggcggccaaccgatccggcctgcagctcgccaccctgcgtaatctggtgctggcgtgggtgctgacgctgccggtatcggtgctgctgtcagggctgctgcgcagcgtaatcaggaacgcgcccagcaccatcagtgctgccgccagatacaccgactgcatgccccagtggccgattaacagccccgccacgggtccgcgccgggaacaccagcgagaaaccgccgccggtgaggaaggcgccaatatccaccagccagctgctgtccgcctgccagatcagcagcagaccggcgccctccagcacgaaggagatcagcgagacctgcagcccgccgaagcgcgtgatatagcgcccgcacgccagccgcaccagcacgaagccgaggctgaacagtgtcagcgcgaacgccgcgccgctccagtcgcggctggcgaaataaagggtaatgaaggtggagatcacgccaaagccgatggtgccaaatcccagcgccaggccaaacagccagacgcggctgaccacgcgatgaaacggaatgcgcacgccggcgctgacgctgaccgccggtttgccggaggccatccagaagccgatcgcccccatcagcgcgaccagaccggcaaagccgctgatgccaaaaatctggttcagcagcacgcccagcggcgcaccaatcgccatggcaaagtaagtcgccacgccgttccacgaaatgacccgcgcggtttgccgcgggccgacaatgttcatgccccacagcgtcgagccggtactgctgaaactttccccgacgccgagaaacagccgccccagcgccagcagcgtcaggctcagcagcggcgcaccgctgcacagcgcggcaatgatcgacagcacgccgctcatgccgcagcacaccagccccatcatcaccacgcgtttcgggccgtagcgatcggccagccggccagagtgcgggcgactgagcaacgtggcgaaatattgcagactgatgatcagcccggcgataaacgagctgaagcccagctggttatgcacaaaccccggcagcaccgccagcggcaacccgacggacaggtagcaaaagaaggtgaaaacgatgacggagaggatgcgtttatttaa

SEQ ID NO: 68527 - DNA, 510 bp, Glycine max
  Peptide Sequence Number=SeqID_160212
atgacttctatagcccagtctaacacttctagacttgggtttcctactatgatcaccgccctatgtagagccagaagggttgtctcttacagccttacttttgagcgcctgagcccgtttttggagagggtagcatggcctgggacccaaccttctcttcatagggaagatgaaggtcccacagctcaggtaccacagcatgtggaggatgagtcatccgaggccaccattccagagccattcatggtagaggaggaggcaggtaaggcacaggttagacaggaagctgctgctactcctgagaggtctcgagaggtcacatcagatccacccacactagtggtggacctatcctcaccacagcatgcagcagacccctccactcctatcctagagataccagaggacccgactacaccagtcctaactctaaacacttctcctccagctactccagcacttcatctgacagatgatgaggatgttcagacacaggatacacaagactag

SEQ ID NO: 68528 - DNA, 300 bp, Glycine max
  Peptide Sequence Number=SeqID_160213
atgcattctgaagctgaagcattagaacatatgaagaaaagagatacaagccatcaaagtgtgtcattggagaataagacaggagattcaactatgctgaagataggagattcaactaaagttgtgataaaacaagacatgaagggaggagagcataaatatgggtttaacaacaataaatgtgagaagccagagaaggtaagggtggtggatgatgaaactggcgacaaacataagctgtatgaagtcctaaggatgccatccagaacaaaaaaccgatgcctcaagttttttacttag

SEQ ID NO: 68529 - DNA, 162 bp, Glycine max
  Peptide Sequence Number=SeqID_160214
atgagagcaaaagaagcagaagatgcaatgtattgtgagcacaatgtagatgtttcgactgtctcgcttagtgcgagtgactccctaagcgagcactcagtgaattttgaattttcagattttaaattcacgcgcttagcgggacagactcgcttagcctaa

SEQ ID NO: 68530 - DNA, 484 bp, Glycine max
  Peptide Sequence Number=SeqID_160215
atggctccaaaaaagctttccgcgaagagatctaggaggggcgccgcggctgaagggacatgtgccgcccccgagtttgatggccaccgtttcaagagcaccgagcaccagcagcgcttcgaggccatcaaaggatggtcgttccacagagagagatgcgtccagctcagggacgatgagtacacggattttcaggaagagatagctcgccgacattggacgtcgctggtcactcccatggctaagtttgacccggatatagtcctggagttttatgctaatgcttggcccacagtagagggagtgcgggacatgcggtcatgggtgaggggtccgtggattccctttgacgcagatgccctcagccagttcctgggtgacccgctagtgttagaggaaggccaggaatgtgagtttagtcagaggaggaacatgaccgatgggttcgacgaacaggccattgcccagctattatgcataccgg

SEQ ID NO: 68531 - DNA, 395 bp, Glycine max
  Peptide Sequence Number=SeqID_160216
aaaaagctaagtgccaaaaggcaagtaatagggttgggaataaaaagaaaaaggttgatctatggatgaatgctctcctagaatctaagcttttgcatcctagaaaaaccatgaattatttgcagcccaacctcattacttgcctaagaaaagtccttttgattcaatttatcacaagaggcaaaagtcttgaagtgctaaaaggagcagtcgtgctaagcggaacctatgggctcagctcgcatctatcactaacctcaactacaacatgcttagcgttatgtgagaatctggaagagcacaagaatcgaggccatgcgcaaagcaagacattcgtctcttaccaggctcaacgcacaactggcaccaagcccaaatccacttactcgcgctaa

SEQ ID NO: 68532 - DNA, 738 bp, Glycine max
  Peptide Sequence Number=SeqID_160217
atgacgcgcatgaaatacctggtggcagcagccacactgagcctggctttggtgggttgctctggctcaaaggaggaggtgcctgataatccgccgaatgaaatttacgcgaccgcccagcaaaagttgcaggacggtaactggaaacaggcaataacgcaactggaagcgttggataatcgctatccatttggtccttactcccaacaggtacagttggacctgatttatgcgtattacaaaaatgccgatttgccgctggcccaggccgcaatcgatcgtttcgctcgtctgaatcctacgcatccaaacattgactatgtcatctatatgcgcggcctgactaacatggcccttgatgacagcgctctgcagggcttcttcggcgtcgatcgttccgaccgcgacccgcagcacgctcgcgacgcattcaatgatttctcgaagctggttcgcggttatccgaacagccagtacgctacagacgcctacaaacgtctggtgttcctgaaagaccgtctggcgaagtatgagctgtcggtggtggattattacaccgaccgcggcgcctgggttgccgtcgtgaaccgcgttgacggtatgctgcgtaactacccggatacgcaggccactcgcgatgcgctgccgaagatggaaaacgcctatcgtcagatgcaaatgaacgcgcaggctgacaaagtcgccaaaatcatcgccgccaacggcaaaaacacctga

SEQ ID NO: 68533 - DNA, 324 bp, Glycine max
  Peptide Sequence Number=SeqID_160218
atgaccaaactagccaacttcaatgagtttgcggagcacgtcgccaagttcgtggctgaacgcgtctacctgccgttgcgggaacgcatcgaatacctggaggccgagctagccgatgctcaagctatctcttcagacatggaggcggacttcctgcggtcgttcaagcagcagtcccgggcgatcctgaaccagctaaagcgcgactccgtcagcgctggtcatgtggcgctcgtggaagaagcactggccgacctgcgtcgcgtgggaattacgcgaatccgtgtcagcgcactggttgctttggccgctcacaacgcgagg

SEQ ID NO: 68534 - DNA, 264 bp, Glycine max
  Peptide Sequence Number=SeqID_160219
atgacgagaatcatgaaactggccaaatacaggctaaaggcccaagtggagaaggacaaagcccccgagtggagaaggatgaaggcccaagtggagaaggatgaaggcccagaggcagagacactatcaagactattaattgttgctgaaggcccaaacttatcttccttcactggaagtggcgtctacccagacttatcttccttcaccggaagtggcgtcatccaaatctctgtaacctgtatcaaacgatccgccccgtaa

SEQ ID NO: 68535 - DNA, 90 bp, Glycine max
  Peptide Sequence Number=SeqID_160220
atggtgattttcagccatggagttacaacgaaagataaaggaggagagtatctaggaagtgatccttggtcatttcccaatgagcaatga

SEQ ID NO: 68536 - DNA, 456 bp, Glycine max
  Peptide Sequence Number=SeqID_160221
tcgttcggagtccccgttgcacctaccaaggtgattcagccgcccatcacccgggcttttattgagaagtactgcacccagagacaggctcagggggatgctccacaggccgtgggcgcgccaccaccaccttatcaggctggcccggctgggtcgtttgacatggagcagtatttacggcatttggttcgccagcaggcagccaaccaccgggcacatgtgcagacccatgattgcctataccagatgagcctcagcatgcagagccagggcttcgcttctttttcatgccctactccagaccagttcagggcagaggtcgcatggcccggggattggcccgaggcccaagcagaagaggcgcccccagaagctcccggcgatggagaggaggcccacgaggacgaagagatggccgatttgcttgacttcttgggagggagtggagctacatga

SEQ ID NO: 68537 - DNA, 534 bp, Glycine max
  Peptide Sequence Number=SeqID_160222
atgggggacgtgtcaacctctagaaggttcattttggaagcactacgcgaagctgatgataaaaacccaagtaagcccaagcctttggtaatccacttcactagggatgtcaccactcaaaagccccaaggtttccagcccgttacagttaaaaagcctgcaccctttccttacaaaagtgatagggcagtgccatggaagtacgccgcacaaggacccaacagaaggaaggatgcatccatcgtacatgttaaggatgatctgtcctccactaaagttacaaacatatccggtacgagtcgcatgactcatagtggatggatcttcacggagcccgaactactagtgcggtccaaagacccaaaagggaaggtaaaggcggatatgggtgagagtgataaggcgggcatgaccctagatgacgaggtcctggttggaaagatcgccgaggaagggaatgacttccgcaagaagggaatatccgctgaggaggcgatcgagttcccgaggatcatccgacagagtgagttcaag

SEQ ID NO: 68538 - DNA, 246 bp, Glycine max
  Peptide Sequence Number=SeqID_160223
atgtcgcggaacttcacggatttcctatcgatgggtgtcaagtacctcaaagtggtcaagcgagggtcgcatcccaacaaacagatgatgcatgcaaccttcatcttggaatgcgaaaggtttgatgcaatcctccctaggaaggggccggtcactagagccctgagcaagaggctccaagaggattgggctagagctgctgaagaaggccctaggattctcatgaaccttagggtagatttatga

SEQ ID NO: 68539 - DNA, 339 bp, Glycine max
  Peptide Sequence Number=SeqID_160224
atggatatctctaaagatactgacatccctgtaatattgggaaggccattcatgttgaccgcaagctgcatagttgatatggggaagaggaggctggagctagcttttgaagatcagaaaattgattttgatttgtttgttgaagacaagcctgctcgagaacacaatgtctgcttacaggtaatggaaggaggtcaagaggttctgaaacgtgagtctcaagcgcttagcgcccaacccttgcatctgaggctgatttggtccgctaagctagccaaggatgagctaagccaacttcaattcgatctgaattcggctaagcttcagcctgatcgctaa

SEQ ID NO: 68540 - DNA, 738 bp, Glycine max
  Peptide Sequence Number=SeqID_160225
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggccagggcgggggctccagcttggagcgaactgcctacccggaactgagtgtcaggcgtggaatgagacaaacgcggccataacagcggaatga

SEQ ID NO: 68541 - DNA, 548 bp, Glycine max
  Peptide Sequence Number=SeqID_160226
tgcgagcgtatttgttgcatcctcttggatgcacactctttgctaacaagagtgccacacacgtgcatgttgtattcttggatgcactacgtgacttgacacagagtgagggttacacttggggcgctgctgcacttgtgcacatgtatgataatttaaatgacgcatccaagagcacggcgaggcagcttgcaggatatatcactctattacagcattttccgtccgttggttccgctgttcctgccaaggattatgatgaaaggagaccatgtgcatgtcgatggacctctggcaagacactgcccgtttccatgtatcgcaggcataaggatagactgacccctgacgtggtgtgctggattccatacgacaaccaccattcatttagagaatttgagtttggtgagcacattgcacctgtagggcaattatgtgcagtgcctggccactgttcgccagattatatggattggttttacatgatctcgcactcattcatgagtccagcacagctagaggatcctcttagagttccgccagtttag

SEQ ID NO: 68542 - DNA, 525 bp, Glycine max
  Peptide Sequence Number=SeqID_160227
atgggcaccgtgggacgccagcgcttcgcgccggcccctgcggtgcccgccaggaacaagggttcgattccggagagggagcctgagaaacggctaccacatccaaggaaggcagcaggcgcgcaaattacccaatcccgacacggggagggcaagtctggtgccagcagccgcgttaaaaagctcgtagttgaaccttgggtctggctggccggtccgcctcaccgcgagtactggtccggctggacctttccttctggggaacctcatggccttcactggctgtggggggaaccaggacttttactgaccgccgtaatgattaatagggatagtcgggggcgtcagtattcagctggaacgaaagttaggggatcgaagacgatcagataccgtcgtagtcttaaccataaactatgccgactagggatcgggcggtgtttctatgatgacccgctcggcaccttacgagaaatcaaagtttttgggttctggggggagtatggtcgcaaggctgaaacttaa

SEQ ID NO: 68543 - DNA, 228 bp, Glycine max
  Peptide Sequence Number=SeqID_160228
atggcaatcaatatacatgggaaggttgaaagtaagcctatgggaatcaatataccatgcttaaagaaacaaatcgctggtgctggcagcttggacatacaaacttttccgaaatttcaattggcaattactgtgaaaactagtgccaaagctagagcttgtctctttgtttccttgtttgtgggttgccatatagggaattggaaggaggattggtgccatccctga

SEQ ID NO: 68544 - DNA, 2958 bp, Glycine max
  Peptide Sequence Number=SeqID_160229
ggaagtatgcatcagatatcttggtttcagtttcttcctcatgaacctgacctgaaccctctacctgacaaaagtgttaaagtggaccaaaaggatgctgcaatgttactggtgctttcatcacatctgcaacttcagaaggaggggtttctcagcacatggaccaattcctttgttggaccttgggatccatcccagggattgcataatccagatgaaaagattaagctgtggctttttcttcgggggcgtcattcatcagttgttgagactgctcagacagcagtatctggattaagagttgttgcttctgggctttggttggctcctggggattcagaagaggttgcagctgctctctctcaggctttaaggaattgtatagaaagagctttgcttgggctttattacatgagatttggagatgtattttcaaagtttcatcaatttcaaagagaagaaattttcagaagaggacagcctgcagttgaatttgtctttgctgcaactgaggaggcaatcttcatacatgtcatagtatcctcaaagcatatccgaatgctttccacagctgatctggaaaaagtattaaaacattctatggagtcgacatatagacttccagtaattgtttctccgcatggaattcgtggcagcttgactggttgttctcctagtgatcttgtcaagcaaagctatttcagttctaccaaatttagggtgtccaatggaattataggtctcccatatcatgtttcccagggtgttggttgccagctgagggggcagaattgttatgttgaagtaagtcttggcttccctagatctggaactgacaacacgttgcagccaaacaaaaatagtgtcaggaatttacccaaacttcatgttgctgaatctcctgttgtgggacgaagtgatcacaagggaccaccagatcatttgttggattacgataaaacgtttctctatccagctgaggcagtgcttgtgccagtcttacaaacatcattagcaaggtcttccttgagaagtgctggtaatgtggattgtactgaagatccttggactgaaatcaatggaacccgcacacaaagtagttatgatagtagtagcaatagcaataatagcagtattagtagcttaagtgccagctctagtgatagtgattacaagactacaggaccaagtgaactagaggcagatgctgattctttgacgtgtagacagtctatggtatcttctgctgatcagttggacagtgatggccccaaattgggctctaagcggtctcgaacaggggtgacagagttgttaagtacagctacaaacattcctgtgcaagatgcttacatgtctgattttggttccatggaagtgaacaattcagccattacaggagtaggaaatgagccaattgggtcttactgggactgggatgatgatgatagaggcatggaaatggatattcaagcccttctatcagagtttggtgattttggtgacttctttgaaaatgatgttttaccttttggagagcccccaggaactgcagaatctcaggcactcatgctttctgccccggattgtggagatgtcaacagcagtccaggtggtgtgatagatgttccagatcaaatacttttgcctgttggctttgcttcctttgagagctttaacccccctccttcaacatccatagaagaatgtcttaacaaaagtcaagataacttgaataactccatgtctttgggtccaaccaatcaaaatcaactgttgtatacaagggagtttgatcatataatgaaagctgaagcaatgatgacattcgctcctgaatttggagctgttgatacccctacttgtgagttctccacaacattattcagaagcccatattttccgaaatctcgaaaagcaaagagttcaacttcaagttcaagcaattacttatatggtgcagcaccgcccacttctacttgcactgaaggatcagaggggaagaatggaaagtccgtcaacacaaaaacaggttctggaaaacatgatgctagtactatgagtctccactcaaaatattactacacttttgtggaaagtaggaaagaaaaaaatgataaaaatcctgccacttgcaatgataacagcataactaaatctgaggggatgccaccactctcaaacattggttctaatgctattgtcaagtctgccataaggaagacaactgattgcacacatgaagcagagcagttccttctatctgcaaaaactttgttggcaactgatatcacatgtattatgttgcaagcttccatgtgcaggttacgccatattctcttgtcttcaggtaacctaatgcctgctggtttgagtaggtcaactggggtttcatttttgaatcagcttcctagtgatccaagtatgacaacagacaacatatctggcaagtatgatgttaagaagaaagaaaatataccaattagaattgcaggtgatattgatggaggaatgcttgatgggcaccttaatgcccctgttggtgtttggcgcacattaggagcttccaaagttgtaaaaccttcaaattcacctaacatggaagttgttccttcctttcctcataattctttcaatgaagaaggtatcctttcttatggtcaaaggaaaccacttcaggagcttcttgatgggatagcattacttgtccaacaagctatttcctttgttgatctggccttggatgtggattgtggtgatggtccttatggtttgcttgcaatgcaagaacagtggaggcgtggattttgttgtgggccttccatggtccatgctggctgtgggggaagtcttgcctcttctcattcattggacattgctggcttggagttagtggatccactttctgctgatgggtatggatttaggatttggtctttgattatagaagtaaaatga

SEQ ID NO: 68545 - DNA, 1803 bp, Glycine max
  Peptide Sequence Number=SeqID_160230
atggagggtacagtgtttccgaataatcccatagagtgtttgggtaaagggtttgatctgacaagtgattttcgattgaagtttgcaaagggatatgggaaaaggttggtggtggtcgatgaagtgaacaaaagggacatcacggttcctgttcctggaggagtagctaccattccaaatgtttccgaggatatacgctgtgacaagggcgatcgcctacgcttcaagtctgatgtccttcaattcaaccagatgtctgagttgcttaatcaaaaatcagcaatacaaggaaaaattccttcgggctatttcaacgctctttttgatttgggtggtgattggtttcgtgatgctcatgacataaaatgtcttgcttttgatggttatttcatttccctgtactatttgcacctcactgcttcacacctcatactgcaagaggaaataaagaagtctgttccagctcagtgggacccagcttcattaaccaggttcattcagacatatggcacacacataataataggtatggctgttggaggtcaagatgtaatttgtgtcaaacaaaaacattcttcgaaggttccacctggtgatctaagaagacatttagaggatctaggagatattttgttttcagatttaagaagcccttctcaacaacaaaggaacaccccagaaggcaaacaaaaagttcctgaggtctttaagagtgtgatgcaatcaagtacaacgcagtacaccagtatttcagaaacatcaagcaaagatggcctcactatcatttgttcaaaaagaggaggggatgtgttcaagcaaagtcactccaactggctccagacagtggcttctaatcctgaagcaatcctcttcaagtttgtacctatttcctcacttctcacaggaattcctggaagtggctatcttagtcatgcaatcaatttgtatttacgctataagccccctccggatgatttacaatgcttcttggagtttcaaattccaaggcaatgggcacccatgttttatgaccttcctctgaggcatcaaaggaaaaagtgttcttccccttccctgcaatttggtttcatgtttcccaagcttcatgtcagctgtgcacaggtagtaagtgaacaaaaacctgtggtaggcctacggttgtacttggaaggcagaaaaagtgatagacttgcaatacatgtacaccacctttcaagcctcccaaacactatgatctactcttcaggcacatcttcgtggcgaggatctgatgacaatgaatccagtgacatctttctggaacctataaggtggaagggatttgcaaacgtgtgcactgcagtggtcaaacatgatcctacctggttgcaagaaacaagtggtggtgtttatattgtaaccggtgcacaactcattagtaaagggacttggccaaagaatgtgcttcacttgcgcctactctatactcacatacccaattgcagtatcaggaagtcagaatggggtggtgcaccagaggcttcaagaaaatcatctttcctcacaaatctgagcacaacattttcattcacacagcaaagtcctcctcagaagcaggctccgacagtacttgactctggtgtgtatccagatggtccaccagtgccagttcgatctggcaaaatgcttaaatatgtggacacaagcgagtttgtgaggggcccgcatgatgctcctggtcattggttggtaactgctgctaagcttgttactgagggtggtaagattggattacaggtcaagtttgctttgttagactactag

SEQ ID NO: 68546 - DNA, 1662 bp, Glycine max
  Peptide Sequence Number=SeqID_160231
atggagtggaatgcaaaatctctcgggcaatgggactgggagcacttattcttcaatacaaaagcagctgagaatccaaggttacaaccaactgattgtagcagtgaagcagatccagaaatcaatgttggactgttgtatccatcaggtggtagtgcttgttctggctctgaactaatacatgcttcttcatcaaggagctcaaaatcagcttccaacaattcatcatcaaatggggatagcagggaatctatattgactctggaaggttctcaggatgattccactgggaagaaagaattgtgcaatggagagccggttgaaacttctccagcagcagtgccctctcctgtctctggtgaaccattgctcactctaaagcttggtaaacgattgtactttgaggatgtctgcaccggaagtgattccaagaaaccatcttcctttgaggttcccattttatcagggaagaaatataaaacaagtagtcagactgtacagcatccaagctgccaggtggaaggctgtggccttgacctctcatctgctaaagattaccatcgcaaacacagagtttgtgaagctcattccaaatcccctaaggtggttatagctgatgggaggcaaataatgagcccatttgcattttcaaggactgctacaaatttagcttggcaagatatgcacagcagcaagcacccccaaacaaaagaattcctcccgaagcctgccaaagccttcaataagataccgagtatagtctctatgctttctgatgattccagtggccttctaacatctagaggcatagcaacgaagagtattgttccaggtatggaagttccaaatggtacacaagatgttaaccgtgctctctctcttctgtcaacgaattcatcatggtgtccatatgagaccaagtccctttctctggaacactccactcggacaacacactcaatcactcagcatcgtttaccacttccttcctcggagtattggcacactgatcaacaaaattcaagcatgtgtatctcattctcggattgcgatagcagcaatcgctttcaagactttcagctcttgagctcaccctatgaatcagatgcgatgaaattgtttacaccagatcttttttctctctcctacgagcttctccctcctttggtcatcggcgacgaggaccaccgcgacgtctctggcggcgaacgccaccgcatctccattggcaccgacatcatccatgaccccatcacgctcttcctcaacaaaccaacctccggcctcgacttcaccagcaccttcatggttagtcatcggcgtcatcattgccggtggggcaaggatatcggggaggagtgcattgaagtagaagtcttcaggctgctggaggaagcggagctgccaagtggacagcgcggcgaggacggagcgcaggcagctgccgaagctaccgcgatggtggtaggagaattcctcatggatctcggcctaaaaaatgataaagtttccgccaaagtttgtgacgaaggcgttgccacagtgttcgacagcgacgtcattggcgacatcaatctcttcggaggggagggaggagaggaagaggcggcggcgggggcagaggtcataggcaacggcggcagcaaaggtcgtaggaagtga

SEQ ID NO: 68547 - DNA, 957 bp, Glycine max
  Peptide Sequence Number=SeqID_160232
atggcggcggctgcgaactctgagggcaatgctcagaaaccgagttcggaaacgtttcagttattctcttcctccgcttccgccttcggaatcttcgacgatgctgcgcaacaagttcctcctatacctcctcctccctgcgttgaagtcctcgcttctgaggttccttcatccctcaaacacaacgtggactctgtaaatttagatggagttattttgttaaagttcccgggaaatatgaaggtgctgccattttctgtttattcacccattcccatctcgttcatgactaaatcagttgctgcaactttggtttcctttggtctaggaggacttaagctgtgggaaggttcacttgatctaattaaagcccttcgttcagatataaaaaatgggcttatctcatttgctgggaagcgagtattagaggtaggatgtggtcatggactgcccggaatctttgcatttcttgagggggcagctgctgtacattttcaagacttcaatgctgaggtcctacgttgcctcacaattcctaatttaaaagcaaatctttctggagaatctcaaccatcatcatccaactcgacaatttgtgacgaggcagaagttcgcttttttgctggcgactggagtggaattgataaactgctccctcatgttactacagatgcaaaacataatcaaggtgatggttatgactttattcttatggcagagacagtttactcaatcaacagtctccaaaatctctataatcttatcaagaagtgcttgcaacatcctgatggagtagtgtatatggcagcaaagaagtattattttggagtaggtggtggaactcggcggtttctgtctgtggtagagaaggatggtgtcatgactagtagcctggttgctgaaatcacagatggttcatctaatgttcgtgaagtatggaagcttgcatacaagtag

SEQ ID NO: 68548 - DNA, 1302 bp, Glycine max
  Peptide Sequence Number=SeqID_160233
atggacaggactgagagatcctccacgccgttcaccgacggaaaatcacgcttgctgtggaggacgtgcgtgacggcagctgttgccggattgttcgtcaccaggccgctatcgacgacaacgcacgaggtttttccgttgacagaggagaagtggaagggagtgaagaggccaggggtcactgatgaaaccctaacctcttctgtgagttcggatccttttccgatgtacggaaccgagaatgaccgagatgattcggaacgaacggcgttcagaagagcagagaagaagtacaagctctactacgacaacaatgcttcttccaagaacaaaaggaaaaagctacctaaacccgtggatttaacggaggtccttgacttcagatctattctagaatgctatctccaaaacgatgtgcttcctccgggtgttatcgttcttcacgacaacttcacttctccagttttttctttgcaaaatcgcccaggcttttattttattcctggggcattaagcatagagagacaatgtagtttgatcagggagagtttgactgattttccgcagccaccgaacagaacaaatcacaatgccatgtatggtcctattcaggatgtgtttgttgcggctaaagaagggaaagttttggttgaagacaactctccaattacttcatctgaaactgatactgatatagatcataaagatggtaaggaatggaagtttactactgaaaaggacgcgctgtcaagaaagtgcagatcagcttctgcttctgtgttacttcgaaagttgcgatggagcacccttggcctacaatttgattggtccaagcggaattatgatgtgtctctcccacataacaaaatccctgaagcattgtgcgagcttgccaaacaattggcaaaacctgctttgcctactggtgttgaattcagacctgaagctgcaatagtgaattacttcggcttaggggacacattgggtggccaccttgatgacatggaagcagattggagcaagcctatagttagtctaagtctgggctgcaaagctatatttcttttaggaggaaaatccagagaggatactcccctggcaatgttccttcaaagtggcgatgttgtacttatggctggagatgcaagggaatgctttcatggggtccctcggatcttcacagataaagaaaatgctgaaataggccatcttgagacacagctgacgcgtgaagatgatctttgtttcttacaatacattcaaacttctagaatcaacatcaatatcagacaagttttttga

SEQ ID NO: 68549 - DNA, 1650 bp, Glycine max
  Peptide Sequence Number=SeqID_160234
atgtggattcctgttacaggaactccaggcaagaggcttatttatttcatactttatatatgtcttttgataactcctataatatgggatgaagttggagaagataagtttgaaagggagaaagttctgttagatttggagcaagagtgccttgaggtttacagaagaaaagttgacagagctaatatatctagagctcggctgcatcaggaattggccgaggctgaggccgaatttacccaccttcttttgtcccttggtgaacgatctctacctggccggccagagaaaagggcaggttcactaaaagagcagctagattcaatcactccagcacttcgggaaatgcgcttgaggaaagaagagaggttaaaccagttccgaactgtacaaggtcaaattcaaaaaatttctgcagaaattgcaggtaactcagacaatgaaccctcaaccattgttgtaaatgagaatgatctttcactaaaaagactcgaggaatatcagaatgagttgcatagactttacaatgagaagaatgaaagacttcagcaagtagagaaatacatcgacataatacacagcttgtccacaatattgggaaaggattcttcagcaatcatcatggaagttcatccaagcttaaatgatttgtgtggaataacaaaaaatataagtgacaccatcttagataaactcaatatcacagtggagtctctttttgaagaaaaacaaactcggctagacaagcttcatcatttaggcaaagcactgtcaaatctatggaatcttatggacacatcatacagtgagcgacaatctttttcccatgtaatcaatttgttgtcactctcatctgcagaagtaacagatccgggaagtcttactctagaaatagtccagcagactgaagctgaagtaaagagactggatcaactaaaagcaagcaagatgaaggagctattccagaagaagcaggaggaactggaattgatatgcaagaaatcacatgtggagattccttcaagggaagagatgaacaatataattaacctcataaactcaggggagattgatcattctgatctcctcctgagcatggatgaacagatatcaagagcaaaagaagaggcttctagcaggaaggctatcatggagaaagtggagaagtggatgttagcatgtgatgaggagcactggctagaagaatatagcagggatgagaatcgatactcagtcagtagaggagctcacaaaaacttgagacgtgccgaacgtgcccgtataatggtcagcagaatgccagctttggtagatttgctaataaaaatgactaggagttgggaagaagaaagaaataaagttttcttgtatgatcaggtacctctaatggccatattggaagaatataacatcctaaggcgagaaaaggaggaggatactaaaagacagcagccatgggaaaaaaagagaattcaaagccaagtagttgagcgagataatacttatgcgtcaagacctggcaccagcagtaggcgtcttcctagtagaagcttgaatggagctctagacagttctgtggtcctgaacagaaggctttctatgggaatccaacagcataaattcaggaaatcacggcatgtccttcattaa

SEQ ID NO: 68550 - DNA, 372 bp, Glycine max
  Peptide Sequence Number=SeqID_160235
atgcctccttttggaacttcttcaccaccttcgtgggaatctctagaggagctaccacctctccctccagcctccccaatttctgccgcgaatccatcctcagctgcaatgtcatgctccacctgccagaagaattgggagtgcgagcctaagtcctttgagttgggaaaccacgacgacgccaccgtgcaaataggaagctcgttgagcggcggagcgaacaagtttgacggcaagatgtctgcatttcttgggaggaatggtggcgccgccatcaatttggaggtggttttagtgcctacgtgtttaatgactagacatgatggcgtggcatgtcgtttgtcacgtcattacttaacagatgcggactaa

SEQ ID NO: 68551 - DNA, 2184 bp, Glycine max
  Peptide Sequence Number=SeqID_160236
atggagttttctcaagatgattttgatcggttactgttattcgagcacacgcgaaagagcgctgaagcaaactacgcagagaatcctctagacgctgatgtacgtatcgttcttcatcttcattctatgagttactttgctcataccgcaggacaaaacttatacaacaccattgtcatcgaattggggtttcatctcggtagtgcacataataaaggtttgcgttactggattatgtggattatcgagaatctgaccaagtgggggggagctttgatcgagttgtcatcgttccaagctcctaaggatgccaaggcgatgattgatgatgccctttcaaagctggaggaggctttgctgatcaatccaactaagcatgacactctttggtgcttgggaaatgcaaacacgtcttatgcttttctaatccctgatatcactgaggcaaagggttattttgacaaggcacttgattatttccagaaagctgtggatgaggatcctgagaatgacctctatagaaagtccttgcaagttgccattaaggtaatggaattgctatggccattggttttgggcgatttcaatgtgaaggttcggttttatctgttccttgttctgtttgatgctcagattttggatactgatatcgcaattgatgccggcaacatgcgaaaagcattgcttagtatagagttttggatttggcaaggatctagccttttagttattactaaggtatctgtttcctatgggcagggatcttttaaaaaagctgttcctggatgcaccgtgtcaggtcctaaagttttaagagcaccgaggaaggtctctgaaaatggtcgagctactgaaaagaaagtcaaagatttaataacatcatctgctagaaagaataaatcttttagcactcttgagaataaagctagagagcctatccctcctacagatttgaataatggatatgagtttatggacagtgggaattccaatgcttgtttggaaaatgatgcagttgacggcatttcattagattctatgggttgtaacaatcaagctgttcatctggaatctggaactatattttctcccgggtttcacttgtccaaaaattctggaggagttgacaaagttgattttatcaaaatttttcagaatgaagaccatgagagagtttctccgtgccaagaaatagagtcaccacaggaagatgcagtagatggtcatgttagtcaagactctgacactgcaatggaggtagacataaacaattcatccaactactcaaattcagggagatgtggcaatcagatgcttgctttaagcacaacaaatgtgaatggttgcaattctgattatgatggaaatggtctttccatggaagtttctgccatatatcttgccgtgaaaaactcaaagctggaatgtgttgacgagcacagtcagaatcccatgtcttctgaaatatgcacagaggaggatgaatttgaggattttgatgactttgacccatacttatttataaagaccttgccagacttgtcaacggtggttccaacatttagacgattgttgttacccaagcagacacgtagttgcccttctactactcttgtcctggacttagatgaaactttggtgcattctaccctggaacattgtgaggatgtagacttcacttttcctgttaatttcaatagtgaggagcacattgtctatgtacgctgccgccctcacctcaaagatttccttgagagagtttctggtctttttgagattattatatttactgctagtcaaagcatttatgccgagcaacttctaaatgtgcttgatccaaagcggaagatatttcgccaccgtgtataccgtgagtcctgtgtttatgtggaggggaattacctcaaagatttaacagtgcttggtcgtgatttggcacatgttataataattgacaattccccacaggcatttggattccaagtggataatggaataccaatcgagagttggtttgatgatcgttcagatcaagaattgtttttgttacttccgttcttggagagcttggttggtgttgatgatgtccggccactaattgcaaagaaattcaacctgcgggagaaaattgctgcagctgcgcttcctctaaatacaaatagaagagatttcttatccgaatga

SEQ ID NO: 68552 - DNA, 1578 bp, Glycine max
  Peptide Sequence Number=SeqID_160237
atggggtttctaagttttataagaaggtatagttaccccttcaaggacaaaactcaaaatagagcatacgcacttcagcatatgcaaagcagaggcttctcaagggacggagttcttaatggcaatgatgtggtgcatccagttctgatcattggcccaggacctgtgggtcttgttctcactattcttctcacaaaattaggcattaattgcacagttttggagagaaacaaggcattttcaaaatatccacaagcacacttcatcaacaatcgatccatggagatattccacaaaattgatggccttgttgaagagatccaaaggtctcaaccaccagtagatttatggaggaaatttatatattgtacttccctctctggttcaattcttggatctgtagatcacatacaacctcaagatcttgagcatgttgtcagcccagtctctgttgcacacttctcacagtacaagctaactatgttactactcaagagacttgaaaatctaggcttccaaatatgtgcgcctgaaagcttggaaggaaatgaacagtcttgtgacaaaaaaataatgatgggccatgagtgtgtttccattgaggccagcagtgaatttgtaacagtaactgcatcttctatcattaaagggaagcgtgtagaacagaacattcactgtaacatccttattggtacagatggtgcaggaagtattgtaagaaagcttgtaggaatagaaatgagaggtgagaaggacttgcaaaaacttgtcagtgtccatttctttagcaaagaccttggacagtttttgcttaaggagaatcctggtatgcttttttttatcttcaatactgaagctattgaggtccttgttgctcatgatctcaggcaaggggaatttgtattgcagatacccttttatccacctcagcaaacaattgaggatttcagtccaaaggcatgtgagaaattaatcagcaaacttgttggtcaagagtttggagatgcagatgtaattgatataaagccatgggttatgcatgctgaagttgctgagaactttatatgtagtggtaaccgaatattacttgctggtgatgctgctcatcaatttcctcctgctggtggatttggaatgaatactggcattcaggatgcccataatcttgcctggaaaattgcttctgtgattaagggtattgccccaacttcagtgctaaatacctacgaaatcaaacgtaaaccgattgctttattcaatgcacgattaagtctagaaaactataaagctgccatgtttgttcctgctgcacttggtcttgatccaactgttgcaaacacagtacatcaattttttgttaatgggattggttccatcttaccatccggattgcagaaggtagctttggatggaatttttggtataggtcgtgcacaggtttcagaatttgtcctaaatgaaagtaaccctcttggatcctcaaggttggctaagctaagacatatatttgaagaaggaaaaagccttcaacttcagttccctgctgaggatcttggttttaggtatcattgtgaataa

SEQ ID NO: 68553 - DNA, 3564 bp, Glycine max
  Peptide Sequence Number=SeqID_160238
atgatggtgttggcgaattctggtacggggcttaggaaacaggtttttcccgtagattacgaaacagagatttcgcagcgtctcgtagacgctgctcactacggtgacacagacgctgcgttcgaatgcatcgcgaatcccttggtggacgttaacttcgtcggaacggtgtcgtttaagtccaaaacgacggagatcgtgctgcaggacgagtcgcctcacagagttaactcggcgtacgaggagttcaagaccgagctcactgctctgtttttggctgcgcacacagggaatttgtcactcctccggaagcttctgaatgttggagcaaatgtaaatatgagattgttccggggctatgccacaacagcatcagtgagagaagggcatctaaaaatattggaggtccttatcaatgctggggcgtcacaacttgcatgcgaggaggctttaatggaagcaagttacttggggagggccaggtttgctgaactactcatgcagtccaacatggttcgtcctcaggtagcagttcatgctcttgtctctgcatgttgcagaggcttcgttgaggttattgatgtactcatcaagcatggagtggatgccaatgcaatcgataggattttgcttcaatcttcaaaaccatttcttcacgctagtgttgattgcaatgcattattcgccgctgtggtcagcaggcagattaatgtagttggattactgttgcaggttggcgtaaggcttgatatcaaggtcaaacttggggcctggttgtgggacacggatacaggagaagaatttcgtgtgggtgttgggctagctgagccttatccaatcacatggtgtgctgtggagtattttgaatccactggtgctatattgcacatgcttctctgccagctctcgcctaatagcttgcacactgggaggagtctcttgcaccatgctatcatttgtaacaatgaaaaagctgtaaatatacttctaaagaatggtgctgatgcagaagtggtagtgcaaaccacagaagaaaccaatgaacaccctattcacatggctgcacggctcggatcatgtaacattcttcagtgcctgattaatggtggttgtaacttggactctcaaacaaaatgtggagacacagcattgatgatctgtgcaaggtacaaacatgagaagtgccttggagtcctagtatctgcaggtgctgatttgggtatggtaaattcatctggtcactgtgcaacttcaattgcaaactgtgttcagtggactaaagtcttccagagagcaatcttggatgtaatcagagccgggaaggttgttaaatcaagcaacacctctagattttccgctttgttatttgtaactcgtgcaaatgatatagagggtttgaagaaactcattgaaaataataacatcgatctagatgagcaaaatgcaaatggattttcagctgctatgatagctgctgtagggggcaatgtggaggctttcaagttacttctttatgctggggctgatgtgactaatcttaaaaacaagtatggtttgacagcccttaacctcatagatattagccaaaatggtgaagtgttccacaaggtgatgcttgaatatgcacttaaaaagggaggcaatggttcgattgaggtgaatcctctccaccgtgcagcttgctatggggacataaacattgctcacaacctactaaaagaagggtatgatgtcaatgcttttgatggtcaaggatatacccctttgatgttagcagcaagaggatgccgcggcgagatgtgtgagcttttgatctcttatggagctaaatgtgatattcagaatgagaggcacgagacagcacttttacttgcaagagaaaatggtgcacgaaatgatgcagaacgcgtgatattggatgaggtagctcgaaaactagtcttgcatggtggtcgtgttaaaaaacatacaaagtgtggtaaaggttcacctcatggtaagttactagtgatgattggagctgctggaatcttacgttgggggaaatctagtaagagaaacgtgatttgtaaagaggctgaggttggaccaagtgcgaaatttcgatggaatcgcaggaggaagtttgatgttgatgagccaggaatgttccatgtgaatgtgaggaagctcaccaaattagacatgaaactgaatgacactcttccacaaatcactgtggacccagaaacatacacggttgcagcagatggagagggcatgcctggttgcgggcaaatgcaaaatgcgttgcttcactattccactttcttccataccacaagtcaaaacagcttgatggtgttccactttcccctgaaaattgataattttcacacgatgccgttttttgggtccttagatttcataaagaaagtcatggccatacaaacagagcaacctcttcccactcacactcccttcctcacttcaaacacaaaccaagaccaccaacacctaccacaagaaaataatgacaatgatgaagaaacacaaacaccccttgatgatgtccttgcacgtttagaagcacttctcacgctacttggcttcaaccagtcttcattgttgagcttcaccgtgtcttggacaacttttgcggcggttggtgtggtggtgccactcctggcccttcaggtgtatgacacggacaagaatcagataaaaagttttgaaattggcattgttgcatttcagacttgcctagcttccgtgtccttgatttgcctctctcacaatcttcgcaagtatggcctcaccaggttcctcttcgttgaccgccacgctgctcacatgccatgctttcaccatgattacgttaaacagatttcgacagcccgagaaatcactcgcctttccttggtagaacacgggtctctatggctctctattgctgttttattggctctgattgtatcatggacttatgtcagtgcaatctctttatcggcctgtgttctatttcacttggtctgcagtttgcaactcattcactttgatgattacgggaaactcttgcaaagggaaaatgatgtgttggtttttatggaggagcacattcggttgcgattccatctgtccaagataagccatagattcagaatttacttgcttctacagttcttggttgtcacagctagccaatttgtgactctattacaggtcactggatttggtggagcactgactttcataagtggtggagattttgctgtttccacacttgttcaagtggttggaattattattgttctgcatgcagcaacaaagatttcacatagagctcaaggcattgtttcacttgcaagcagatggcatgcgctagtaacatgcacttctgattcatctaaactgagatattgtgctagtacagggagcttggaggttgcaaaacatttaaactcaatgtttttggattactcagaaagtgatctagagtcatcagattacattggtgtgccttcacatacccagttagcttcttatatgtcctcgcataacaagagacaagcctttggtacgtaa

SEQ ID NO: 68554 - DNA, 1821 bp, Glycine max
  Peptide Sequence Number=SeqID_160239
atggctgaatcatcggcgtgtcttgttcgatccttctccactcccgcagaggctacttgttgcgacgatagcaatcacgcatgggtttcgatgtcgctgggtaaccctattcgtgcgcttggagaatctatctcttttgggaggtttatgacagaaggcctggattgggagaaatggtcaacattttcacacaatcgctatgtagaagaagctgagaaatattccaagccgggttctgttgccgcgaagaaagcctactttgaggctcattacaagagagcagctgcagagagagcagctgcattgatcccagaagcaaatgctcaggctaatggaacttttgaggcacaagttcacgaaggaaactgtgctgattcatcctttgggacgagttcaaatgtggcaaatgttgtggccgccaatgaacagctggataatgaaactgctaattaccaagttgttgaatgtgctgatactgaccaacataaatgtgatgccggacaaagtcatttggacatttccaatgtgaaaggagcagaggatgtgccacatcctcgcactgatacagatcttaacgtggaaagttgcacatttgttgctaattcttattctaaccagcttcatcatgttgaggacaatacatatattgctgtccctgcagaagagaagacacctgatcatggtgctgttggtcaggaagttttaactttgtctgtcaagggaagagaagcaaactcttctccgaaattatcaaccaaaactgtggttgccaaacattctcgttctcctgatgaaaggaaggctgctgtgctacccagaagcggaataaacagtggtccaaaaggtaagaagtctgttggagactcagttgagaagaagagactaattgcacagtcagtccgcatgtcaatcaatcttccatctggtaccggtgaaacacgcaaaagaactgcaactgcttcacagtccagaaatggcacaaacaatttttcaacaagtaagaagtctgttagagggttggttgagaagaaaagaataactgcaccatcacttcgcatgtcaatcaatctcccatctggtgccggtatgacaagcaaaacagatactgtagctgctaaacccagaaatggaataaactttgctgcaaaaagtatgaaatctgttggaaactcagtggagaagagaccaactaaaaggtcactccacatgtcaatcaatctgccttctggtgcaggtgaaacaagtaaaacagcttcagtgttggaacagaacggaattaaaaaaaatcattctaacatttccaaaaataatccaggggtgttgcggacatccactaaggccccaccaaaagcaacccccaatcagctaccatatctacaccttttagattcagaagtgaagaaagagcagttaaacgcaaagaggcaattcttgcagaggatggatgaaactaaatccaaggaagaagagaaagttaagttgcaacggactctcaagggtaaaacagagcatgatcacaagaagctgcggcagcgcagtggctctatatccaaactaaacgaagacaagcctggtggatcacaatctccaagcaatcagactagaaagatctcacttacactgccccagtcaccaaaacttgggaggaaagcgagttctagttctagcacagttcaggacagaagcttaggaaattcatggaagcctcctatcagcacctccaaacgtactgcagaaaaaaactaccgaacagcatggcgaccagtaacttcatcatcaaataccacaagagaaaatgcttcaccaaatattcagcaatga

SEQ ID NO: 68555 - DNA, 687 bp, Glycine max
  Peptide Sequence Number=SeqID_160240
atggcaatgattccttaccacctttgccgtttaccttaccaggattccctcaaagcacttgaggctgatatacagcacgccaatgctttggctgctgcaattcccagagccaagggctttctccataggtatctcgacctcttccacatacttatttacaaggtacataatgatggtagatcaatcatgcctactcatggaaggaaggctaccattggggacttttatgctgttatattaccatctctccaacggcttcatggtagtttggagaagttggaggttgttaaagaagaaggccagtcaagcatagaaggtccaagttatggcaagaaggtcattgaagaaggtgtgaaactaacggccaatgttgatttgcaaagagaagatgaatgtgggatttgcttagagccttgcaccaaaatggttttacctggttgctgccatgccatgtgtattaaatgctaccgcaagtggaacagaaagtcagagtcttgtcctttttgccgtggtagcttgaggagagttaattcggaggatctatgggtattaacttgtaatgatgatgttgttgatgctgaaacagtttctaaagaggacttgttgcgtttttatctctatgtcagcaagctgcctaaagatcacccagatgcacttttcctaatgtattatgaatacctcatttaa

SEQ ID NO: 68556 - DNA, 3864 bp, Glycine max
  Peptide Sequence Number=SeqID_160241
atggcgactcccaaccctaacgtcgttttcatagacaccaacctcgatacccacttggccctcgtcgtttccgaccttgacactgtctccgacctcaaaaagagtattctgtcggaacatcccttatgctttccgaaaattgggcaagttcagattcatggtataaaggttgagcgcaaggggtacttttaccaccttacagattccatgcccgtgagaagtgccttcaggggcatcaatgggagctggtttctcagtgttgatgtttctgtgttgagggagtgttctcagaatgagcaattattttctcacggttcccctaaccaggtggccactcttggcattgcaaataatgctttgattgtgggttctccatccaagagggtgtccacctttgaccatttcaagttgcctcagttggagaacagacaaaatgaagaaattcatgttgctagtccatgtgtttcaaaacataccggcaaaggagttaaatcgtctgctgacaatgacatggaaaccccattacctggttctgttcatgagacagaggaccattgctttgtaaatcgtgaactgccaagtttaaatattgagtgcgaagtagatggatctggtaaaggcattaaggatgatcataatgtatgtgaagagactcctgtgtcaagtgcaaagaaaaaacgaaagaataaaaggaaaaaagaagacacagcgcaagatgatactgctgtagacaatgctcttagttttccatccaaaagggcatccggtgcaaataatgaacttccaggttcacgtattgaacacgaggtagatggaaccattgaaggcattaaggatgcttgtattgtacatgaggagggaaattgtaaatctgtatcaaatgtgaagaaaaaactgaaaggtaaaaggaaaaaattaggcacgttgcagcatgacacttcaaaagtaaatgatgcttctgttgttggatctggtgattatacaattcagcaggatattgaggtcatagcaaacccttcagaggatgcagataaagaagtaactaaggaaactgaaattttaaaggagcatcagcacactgattgcaacaataataacactaagaatgacattgatgttgctgcatctgcaaataagaagcataggaaaaggaagaggtctttggctgttgattctaaagaaatgttcaaggtagagacagcaattcagcaggatgaagtgcataagtctaatgaagcacataaggaaaagaaagaatcaaaagagcagtttgaacttaaaaatgaaaaatctagggatgatgttgaatataagcaagatcaggtaactgaagacattttaaatactggacctcctgcaaagaaaaagaggaatggcaaagagaaaagtgtagaagtaattttgtccaaggcaaagttgattaatcatttcaatggagacaatgcttctcaccacattttggaggatcaacagaagattaaaaacagcaatgctgaccaatcagctaaacattttgatgacacagatccaccaagaactagtgtgcagggtaggaggaagaaagggaagataaattcatcaaatcctcatgaaacacctgtagttacttcttccaggaaaggtgaagaagcagattgttccagcattcaaagaggtgttcaggaggaaatatctgaagatgccctatcatctaaagataatagtatgagcaaagctactattgacaacatggagactggaacagatgcatgcaaagaaggctttcaatatacagaaagagcaacaggatattataagaaccattctgacattgaaacaaatgcacacatagctgatgtggatgagcctatggagctgacagagaatagtgagaatgttgtccttgatcaatgtcataaaaatgaagctggtcagattgagggagctgaggaaggaagagaattatcaccacaaaatgattctaagttagccctgttggaaaagtccacatcatccagccaggataaaacagatgcaaacatcagagaattaaatgtgacttcaaaaggtgtggatgccaatggaatgactgaacctataaagtcagagaaggaaaaaagaaggatgagaaaagctaagagttcaggtggagggtctgcacttagagaaggtattggccttgtggatgcttctgagagtgaaactgttattatgaaatctcttagtgcaaaaaattgtgatcctatgtcaggaaatacagagacagaggataaccctttaaatcaaacagaaggggaaaaaattcatcaggagaaagtacaagggacttctgataaggaagatgattttggtgttgataatgctggttccttggaacaaattacaactaaatctaatgaacgcatggacaagagacagagaaagaaatcaaacgacaaacagacttctacctcaaagatcatatcaagtatgctaacaaaagataaagttcttgatagtaagaagccatcaccatcttctgacagtggaacgcatggcaaaccttcagttgcagtgacaaagaaaagtaaatctacaagcacaaagtccactaacaaatcaagcaaaacaaatttggaactggtggaagagtctgttagacttgaactttctgattctcgatttaatactgggggtaaagatgctgcccaacaatcaacacgctctggagagaaagatgatgataacttggaagcaataaatggacaagctcatgctgaggatttaagctcctcacagcaattattatcaaaggaagagcttgatgtaaggagtcacccttgtaagaaggttccaaatgtacacagggctggacaagattcaaaattgtctggtaggtctgacagggccatgtccttatttggagaaaacagaaaggctcatgtcaatgcttctgggaaaagtatggatttggagaaacgaagaaaacatgttcctgtatcaaactcaaagccggaaggttccataaaaatggttcaaaataaagcaggaaaagcttctgggaacaacattcatggagttgcaagtaaaatacaacagaagaagagcttgttatcaggagcaattttcaaggatgatagtagcggcacctctgtagatgaagttgataattctgatgccagtactagaactccatcatataatccactgttgtctgatttttctgatggggatagcagttcaggtctggattcacaagtagatgatctggaaatattctttatgatcatatttatcaaggttgaaaatgttgtaattcctaaagtagagatgaaaagcttgcttgttcccttggctaattttgagactattttatgttttcaaggtgagtacgacttaagccttatagggactacattgatcatatctctagccgatgagggatctcaacacactccctctcacccaggattggatatctggagcgtggacaaatcatcagcaatcacagcaatctcactagccgatgcatctgagccaaaaagcatgcccgatgcgcccagcccgagcccaagcccaatgatgacccccttgctgctacgcatgcggttcagttggttcagcgctggctgcagaatgttgaacagcacccacactatggcgggaatcaatggcaacagcagtgccagcccacggttatcgccttctgctatttcagcaatttgcgacgcagccaaggctgcgtcacagtttgcgagtgggagcttgggattgttcgacttgggtgatgaccctgttattgggttcaaacacttggagtttatcatagccattgttgctgctatggttgctgccattgcggaacatgaacgtgcagagtgcagagtgccgaggcagagacaatag

SEQ ID NO: 68557 - DNA, 2113 bp, Glycine max
  Peptide Sequence Number=SeqID_160242
atgtccaataggtatcaggatgattggctcaagacatcagcaaactctttgcagcactgggagaaggctcctctagagccctatgctctacagaaacctattacgtatcatgttgtatgtcccgacattgatccccttacttctgctgctgctgatttttttcaacaactaggaacagtgtatgagacatgcaagctaggtactcattcacctcaaggcttggggaatcagatagagatagagtctgcaaagttgtcatcttgtggttttgttttacttgattgcccccaatcaatgaagattgagagcagcaatgcatctcttgttggttcagtaatctatgtggtgtgcccatttcctgatcccactgcaattttgcaaactgtaattgagtcttctgttgccattggatcggttgtccaacagtcggatagagagaggagatctagcttgcatagtcaggttgtgaaggcattaagtggcttggccactgtcgatgaagcttcagcgtctaatatccttgtgctttctgggtttagtattccaaaattggtcttgcagatagttacagtggatgccattttcagagtcacaagcccatctgttagtgagcttgtcattttaaaagagacttcctttactgtatacagcaaggctcgtcgcatttcacgtggaatctctagtgattttgctcaatctgcattttctagtagatctcattctggtttgacacaaatgccttctcccatctctgggatgtggaaagactgtgttggtcctcgaatggcaggacattctcttccaagagagggtgacattgatgctagcttgaggcctggtacttgggataattcttggcaaccaacaaggactggggggttaagctgtgatccaagtagaactggggataattttcttcatgatgaaattcgttacatgtttgaacccctttttattctcgcagaaccaggttctcttgaaaatggtatttcagttattggtagtcccacttcagaatcttccaaggcattggcagatgacagtagtggtaactatgtacagagtacaagtacagcaggaagtgtggagtctgcttcaagcactgatgcatctgggtccgatccaaagactcctccaagcctacattgttgctatggatggactgaggactggcgttggctcgtgtgcatctggacagactcaaggggagaattgctggactgcaatattttcccctttggtggaataagcagcaggcaggatacaaagggtctgcagtgcctatttgttcaaattcttcaacaaggttgtctgatacttcaatcttgtgatcctggccttgcaaagcctcgagattttgtgatagcacgcattggaggtttttatgagctcgagtaccttgacatggctgatgacattgactatgacatacggtgtaatttgctggttgttgaaaaacacttatacagtcctaaagataatgatcgatacaaacagtggcagaaagccatttattcagttggtgtatctgagatgaagagatggcctctgcaattgcggaaatctatgtctgatgggatgtctgcaactagtaatggttcttctttgcaacaatcagatatgagtttgatcccagaaagaactcttccttcctcaccgagtcctttgtacagccctcataccaaatcccctggttttatgaaaggcagtttagggcaacctactgcaagaaagcaacttatcggtggacattctatggttgacaattctaggggtttgcttcattgggcgcaaagcattagttttgttgcagtttccatggaccatactttacaactagttctcccagcagattcatcaactcctggtcctcttccactttccccagcttgccattttactcaattctgtgaaggttttggtgcagctgtgaaccatagcagaaggaatctactgattttccaaggaaaatcttttgattcctctaaagtcatggatgatgctctctttctagcttggtcatggttaaaggctaaagagaaagatttcaacattagttttaaccaatgggcagcacattggtgcactgtaatttctatctatggtaccactg

SEQ ID NO: 68558 - DNA, 615 bp, Glycine max
  Peptide Sequence Number=SeqID_160243
atgaacatattgagccagaggaaggtcctattaatgaaattgggccaaagccttgaaatagatgcattgcctctaaattgcagtgcaaagaaagtggttaaggctattcctacggactctactgaaaatggtattgaagatatggatgttgatgatgctaaaggtgtggataaaggtggttcagatgctaaaattgaagttgttggagttgaaactgtacctgatgtacaagatgttgaaactgaagttgctggagttaacaaaacttggtgtataagatgcaaaaaactgaagttggagttgaaacccaacttaataatggtgcagatgatgatgaagttaaagaacatgatgaggatgctgacttttctgatcattctaaaagtgacccagaatatgtatatgtctctccaaaagatgatggataatcaagtgacacaagtaatgatagttaccactctgaagaatttcagtctcttcccaacagtgatgatgaatgggacaccaattttaaaatcgtgtatcctcaatacaatcctagaagttgttttggacaagtgcatttggaggttgggatggagtttgatactattaaaatgtttcttgaagctgtaa

SEQ ID NO: 68559 - DNA, 1227 bp, Glycine max
  Peptide Sequence Number=SeqID_160244
atggcctgctcaaatacttttggacttgttactggtgcatttcttcttggctttggtttaagtgaaattcctaaaagcatttggagaaatgctgactggactatccgccagaaagttcttacgcacaaaattgcccaaatggctgtcaaactggatgatgctcaccaagaactttcaaatgctattgttgtagctcaagcaacatccaagcaaatgtccaaacgtgattctttgagaccttatatgaatgtcattgatgatatgctaactcaaatgtttagggaagatccttccttcaaaccacaaggtggccgattaggggaaaatgatatggattatgatacagatgagaagtcaatggcaacactaaggcgtcatcttcggggagctcgtgaggagtattatagatataaaagtgaatatatgacttatgtattggaggcacttgaattggaagatacaataaagaattatgaacgccgcaactcaactggatgggaatataattcaagcattagacctgctcggactggcaagttggggtccttatgtgatactttaggtaataatgagaattataggaaacaagttgagaaaggcttggctgttatacttggtatcatgtctgtagcaattcttttagctgaggcaactcttctgcctagcattgatctatcgcttttttccattcttataaaatcggttggaacacaggaggtccttgtgcagcggtcttggcttgagcaaggatgcaaagtaggggagcaagttgttccacttgcaagaaatttcaataacattgatattgaatccagcaacaattttatggagaggaatggtgctgaaatgaagccaacttccaatttaattactgatgaaataaatggccgtctgtccaaaacttcgaaggaagacacaagcagaagcagggaagccatcaccaagaagtatgctgtcgttagagagcagggtcggccagcatctaagttgaagtcagaagagaaaaacgcagcctcggctgattccttgtccgacgaagggaatactaattctagcaattcatctggaggatcatcttcaggtttgacttcgacgtggcaatcgatgaagactggctttcagagtttcaagggaaagatagtgtgctatacggaaactcctatacgtttgcaaatcaatctcacacaaaatcttgatgtaccagtggacggtgtcaccgacgtttaa

SEQ ID NO: 68560 - DNA, 957 bp, Glycine max
  Peptide Sequence Number=SeqID_160245
atgataagttcccagaagaagaaaacaggtgtcattgctcccaaacgatttgtacaaaggttgaaaaaacagaacgaactcttccgtagctatatgcaccaggatgcccatgaattcttgaactttttgttaaatgaacttgttgacattctggagaaagaggcccaggctgcaaaaaatgatcaagagacttcaccaccttctgaaaaggctgcaaatggacctaagaatagtctagccaatggtgctaaaaaggagcctttagttacttgggtgcacaaaaattttcaggtgaccttgacctaccaatttaaggtctttattttagcatgctgtgttaaagttaagaatttggacgcaaagtacaagggaatactcaccaacgagaccaggtgcttgcgatgtgaaactgtaacagctagggatgaaacattttttgacttaagccttgatattgaacaaaatagttcaattacaagttgcttgaaaaacttcagttcaacggagacattgaatgctgaagacaaatttttttgtgacaagtgctgcagtttgcaagaagctcagaagcgaatgaagataaagaaaccacctcatgtgttggtcatccaccttaagcggtttaaatacattgaacaactgggtcgctacaagaagctgtcttaccgggttgtcttccctcttgagctgaaattgagtgatactgctgaagatgcagatattgagtattctctatttgcagtagttgtccatgttgggagtgggcccaaccacgggcattatgtaagccttgtgaaaagccataaccactggttattttttgacgacgaaaatgttgagatgattgatgagtctgctgttcagacattctttgggtcttcgcaagaatattccagcaatacagaccatggttacattttattctatgagagcattggctctggtaacaggaactag

SEQ ID NO: 68561 - DNA, 1619 bp, Glycine max
  Peptide Sequence Number=SeqID_160246
ccgccatgtgcggaatcctcgcagtgttgggttgcgtcgacaactctcagaccaagcgcgctcgcatcatcgaattgtctcgcaggttgcggcatagaggtcctgattggagtggcatacattgctatgaggattgttaccttgctcatcaacgccttgctattgttgaccctacttcgggggatcaacctttgtacaacgaagacaaaactgttattgtcacttatgaagaacatggagaagaatttgttaatatgctggatgggatgtttgcctttattcttcttgatactagggataaaagttttattgctgctcgtgatgctattggcattacccctctatacttgggctggggtcatgatggatcaacatggtttgcatctgaaatgaaagctctgagtgatgattgtgagagattcatatcttttcctccagggcatatctattccagcaaacagggaggattaagaaggtggtacaatccaccatggttttcagaggatattccatcaactccctatgatccaacccttttgcgtgagaccttcgagagggctgtagttaagagaatgatgactgatgtaccttttggagttcttttgtctggaggattggactcatcacttgttgctgcagtggtcaatcgttatttggctgaatctgaatctgctcgtcaatggggatcacagttacatactttctgcattggtttaaagggctctcctgacttgaaagctgcaaaagaggtagcagattaccttggtactcgtcaccatgaactttatttcacggttcaggaaggtatagatgcacttgaagaagtcatttaccatattgaaacatatgatgtaacgactatcagagcaagtactgcaatgtttcttatgtccagaaaaattaaagccttgggagtgaaaatggtactttctggagaaggttcagatgaaatatttggaggttacctgtattttcacaaggcacctaacaagaaagagtttcatgaagaaacatgtcgaaaaattaaagctcttcatctttatgactgcctgagagccaataaatcaactgcagcatggggtgtagaggcacgtgtaccattcttggataaagaatttatcaacgtagccatgagtatagatccggaatggaaaatgataaggcctgatcttggaaggatagagaagtgggtattacgcaatgcatttgatgacgataagaatccatatttaccaaagcacatattgtacaggcagaaggaacaattcagtgatggggttggttacagctggattgatggcttgaaggatcacgcaaacaaacaagtcacagatgcgacgatgatggctgccaattttatttaccctgaaaacactcctaccacaaaagaaggatacctctacaggacaatttttgagaagttctttccaaagaatgcagcaaaggcaacagtgccaggaggtcctagtgtggcatgcagtactgcaaaagctgtggaatgggatgcagcatggtcaaaaaatcttgatccttctggtcgtgccgcacttggtattcatgatgctgcatatgatgcagtggataccaaaattgacgagcccaaaaatggaaccctttaa

SEQ ID NO: 68562 - DNA, 180 bp, Glycine max
  Peptide Sequence Number=SeqID_160247
atggcttggaagcactctagtgatggtaactttacttgtttgactatcatctctcctgatagagatgacattgttcttcccattcctgagaatgagaatccaaagggtttatggtttactactaaagaaggtagtcattaccggttgaaattcaccttcaatgtgcagactgagcgttga

SEQ ID NO: 68563 - DNA, 626 bp, Glycine max
  Peptide Sequence Number=SeqID_160248
caaaaacttttggaagaggaactgaaagtggtggtggtggtggtttgtctatttcaggttacatagaaggtttcactccagttaagtctcttggttctacgtcttctgcatatattctaattccttctcctagcatgcggttccttcctacaacagttcttcaactcccaacatgcctcacagcagagtcgccaccactagctcatctgcttcacagcaagggttctgctcttcctctctctactggatttgtggtttcaaaagctgtaccttccatgaggaaggactatagagccaaccaaaaagaagaatggccctctgtactttcagtgagcctcattgattattatggaggtactaacatcccccaagagaagattgtccgaggaattaacaagcaaggtggtagaagtttaagctgggaagctaaagattttgaaattgagacccacttggttctggagtctcttgcagcagagcttcatgccttgtcatggatgacagtgagccccacatacttagagcggcgaacagcacttcctttccactgtgacatggttctaagactaagaagacttcttcactttgctgataaagagctctccaagcagtccgagaaatcttga

SEQ ID NO: 68564 - DNA, 1128 bp, Glycine max
  Peptide Sequence Number=SeqID_160249
atggcaagatttgatcatttctggaatctggatgaattcatcgtgtcgactctgacaactgacagattaaagagaaacatcgtggaggaaacaatggcagcaaggtattggtgtcacatgtgctctcaaatggtcaatcccatcatggatatggaaatcagatgcccgttttgccaaagtggatttgttgaagaaatgggtaacacccccagtagcagcagcattcccaatacatcagaatctgattttgaatctgatcgggctctctccctttgggcgcccatcttgctaggcatgatgggcaatccacgtcatcctagaagactcagacaaatagccaatgataatggtaatcgtgattatgttgatggtgtagcagatcatggtagagaaactgaatatgatcaagagtttgagtccatccttcggaggaggagaaactcagctaccattctacaattgctccaaggtataagaactggactggcatctgaatcatatgagaatactgatggccatgaccatgacagggaaagagaaagagaaagagaaagagagcacatgatcttgatcaatcctttaaatcagactattattgttcaaggttcctatgagtcaaaccgggatcaaagtgataatcatagctccgttgggtccctgggtgattatttcacagggccgggtttcgatatattgttgcaacatttggctgagaatgatcctaataggtatggaactccacctgctcagaaggaggccattgaagcgctgcctaccgtcataatcaatgagaattcgcagtgttctgtgtgtctggatgattttgaagttggttctgaagccaaagagatgccttgtaaacataggtttcatagtgggtgtatccttccctggctggagcttcatagttcttgtccagtttgcaggcttcagttgccattggatgagtctaagcaagactctgatctgtcaagggatagcagaagccaaagggaggatgaaagtattgaacatgacaatgatgaagaaagagatggcgaagggagaaatgcaagtgggggtagaagattctcatttccatggcctttcaatggattattttcttcatcaaactcttcatcctcttaa

SEQ ID NO: 68565 - DNA, 1077 bp, Glycine max
  Peptide Sequence Number=SeqID_160250
atggccatgagtgtgggcgtggcattgccatccaccaccaccagtctcagtttccttcgctaccgctctcgctctccaattcaaaataaaatccgttttccccgtcaaattgtttctaaattaaacagtgcagaggtccaggttcaaacctgtcttcaggccttgtattgtagcgtgtgggattggaggggttactctattcgctatcaacattctggaaatattggccctgcactagttttagtccacggttttggagctaacagtgaccactggaggaataatatttcagttcttgcacaatcccaccgggtgtactccatcgatcttattggatatggatattcagataaaccaaatcctcgtcaaatcggagaccattccttttacacttttgagacctgggccactcaactaaatgagttttgtcttgatgtcatcaaggacgaagcattctttatatgcaattctattggaggagttgttggtcttcaagcggctgtgttagcaccacacatttgccagggtattatccttctcaatatatctctgcgtatgcttcatataaagaagcagccttggtatggaaaacctttcatcagatcgctccagagattgcttagggatactgatgttggcaaattcttctttaaaactatagccacaaaagaatctgtgaggaacattctttgccagtgctatcatgacacctccaaggttacagatgagctagtgcagatcatccttggtccaggtctggaacctggagcagcagaggtctttctcgagtttatttgttactctggtggccctcttcctgaggaactactacctcaagtaaagtgcccgattttgatagcatggggtgacaaggatccttgggaaccaattgatattggaagaaattatgaaaatttcgattctgttgaagacttcattgtccttcccaatgttggacattgcccccagggaagtttctttactacctgcttaaccagtttcatgtctggctctcattatctcctggaaggccttgccaaatgcaattacatttgtcctggaacttcaaagctctaa

SEQ ID NO: 68566 - DNA, 117 bp, Glycine max
  Peptide Sequence Number=SeqID_160251
atgggacttctagatatgcaagaatggagttgtcctttacggcctttttgggccaacatttcaccagcctgctctggcccatttgccacaatggattggccgagttctaggagatag

SEQ ID NO: 68567 - DNA, 474 bp, Glycine max
  Peptide Sequence Number=SeqID_160252
atgggggttggagattactggtctgatttaatgggaagtgggaatggcaaccaccaacacaacaacaagaacaagaacaagaagcaattacagaccgtggagctgaaggtgatgatggattgtgacggctgtgtgctcaaggttaggaaaactctctcttcattagatggagtagaatcggtggagataaacaggaagcagcagaaagtaacagtaactggttatgtggaaccaaacaaggtcttaaagaaggccaagtcaacagggaaaaaggctgagatttggccttacgtgcctttcaacatggtggctaatccatatactgttcaagcttatgacaagaaggctcctccgggatatgtgaggagagtggacaactctgctgccaccataggaacagtgacaacagcatatgcagattcatacaccaccatgttcagtgatgaaaacccaaatgcatgttctatcatgtag

SEQ ID NO: 68568 - DNA, 309 bp, Glycine max
  Peptide Sequence Number=SeqID_160253
atggacttcaccacttttgcaaattccatatcctcttctcatgcaattcctccaatacacacttatcgccttcaaccctctccttttcctctccacctcccattttcgaatttaaagcgttcaggtttggttaagaatcggcttattgctcgttgcacttctatgtccgatgaatttggttctgttaatgggttgcaattctcgcccaataagctttttgtggaggagaggaagcttaaccaccttatgggaaagtggcttaatgaaccatccttaatgaaactaattgttgaggctctatttttgtag

SEQ ID NO: 68569 - DNA, 1548 bp, Glycine max
  Peptide Sequence Number=SeqID_160254
atggtttcggttgatgatgggattgtgaatcccaatgatgaaattgagaaatctaacgggagtaaagtgaatgagtttgcatctatggatatttcagcaactcaaaaatcatatctgaacagtgaagatcctcagagaaggcttcagggaaccttaataagttcttctgttactaataggataaactttcttaaatttggttctgcatctgccaaattcaaaaggcttgctactgagagagaccaggtttctatatctgtgccttctcctcgttcaaagagcctaagatcacgtttcagtggcatgtttgctcagaaacttgactgggcttcagtcaagaaaatgtgcatggaatggattagaaatccagtgaacatggccctttttgtgtggatcatttgtgtcgcggtttcgggtgctattctgttccttgtcatgacaggcatgttgaatggtgtgctaccaagaaagtctaagagaaatgcatgccttaggaaggtatattgcaagaatgtcacttacaagccccatgagtggacacatatgatggtagttgtcattctccttcatgttaactgttttgctcaatatgcactttgtggtctaaacttagggtataaaaggtccgagagacctgccattggagttggaatatgcatatcttttgcaattgctggtttgtacaccattcttagcccacttgggaaggactatgattgtgagatggatgaagaagcacaggttcaaattacagcttctcaagggaaagagcagctgagagagaaaccaactgagaagaaatattcatttgcatccaaagatcaacaaagggttgttgaaaatagaccaaagtggagtggaggaatacttgacatttggaacgatatttccttagcatatctctcacttttctgcaccttttgtgtgcttgggtggaatatgaagaggcttggctttggaaacatgtatgttcacattgccatttttatgctgttctgtatggctcctttctggatttttcttttggcttccgttaacatagatgatgacaatgttaggcaggctctagcagctgttggaatcattctttgttttcttggtttattgtatggtggattttggaggatccaaatgagaaagaggttcaatttaccagcctatgacttctgttttggcaaaccttcagcttctgattgcacactttggctaccctgttgctggtgctctctcgctcaagaagcgcgtaccaggaataactatgatcttgtagaagataaattctcaaggaaagaaactgatactagtgatcaaccatcaatttcacctttggctcgtgaagatgtagtgtcaaccagatctggcacaagttctcctatgggtagcactagcaactcttccccttatatgatgaaaacatctagttctccaaattcaagcaatgtcttaaagggatattacagtccagataagatgctatcaactttgaatgaagacaattgtgaaagaggtcaagatggaacaatgaaccccttatatgcacaaaaataa

SEQ ID NO: 68570 - DNA, 600 bp, Glycine max
  Peptide Sequence Number=SeqID_160255
atgactaattttgtcaggctatggaatcattctgttgagaacgagaaaaatgaaatagatgagctaaccatcgaggaagaagctgagagaaaagttggatggctattgaagacgatattttttgtcactgcaggggtagcaggataccatttctttccttatatgggagagaatttgatgcaacagtctgtttcgcttttgcgtgtcaaggatcccttgttcaaaaggatgggagcttctagattggctcgttttgcagtagatgatgaaagaaggaagaagatagttgagatgggtggagctcaagaactcttaaatatgttaagcactgctaaagacgaccgtacacggaaagaagcattgcatgctcttgatgcactgtcacaatcagtgctagctagtactagccttttctgttctctttcgattgagataagctacttcaatgttatagatgaagctcttgcatccttgcatcatgctggggccatttcagtaattaggtctgcaccaaattcacttgaggatgcagaagttgagggattcaagttgagcttgatgaaaagatttcaagatctcagatatgatgtgccatcatga

SEQ ID NO: 68571 - DNA, 765 bp, Glycine max
  Peptide Sequence Number=SeqID_160256
atggctccaacaaaaacagcactaccttcatcagatttccaaaccttgactccactgcttccgacaacctttcagacgttttcaacctttcagacgttctttcttcaccctctttctagacaagcatcacatatgattatgaaactcttagggtctaacttggaagagctgtggatgcgttcattgaaccttgcgctgtattgtcacctcatggtcatggatgttgagaattcaaaaagcagtccagctagcgagaggcttcaattctccctcagatatcaccatgtggaaggcgttcttcaattcaatcacaaagtcttaatcaaagacgagtgggctgaaatcatggtggacattgacaacgtaaggtgtgatgttatcgaattggtgaatgagttccttatgaaacaacgaggggctggtgcagctgaaaaacattttccttccagaatatcattgcaacttacacccacaatccaagaccaagtgttgagcctatcagttggcaaatcctcagagaacccacgaaaagaaattggtgttgacaaaagcgtagaagcttcatttgaggcatcgaatcccttggcacttaaggtgtcagctggagagagtcctcaaccgttagtttatggatacagtgcaaatttgaattggtttcttcatgacagcgttgatggcaaagaagttttatcatcaaagccttcgaagtttgcaatgcttaacccaaagtcatggttcaaaaatcgatactccagtgcttactga

SEQ ID NO: 68572 - DNA, 369 bp, Glycine max
  Peptide Sequence Number=SeqID_160257
atgtatactagggtggggaaagaaatttttgtgtttgatagccaaagaaatataggggaaaacttaggttatttagttaatccttggactaggttcagcgatcttatccgacatcctactgatcatcgtttaccgttgtcagaggcgattttgacgtcaatgtttacacaaacatcacaagtagcaggaaacccatttccccaccacaaatcaaaaaagatttgtgccccttctcttcgaagaggtcagggacgttggggaccatggcaggagctcgacgacgaaggagacgacaacggtcttaaggtcgacaagctaaccacacatcgccctcattgtcgtctcaagcatcgttctcctatgcggtga

SEQ ID NO: 68573 - DNA, 231 bp, Glycine max
  Peptide Sequence Number=SeqID_160258
atgtataaaagtgtggaagctatccgaatggggtcacttcatggtagcaagaacaacttggacgaattgctatccgcaaaagcggtagcagagagcttattgcatgctcttacgtggataaagaatcaaaattttcagaatattgatatcgagatgaacgctaaagttatagaagacagattatacaataatttcactggtagctcttatttacaagttttaatcaattag

SEQ ID NO: 68574 - DNA, 348 bp, Glycine max
  Peptide Sequence Number=SeqID_160259
atggccagccataactacaaagtcttcagctgcttcaacaggaagttcaccgtcaccgagccgggcccaccgccggacgtccaaaaagcgttttctgaatttgccgacggagcctcctccctgtccggcgatcacctcctccgatttctggcgaagcaccagggcgaagtggactgcaccgcagtggattcggagcggatcctccagcaatcgcggaaagaggatcgggaaagtggactggatctccacgacttcttccgtttcctgctacatgacgatttcaatagccccatcaaatctcaggtgggcgaagccagtttatcttgcttgagttgttttgagtcctag

SEQ ID NO: 68575 - DNA, 465 bp, Glycine max
  Peptide Sequence Number=SeqID_160260
atgcaagaacatgggactcacgcggaagggcttgtttctgctacttcagttgtccaggcttatgtgctaagcgcagcaagacatggtctggttggtgtggcagctccaacaactgtgacaagcaatgcaggactaaggaaggtgcaactcatggagcctgtcacgtgctctcgctctccagcattcgcaccgagagctccgtgccaggctccagctctgaattggcatcacaagtttgaatttgtcattgcgctctacattccgagaatgaattttttcgtgtatggttatgtgaaacatggtagtcaaaattgcgagttgaatgcgtttctatctcagattgaaaaaatgatcaacaacttttggtggtggtgtagtagcaaaaaggagaggaagattcgctggcttaactgggagaaaatgttcaagctaaaatctgtaggaggtatacgatttggaacatga

SEQ ID NO: 68576 - DNA, 1659 bp, Glycine max
  Peptide Sequence Number=SeqID_160261
atgtcgcgctgctttccttttccaccaccaggatatgaaaagaaggctacagcacaggacgtggatgtactgacaaaggggaaggggtcaaaacataatctgttattagaattgaataaacaacttgtcattgtcatcaacttattagtccttcagatgggaaaagaaaagcacagagaaaaaaagcataaaaaagagaagagggacaaagagaagaaggaaagtaaggaaaagagagacaaagaaggaagggatggaaagcataaggaaaagagggacaaaaaagaaaaacacagagaaaaaaagaaagataaggacaaggacagagataaagataagagcaaaaccagtgctgcaattgagaaagactttccaggacaagctcagggtcccaatgcaggtaaattacatcaaaaggaaatcaaaccaaatgataagaaggctattttacttgaggataaactcaccaaacagtttgccagtaacaatggagagaaggttagagagaataatcatttggctgaggaaaacaaggattctaaattcctcctggagttggacaagaggattagggataatgatggaggagctgagaatcaattggctcaaaagtttacaactgcaggacacagaaagaatgatggggctgttagattggttactaagggtagtgacacctggcctgatggtaaggaaaggcttcaggataagggcattgatactagaaaggttgataggagaggaatctggggtgagtcccgaccagttggaaatgcaacagttcagaataatgctggaaaatttcatcccagggttgatgaaatgcccaaatctttggaaaataatatttacaaacctttggaagcaacagttgaaggaaaagagaggagggttaaggggaaaaaagatgataaacatggagataaaaagaaaaataaagagaaggggaaaaaaggacatgggaaggacaaagacaggagtaaagagaagaaaaaggaggagaaagcaaaggagaatgttgaacatgaaaacagagagcagcagaataaattaaaagaaagcagcaaagctggtacaataggttcaaattctttcacacaggtttccaggcacagctgtgagaaatctgctgttggggaaaatctcaagaaacggaaggacattgaatcaaatggaattatgcatgcaaatgacagttggcccagtaagttgccaaagccctctccatctctctctcatctcactgaaaatgggaggatattggaaccctgccaaatttcccttcagaatacatctgataggctagcagcagcctctaatatcaaggttgataacaaagaacgcaagataaatggcatcatcgaagctctaccatccacagtttcctcaaaaactcccactcccattgctaccatgccagctccagtcagtgaagcatctgcaaaaccacctcatccagatagcaaatacataagtcaggtatattccgtgcccaaagtagatgagtggtctgattttgatgaccaagagtggttgtttggcagcagccattggcaaggaagaacacctgcagtgaaatcttcagaggttgaggatacactacaggtggcacatgatacttcaaaaatacctgatctgctcaaggaaccctctatttga

SEQ ID NO: 68577 - DNA, 2193 bp, Glycine max
  Peptide Sequence Number=SeqID_160262
atggatttggttgaattggaggcggtggaagggctccgatgggcgtggaattcgtgggcggcggatgggacaaatatgataatcccactgagcataatgtgcacacccttgatgttgttgaacagtgaggtccctcttctcccttacgaccctctcctctgctcccgatgcggcgccgttttgaacccctacgcacgcctcgactaccagtcccgcatctggcactgccccttctgctccctacgcaaccccttcccccgccccatcgccgacaccaacctccccgccgaactcttccccacctacagcaccgtcgagtactcgtctccctctccctctccccctccccctccccctgccttcgtctttctcctcgatctctccactccccaagacgaacttcctcccctcaagaaccagctcctccacctcctccaccacttgcccgaccactccctcgtctctctcatcaccttcgactccatggtctatctccaccatctctcttcttcccacttttcctctctcctcgtctttcacggcaaccgccatctctcctccaatcagatccgccacttccttaacccccaccgccaccaggcttttcttttgcctatttccgaatgccaattctccatcactactgccattgaagagatccattctacatccaactccaccatctccgcctctcgccctcccaggtgcaccggctctgcaatctccgtcgcccttggtcttttggagtcttgccccatcaatacaggctccaggatcttggtcttcacctctggacctgctactctgggacccggaatcgttgtcgattctgatcgccgccaacccatcagaacccaccatcacatcttcaacgcccaagcaacacactatgctaagtcttccgctttctataatcaactctccaagaggctatccggtgcatctgttgttctcgatctctttgcctgttcccttgatcaagttggggcagccgagctccgaggacccgttgagcactccggtggattcatcgttctctctgagtcttttgattccgatcagttcaagaattgtctgaggcagatgttcagatgtgatgaccagggccacttgagaatgaattttgatgcgactattgaaatagtcaccaccaaagacgtgaaaatctgtggagcgcttggtccttgtgtgtcccttgagagaaacaactgtttggtgagcgaggctgaggttggagaaggtggcacctctgtctggaagttaaacacgctcacccacaaaacttgcattgcgtttttcttccaagtgaatcaggagcagaaaatgaaaattcaaccgggctctgcatttttaatccagtttataacgcgatacaggcagggaaacatgatccggaaaagagtgacgactgctgcaaggcgatgggttgcaagccattcggcagatattggtgccgggtttgatcaagaagccgcagctgcagtcatggcaagacttgccattctccgggcagaaacatgccatgcccgtgatgtcattagatggctggatgacacgcttatacgtttcacttccaagtttggggactatgtccctgaagatccatcctctttccgcctatcctccaacttctccctttatccccagtttatgtaccacctgaggcgatctcaattcattgatgtctctaacactactccggatgaaactgcattcttccgcctcgtgctcaatcgcgagggagtagtaggatcccttataatgattcaacccacacttttccaatattcgtttgatggcccaccggtgccagtgctgctagatattcgttccatttctccagattttatcttgctctttgattctttcttctgtgtggtgattcattatgggtccaagattgcccagtggaggaagctgggttatgataaggaccccaatcacgaaagcttgagaaagctgttggaagccccagaactggatgcagagcaattggttgctgaccgccttccagtgccaaggattataagatgtgaccagcatagtagtcaggctagatttcttcttgccaagttgaatccatctgttactcaaaattcaacctacacagagggttccgacattatatttaccgatgacctcagcttggaagtttttctggatcagttgcaggtgctggcagtgcaaagctaa

SEQ ID NO: 68578 - DNA, 2961 bp, Glycine max
  Peptide Sequence Number=SeqID_160263
atgttcctttcaattacaccagtggatgaggcgacgcacaggtacactgtatgccttgctgcgccaccccatattgtgtcagatgggttatggggtagtgctgcagcaaataggaaaccaatgaaatcttttctcccattgtttgagttacagatgttggctggcctcattcttcaagcttgttttgcgttggatccatttgcctcatacatgaggctcttgtttccgtatggaactcacgacaccattaccacaatatcatctattggttttgttctcttcatttttataaacggtgtacaaatggattttggtttgataacaaggatgggtaagagggcatggaccattgccatatccggattgctagtacccatattttgtgccatttccatactaagcttatttccatttggccactctggaaactacgatgatttggttgttgcattggtctcccacaccgtaatttcatttgcggtcatttcttcctttcttaatgaacttcaaatccaaaactccgaacttgggaaattggcattatcttcagcattgatcagtgacgtattgtgcacaatcgttacctccaccggcactgctgttatggttactgaggattctaatgtcaaagaggttacaagaaacatcttgtctttgatatgcatgggtatcttaatcccattagtgtgtcgcccagcaatgttatggatcatcaaacataccccggaagggagagctgtgaaggatggttacgtttatgttatcatcgtactgctcttcattttaggttggctttccgttaaaataaatcaagaattcgtgcttggagctttcattttgggattgtctgttccagaaggacctccactaggatctgcattggttaagaagcttaatttctttggtaccaccttccttttgccaatcttcgtctctatcagtgtgttgaaagcagatttttccgccactcattcatccacatcagttatgactatgactttcgtcgtcatcttcactcatttggttaaaatcatagcatgccttgtaccttccctctattgcaacatgccgtggcgtgatgctctctctcttgccctcattttgaacaccaaaggcgttgtggaaattggcctcttctgcttcttatacgacaccaaggtaattgatgggctaggattcggagtaatgattttgagcataatggtggtagcatgcattgtgcaatggtctgtcaagtttttgtatgacccttcaagaaaattcgctggataccagaaaaggaacatgatgaatttaaaaccgtggtctgagctgaggatgctggtgtgcattcataaaccaagtcacatatcgtcaatgatagatgtgcttgacctgtgttgtccaacaacagaaagtccaatcattgtggaagtattgcatctaatagagctagttggacgcgccctacccatttttattccccatcgccttcgaaggcaagcatcaggattgcaacacaagtcatactctgatgatgtcattcttacttttgacatttatgagcatgacaacccacatgctgtatctgcatacccttgcacagcaatagctccacccaacctcatgcatgaagatgtttgcaaccttgcctttgacaaagttgcttccatcataattcttccatttcatcaaagatggtctagtgatggggaagttcaatttgatgacaagaacataaggacactaaataatagggtcctagaaatatctccatgctcggttggaatacttgtgactcgtgcctctcaccaaattagaggttcaaccactcgattagcactaatttatttgggcggacatgatgatgaagaggcattgtgcatagctaggagagcaattaggaacccagaggtgaaccttgttgtttaccaccttgtttttaaagaagatgatgagtggggacaagaagtggatgatgagctagaagatgtgaagcatgcacatgaacataatataaggtatcaacaaatcatagcaaaagaaggggcccagacagctgcttttcttagtgacatagtgaaagagcatgacttctttctagttgggaggcgccatgggattgagtcccctcaaactgatggacttacagactggagcgaattcccagaattaggtgtcattggtgattttcttgcttcaccagatttggagagtcgtgcatcaattttggtcgtgcaacaacaactctcatcaaaggcacattctggctgggtatactttttcgttcttatgttgcagcaattcgaacttgataataagattgatgaaatgaagttggttctaaagtctctacagaatcttcagtttacagtcaaatggtttgaagttgtagagcagattgagtatgcattcatggagctaaaagtgcttgcattcggtgagaattgcattaggttgtcgttgcagacttatatgccaacatttgtgggcatttcctacctaccgagagttgaagctaccgttgatacagctgaactgaatcatgagttattaattgaagtttttgagggaactatgaggtcaaagaatgttcaggtttttccaaatgatatatatgtgaacgacattgttgatactgcaaagtttgtcagcaagtcttcattgcagtggtttatacagaaagtgcaagatagaattatactaagcacacttaggcatcttgtagtaaaggatgctaataaatcaagatattcgcttgaatacttggacaaagataagactattgtggttcatatggctggaggaatcgatgcgtacataaaattgtcacttggttggcctatatttgtttctccattgaaactgatatgtataaagggatcagatgatttgaagagaacttctctaagttttcgttgcaaagttgaggcattctcagtgtggcatcagggttttaagctcaaaaatgttcatacttaa

SEQ ID NO: 68579 - DNA, 1488 bp, Glycine max
  Peptide Sequence Number=SeqID_160264
atgtacaaggaacctggttttcctatggttagtcacatccttgctgatctcaagctcctctacccaggacttggcaaagtggccttagcaacagccatgatcagtgacttctataattgggtcatgtttgcattgttggttccatttgccattaacggtggaagcatcatctactctgtgctgagcaccttagcttttgtgcttttctgcttcattgttgggacacaccctgtggttggggctctggtgtatggaatgatgatacctcgtgttttgctcctctcattcatcccaaagattttaagcactgttatagcgagtcagttttatggcatgtctgttcttgatggtgtctctattggactgcttatgaacaccaagggcatcttaccaatattaatgctcaacaatgcctgggacaagcagattttgagtgtggagtccttctcaattttgaccgtagctgttgttatgatgaccatgacggtgcctctaatcatcaatgccatatacaagctaagaaagttatacaaacaaagcaaactgaagaccatacagaatttgaaggccgaaatagagctgagaatactagcttgtgtccacaaccctcggcaagccacaggaatgatcaacatcctcgatgcatgccacactacaaaactctcccctctgcgcgtgtttgcacttcagcttgttgaactaagtggaaacaccacttcccttttcaaccaacagcgaagtggtggtgcacaagccctcaccaaagcacaagaagacttggagagcatcaccaacattttccaaacatacacaggtgcaaatgagaacactagtgtggagacttttgctgctgcgtcaacttactcaaacattcacgaggacatatacaacgtgtcgcaggagaagcaagcaagcttgatgagggatgcaccatgttctgttggaatcattgtcgaccgtggactagggtcattgttcaaggtgaacctgcgtgtgctcgtgcttttcatcggtggccctgatgaccgcgaagccttggcggttgcgtggaggatgtcaaagcatcaaggggtgcaactatcagtgatgaggatccttattgagaagcaaaagaaattggatgaagagtatgtgagtgcctttaggctcaaggcagtgagcaatgaggactctataaagtattcagagaaagaagttcgttgtcgtgatgatattcctcaagacaaggaacaggtaggaactaggaactctttgatcttgtcagagttgatacaatgggctcattgccctgaacttggtgttataggggacatggtggcatcaaataattttggttcaagctcttcagtgcttgttggacagaaatatgggtatgggggagtggtgtttgataacagtaatgctgccacacagcagcaacctagggaagtaatgcctgcagatgatgataatgatgattctggggcacttgctgtcaagatagaatag

SEQ ID NO: 68580 - DNA, 1725 bp, Glycine max
  Peptide Sequence Number=SeqID_160265
atgtgggcacatagccttactgtggatgactaccaagatcttcttgatcgtggctggagaaggtctggatgttttctttataaaccagagatggaaaggacatgctgcccttcttatacaattcgcttgaaagcaagtgactttgttccttctaaggagcaacttcgtgtatctagacgaatgcaaaggtttttagatggaaccttggatgtaaaaaaagttgatgttatggaggacccaaccaaatcgggaatcttcactagacctatgtcagaagaatccttagctgctggcagtgaaaacaaggatgaagttgaaaaatctttgcattatttatcaaaccaaattgataatgttatacacatcctcattgagaagggggaatttccctctggtattcaattaccaaatgcttcagtaaaaagagtttcacagggaaaaagaaagttactagtcaatggatcagaagatctcttatatagtagcaatatagcctttcaaattgcagcatctataaaacgagcacaatcatgtgacaaggttgtcgatgattccaaaccagcaagagtctgtgaaaaggagaatgattcatctcctaaaattattgcagaaaagctagtagcttctttagatccaactgtgaaaaattctgatttgtctatcagggcttgcaatggacatatcaatttttatgcttctagtaagcaagtgtccctgaacagaagtgttcaaaatgctccagttcctaaaatttctagaatgaagcatgacagtggaggaaattgtttgattggtcaggtaaaaaggcaaaagcttgagatccgtttaaacagatccagttttgatccagaagaatttgctttgtacagaagatatcagctcaaagtacataatgataaaccacaaaatgtcacagagaactcatatcgtaggtttttggttgatactccattaatacaagtttctcccactggtgatagcacagttcctccttgtggttttggctctttccatcaacaatatctaatagacggccagttagtggcagttggtgttatagatatccttcctaaatgtttgtcaagtaaatatttgttctgggatccagactttgcctttctatcactaggcaagtactcggcttttcaagaaataggttgggtgaaagaaaaccaggtttattgtcctagtctacaatactattatcttggctactatattcactcttgcagcaagatgagatacaaagctgcatatcgtccttcagagcttttatgccctcttcgctatcagtgggttccatttgacattgcaaggcctctgcttgacagaaaaccttatgttgtcttatcagattcttccattttacaaaatggagagtcatccctacctcaaactacggaagatgtaatgagaaggggttttgatgatgttggccaagaagatgcaaatgatgttccaatgcttgatgatgaagaaatggttgagtctgaatcagaatgctctgatgatgaacctgacctagaaaccacttcagatgatgatccagaaattgctgatgtcagcaaggttttgctagggataaagggatctcatgtgaaatacaaggatctgcgggttgtctttggtcctgagcagcagagttacttggagtcacaattgcggagatacaggaaggttgtgggtccattgctatccgagcgaatcgtctattcgctcggataa

SEQ ID NO: 68581 - DNA, 951 bp, Glycine max
  Peptide Sequence Number=SeqID_160266
atggcaaggaaactgacgaaagcgcagaagaagatagcatacgatgcgaagctgtgcaagcttctggacaactacacccaaattctggtggtggctgcggacaacgtcggatcgaaccagcttcagaacattcgacacggtctgcgtggcgactcggtcattctgatgggaaagaacaccatgatgaagcgaactattaagatccatgcccagaacaccggcaacaccaccatcctcaaccttattccccttcttgtcggtaacgtggggctgattttcaccaaaggtgacgtcaaggaggttaaggaagtggtttccaagtacaaggtggcagctcctgctcgtgtaggtttagttgcacctattgatgttgttgttcccccaggcaacacagggctggatccctctcagacctctttctttcaggtgcttaacatccctaccaagattaataagggtactgtggaaattatcacccctgtggaactcattatgaagggagacaaggttggctcttctgaagctgctttgctttccaagcttgcgataaggcccttctcatatgggcttgctgtcgtttctgtttatgagaatggttcagtttttagccctgaggttcttgatctcactgaagatgacctcgttgtgaagtttgctgagggtgtctgtatggtgtcttcactttccttggctatctcctacccatccattgcagctgctccacacatgtttgtcaattcctacaagaacatcctggctgttgcagtggcaaccgaatattcgttccctgaggcagacaaggttaaggagtacttgaaggatcccactgttgttgccgcacctgctactaagtctggcgctgctccagctgcagcatccaaggtggaggataagaaggaagaagccgcagatgaatccgatgatgacatgggcttcagtttgtttgattaa

SEQ ID NO: 68582 - DNA, 492 bp, Glycine max
  Peptide Sequence Number=SeqID_160267
atgcctcagttggtgtcctggcaccccccaaggcaggattttgtggcattgaatacaaatggaaatgtatcaagggaagaatgcaaagctggaactggaggcttaattcgtgagggaagtagcaattggctccttggtttttcaggaagagtatatcataatgcatctcccatatttttgtgggagggagatgcatttgatggtggttgcggtgacggtatggcagctatgtactctaagaatgagatgaatttgaaagaagttcttgatgggtatgataaagctgttgaggcattgggaaatgtttcaaatattaaagacgtgtatgttgaagatcaagaactggagatggaattaggattttgggaagtgagcatggatgaagccccttacctcaaagacataaacatgtggttatacggaggcttcacacaactcaaaccactacaaaacatgttcaaattagttgaccatagacgagagatgcagtaa

SEQ ID NO: 68583 - DNA, 1350 bp, Glycine max
  Peptide Sequence Number=SeqID_160268
atgggttcttcttcccctccggacactagcaagagcataaagctagagcgatacaacagctacatccggagactcaacagcaccaagctcctcaacgcctcctccaaactcctcttccgcgccactctcttggtcgcactcatcctcgtcttcctcttcaccttcaactaccctcccctctccgccaccgactccacccaccgccacctccacgcccactcccactacttcctctcctcctcctccttcggcgcctgggagaagcaggtccgccactccgcctccccccgccgccccaacggcctcaccgtccttgtcactggggctgcgggcttcgtgggcagccactgctccctggccctgaagaagcgcggcgacggtgtcctggggcttgacaacttcaacaactactacgacccttcccttaaacgcgcccggcaggcaatgctctggaaacaccaagtgttcatcgtggaaggtgacctcaacgacacccccttgctccagaagctcttcgacctcgtccccttcacccacatcctccacctggccgcacaggccggcgtccgctacgccatgcagaacccccaatcctacgtcaccgccaacatcgctggcttcgtcaaccttctcgaggctgccaaatccgccaacccccaacccgccattgtctgggcttcgtccagctccgtctacggcctcaacacccaaaaccctttctccgagctccaccgcaccgaccagcccgccagcctctacgccgccaccaagaaggccggcgaggaaatcgcccacacctacaaccacatttacggcctctccctcaccggactccgtttcttcaccgtctacggcccctggggaagacccgacatggcttacttcttcttcaccaaagacatcctccatgggaagaccatcgacgtctaccagacgccggaggggaagcaggtggcgcgtgactttacctacatcgacgacatcgtcaagggttgcctcggcgccctcgactccgcccagaagagcaccgggagcggcggcaagaagcggggccctgcccagctcagagtgtacaatctagggaacacgtcaccggtgccggtggggaccttggtgtccattctagaaggtttgctgaaaaccaaggccaagaagcacgtcattaagatgccatctaacggcgacgttcccttcactcacgccaacgtcagcttggccttcagggatttcgcctacaaacccaccaccgatctctccaccggtctcagcaagttcgtcaagtggtacctcggttattacggcctccagccaagcctgaaaaaggataatcaccttcacaatattgaatga

SEQ ID NO: 68584 - DNA, 777 bp, Glycine max
  Peptide Sequence Number=SeqID_160269
atggccatgctcaatatcatcgccattgtctccctcttactcttaatgattccatcccaagccaaaattcccggcgtctattccggtgggccatggcaaagcgctcacgccactttctacggtggcagcgacgcctcaggaactatgggaggggcgtgtgggtacgggaacctatattcccaaggctacggcgtgaacactgcggcactaagcactgctctattcaacaatggtttcagctgtggagcgtgcttcgaaatcaaatgcaccgatgacccgaaatggtgtcatccaggtaacccttccatctttgtcaccgccacaaacttctgccctccaaactacgctctccccagcgacaatggcggttggtgcaatcctcccagacctcacttcgacctcgccatgcccatgttcctcaaaatcgctcagtaccgcgccggcatcgtccccgtctcatatcgccgggtgccttgcaggaaagagggagggatgaggttcacgatcaacgggttccgttacttcaacttggttttgatcaccaacgtcgcgggtgcaggggatatcatgagggccagcgtgaaagggtccaaaacggagtggatgagcatgagccgcaactgggggcagaactggcaatcaaacgcagttctggttggtcagtcactctccttcagggtcacaggcggtgaccgacgcacatccacctcatggaacattgtcccacgtaattggcaatttggccaaaccttcgctggaaagaattttagaatctag

SEQ ID NO: 68585 - DNA, 123 bp, Glycine max
  Peptide Sequence Number=SeqID_160270
atggagggacacaacacaaacgatgaagggaagtcagagggttgtggtggtggttgtaaaatgggtgacagtgaagatggtggtggttgtagagggggtgcgacaatgagggtggagggttaa

SEQ ID NO: 68586 - DNA, 93 bp, Glycine max
  Peptide Sequence Number=SeqID_160271
atgtgtgaaaggcaagaattagtgtgggataaggagttagtgcatgacaggcaggagttaacgttggacactatgtgtgacgataagagctag

SEQ ID NO: 68587 - DNA, 1461 bp, Glycine max
  Peptide Sequence Number=SeqID_160272
atggaagaaagccctcgtggtcgcagaaagcgagcacacccttcttctccttctcctccttcgccaatctccaagaagccccaaaccttcccttcgttccaagacatccccaatctcccttctaacatcaaatccctctgccacctcatcgccaccacctccgccgccaccgtcgagcactccctccaatccgccgccatctccgtcatccctcacgacgtcgaagaagtcctcaaactctcctacggcttcccgggccaatccgtcaaattcttccgctggagcggccgccacctcaacgacaaccacacgccctattcctggaacctcgttgtcgatatcctcggcagaaaccgcttcttcgaccccatgtgggacgccgttaagtcaatgaacaaagaagggttactctcgctcgccacattcgcctccgtcttcagcagctatgttgccgctgacagaatccgtgaagcaattatggcgtttgagattatggacaattacggttgtgtgagggatgcttttgctttgaattcgcttttgagtgcaatttgtagcaatggtaggactcttgatgcttgtgattacttgcaggttgctaagaaattcgtccgaccggatacggatacttacgcgattttaatggaggggtgggaaggggagaagagtatggttagtgctaaggagacatttgctgagatggtgattgagattggatgggatcctgcgaatgtgccggcttatgattcgttcttgtgtacacttgttagagggcatgatggattgcttgaggctattaagtttgttgattccatgagggataggaggtgttaccccggtgtgaggtttctgaaggctgcattggatgagtgtgttaagtgccatgatgttaggacagctgagtttttctgggaggtgttggtggttgggaaggtgttgcagcccacctctgagatgtacaatttgatgatcggtttgtgttgctatcgcggtgacaccgatgctgcaaggaggatgctccatgagatggtttaccaaggggcttttcctgatgtggtgacttataacttgttgtttaagttcttgctcaaggggaggaaactgagggaggcttcgtcggtgtttgcggagatggtgcagaatgagtgtgtgccggagcaggataactgtgatttggcagttaaggcgtatgtggattgcggggagcctgttatggcgatcaaggtttggaagtgtttggtggagaattataagaagggtttggagcagaccgcgaattttctggttgtggggctttgcaatttgaacaggccacaggtggcggttaagtatgccgaggatatgattggcaggggaatcagtttgtcctcttccacattgtcgaagctgagacaaagccttgtcaaggagagaagagaatatgtgtatgaggatcttttgagaaagtggaaatctcactag

SEQ ID NO: 68588 - DNA, 303 bp, Glycine max
  Peptide Sequence Number=SeqID_160273
atggatgggactgctaaagactctccaggtgttgcgggttgtggtggtatttttaggaaccattgtgtttggattatgggttgttttgccttatctgttagcatcaagcacaccttatatgctgagctttttgctgctatcgaggcaattgaaatagcccatgaaaaagggttgagtcacatttattgtaaggacaacacttgtgcagatagattagtctctcacaggcttttgttgttcgggcaagtggttgtaggggtgggttccaacttagttgggatcacagcaacctccttgtcctag

SEQ ID NO: 68589 - DNA, 687 bp, Glycine max
  Peptide Sequence Number=SeqID_160274
atgggaggtttaatgctctatagtctgaagaaagtattggaatggaagcacaacgcaaaaggtgagcaatatcatcctgtagttgctatgtgggcctcacttgcttttgtgctttctcatactgtcctgactcctgatgttctgctttgttttctctttgacaaggaaaataacaatctcttcttaatggaaataagtattgcaaggtctcatctcgaaacacagggaatattcttttcaaatgtttcaagaacgataggatgggaaagcaccaagaaacttccatgtaatgtggcttcccagagttcaagatgggactttcacagattggcctcttcccatcaagcttttactgcagtgtatcctagaaggccttttatctgtagagcaaattctatgccaattagtttacaggaatctgcatcatatggagataattctattgaggatgaggatccatctacagacttggaagaggaaactttggcaaaaccacctaccagtgaacagataatggcactgcttgctgacacacagggagcaaaactcactaagaagcttagtgaagccaaccggcaaaatcggttcctaaaaagacagatggatcattgggaagaagatgtatgggatgtcaataatacatgggatggatttagtcaattcaatctggatgtaccatcttcttaa

SEQ ID NO: 68590 - DNA, 192 bp, Glycine max
  Peptide Sequence Number=SeqID_160275
atgtcgatcccacatggttggagcattttcgcaaaacagcacgaccctgactggtcttcatatgattttacctatgtcatagaagtcgccgtcgacatccaaaagaagaagaagaacaacaacaacaacaaggcctttgatgcgacaacattcaaggtggagtggttagtcctcgacgcagaggcccaatga

SEQ ID NO: 68591 - DNA, 327 bp, Glycine max
  Peptide Sequence Number=SeqID_160276
atgcctctacctctaccagctcctaacgcacgacctaaacctcgtcctgcggaagaaggttctgcaggatcttccgcgggtccgcgaaagacaacgttcttccactggatcacgcggaagatcctgcagaaccttcttccgttggatcacgcggaagatcctgcagaagcttcttccgcaggaattcgcggaagaaccttccacagttcctacagccatttacgccattcaaacagttacgaggaggttagaagactaaccttgatggcggaggacacaaacaacaacttcaatggaggacacgaggggctcggaggaaggaaatga

SEQ ID NO: 68592 - DNA, 493 bp, Glycine max
  Peptide Sequence Number=SeqID_160277
atggggaaaaagggaaggagaaaggaagggatgaggaaaggaaaaagaaaagaaaggaagagagggtggtgggaaggagtgtgttttgggataaacctggccaaggacccatggtgggtactaggcttcaccgttgtagtaggctttcttcttccccttgcttctgcgcttgtttcttccccgtgcacccaacaatctccattcgtgcttcttcttccccgatattggccttcttcctctgcgccctcatttccttcctccgagccctcgtgtcctccattgaagttgttgtttgtgtcctccgccatcaaggttgaagacgaaggttcttccacgcataggaaaggggcttctgggaactcccgcggaagaactgtggaaggttcttccgcgaattcctgcggaagaagcttctgcaggatcttccgcgtgatccaacggaagaaggttctgcaggtggtagaaccttcgtctttaacctccagcaccacag

SEQ ID NO: 68593 - DNA, 732 bp, Glycine max
  Peptide Sequence Number=SeqID_160278
atgaataatatctttcgtggttccaggtaccgcattgtcactgttgctccgttgttgatcatgctccaactgcaacaactgagaagcgaacttggagattctggtgacgactctgttccaggaaatgtgctagagagagttcttgaagcttccgccgatctccacaagatcgttccggattccgatcagagcttgcgaggaggagaaatcaccggcgggggtggaggaagaagaagaagaagaagaagaagaagaaaaagaagaggaagaggaagacgacggcgacagagcgagggagttggcgacactgcgaaaaatatgcgatatgtcgtccttgacgcaatggcgatcgatggcggcttacggcggcgaagacgagtggataacggtgcggtcgtggagattataagattttgggttggggtggttggacttgaagagctaagacatttttcttttaatttcaaagacttggcggcgtgggcatggagcaaggtggcgaggagcgaggaggtgagggttgagagggagaggagtgtatggaagcttctagggcacgaaggagcaaaaaaagagaataaaaagagcaagtcattgtctatcccaaaaacaattcccacacacatgcatctctttccatgtgatcttaagggacacgtttgggtccgtggtcctaatgttgtccataagaagttgatttgtaggtcttcaagccgaattacattgacataa

SEQ ID NO: 68594 - DNA, 957 bp, Glycine max
  Peptide Sequence Number=SeqID_160279
atgatgttgtggaaacgttgtatagtgccacgtaaacatcgcgggaaccaaaagcacaacaacgcaacatcatcatcagcttcagcaatgtccactgtgagagttcaagtttcggcgtgtgtgttttctgccaccgtcaacaacctttgcctccgccaaaacgccgtcgtttccttcagaaagaagaagcttctcagattggtctcaatgtcttccgttcctccttcccaacccttcgaaatcgccgttaaagcttccgtcaccacacccaacaggctcggcgactgccctttttgccaaagggtgttgctgacactggaggaaaaacatctaccttatgaccccaagttggtggatttgaccaacaagccagaatggttccttaaagtcaatcctgatggtaaagttcctgtcataaagtttgatgagaagtgggttcctgattcagatattattactcaaacattggaagagaagtatcccagccccccattgttgaccccacctgaaaaggccacggcggggtcaaagatcttttcaacatttattggttttctcaagagcaaggatcccaatgatggaacagaacaagcattacttagtgaactgagctctttcagtgattacatcaaggaaaatgtaggggtattgtatgtaggtgaaaaggctttatttaaggggttaggtgctgtttgcaaaaggtttggggttgatttggtgaagtttgaagtgctggtgggttttgggttagagacatgtgatctggaggcttcatttaatctagcaagattagctgcatggggtcctttcatcaacggtagtgagatatctgcagctgacctatcacttggaccaaagctataccatttagagattgctttggggcattataagaaatggacagtgcctgattcacttacctctttgaagtcttatatgaaggtatgttcaagatga

SEQ ID NO: 68595 - DNA, 1320 bp, Glycine max
  Peptide Sequence Number=SeqID_160280
atggccaaacactttcttctgcttctttttgcagtatgcgttgctgctattgatgaagaaccatttataggggtgaatattggaagagacctctcagatatgcctcaccccactcaagtagtagcactacttaaagcacagcaaattcgacatgttaggttgtatgatgctgaccaagctatgctcattgcccttgcaaacacaagaattcaagttgctgtatctgtccctaatcaagagatcctagcaattggtcaatcaaataccacagcagcaaaatgggtttcccataatgtgatagcacattaccctgccactaatataacaactatttgtgttggttctgaggtcttaactaccctcccctatgcagcgaaagtgcttgtcagtgcccttaagttccttcactcagcacttgttgcttccaatcttgatcaccaaatcaaagtctcaacacccctttcctcctccatgatccttgattcattcccaccttcacaagccttcttcaaccgctcgctgaatccggtcttggttccaatgcttgatttcttgcaaaccactgactcttatctcatgctcaacatctacccttactatgactacatgcagtcaaatggtgtgattccattggactatgcactcttcaaaccactccctccaaacaaagaagccattgattctaacacccttctccactactccaatgtgtttgatgctgtgattgatgcagcatactttgccatggcttttcttaattacactaacattcctgtggtggtgacagaaacaggttggccatcaaaaggtgactccaatgaacctgatgcaacagtggaaaatgcaaacacttacaacagcaacttgatcaagcatgtgcttaacataaccggaactccaaaacaccccggaattggtgttagtactttcatctatgagctctacaatgaggatgcaaaggcaggaccattgtcagagaaaaactggggcttatttgatgcaaatggaaaacctgtttatgttttgcacttgacagaatcaggaggagtgttggcaaatgacaccaccaatcaaacttactgtgttgctaaggatggtgctgatcctaagatgctgcaggctggaatagattgggcttgtggacctggcaaggtggattgctctcctttgctgcaaggacaaccatgttatgaaccagacaatgtggttgcacatgcaaattatgcttttgacacttactatcatcagatgggaaagtctactcagtcttgtgatttcaatgacatggctacaatctccaccaccaatccaagtaaatga

SEQ ID NO: 68596 - DNA, 300 bp, Glycine max
  Peptide Sequence Number=SeqID_160281
atggtggcgatgcaactgctccttagagacactagctctaccattggagccaccatatttgccaacggagccaccagatatgatcttctctccaagatttgcacctccatggttgacatcacgaaaccgattcgacaaggacaaagttttgaggcgagaatggaagggatattcgggatgttgggaggcgagaaaggaatggagattcaaaggaagaaagaagacatacgaaggctgagagctagtttcgagcaaaagactaagagactaggctctcaaatggcaatacctaacgaataa

SEQ ID NO: 68597 - DNA, 201 bp, Glycine max
  Peptide Sequence Number=SeqID_160282
atggcttcctcgaatagaaattttccagcatctatgcctgttctcataggcaagaactatgaggattggtgtgctcagatgaaggtggctcgccctgatttgatgaaaagagatgcaaaggcattgttcattattcatcagtgtgtagatgcagataatttccagaagattagatctgctgatactgcaaagaaggcatga

SEQ ID NO: 68598 - DNA, 429 bp, Glycine max
  Peptide Sequence Number=SeqID_160283
atgggtgatgaaggaaagctttatgttcctcaagagctagtatcagtctatcgtgagaaggttgtcccagtagcttcagtgttgactcccaaccagtttgaggcagaactactgacaggcttcaggattcagtctgaaggacatgggcgggaggcctgtaggcttctccatgcagctgggccttcaaagggaacgggagatctcatgactgcacttcttcttggttggagcaataaatacccagacaaccttgagattgctgcagaacttgcagtgtcaagcttgcaggcagttttgcacaggacacttagtgactacaaaagcgctggacatgattctgagtcaaccagtttagagattagattaattcaaagtcaggatgatattcgcaccccacaagtaaaacttaaagctgaaatatacagctaa

SEQ ID NO: 68599 - DNA, 480 bp, Glycine max
  Peptide Sequence Number=SeqID_160284
atggaaattcgaagagagagagagtgtgaaagcaaacctggctggtggttcgttggtggtttgattcgagatctttggtgttgggttcggatccttggaattcccaccgcttcaacctgcactcaccagcttcgtgcggttctcctgctggtgcttccagaccctcgtgtacgccttgaacaccttctggaacgcgtggggctgctgctgatgctggcttgtgctgccgccgtatgctggcacatcgcgcagacggccgaactttcgatccgtgccctccaccagcacgcagaaggccaccgccgtccccaatacgttcccacaaaatgctgtcatccccgtcttggtcagccatacccaataagaactagaacatggcgagtttgttcgtgtaaggacaattcacctcaatgggaagccacgagtcctaacattgaagcaagatttgcattactggccaacgtgggaattgagatttaa

SEQ ID NO: 68600 - DNA, 408 bp, Glycine max
  Peptide Sequence Number=SeqID_160285
atgaaatggcctttctttttgcccttgatccctagccttagaaaaacgatacctaccctcttccattaccttattttggaagtgagcatcgagggatcggcgatgatccaggtggtggtggttccaatcggaacggtgccgtcgaacgtgctgcgagactattactctatgctgcttccgctgcacacgatcccgctctccgcgatcagctccttctacatcgagcaccaaaagtctcccttcaccgtccagccatgggactttggctccctcctctttaagttcgtcctcggtggcgagcagccgagtccatgggaggacttccagtcgcaccgcaaaaccttcgccggtgaaggcgccgacaccagagtgatggaggctacagaggctctgacggttagagcatag

SEQ ID NO: 68601 - DNA, 1437 bp, Glycine max
  Peptide Sequence Number=SeqID_160286
atggcagcatctgggaccaaaggagggtcaagtggttccccagttatagattggcaaggcagggcagtggccctcaatgctgggagcaagtcatcaagtgcatcagcattctttctacctctagaacgagttgtgagggcattaaggtttcttcaaaaggaaagtgaaacttatgttgataaatggaaggcagtttctatacctcgtggtacgcttcagatgacatttctccataaagggtttgatgagactcgtcgacttggccttagaagtgagacagagcagatagtccgtcatgcttctccagctggtgaaactggaatgcttgttgtggactctgtggttccaggtggtccgggttataaacatttggaaccgggtgatgtacttgttcgtgtcaatggagaagtcattactcaattcctgaaactggagactctacttgatgacagtgtaaataagaatattgaattacaaattgaaaggggtggcacatcaaaaagtttaactttgttggtgcaagatttgcactcaataacgcctgattatttcttagaagttagtggggcagtaatacatcctctttcttatcagcaggctagaaacttccgtttccattgtgggcttgtttatgtggccgaaccaggatatatgctcttcagagcaggagttcctcgccatgcaataattaagaaatttgctggtgaagaaatatcatgtcttgacgaactgatatcagttctttctaagctatccaggggtgctcgagtaccattggaatatataagctacatggatcgtcatcgaaggaagatactgtttattacttcttgtcataactttcaaatgaagcggattgactttctgatccgacatgaatcacatgataatgttttcatgttagaagcggtgtctgtgttagtgacggttgatcggcatgaatggtatgcaccacctcagatatacactcgtgatgacagtactggtctttggaatgctaagcctgcttttaagcttgattcccccttcctatcattgggtgctaaagatgttgaaaatctatctagacagtcagtttcactaactggtgagcatgcttgtgggggacatgtgtgtggagataacagtcaggagttggttgatggtgtcactagcatggaaaccaattgtgaagatccctcagagtgtgtatctcaccacaatgcatctgatggtgtggtgaaaaaacgaaaagtggatgaagatttatcagctgatggaaatgttgttgctgatttttccttaaatgactcaagggaaactaagctagaaaaatcaagtattatacaggatgacatgttaatggactatcagggtgcaactgcagctacagcaaatgcatcagttgctgaacgtgtgatcgagcctacacttgtgatgtttgaggtattattgtag

SEQ ID NO: 68602 - DNA, 345 bp, Glycine max
  Peptide Sequence Number=SeqID_160287
atggttcttctaacagcatgtgacttgttttcaccaaatgcaatcctgcagtccgaagaagaaagtttgaaagatcaaagagagaaggaggaattagagcagcatatgcgagaaagagatgcagcagggacacggaagaagttttattggagagaaactaggaataatgcaattagggactccttgatgaccaaagggccctcaagaaacaaggatattcaaactttcagttttaaactagcaacaaatttgtccattctattcacatataagattgttttgtcccccttaactgaccatagctgtagcaccaaagaaagagcatacactaaacctgccccatag

SEQ ID NO: 68603 - DNA, 1761 bp, Glycine max
  Peptide Sequence Number=SeqID_160288
atggaactatttgatgttttgttgattggtcgtagttttacttggattagtccagccaacacgacggcagattatgtctacaaagaaaatttgaagaagctaaagtttgagctgaaaaggtggaattatgatgcttttggtgatcttgaggaggcaaaaaggaggtcagccatgcaaataggcactttggatgatattgatgaggtgagagatatttccacccaacaagcacttgataggagcaaattattagaagagctagctcttgtctccaacgagcaagaatctcttatggtgaatggtataaggggagtaaatgtcaatgatacatgggttgaggaccaattacgtttaaagcaagaagttaagaatttctttgaacaaaggaaaagattaggtgtgcagtatgggagtgaagacatcttgaaggtagtcaatgaatttcatcacaatggtactctaccgaggggtgtgaatgcaacttttgtgtctttgatccctaaaggcaaccctttggcaccattcctcttccttatggtggcagatggtctaggaggtttgatgagaatggctactgataaagacctctttgtcaggcccaaggtggttgtactcaaatgtttcaaaccggcctcaagtctgaaagacaacttctttaagagtaagttggctgaagttgcagtggcttcggatcttcaacaaagattggcagccattctaaatttttgggtgatggttattccattcatctacttggggataccagtggatccatcaagagttcccccacatcaagatgtgaaacttactaatgaaaggaagaaatgctttaaaagatactttgatgatgtggatgtaaggagacaagttaatttggagtttgcaaatttttctaatggaagagaagcctttcataatgttgactctttaagagataaaggtgaattggatgcaaaatcttggtggcttgctcatggtgcttatgcaccaacacttctaaaaattgcccttaagctacttgggaaaccatcttcatattcttgtgatggaaggagaatgtattgggttaattggaagaaagtgtgctcctcaaaggatttgggatgcctaggtatcaaggatttagagacttttaataatgcattattgtataagtggatgtggaggtttttggtagataataattcgacgtgggctaggacaattagagaaagggctaaagtctataaggatattttgttatctccttctacgtcacttggtggaagaatgttagcaagggagattgatggtttctctgtggggaaagcatatagtattatgaaaaatgtagtagatttggaggagaatggtttttataaacaattatgggcagttaaggctccctcaaaggttgttgcacttacctggataattgcccttaatagtgttttgactagggagaatttaagaaggaggggtatttctttagccaataatgatgtcacttgtgtgaggaagatgatccggccaaacccagttagttttgtggaaacccgtcgacctgaccgtcacttctcttcttcacgctcatcttcacgctcgatgccaccgttgcactgcgagggaagttgtcgcgccaaccttgttgccaataacgtggacgaagacgtcaacgatctgggaggggtcgaacttcggcggcattgtgaagcggtaatgatcgaagaggaagaggaaaaggtacaacaggaagagagggttatatatattggagattag

SEQ ID NO: 68604 - DNA, 204 bp, Glycine max
  Peptide Sequence Number=SeqID_160289
atgttgctaagtagcaatgtcatttatatctgtttaagagtggtcatgttggtgcgcatgatccacactcgtctctttccagtggcacgggtgaaagcttgccccggtatgcacaatagctgcgcgatagccttcctctggttgtgcttgcacagttggccctcctttgagatcaaggggtggcccgggaaaaagaatggttga

SEQ ID NO: 68605 - DNA, 333 bp, Glycine max
  Peptide Sequence Number=SeqID_160290
atggcacccacaaagacacccagtggacccggagaagtccaacagggccctaggggatcgcgcctgcaagacacccagtggacccgaagaagtccaacagggtcttggagttgtcaagctctaattacgggtctctatcagttctacggagtgcttgtcacctccggcaagggcatcaggccccttactaatcgagctttcatcaagaagtactgcgcccccaggcaggcacagggcgaaacaccacagcagcctggggatggccagcagcgggcaacagacgcaccgccatcacctctagagttcacctcagctcatccacaaaaaggttag

SEQ ID NO: 68606 - DNA, 572 bp, Glycine max
  misc_feature (557)..(557): n is a, c, g, or t
  Peptide Sequence Number=SeqID_160291
atgccgcggcttcctgctgtacctggaacagcacggcatcctcgacgccgaccagcgcgagctggtgctggaccgggcgatggccctggaccaggacgaactggacctggacgacctgaaatgggtcgtgctgatggtgctgttcaaccagcccggctccgaagcggcctatgcctggatggagacgcaaatgagcgtccccgtgagcgagtggttccatgcagaaggcaaccggcagcaaggcccgctgccggcggaacagttggtcgagttgttccgaaacaaccagatctccctggacaccctggtctggcgcgacggcctgccgcaatggcagccgttgcgcaccgttgtcgacgagctgggcctgatcgtgccggcgctggacgttgctgcgccggcccagccacccgagccggaaccggaaccggtggccccccctccgccgcagccgcctgtgctgccgccgtccacgccctatgccacccaggcggcagccgggtcctgccaccgccgaagaagaagctctccggttgcgccctgaccgcgatcatcgncggcggcctgctgct

SEQ ID NO: 68607 - DNA, 513 bp, Glycine max
  Peptide Sequence Number=SeqID_160292
atggcccttctccccattctcgagttccccgatccgcgcctgcgtaccaaggctgcgttgatcgaagccgccgaagtcaccacgccggccttccaggaactgatcgacaacatgttcctgaccatgtacgacgccccgggcatcggcctggccgccacccaggtggacgtgcacaagcgcttcatggtcatcgacgtcagcgaagaaaagaatgaaccgcatgtgttcatcaacccggaaatcgtcgccaaggacgggggccgggtgtaccaggaaggctgcctgtcggttccgggcatcttcgctgacgtcacccgtgccgacaccatcaccgtgaagtacctggaccgcaacggccaggaacagcagatggaagccggcgaagtgctggccacctgcatccagcatgagatggatcacctggacggcaagctgttcatcgactatctgtcgccgctcaagcgcgagatggtgcgcaagaagctggccaagcagcgcaagcacgtggcgtga

SEQ ID NO: 68608 - DNA, 744 bp, Glycine max
  Peptide Sequence Number=SeqID_160293
caatcgcgcggcaggcctttgccgacctcgcgggcgatgtccaccatcttgcgcttgcgcgcctcgaacccttcgcgctcgaagtcgcgcaggatatagtgcatttcggcgcgctctacgctgcccttgatgctgctgaggtgataaaagccctggtagccttcggtggtctccggcgcttcgtccgccggcagcgcctgatgaatgcgggtggccagcgacagcgcgttgaccatcacgcccttggcgctgccggggtgcacgctgttgccgaggattttgatcgtcaccgaggcggcgttgaagttctcgcactccagctcgccgacgccgccgccgtccacggtataagcccattcggcattgaaggccgccacgtcgaacagctgcgcccccttgcctacctcctcgtccggggtgaaggctacgcggatgtcgccgtgcgggattttgcgcgcacgcaggcgcaccatggcggtgaggatctcggcgatgccggccttgtcgtcggcgcccagcagcgttttgccgtcggtggtgatcagggtctgccccagcatctggtgcaggatcgggaacatcaccggcgacagcacttcatcgccgatgccgagcgcgatgtcgccgccgcgatagttctcgacgatctgcggattgacgtgtttgccgctgaaatccggcgaggtatccaaatgggcgataaaaccgaccgccggcaccggccaggcgacgttgcccggccag

SEQ ID NO: 68609 - DNA, 414 bp, Glycine max
  Peptide Sequence Number=SeqID_160294
atggtcagtgatccgttggactcggggcgttttacgcgtcagcaactggataagaagtacaagcacgcgagtgactttggtgttgcggacaccagaaaaaacagagagactctgactcaatatcgcgatgcgctcgaggcccatttgaatgataaggacacggcattactcgactctaaattaaccgctgatgagtatgagtcacagtatcttaatgtgtggagaaaagaacgcgatgacgggacattaagaaaagatagtaatgatgttgggtattgtgcagcagagcttttcagcttggctgattgctatacatcttctccaaatcgggatggtagcgatttggatgagaatgaactcaagatagaggtaaaaaaaacgcttgagaagtataattttctcaaaaaagagtaa

SEQ ID NO: 68610 - DNA, 1121 bp, Glycine max
  Peptide Sequence Number=SeqID_160295
atggcgaccgccggggtgatcctggcgctgtcgctctcttacggtttggtggctgtcgtcggctatatcgtcagcttcgacaaaaccgccttccgcctgctgcgcggcgagagcaacctgttcttcagcctggcgcagtggaaagacaacaagctcaccatcgccattccccccgatatcgatctcaacttcccgacgctggtatttatctacgacgataaaggcaacctgctgtggagccagcgcaaggtgccggagctggagaagctgatcaacaaggaatggctggaggagtccggcttttacgaaatcgacaccgacacccgcgtcagtagcgaagtgctgggggacaaccccaaagcgcaggatcagctgaagaattacgacgataccgatcagaacgcgctgacccactcggtggcggtcaacacctatgccgccacgcctcgcctgccggcgctgaccatcgtggtggtcgacagcattccgcaggagctgcagcgatccgacgtggtgtgggagtggttcagctacgtgctgttggccaacctgctgctggtggtgccgctgctgtggctggcggcctactggagcctgcggccgatcaaggcgctggtcaatcaggtgggcgagctggagaacggcgagcgcgatcagctggatgagaacccgcccagcgagctgcgcgggctggtgcgtaatctgaacattctggtgcgcaacgaacgccagcgctacaccaagtaccgcactaccctgtcggatttgacccacagcctgaaaacgccgctggcggtgctgcaaagcaccctacgctcgctgcgcggcgagaaaatcagcgtcagcgaagctgagccggtaatgctggagcagattagccgcatctcgcagcaaatcggctactatctccaccgcgccagcatgcgcagcggcaatgcgcttctcagccgggaactgcaccccatcgcccccctgctggatagcctgacctctgctttaaataaggtctaccagcgtaaaggggtcaacatcacgctggatatttcgccggagataagctttgtcggcgagcagaacgactttatggaagtgatgggcaacgttctcgataacgcttgcaa

SEQ ID NO: 68611 - DNA, 477 bp, Glycine max
  Peptide Sequence Number=SeqID_160296
atggtagccataaccctagccaaggttcgtcaacctccatttctccgagaatacgactcgaacgcaacgtgtgcttgtcacggagaagccccggggcgttccattgagcattgtagggctctgaagcgtaaggtgcaaggtttaattgatgcgggctggctgaaatttgaggagaatcgcgtgattttcaactttcaccggaagtgggtgcaagccattggtctgtttgctcaagcgacttgtgctcctgagtttggacttctaagaccgttcaatcagagattattcgtcttgcgtgttggtggggctgccggacaacccttcccttatgttcaggaatcctctacaacaagagacccacggtctcttaatcccttttcagaaataagaagaagagaagaagatatctctcttaaaagagatagattgtacaatgaagatcaatcaaaattccttattgaatatgcaagtggttga

SEQ ID NO: 68612 - DNA, 222 bp, Glycine max
  Peptide Sequence Number=SeqID_160297
atggacaagtttgatggacttcagacttttgttggtgacaagtttgatgccatggaattacaagttgacatgaggtattgtcatcatcaaaaagggggagattgtagacaaaggatcaagctgaatgttttgatgatgccaaaggattacctgaatcacatgcttctcaaagatttattcaagacaaagatattcaagatgaatgatcaagacagtctctag

SEQ ID NO: 68613 - DNA, 363 bp, Glycine max
  Peptide Sequence Number=SeqID_160298
atgtctcagaaaaatgatgatcttagactcattcactgttggatcatcgtgaaatttaagcaccaggttcaaaatccaattccgagcattctcaccgttgggaatttcaaaatcattcaaattttgatatgttgttccaaattcaaatgcggaaactttcaccgttgggatttgcaagataatattcgtggagggagaaaaagcattcgcgtgaagatagtacaaatggaggcttcaatcccttctctttctctctatcgtttgggaaccctatcagagcaaccagaggaatctcaagaacttgttagagatgtctctatcgctgtcggaagacacatgagtctgcttagaggtaagggatga

SEQ ID NO: 68614 - DNA, 84 bp, Glycine max
  Peptide Sequence Number=SeqID_160299
atgattcatcttgaccctcttttcatagttgctggagtggacttgggtctgcatactcgtgctaagcctgcgttactcgcttag

SEQ ID NO: 68615 - DNA, 735 bp, Glycine max
  Peptide Sequence Number=SeqID_160300
atgccagtctcagcaccaaccgacagcttgctggttacatcaccttgttacagactacgacgaggtgtcatcacgtgcgtgtcggtggattgcgatgaagaagactgtgaagaaggtatctacaacaacgtacaggcagtgcctggatcgtctgaggatcgcagatgtctgctggacgccatatgcggcgcaccgacctgtgtaggactttcatccgatttcgtgcttctcgggacagctccgctggggcatgttgccagatacagaccggagagggttatgcaccagttcagctacgtccagtgcattcctgcacaccctatccattcatgggtgtcatatgatgacatggacgatacctggacacattactcagaccatctagcggcagtaggtgatctatgtgttgtgccaggtcagtgtgcgcctgactacatagactggttcttcgtcatatcacattcattcatgactacgccacagacagatcctcctcgagatgcatatgcaacacaacccaatcatatccctcatgaggaagcaccgacatcgacatatgcggatcctgatgtagacgagcccagacatgcaatggaggcttgtcatgcgatcgcggaggcgttggagcagcatctaaatgcgccaggcacatccacacatgaagaggccatccaaaaatgtctcaggattgccagggattccttgatcggagtgtgtgattcttgtgtaatgtga

SEQ ID NO: 68616 - DNA, 270 bp, Glycine max
  Peptide Sequence Number=SeqID_160301
atgcgttcatgggtgaggggtcagtggattctttttgatgcagatgccctcagccagttccggggtgacccgcaagtgtcagaggaaggcccaggagtgcgagttcagtcagaggaggaacagggccgatgggttcgacaaggaggccattgcccagctgttatgcacaccggggcaggatttctcccggaccgctgcagggaggcgggtgcggatcatgcgcaccagcatgaccaccttgacccagacgtggatgacattgttgcttag

SEQ ID NO: 68617 - DNA, 462 bp, Glycine max
  Peptide Sequence Number=SeqID_160302
atggcgcctaccaggcaccctatggacccggataagtccaacagggccctgggatttccagctttgatcataggactctgccagtcgttcgaagtccccgtcgcacctagtaaggctgtaggcgcgccaccaccacctcatcaggctgacccagctgggtcatttgacacagagcggtatttgcggcactcaatgcaccagcacgcggccaaccacaggggactggggcaggtccatgaatgtctctaccagctaagcctcagcatgcagagtcaaggcttcactccttttccgtgccctactccagaccagttcagggcagaggtcgcatggcccggggattggcccgaggcccaagcaggggaggcacccgcaaaggctctcgacgatggagaggaggccggcatggatgaggagatgtcagatttgctcgacttcttgggagggagtggggccacatga

SEQ ID NO: 68618 - DNA, 471 bp, Glycine max
  Peptide Sequence Number=SeqID_160303
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctacgaaagcttgtgcatccaataccctgatgaggatgtcccatatgttcttaagactggactgattcatttgcttccaaagtttcatggccttgcaggtgaagacccgcacaaacatttgaaagaatttcacattgtctgctccaccatgaacccccagatgtccaagaggatcacatatttctga

SEQ ID NO: 68619 - DNA, 455 bp, Glycine max
  Peptide Sequence Number=SeqID_160304
atggaatcaagtcaaatgccttcgcttaaaaagaggttctatcaagtcaaggtcaagagcctagggatcactagtctaaaagagttaggacagttgatgggtcagctccagcggcaagcttttcgcaaagcttatggtaaaatctgggacctagccatggtagaagtctccacagaggtcattgcctccctcgcccagtattatgatcagtcgttgaggaaaccatacctcttcactgggttctatccctcattagctagaatttccaagatagtccaaatctcggcgcaggaattagaccacaagaagcaagtcaaaaatggggtggttggaataccgagaaaatatttggaggaaaaagcaagaatcttggcaggtaaaggcgagtgggccccattcatagatattctcgcactgttgattttcggaggagtcctctttctgaatgtggatag

SEQ ID NO: 68620 - DNA, 1032 bp, Glycine max
  Peptide Sequence Number=SeqID_160305
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcag

SEQ ID NO: 68621 - DNA, 270 bp, Glycine max
  Peptide Sequence Number=SeqID_160306
acacagcccagcttggagcgaacgacctacaccgaactgagagacatacagcgtgagctacgagaaagcgccacgcttcccgaagggagaaagacggacaggtatccggaacgcggcagggtcggaacaggagagcgcacgagggagcttccagggggaaacgcctgggggacggagcctatggaaaaacgccagcaacgcggcctttttacggttcctggccttttgctggccttttgctcacatgttctttcatgcgttatcccctga

SEQ ID NO: 68622 - DNA, 247 bp, Glycine max
  Peptide Sequence Number=SeqID_160307
atgaaagttggatatgttctacgaaatgcaattgcgcacactttcactgttgggatttgcgagataatattcgtggagggagaaaaggaatcgcatgaagacagtacaagtggaggtttcaatcccttctccgtctctctgacgtttgggaactctatcggagcagtcggaggaaaattggaggaatctcaagaaagcgctagagatgccgctattgctatcggaagacacgtgagttcgcttagag

SEQ ID NO: 68623 - DNA, 378 bp, Glycine max
  Peptide Sequence Number=SeqID_160308
atggtgaggacgtgtagccctctgaaggtgaaggcgtgtagccctctgaaggtgaggtcgtgcagccctctgaaggtgaggacatgcagccctctgatggtgaggacgtgcaaacctttgaaggtggggacgtgtagtcctctgatggcgaggacgtgtagtcctctgaaggggaggacgtgtagtcctctgaaagcgaggacgtgcagtcctctgaaggtgagggtgtgcagccctctgatggtgaggacgtgcagccctctaaagattgactgtccttttgaaagaggtgataattcatgcaaccttatcctatcttttgcaaatctcatcgggaactccctcagagtgtatgttctgtttgatttagtcacttga

SEQ ID NO: 68624 - DNA, 270 bp, Glycine max
  Peptide Sequence Number=SeqID_160309
atgggtatactacgtcggttgaagaccgtcgttgtctgcgacgacgaccgtcgtagtaaggtccacaattcaaacacggctgtcaacagccccgtcgtagaagtaacaacagactacgacgggcatggggaccccaccgtcgtagaagtaacaacagactacgacggttgtcttccaagaaccgtcgtagaagggtcctatcactacaacggtgttttgttgcggacgaccgtcgtaagagacggtgttaatactactacggtcacgtaa

SEQ ID NO: 68625 - DNA, 225 bp, Glycine max
  Peptide Sequence Number=SeqID_160310
atgaagggaaaccaacaaaggacggagtcgccaactgtcgcaacctacccttcaacgggagggcgacgcgtgactcgtgagatgcgtgttccacgaaaggaatacacgcggagttgccaccaacgtttatttgaggaaaacgtcggaaaaaccggaaaagacgcgatctacgaacttttaagtgaaaggctcgggagttgtatttatgcacggggaaggtattag

SEQ ID NO: 68626 - DNA, 249 bp, Glycine max
  Peptide Sequence Number=SeqID_160311
atgaccaaacttggtctctgcttgtcatcgggcccgccgcctctggatgacaaaagggtgcggataaccgtaagattgaccaaacttggtctctgcgtgccatcggacacgactgtgtctgaatggcaaaggggtgcggataaccgtaagggtcagtatgacaaagattatggggcggccgacaaaagcaaagctcttgctcctacgtatcctccaatgaggaactcagacctacgtagttctggataa

SEQ ID NO: 68627 - DNA, 663 bp, Glycine max
  Peptide Sequence Number=SeqID_160312
atgtgctctgaaaagggtaaagcaaatcaggaagcgctcttagcaggcataatgggagcgtttgttagttggttcccacggtggaaagaaggaggagcaggagtgttatgctcatgcaaaggattcccaaatgtccccttgatagggatgaggggctaccctatgagaggtgcatcttcaaaggaaatcatcacgcctttcatcacgcaaggtttcattgatgctaaagcgaagatactgcagaaaatccgtaaagcatggaatagagtggaaagaaaagataaggatcttaggggaagtagcaacagtgtcattggcggctatcacaagtggttgaagtctagaacgcaagggataacttggctcccaaagctaaaaagtctaagtgggaaagaggctgaaatttctgaggaaagtgaagaagtgcaagctttgaaagtagagctcgaagagtcaagagtggtgaatgagaagttgagggtggtagtcactagggtcaggaaaaaatgtgatgagctgaaagatatcaacatgaccacggtggaagctaaggagctcaaacttagaaaggccgagagggacaaatcaaggatggaaagcatgggaagcgagagaaagggtgatagagttattgcacggggaagatatgaaatggatggttag

SEQ ID NO: 68628 - DNA, 552 bp, Glycine max
  Peptide Sequence Number=SeqID_160313
atggtacttatgatgtcatcaatgcatatctccaccgagcttctgcatctttcaacgagctcaaccacctccacaaggagcttggatcatgtgactctcataacaagcacaaaacagagaatggagctgagccttcggcatgtgaaatttgatcagttcaaaaggcaacaaagtggcagtgggaatgctgatggtgaaaattttagtcaacaaggagaagaagaaaatgtggatgagggtgaaatgcataagaagaagaaaaagaagaagcaggaagttgagtccttgcacgacatacatagcaccgttaaatttggagtgagggaagctgatggaaagcatgttagttctaggaaccctacagttgagaaatatcagccaacaaactgtagatatatctgcaatgaatgggaaattgggattgaaattgataccaatgtgaagagagaagaggtggagaagctggtgaatgacttgatggcgggagagaaaggaaagaaaatgagacaaaagatcgtggagttgaagatgaaggcagaggaaggaaaatag

SEQ ID NO: 68629 - DNA, 255 bp, Glycine max
  Peptide Sequence Number=SeqID_160314
atgcccctactccagaccagttcagggcagaggtcgcatggcccggggattggcccgaggcccaagcaggagaggcgcccccagaagctcccggcgatggagaggaggcccacgaggacaaggagatggccgatttgcttgacttcttgggagggagaggagctacatgactgggagatccccagattcatggtgaacgctgtgaaatttccccggacgcccaaaatggactcggatgaatgcacaaatggataa

SEQ ID NO: 68630 - DNA, 156 bp, Glycine max
  Peptide Sequence Number=SeqID_160315
gttctcccgtattatttgagtttggagcttcaaacgtctgagcaaccatgtaacattgtgatgcaatcctaccccacaagggcattggatagaagactccaagaagattgggccagagatgcaagagaaggccctaggattctcatgagccttaag

SEQ ID NO: 68631 - DNA, 276 bp, Glycine max
  Peptide Sequence Number=SeqID_160316
atgggtaattacgcgaagattttcaaccgttcttcgtcattcatcgttcattcttcattgttcttcggtcttcaaccgacaaacgcgagaggtgctaataccttcctcaaacgtaaatacaactcccgaacttggaatattctttttgaccggtttccttcggtttttccgacgttttccacaaataaacgttggtggcgactccgcgcattttcctcctttcgaaaatgcacccgtgagcctcgcctcgctcgcccgcaaaagggcatgttgtga

SEQ ID NO: 68632 - DNA, 222 bp, Glycine max
  Peptide Sequence Number=SeqID_160317
atgatggataaaagattgtccctctggatgaagcacaccatgtacccaaagaagggtcaaatggtaaccctctcaaagatgaaaagcactgttcaagtggtcctcttcgaggatgagagagtgacacatgtttcgtgcagagcatgtgttacagtgtatgcgagttatacatttggaggaaagcataaaatggaatcgcatgttgcagactacggcctctaa

SEQ ID NO: 68633 - DNA, 4074 bp, Glycine max
  Peptide Sequence Number=SeqID_160318
atgccgttcctatcggaggctgcgagtgcgattaagagcaggttcgggttccacgaccatccctccgaatcgctttcgctggttcagaacactccggatcttttcaaatccgccgtcaaagacactctgtcgcaaagctccattgtccgaaacctaagcgattgggacgatgaaactgtggttggaccaagtagcgccgccgtttcctcttctcagagctttgaattcgccgaggacccttccttctggaaagatcacaatgtacaggttataattagaatgcgtcctcttagcaactccgaaatatcggtgcaagggtatggaaaatgcgttaggcaagagagtggtcaggcgattacttggactgggcatcccgagtcgcggtttacttttgatcttgtagctgacgagaatgttagccaggagaatctctttaaagtagctggtttgccaatggtagaaaattgcatgggaggctacaacagctgcatgtttgcttatggtcaaactggaagtgggaagacacacaccatgcttggtgacattgaggggggaactagaagacacagtgtcaactgtgggatgacaccaagaatttttgagcacttatttactagaattcaaaaggaaaaagaggctcgaagagatgaaaagataaaatttacatgcaaatgctctttcttggagatatacaatgaacagatccttgatcttttggacccatcatctaacaatctgcagataagagaagacagtaagaaaggagtttatgtggaaaatcttacggaaacagaagttacttatgctcgagaagtcattcaattacttattcagggagctgcgaacagaaaggtagctgccactaacatgaatcgtgctagcagtcgttctcatagtgtatttacttgcatcattgagagtcagtgggagtctcaaggagtgactcactttcggtatgctcgacttaatcttgttgatttggctggatctgagagacagaagagttctggtgctgaaggggaacgcctcaaggaagccactaatatcaacaaatctctttcaactttagggctggtgattatgaacctagtaagcatatctaatgggaagtcgcaacatgttccataccgtgattcaaagcttacatttttacttcaggactctcttggagggaattcaaaaacaatcataattgcaaatataagcccctccatttgttgttcacttgaaacattaagcacattgaagtttgcacaacgcgccaaatttattaagaacaatgcaattgtaaatgaggatgcgtccggagatgtcattgccatgagaattcaaattcaacaacttaagaaagaagtatcccgtttgcgtggtctagttggtggaggagaaattcaggataatgacatttcagtagtcagcttccctggttctcctggatccttcaagtgggagggtgtgcaaggatcattcagtccattaacctctattaaaaggatatctcagaaaaaagactatgacgttgcccttgttggggcctttagaagggcaaaagacaaagagatggaattgcaagcactaagagatgaaattgaagcgtccatgaagctggtgaaacaaagagaagatgagattcagagtttgaagatgagactacgttttcgagaagctggaataaaaagattagaaacagttgcttctgagaagatctcagctgagacacacttgctaaaagaaaaagaggagcacttgaaggaaattgaggtcttgcgggcccaggcaagaacacagcctcatggtattgtcaaactcaaaagaaacaagtcaaccaaccagtccaagttaaagtcattttgtatggaaggtgaacgagaacagatgaatgaacaaatcatggtattggaaaacaagttgttggaagcactagattggaaatttatgcatgaaacagatctgaaaataaactctgattcaatgatggaagatgtacataatgatggtaatctcatctccaaacaggagtcaagtccaaaatcacattggcagtctttgctgagggaggaaaatgagtttctcaagattcaggctatacaaaaccaggcagaaatggatacaattcgcaaaaagctagaggtttgccttgaagagaaagaaaaattaaaaaggcatgttgatgatttgatggaaaaatttgaacaagagaaatgccgaacaattaatgaaggaaaggagcaaatggatcttccatcaacaactgatatgcctgtcattaacagcaatgaccaacttgaattgaaagcaatggttgatgctatagcttctgctagtcaaagagaagcagaggctcacgagacagcaattatgctggcaaaggagaatgatgaactcaagatgaagcttaaagccttgattgaggataatagtaaactaattgaattgtatgaacaagctgctgctgagaaaaataatagaaatgttaataaaggggagggtgctcaagaaattggttctgagattgacaatggttgctattctcttgaaacaacaaaagaggagactgagttgaaaggagtggttgagaatctccagcatcagttaatggaaatgaatgaagaaaatgaaaagctgttgagtttgtatgaaagagccatgcaggagaaggatgaaataaaaagaactcttgcatgttttggacatgaaagagttgaaaccaaaggagatatggactgcccagagaagcttgttgaagttgatggtggggaaagagactcgagagtacaaactgtctctcaggaagtgcagggtagagatgaaagtaaatgtgaatcttctacatctggatctgatgtggacttcgagtgtgatgctcatgaacaggaacatcttttaaaggatgacaatgaggctgatatactggtcaactctgagaagaaatacgaggtatctgatctcagcgaagcagagttatcagaggaattaaattgtgctacgaagaagcttgaaagagttgatgaacgtatctcagatgcagtcaagactatagcttcacttggttgtgctgaaaaggcaatggtccaggttgatgagctctctagagaaattgaggtcacagaacatgatattcaggtcaagcgtcggcagtttgaatccttgaaacttcagttttctgaagcacaggaaagaagaacaatagtcaataaaaagttctctgcactcaaatattcattatcaaacttctcctcaacattttcttactttgagcaacgggaagcaagggcaagagcagtagtgaatgacttgacatctcatcttgcccaaaacaaaggtgaattggctgctcttcaagcttccaaacagggactggagaatgctcaaaagaggaaccaagaatgtgaagttgaaataatgaaaaatgttgcatccatcaaatcaaaattggaggaggagaatcgcaagtgcgaaggtgagaaggttctatttgcagttgaaaacacacagaatattgattccgcattgaaaattttgcatcgtagttgtaaagccaccgagttacttaagttagaggaagataaaacaaaactgcaagcagagatgaagctttctcaagaaaaacttggtgttataagaaaggaactggggaatctaaagaagaaggaggcaaatgtagagagccagatacaagctgttcaactggaagtaaagaaacttttgaggaacacagaggagaaggagcttgcacttcagcgtgtgatgaaagagaaagagatgctcttggagtttagagataatggtatgttggaaatagagcatatgatcattgaactccagcaatatgtatttgactatgagctaaaggaggctgaaataaacattcttggagaagaattgcaaatagatttgataagagccgaagagttacaaacagccagggtcattgctgccaacaacaagaacaatgtcctttcttctatttcttattctggcatgtttgggaagctgaaggaggagatgcaaaatctgcgggcatcaattctcgaaacaaaattgttgctggaaggcatttcccatgccaactaa

SEQ ID NO: 68634 - DNA, 921 bp, Glycine max
  Peptide Sequence Number=SeqID_160319
atgatgctgccccgaggattctccattgaattcctccttcttgctctgtactgtgcattagacccctttgggcacagccccattgctggtttccctcactttgaggtgcacaaaatcgacatgcccgcatggtctgaggttcctacggaccgagacaaagacaactcgttgcagaaatcggaggtcttgattgtgaaccaagtgcaaggaccagagagcattgcctttgatcctcttggtcgtggcccttacactggtgtagcagatggaaggattttgttttggaatggacagtcagaactatgtaatcctaaggaatctgcatctccgatgagttatgtcgaaactgagcacatctgtggaaggcctttgggactcagatttgacaaaaacactggtgatttatacattgcagatgcatattatggactgatgaaggtggggcctcagggtggtttagcaacatctcttgcaactgaggctgaaggggtgccgctgagatttactaatgatgtagacattgatacagaggggaacctttattttacagatagcagcactaactttcagaggagggttttaaaatacaaccttgccactaaggaaaccactgttctcatgaggaacgttcaatttccaaacggcatctccttgagcaaggatgcttccctctttgtcttttctgaagggatgaatggaaggttacgtaagtactggctaaaaggagttaaagctggtacttcagagatcttggcaatcctccctggttttccagacaatgttagagtaaatggaaatggtgacttttgggtggctatccactgtagaaggttccatgcagtagttgtcaagtatagccctgaaggtaaacttctgcggatattggaggacagtgagggtaaagttgttagaactgtgtga

SEQ ID NO: 68635 - DNA, 1782 bp, Glycine max
  Peptide Sequence Number=SeqID_160320
atggcaagagggggtggactctccattgattcagatccaattgggagcttcctcccccacgagccaatagtcttaaactccttccctgaagacaacaaagacaacaacaacagtcgccaacaacacaagtggaaacttggtacaaacatggatgccactgttagcagaaagagttctccatcatccacttctaacactaacaccaccatccccttccaagaccaccttacctctgatgacaagatgcctcacctcgacgagatgaacttcttccccaacaaaagcaacaaggatgatgacgatgacaacaaccttgcctctgcctccacctctgcacctccctcccttgaccaccttcatcacacacatgatcattcctccgctatcttgggattgaaagtaaacactggtttgaatcttcttactaccaatgcaagcagtgatcaatctatggtggtggacgatgacatatcccctaattcaggagacaaacgagctaagagtgagatggttgttcttcaagttgagcttgagagaatgaagacgcatttggtgagtttgatgaaggaccagatggacaaggaggatgataaacaacaaccgcatcaagtgtttgatggaaaactagaagagaagcaagctgggaatggtggtggagccttggtgccaagacagtttatggatcttggattggccactaatgctgacaccaatgaaacttcgcattcccattcttcgtccgtgataagaagtcaggattcaccaccaacaaataatacagaggtggcatccaagaagaatgggggtgctagtgatgaaggactagtgtttgatcaagacaagaaggaatttggtaggggaattgagagagaggatagtccctcggatcaaggggtagctgctaataacaatgttccaaagtttagtcctccaagaaatgttgatcaagctgaggccaccatgaggaaggctagagtttctgttagagctcgatcagaggcacctatgataactgatgggtgtcaatggcgaaagtatgggcagaagatggccaaaggaaacccatgtcctcgtgcatattatagatgtaccatggcagcaggttgcccagtgagaaaacaggtgcaaaggtgtgctgaagacagaacaatactgatcacaacatatgaagggaatcacaaccaccctttgcctccagcagctatggcaatggcacaaaccacttcctcggcagcaagaatgctgctttcaggatcaatgtcaagtgctgatggcctaatgaatgcaagcttcctcacaaggacactcctcccttgctcttctagcatggcaactatctcagcctcagctccattcccaactgttacattggacttgactcagtctccaaatccattgcagttcccaaagcaaccaagccaattccaaatccccttccctggtgtccctcagaactttgccaattcacaagcctcattgctgcctcagatatttggtcaggcactttataaccaatccaagttttctggccttcaaatgtctcaagattcagacccttcccaattgagtaatcaatctcaaaggccaccaccacaccttgctgacacagttagtgctgccattgcagctgatccaaacttcactgcagctttggcagcagccatcacttccattattgggggtgcacagccaaacaacaatagtactaccagtactaattataatggcaccacatcgaccaacaccagcaatggcaatattacatcaagcaacaacaaataa

SEQ ID NO: 68636 - DNA, 948 bp, Glycine max
  Peptide Sequence Number=SeqID_160321
atggttgggtacatactagttcttgaacttgatgtaattgtggctaataatgctattttgttatcggtactgggccaggagccattatccatatctgatattgtggctgctttggatgatggtgctaaagtacagatatcatataaggggataccaggatcatacagcgaggatgctgcactcaaagcttaccctaattgtgaaacagtttcatgcaatgactttgaagaagcttttaaggcagttgagatatggtgggctgacaaagttatccttccaatagaaaatacatctgggggaagcattcaacggaactatgatttacttctttgccataggcttcacattgttggtgaggtgcagttggctactaacctctcccttctagctctgcctggcatcagaactgagtacctaaaacgggttctaagtcattctcaggcaaagcttcatgttgctggcacttttttagacgtggcatttgaattgagtgatgatttcctgactaaattaggtgttgccagagaaaacgttgatgacacagctggtgctgctcagattatagcttcaaatggtctgtatgatgccggtgcgattgccagcattcgagctgcggaaatctgcgggcttaatattgaaagccgaccacaaagaaatcggccattaagagttgttgatgactcaaacactccaactgccaagtatttcgattaccttttctatattgattttgaggcgtctatgactgaaccccgagcacaaactgccttaggacatcttcagcatatgataaaatgggacaaatttgcatacaaaaatagcaatgacaattggcagaagcacttcctgcaagccatgaatggtgctgttccaaaagtttctgaggaaactttcttcctcaaattttctgtgcggtgcagtaactttttcctttttgggcagctgtaa

SEQ ID NO: 68637 - DNA, 84 bp, Glycine max
  Peptide Sequence Number=SeqID_160322
atgaataaaaggagcttcaaggaaacttcaaatattccttattggtattttgttgttttagtgaggtttgcaatgaagatttaa

SEQ ID NO: 68638 - DNA, 948 bp, Glycine max
  Peptide Sequence Number=SeqID_160323
atggctaagcctcacaaactcgtgcctttctacgctacacttctcgacgcttgttcttcctcgaagcacttgaaaaatctaaaacgaatccacgcgctaaccattaccttaggcatttcacgcaatgacttcattcgaagcaagcttgtgtcttcctacgcttgctgtgcccaattgcacgaagccaatatcctcttttctttcaccattcgccaacccactttcctctttaactctctcatcagagcttattcctctctcaacttgttctcccaatccctctgcatctttcgccaaatgttgcttgctcggaaaccctttgatcgtcacaccttacccgtggtgctcaaatcttgtgccggcttatcggctctgcggctcgggcaacaagtccatggagcagttttggttaatgggtttggcttagatttggcaaattcgaatgctttgataaacatgtatagtaagtgcggacatttggtatatgcacgcaagctgtttgatagaatgtggcaaaggaatgagattacgttttcaactatgatggcgggttatggaatgcatgggaagtgtggggaggtgtttgagctgtttgataaaatggtggaggcgggggagaggccagatggtgtgacttttactgcagttttgagtgcatgcagtcatggggggtttatagataaggggagggaatatcttaagatgatggaggtgaggtttggggttaaacctggattgcatcattatacgtgcatggtggatatgttggggagggttggacaggtggaggaagcagagaagttaattttgagaatggaggttaagcccgatgaagctttgtggggtgccttgttaggagcatgtaaaactcatgggaagcttgaggtgactgagagagtagaagagagggtttatggaagggaattgagttttgcatcgtcggtttga

SEQ ID NO: 68639 - DNA, 234 bp, Glycine max
  Peptide Sequence Number=SeqID_160324
atggaagtggtggatgtattgtgtggtgtgctttcagaaagaggaaaacttttgggttatattacgggtagagccactgggttgagagtgagaactgagaacttagaagaagggaggaggcacagtgtcgggagtcagatacagatagagtctagagagagagatagagaaatgtgtgttgttttgtttgctgagtcagagagcgaaagagggtgtgaaactgtggcagtgtag

SEQ ID NO: 68640 - DNA, 1566 bp, Glycine max
  Peptide Sequence Number=SeqID_160325
atgatccttcctgcgtgcaatgctacaccaactcagcttcctcaccctccaaaatcaccttcatcaaattcacttccaaatcaaactcattccactttttctaatactaacaccaacaccaaccaaggcctctccctgagacacaccacaaaatataacgaccccattgtatcatggacaacgtccatagctgactattgcaaaagtggtcacttggtaaaagctgcttccaaattcgtgcaaatgagagaagctgctattgaacccaatcacatcactttcatcacgttactctctgcttgtgctcactatccctcacgtagtagtatctccttcggaactgccatacatgcacatgttcgcaaactgggcttggacatcaacgatgtcatggtgggcactgcactgattgacatgtacgctaaatgcggtcgtgtggagtccgctaggttggcattcgaccaaatgggtgtcagaaatttggtgtcttggaacacgatgattgatgggtacatgaggaatgggaaattcgaagatgccctccaagtgttcgatggattgcccgtgaagaatgctatttcttggactgcgctaattggtgggtttgtgaagaaagattaccacgaggaagctctagagtgctttcgagaaatgcagctttctggtgtggcacctgattatgtgactgttattgccgtcattgctgcgtgtgccaacttgggcacactcggtcttggcttgtgggtgcaccgacttgtgatgacacaagatttcaggaacaatgttaaagtttccaactctttgatagacatgtattctcgttgtggatgcatagaccttgctcgtcaagtgtttgatagaatgccccagagaaccttagtgtcatggaactcgatcattgtgggttttgctgttaatgggcttgcggatgaggctctgagttacttcaattcgatgcaggaagaagggttcaaaccagatggggtcagctacacaggtgctctaatggcgtgtagtcatgctggactaattggtgagggacttagaatctttgaacacatgaagagagttcgtagaattttgcctagaatcgagcattatggttgcctagtggatctctatagtagagcaggtaggttagaggaggcattgaatgtgttgaagaatatgcccatgaagccaaatgaagtgattttggggtcattgctcgcagcttgtaggactcaggggaacattggtttggctgaaaacgtgatgaattatcttattgaattggactctgggggagattccaattatgtgcttctttctaacatatatgctgcggttggaaagtgggatggtgcaaacaaggttaggaggagaatgaaggagcgtggtatacaaaagaaaccaggctttagttccattgagattgactccagcattcacaaatttgtttccggtgataaatctcatgaggaaaaagaccatatttacgcagcattggagtttctgtccttcgagctgcaattatgtggctatattccagatttctctggaaaagaatcttatgaggatggttaa

SEQ ID NO: 68641 - DNA, 192 bp, Glycine max
  Peptide Sequence Number=SeqID_160326
atgactaacaaacggcctgttctgccagactgccacctcaagatcttcgaaagccatgacgcgggtcacgactcacgagttcatgaaaaagagagagctgatgcaacgcaaatactaatgtcatccatgccggattggtccataagagaagtaaccaatgatatcgctttaaattggacaatccctaattag

SEQ ID NO: 68642 - DNA, 810 bp, Glycine max
  Peptide Sequence Number=SeqID_160327
atgactatcagatatatcgattatctattcctaggagattatgttgatcggggacagcacagcttggaaactataacccttcttcttgctctgaaggttgagtatcccaacaatgtacatttaatacgtggaaaccacgaagctgcagatattaatgcactgtttggtttccgaattgagtgcatagagaggatgggtgagagagacggaatttggacatggcatcggataaacaagctgtttaattggcttcctctggcagctttaattgagaaaaaaattatttgcatgcacggtggtattggtcgttcaataaatcatgtagaacagattgaaaacattcagcgtccaattcctatggaagctggatcaattgtgcttatggatctattgtggtctgatcctacagagaatgacagtgtggaaggattgcgaccaaatgctagaggtcctggattagttacttttgggcctgatcgggtcatggaattttgtaacaacaatgatcttcagttgattgttcgtgcacatgaatgtgtgatggatgggtttgagcgttttgctcagggacatttgatcacacttttttcagcgactaattattgtggtaccgcaaataatgctggggcaatattagttttgggtagagacctcgttgttgttcctaaactaatccatccattaccaccagcaatttcttcaccagaaacatcaccagaacgtcatattgaagatacatggatgcagctatcaaatatatatgactcagtggcatgtatatttgatagctgcaatgacgcctttagttaa

SEQ ID NO: 68643 - DNA, 285 bp, Glycine max
  Peptide Sequence Number=SeqID_160328
atgagaattctttgtcccaacacattggagggtacatcatttgtgatacaagtagaggttcaagtagagggtacatccacttggttattcaaagagaacaaggaagggtatatcccttgtggatcgttggcttgtaaaggattttacaaggttgaaagaaatctcaagaaccggttagttgcttggggactggacgtaggcacgggttgtggccgaaccagtataaatcttgtgtttgtcttcttcttctctacattttttaatttccgctttacttttgtctaa

SEQ ID NO: 68644 - DNA, 594 bp, Glycine max
  Peptide Sequence Number=SeqID_160329
atggggacaaatcaaactggcaaaaggttttatcaagtcaaggttaaaggcctagatgttaccagcattaaggaattggggcggttgatgagacctctccaaatgcaagccttccgcaagacttacggaaaaatcttagatttgaccatagcagaggtatccatagaagccattgcatcactcacccaatactacgaccagcctttgagatgcttcacgttcggagacttccaattggtatcgaccattgaagaatttgaggagattctgggatgtcctctcgggtggagaaaaccatatcttttttccgggtttctcccctccttgagcagaattgcaactgtggtcaaggattcagcaagaggtttggaccgcgtaaaacaaactcgaaacggcatagcgggcctaccacggaagtacctagaagacaaggcgagggatatggcaaatcaagaagagtgggttccgtttatggatgtgttagaattgctaatctttggggtcgtactctttcctaacgtggatggtttggtggacctagccgcaatcgacgctttccttgcataccaccatagcaaggagagcccggtgtag

SEQ ID NO: 68645 - DNA, 627 bp, Glycine max
  Peptide Sequence Number=SeqID_160330
gtggagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaagttactctagggataacagggctgatcttccccaagagctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaaggtcacggcgagacgagccgtttctaa

SEQ ID NO: 68646 - DNA, 399 bp, Glycine max
  Peptide Sequence Number=SeqID_160331
atgactagaggcaatccatctaacttacaaccctttgatcctgagatagataggacatttcataaattagttaggcatcatcttgtaccttttgagcattctgactattctgttagtggtgattttgagcatcctgatttagagcattataattttgaacattttgagaacatgacacaacctccacactgtgagaggactctaagggaaatggctgcacctgatttcacctacgaaagtttgtgcatccaataccctaatgagaatgtcccatatgttcttaaaactggactgatccatttgcttccaaagtttcacggccttgcaggtgaagacccgcacaaacatctaaaagaattccatattgtctgctccaccatgaaacccccagatgtctag

SEQ ID NO: 68647 - DNA, 1542 bp, Glycine max
  Peptide Sequence Number=SeqID_160332
cagctgtatctgaacatctgcaacaagatccagcagcagctcgatccgagcaatcgcgcgcaccgtccaatcatcgacgagctgcaagagcgcatggcggacaagttctacgtcaacttctcgctgttccagtcgatgccggatgcctggggtatcgatcagctgttccctgtgctgccgctggaagggctggataagccgccggaaggccgtgcggtgctgctcgacatcacctgcgattccgacggcactatcgaccattacgtcgacggcgatggcgtggcgaccaccatgccgatgccgccgtacgatccggagaacccgccggtgctgggcttcttcatggtcggcgcgtaccaggagatcctcggcaacatgcacaacctgttcggcgacaccgcctcggttgacgtgtacgtgttcccggacggcagcgtcgagaccgagttgtccgacgagggcgacaccgtggcggacatgctggagtacgtgcagctcgatccgggtgcgctgctggccaagttccgcgatcaggtcaaagaaaccgatctggacagcgagctgcaggcgcaattcctggaagagtttgaagccggcctgtacggctacacgtatctggaagacgacaccttaggccatcagtccgataattcattagtgtccaacgcctttggtttcctgcgctttccgctgaacttcatgccttacgacagcgatgcagagtgggtcatcaccggcattccgtttgacatggcgacctccggtcgcgccggcggccgtcacggcccggcggctattcgtcaggtgtccaccaacctggcctgggaaggcaaccgctggccgtggagcttcgatctgcgcgatcggctgaacgtggttgactgcggcgatatcgtgttcaacttcggcgacgcgcaagacatgagcgacaagctgcaggcgcacgcggagaaactgctgaaggccggtaagcgcatgctctcgttcggcggcgaccacttcgtgaccctgccgctgctgcgcgcgcacgccaagcatttcggcaagctggcgctggtgcacttcgacgcccacaccgatacctacgccaacggcagcaagttcgaccacggcaccatgttctaccatgccccgaacgaaggcttgatcgatccgcaccactcggtgcagatcggcattcgtaccgagttcgatcatgacaacggttttaccgtgctggacgccgcgcaggtgaacgatcgcagcgtggacgacctgctgacccagatcaagggcatcgtcggcgatatgccggtgtatctgaccttcgacatcgactgcctggatccggcgttcgcaccgggcaccggcacgccggtgatcggcggcctgacctccgatcgcgcgctgaagctggtgcgcggcatgcagtcgctgaacatcgtcggcatggacgtggtggaagtggcgccggcttatgaccagtccgagatcaccgcgctggccgcggcgaccctgggcctggagatgctgtacctgcaggcggccaagaaacacgcctga

SEQ ID NO: 68648 - DNA, 2883 bp, Glycine max
  Peptide Sequence Number=SeqID_160333
atggcgctggcgctgtcgccgctgttgggctcgttgcccggccgagcggcggatgcgccgccggatatcgcccgcgttgcggcgctggaatggctgccgatcgaactgctgttggcattgggcgtgacgccgctggcggtggccgatgtgcataactacaacctgtgggtggcggagccgaagctgccggcgacggtggtcgacgtcggccagcgcaccgaacctaacctcgaactgctgcagcagcttcagccttcgctggtgttactgtcgcaaggctatggcccaacgccgcaaaaaatccaacccatcgcgccaaccatgagctttggcttcaacgacggcagcggcaaaccgctgaccgtcgcccgccagtcgctgctggcgctggggcaacgattgggcatagaaagccgcgcggtacagcacctggcgcagtttgaccgctttatgcaggacgcgcgtcagcgcctgcaaagctacacccggcaaccgctgctgctgttttcactgatcgacacgcgccatgcgttgatcatcggccagaaaagcctgttccaggaagcgatggatcaactgggcatccgcaatgcctggcaggaagaaaccaatttctggggcacggcggtggtgggcattgaacggttggccacggtgcgtaatgcccgggtcatctatctcgatcacggtaatcaggcgatgatggacaaggtcagcgcgacgccgctgtggcagtcgttgcccttcgtgaggcaaaaccagctgcggcaggtgccggcggtgtggttctacggtgccacgctgtcgacgatgcggctcaggagagtgcgtcatgagttcgggcatccggaaattgccgctgacgctgatcctactgttgctggcggcggcaggtggcctgacgatatacaatctggcgcagcagctgccgccggcgcaatgggcgcgggcgctcagcgcgccggacatcgacgacgtgcggcaaatgctgttccattacagcctgttgccgcggttgacggtgtcgctgttggccggcgccggtctggggttggtcggcgtgctgttccagcaggtgttgcgcaatccgttggcggagccgtcgacgctcggcgtcgccgccggcgcgcagcttggcctgaccatcgccacgctgtggttggccgctatggtgggcgcgattgtggtgggcgggctggtgttcggcgtcgcctggggcaaacggatgtcgccggtcacgctgattctggccgggctggtgctggggctgtactgcggcgcgggcatgttcctgtggggcaccggcgcgttgaaccaacaggactggagcgccgtgcagttcctcctgccgcgtttgctggtggctggcctgttagcggcgctgttgctgcgcccgctgacgctgctggggctggacgacggtgtggcgcgcaacctggggttagggctgtcgatggcgcgcttctgtgctttggggttggccatcatcttcagcgccatgttggtgagcgcggtgggcgttatcggctttatcggcctgtttgcaccgctgatggcgaagatgctgggggctcgccgcctggcgcaccgcatgatgttggcgccgctgctgggggcgctgttgctgtggctgaccgatcaggtgatgctcggggtaacgcaggtgtggcgcgagatcccgaccggcgcggccaccgcgctgttcggcgcgccgctgctgctgtggctgctgccgcgtttgcgcagcgccgccacgccgccgccgatgaacctcggcgacaaggtgcctgccgaacgcgggaatctgcctggctggatcctggtgggcggcctcgtgctgctgatcggcctggcgctggcgctgatgctggcctgggcgcggaattggacgctctgctgccgtggcgctggccgcgggtgttgtcggcgctggcggcgggcatgatgctggcggtcgccggcacgctgatccagaagttgaccggcaacccgatggccagcccggaagtgttgggcatcagctccggcgccgcttttggcgtcgtgatgatgctgtttatgcctgggggcggccgctacgttgctgatcatcatgatcgccgcaggccgcggcggtttctcgaccgaacgcatgctgctggccggtatcgcgctcagcaccgcctttaccaccgtcatcttcctgctgttggccagcggcgatccgcgtatggggggcttgctgacctggctctccggttcgacctattcggtggagccggcgcaggcgctgcgcaccgcgctgatcgccgccggattgctggtattggcaccgctgtgccgccgctggctgaccatcctgccgctcggcggcgccaccgcccgttcggtgggcattgcgctgacgccgacgcggttgaccattctgttgctggctgccaccctgaccgccatggcgaccctgaccgtagggccgctgagctttgtcgggctgatggcgccgcatatggcgcgcatgctgggcttccgccgcgcgctgccgcaaatggtgatcgccgcgctgctgggcggcttgctgatggtgtttgccgactggtgcggacggatgctgctgttcccgtatcagatccccgccgggttattggcgacctttatcggtgcaccgtacttcgcgctgcgaacgggtgcgcaaaaacgatattgcgtgcgaaaaggaacgcgaggcgtggcggtgagatgaatatactgcgggcgggtgctctggatctttgtctctggagcttctgcgaaaggtacaaagagaaaagccccgagtcgatatccatcaacccgaggcctactctaacgcgtcacaacgttaagttagcctcttacccgccgcgaggcaaggagaagaaggcatga

SEQ ID NO: 68649 - DNA, 865 bp, Glycine max
  Peptide Sequence Number=SeqID_160334
atggctggggatgaccgcgagcccatcgggcgcaaaggaaaacaaccaaaaaacaccgcgtcgcgcaagccgccgcgccgtcgccgagacgacgattatgacgattacgaagaagacgagtatgacgatgatgagtatgaagaggaggaggaacgcatgccgcgtaaggtaaaagcgactccgccgcgtaaaaaacgccgctggctcggcctgattatcaaactgatcctggtgatcgccgtcctgttggcgatctacggcgtctatctggattcccagatccgcagccgcatcgacggcaaagtctggcagctgccggcggcagtgtacggccgcatggtcaacctggaaccgggcatgccgtacagcaagaaggaaatggtcaacctgctggaaggcatgcagtatcgccaggtcagccgcatgacgcgtccgggcgagtttaccgtgcaggctaacagcatcgagatgctgcgccgcccgttcgattttccggatggtaaagaagggcagatccgcgcccgtctcgatttccagaacaaccgtctggctaagatcgaaaacctggacagcggccgcagcttcggtttcttccgcctcgatccgcgcctgatcaccatgctgcagtcgccaaacggtgaacagcgtctgttcgtgccacgcgccggtttcccggatctgttggtggatacgctgatcgccacggaagaccgccacttctatgagcatgacggcatcagcccgtactccatcggccgtgcggtgctggccaacctgaccgccggccgtgcggtgcagggcggcagtaccctgacgcagcagctggtgaagaacctgttcctgaccaacgaacgctcgctgtggc

SEQ ID NO: 68650 - DNA, 267 bp, Glycine max
  Peptide Sequence Number=SeqID_160335
atgacacccgacttcatgggtcaggatgacaaaggtgctgaagacgatgtaagtctctgcttgtcaacgggtttgcttgcccctgattgtcaaagggtgcaaaagacgacgttagtctctgcatgctaccggactctaagtttgacggatagcgaaatagtgtttatacggataaccacttggcttgggtatctccgcatgtcacccgacttcacggaagatgacgtaagtctccgcgtgtcaacgggtttgcttgcccctgattga

SEQ ID NO: 68651 - DNA, 429 bp, Glycine max
  Peptide Sequence Number=SeqID_160336
atggtagaaccatcgaagaagagaagggatcatccttcatcaccgccacggaccatccgaagcacccacaacacctattcatccctctttgtcatctctaagatcatccacttttcattgttcttctctttaactcatttacccagtcaaggtgcaccttttgagggcaccattgttgatgactggaaatttgattattctagtcatgatgctcgccgtatggtctgcaatgaccaggctgaaatgaccggtagattgctggccgggtcattaacatttgataatcgcatcatgcactatataattgttagaattttgcttccccggtcttcaaatttggcacaagcctctgaaggaggatttgattctgatgtggggcttcccttaccgggtcgtcggattgactgggctcacttgattcagtactga

SEQ ID NO: 68652 - DNA, 978 bp, Glycine max
  Peptide Sequence Number=SeqID_160337
atgaccgccgaggtcaaggacgaactgagccgcctggtggtgactcaggtcagtagccggcgcgccgaggtcgcgtcgctgctgcggttcgccggcgggctgcacatcgtcagcggcagggtcgtcgtcgaggcggaggtcgaccagggcagcatcgcccgccgtctgcgtaaggacatcttcgatctgtacggctacaacgcggtggtgcacgtgctgtcggccggcggtatccgcaagacaacccggtatgtggtgcgcgtcgccaaagacggagaggcattggcccggcaaaccggcctgctcgatctgcggggtcgcccggtgcgcgggctgccggcacaggtggtcggcggcagcgtcgcagacgccgaggcggcctggcgcggtgcgttcctggcgcatggatcgttgaccgaacccggacgttcctcggcgctggaggtcagctgcccgggtccagaggccgcgttggcgctggtgggtgctgcccgacggctcggcgtaagcgccaaggcgcgtgaggtccggggaagcgatcgcgtggtggtccgcgacggcgaggcgatcggtgccctgcttacccgcatgggcgcccaggacacccggctgacctgggaagagcgccgcatgcggcgtgaggtgcgggcaacggcaaaccggctcgccaatttcgatgatgcgaacctgcgccggtccgcgcgcgctgcggtcgcggcggcggcgcgagtggagcgggcgctggagatcctgggtgacaccgtccccgaccacctggcggccgcgggcaaactgcgtgtcgagcatcgtcaggcctccttagaggagctgggccggctggccgacccggtgatgaccaaagatgctgtcgccggccgcatccggcggttgttgtcgatggccgatcgcaaggccaagaccgagggcatcccggacactgagtccgccgtgacccccgagctgctcgaagaggcctag

SEQ ID NO: 68653 - DNA, 1077 bp, Glycine max
  Peptide Sequence Number=SeqID_160338
cgacttgccgaccaggccgaccaggtcgacgaggcggttcgagtagccccactcgttgtcgtaccaggagaccaccttggcctggtcgtcgatcaccttggtcagacccgcgtcgaagatcgagctgtgcgggtcggtgacgatgtccgaggagacgatcggcgcgtcgtagtacttgagaatgcccttgagcttgccctcggcggcggccttcatcgcggcattgatctcatcggcgctggcggccttcttgagttcgacggtgaggtcggtcgccgaaccggtggggatcggcacgcgcagggcgtagccgtcgagcttgcccttgagctcggggagcaccaggccgatggccttggcggcaccggtggaggtcggcacgatgttcagggcggcggcgcgagcacggcgcagatccttatgcgggccgtcctgcaggttctggtcctgcgtgtaggcgtggatggtggtcatcaggcccttgacgatgccgaactcgtcgttgaggaccttggcgagcgggcccaggcagttcgtggtgcacgaggcgttcgagatgatgttctggctgccgtcgtacttgtcgtcgttgacgcccagcacgatggtgatgtcctcgtcgctggccggcgcggagatgatgaccttcttggcgccggcgtccaggtgaccctgcgccttggcgcgtgcggtgaagatgccggtcgactcgacgacgacgtcaacgcccaggtcgccccagggaagggccgcaggaccctccttgacctcgagcgccttgatcttgtgatcgccgacgacgatcgtgtcatcgccctccaggctgacgtcatagggcagccggcccaggatggagtcgaacttcagcaggtgggccagggtggcgttatcggtcaggtcgttgaccgcgacgatctcgatgtcagtgttgaccccttgagccttctgcgcgtccagtgcccgaaagaagttccggccgatccggccaaacccgtttacgcctacccggacagtcacgtagcgctccctctttgtcggtttgagatgtggtgtacccgttatcggcactcacattag

SEQ ID NO: 68654 - DNA, 420 bp, Glycine max
  Peptide Sequence Number=SeqID_160339
atggcttcctatggtggtgagcttgttcttgactcatcttctccttgtagtggaatctccaatcatctttcttccttctccattccccttccattgatcttcaagaagcaaaggaccccattgatgaagaagatcaaggcctacaagcttcacatggagctacatcatgtggtatcagagctcaccatcaaaacttggggtgttacaatcaccaccaccaccaccatcaatgtctctgccaccatcattgtccctgccaccaccatcattattaacaataccacctctgtcattgccaccacaaccactaccaaggtcattgcaaccaccaccacaccgccatcaccaatatcgctacctccaccaccccaccatcgacattgctaccacccccactatcgctgccaccacctaaagtga

SEQ ID NO: 68655 - DNA, 159 bp, Glycine max
  Peptide Sequence Number=SeqID_160340
atgtcattgcctagcgctgttcatgtgtcctccattatcaagcgcgaagcctctgaagaaaaaagaaggagtagagacgagagtcgtcatcacgaaaaggcagggcgaacgaaatcagtgtcctatctttgctttcctcttatctccgatgagaggtaa

SEQ ID NO: 68656 - DNA, 297 bp, Glycine max
  Peptide Sequence Number=SeqID_160341
atggctaagtttgacccggatattgtcttagatttttacgctaatgcttggcccacggaggagggcgtgtgggacatgcggtcatgggtaaggggccagtggattccttttgatgcagacgccttcagccagttcctgggtgacccgctagtgttagaggagggtcaggattttgctcgaaccgctgccgggaggcgggtgcggatcatgcgcaccagcatgccccccttgattcagatgtggatgacgttgctgttcagcaattttttgcctagcgatcataattccgccctgtga

SEQ ID NO: 68657 - DNA, 1975 bp, Glycine max
  Peptide Sequence Number=SeqID_160342
atggcaatttcactggtcgaaaacgcgaaaaagaaagaaggctttatcgacttcacgccttatttcaacaaaattaagcacaagcttatctggtgcctggtggtggtgattgtcgccgccgtggcgtcatttattctgacgcgctttatgtcttccagctacacggcgaccgctaccgtgctgttcaaagcgcagtcgcaggacgtctctcctctgccgcggctggaaaactacgactccacgcgcagcgattactacgagaccaagtacgcgttaatggggtcacgagtagtgctcgatgccgcggtgcgtaaattaaagctggagcaggatagcgaatttaacggcggcgataatctcgacgaaaccgcgcgtattaataatgctattcaggcgctgcaaaaaagcctgaccatttccggcgtgcgcaccacccaactggttgccgtatcgatggaagcgaaatcaccgcagaaagccgccgatatcgccaacggcgtcgcccaggccttcatcgattacagcctgcagcagaagcaaaacaccttgcttcaggcgcagggctggaacgaaaaaatgatggacgacctgaaaaccaaaatggatcagcagaaggcggacatcgataacttcctcaagcagaacggattgctgaccttccgcagtatggatggttatgagaccgagcggctggggattgtgattaaccatctggccgacgccacccagcgccgcctgaaagcgcagacggtatgggacaaggtccgccgccagcagggtaaaccggtagagcagattatctcgctgccggaaatctccggccatccgcaggtgcaggatttacgcattgccctcatccagacccggcgcaatctttccgaagcggccaaacactacggcccgcagcatccgaaatatctgcaggcccaggcgcagctgcaggcggtgaatgcccagctcggccaggtattgggcgagctgtttaacggcctgcgccagcagtatcaaatcgccctcgacgatgagcagcactaccaaaaaatgctcaacgatcagaaggccgatttccaggcactcggcgccaagcgcgaccagtacaacaccatgaccaccgcgctgaataaaaccgaagagctttataaatcactgtaccagcgcgctaatgagcagaaattgtcagagaccttctcggtaccggatgaagtcatttacgacgccgccgtaccgccggatcgtccatctaaaccccagcgcggcctgttgatcgtgatgattaccctgatggcgctggcgctgtatatcatgtatctgatcgtcagtaccgcgctggataaaacggtgaatagcctcagcgagctcaaagcgaaaacctccctcgaggccagcggcgaatttccgctactggcgcatctggaaaacgcgcagcagattttccataacgtgctctacgccgatatgatccacagcctgcggctggcgttgctcaatcagcgcgataaacccgccaccatcctggtgacttcggtacaatcccgctccggcagttcgtatattgccgaactgctggcctgctcagccagcaaatcgcgtaaaacgctgctgattgacctcgactacctggccactcaggggttatcggcgaaatttccgcaacataaacagggcttcagtcaattgctgaacggcgagtgcatgccggagcagtccgtcgtcaaactggatgatcaactggactttataccccgcggcaagctcaacgactcttcgctgctgttgctcacctctgaacgcctgccggcgctgctggcaacgttgcatcaaacttacgatacgctaatcatcgacgccccggcgctgaaccacgctcaggatagcctgctgttggcggcacaaagcgatattactctgctggtggtgaaggccggcgagcaggctccgcggatccgcaaagcggaacaacgtctgcagagcgcgg

SEQ ID NO: 68658 - DNA, 718 bp, Glycine max
  Peptide Sequence Number=SeqID_160343
gaagaagttgttgaaaagtttctgaagaaatatttcccagagtcaaagactacggaagggaaagtggtaatctcttcatttcatcagttccctgatgagtccttgagtgaagcgttggaaagaccacaaaccaagcaactactagatgcttcagtaaggggaaaaataaagttgaagacccctgaagaggcaactgagctaattgagaatatgtcagccagcgatcatgacattttgtgcgatagagttcatcaagccacaaagaaaagcttgttagaactatcatcacatgacgctttattggcacagaataagttgctttctaagcaacttgagattttaacagaaacactcggtaagctcatgaaacaggccaatgtattcccattgaagaacacactcaagaagttcactatatgggaaatcaacagagacaaggatatactcaaggaggattttcaggcttccagcagggtccttttaatgaacaaggataatggagatcacaccctgccaatccaacaagggcctaacatctttcagaggactactaagctggaggagactttgactcagtttatgcaggtaacaatgtcaaatcataaaagcactgagtcagcactgaaaaaccttgaggtccaggataaggataatgtagagtccaagaagaaagttgctgaaaagaaaagtactgatgaaaagaaagatgatgtgatag

SEQ ID NO: 68659 - DNA, 354 bp, Glycine max
  Peptide Sequence Number=SeqID_160344
atgggcacaatgatagaggccatgatgagcatgaagaagataatgaaggtcaatgcggctgcagtttccgctactagtgtcgttgttgaggtggactggactcctacatctggcctcaaccaaataaatcaggccatctcagatatggtagggcagaaaggcaaagaattgggaagtacaagcggcccccattttgtgcaagttcaaaacaagcattccattccaccatatggcttggctcccaaccatacactacccaatgttgcacacactcccaatgaggatgtcaacaaccctgcacccatacccattgagagccaacaaccccaagctgatcatgcacatgtctcttaa

SEQ ID NO: 68660 - DNA, 129 bp, Glycine max
  Peptide Sequence Number=SeqID_160345
atggataagagcttgaaggtaggagaagatgagtggaggaagagggagagaaggagcacgaaatttcgtgtcccaaatgagcatacaaatccaagatcaagtccaagattctccactaagtgtgcttag

SEQ ID NO: 68661 - DNA, 255 bp, Glycine max
  Peptide Sequence Number=SeqID_160346
gaacatgagatggaacttcaacggctaaatcaaaatgaagaaaccgacaagaggaaacaaagcatagcactaaaagcctcatcatcaatgcaagatgaaaatgaagatgaagaatcagaagatgaagaagacttctcactctttgtgaagaagtttcacaaatttgtcaagaagagaagaatcgagaggcatcaaaatttcaaccatggaaaaagattccaagaagacactccaactcttagatgctacaagtga

SEQ ID NO: 68662 - DNA, 262 bp, Glycine max
  Peptide Sequence Number=SeqID_160347
tctccgcgcatagacaggctcatttgcccctggttgacgaaaggtgcgggtaaccataaggtccgcatgtcacttgacttcacgggtaaccccgcatgtcaggtgacttcactggtcaggacgacaaaaggtgcagaagacaatgttagtcttcgcgcgtcaacgggctcgtttttcgctggtgcagaagacaatgttagtcctcgcgcgtcaacggggctcgttttccccttgtttacaaagggtgcgggtaaccataaag

SEQ ID NO: 68663 - DNA, 175 bp, Glycine max
  Peptide Sequence Number=SeqID_160348
atggagtggcggtggattaagctttaccggtacaccacatggagatgtcattggttatagaatgaaatttgaccacgtgacagttggacagttcttatggaatccatatctccactttttggatgctttggagtcgatagttttcgtagactatggacagcctgcacccctctaa

SEQ ID NO: 68664 - DNA, 1260 bp, Glycine max
  Peptide Sequence Number=SeqID_160349
atgtcgcccaggtcggtgccatccacccaggatgcgaccgtgctggggctcgatcgacttcagtgccagcttgaacagcgtcgacttccctgccccggtctcccccatcaggaagttgatgccgccgcgcccggcgtggaaggacgcatcccggacgccgcgtccattgccgtagcgatggctgacatgctggaactcgatccggccgcattctccgtggaatcggccggccgtccacgaacgggcaacgtcatcgatcgagcgcgcgatcatttcaaagggcatgttgagctgcagcaacagcaggttgaacagcacgatatcgccgacgctcaggtcaccgctctgatagcgcgggagcagcagtgcgaaggtgacgatgaactcgaccgccaggccgatgcccagcagcgcgatgaagccgacccgctgcagcacgtaggcccgccagctgtcgcgcacctcctgggccttctgttcgaagcgctggatcatccacgcgctgccgccgaactgccgcagcgtctccatcgcgttcatcgcattgccgacgaagcgcgcattctgctggcccgcttcgaccgccgcctcacgatggatccgtgctcgccgcgtagcgatggccgagagcgtgacggccacagaaccgtagcccagcacgatcgccaccatctgcaggttgatcagcgcacccagtgtcagcagggtcagcaggatctgcagtgcgctgggaatgaacaccaccaggccaagctgcaccacgatcttcagggcgttgcggcccttctccccggccacctgcagttcggctgcgttgtaatccaggaagaagctgtgtgtcttcttcagcagccgcgcgaagtagcgggtgctggtgatgaaacccaggttctcgccactgaggaacgacaggtactgcacggtgttctgcaggatgctggcggcgccgagcatcaccgcgtagagcaggaaccctcccgccagttcacggatgccttccgtgctgatgcggtcgatcaggcgcgagaacaggtacggcgctgccaccgtggccaggctggaaagcacgacgatggcggcaatcaacagcagcagcctgcggtccgccttccagtacgcggtgaggatctcggtgaccggcggcggcagcgcgaacattctcatcagcgtcggtccggcatcggtgcagtggctcctgtgtggcggtgtgcctgctgtcgcctctcggcacagcaagagatcgtcgcgcatcttgaatga

SEQ ID NO: 68665 - DNA, 537 bp, Glycine max
  Peptide Sequence Number=SeqID_160350
atggccaagttcggacacagacatagtcctggaattttatgccaatgcttggcctacacaggagggcgtgcgggatatgcgatcttgggtaaggggtcagtggatccctttcgatgcggatgccctcagccagttcctgggataccctttagtgctagaagagggccaggagtgcgagattttgcccggactgctgccgggagacgggtgcggatcatgcgcaccaacatgactaccctgacccagacatggatgacgttgctgctcagcaacatccagcccagtgatcataattccgacctccccctgccgaagtgtcagctggtgtatgccatcctgacacggatgagcattcacgtggctcagttgatcgctgatgccatttatcaatttgcaggtatgccacataccaggcaccctctggacccagataagtctaacagggccctgggttttccggcattgatcacgggtctctgccagtcattcggggttcttgtcgcacccagtaaggtgatccgaccgccgatcacctga

SEQ ID NO: 68666 - DNA, 282 bp, Glycine max
  Peptide Sequence Number=SeqID_160351
atgtcgggactcatacgcgattctcctcaaattttagccagcccgcatcaattagactttgcagcttacgcttcagggttatacaatgctcaatggaatgccccggggctcctccatgataagcacacgttgtgttcgagtcatatccttagaaaaatggaggtgggttttgttgttgatttagggatggcctttgtggataaatgggtggtaggtaaggagaagggttgttattggctgagtaatgacattgttggattggtgggaaacttggccatgtag

SEQ ID NO: 68667 - DNA, 141 bp, Glycine max
  Peptide Sequence Number=SeqID_160352
atgaaatggaggggattgttctcagggttggttactgggtctgatgaggaaagtgtggaatttccagggggaatttatggcagtgagaacgagagaaagaggatacaaaggatgtgtcttggggaggtttcaggaacatga

SEQ ID NO: 68668 - DNA, 798 bp, Glycine max
  Peptide Sequence Number=SeqID_160353
atgtttgcagatctctgctacttttctgtacgctcagttcagctttcatttgtctttcttgttttgccgtgcctactattgggttatttgggtcaagctgcataccttatggaaaaccatgctgatgctggtcaaagttttttttcttctgttccaagtggtgcattctggccaactttccttattgctaacattgctgcacttattgcgagtcgggctatgacaacagcaacattttcatgtataaagcaatcaactgcactcggttgtttccctcgtcttaaaatcattcatacttctctgaaatttatgggccatatctatatccctgtgataaactggttcctcttggctctttctctggtgcttgtctgcactatatctagcattgacgagattggaaatgcctatggcattgctgagctcggggtgatgatgatgaccactattttagtaacccttgttatgcttcttatatggcaaatacacatcatcatagtgctgaatttcgtggtactcttcttgggattggaaggctgtaatctcgggacaatacgagctcctaggattggtttgctttataatgagttggtcaaaggaataccggcaatttttggtcattttctgaccacacttcctgcaatacactccatgattatatttgtaagtatcaagtgtgttccagttcctatggtgctgcgttggattttgtttcttgtgatgactccaaagtttgtcttctgtcatgtgtggtggttaagcattgttcatttgttagcttctatcatgagtgattaa

SEQ ID NO: 68669 - DNA, 297 bp, Glycine max
  Peptide Sequence Number=SeqID_160354
atgttgaactcttggaagcatagaacattgtctatgggtggtcagggaggtgtggggatcaaaaaccttagctatttcaatgaggctttaccaggcaggtggagatggaatctcttcaaccacgatgccttatgggtaaagattctagaatcaaagtatgagggggtgaaagggtttggtggatggatttatgttctatttgtgaaggtagtgaggcatctaattgatttgtgtctgattgcaagtggaagtttgggagtggcgaaaaggtgcggttttggcatgatatatggttga

SEQ ID NO: 68670 - DNA, 2625 bp, Glycine max
  Peptide Sequence Number=SeqID_160355
atggggcttgaggcccttccaaggggagagcctcatttatctatggaaagaagccacagaagagactattctcaacaaatgtatggtcctgtaggcttaccattcaagcattggcaacaggaagataggtttatggatagggaaatgcttcatgaagttcatccaagcacagaacaggttgcttacaaagatatgtatgaaatatggcagcaatctcagagagcaagccatgacagaggaaagtggagtgaagatgttgatgagaaaagaatggctctgattcgacagaaattcatggaagcaaaacgtctgtcaaccgatgagagactgcaccaatctgaacaatttaaagatgccttggaagttttaagctccaatagtgatctcttgatcaggttattggattctcaaaatgtttctgatttatactcaacttcacctaatgagacaaagcgcattactcttattaaacctttgaagatggttgacaacgacaaatctgccagaaaggagaaaacgaataatagaccgattaagaaaccatctagtgttgatcaagcaaatcctggaaactctccagatagtcagaaagttgatgaatctccggtccgaaccactcgaatagtgttactaaagccaagcccagggaggacacctgagcaaaaggctgttgtttctccaacaacttcgctgaatctgaaaagcagaaatttccatcatggacctgaatatgatgatgtactagaatccattagagtggcaaatgagatcacacagcaaatgcataaaggcccgaggagctatcaaaaggataaaactctgtattcctcagtgttttccaatggctattctgatgatgagagttcattcaacaaatcatatcatgagtatgcatctgcgaatttcagtgattttgaagctacgtcaatgtcaccattgccaaggctttcgtgggattacaattacatcaatggctatggcagcccttattctagaatgtccttgggccgtgtgccatgctctcccgagtcatcggtgtgcagagaggcaaagaaaagactttctgaaagatggactatgatgacatcagataataagggtcatcaagaacaaaggcaagcaaggaaaagctctaccttgggtgagatgctttctcttacccacaaaaagaaatctgtaacatctgaggttgagagtatcaatgaggaccaagaacctggcaaatctgtttcttgtagtcattctttcaatgcagaaataagcattgagggttctcctaaaaatctccccaggtcaaattctgtgcctgcatcttctactgtatatgaaaatggcctcacagttaaagtaaatgatcataagaatactggcaaagcacaaggctccaaggagcagaaaaagcctaagagtatgagatcatcttttaaagggaaagttgctactttcttgttctcaaggagtaagaaatcaaccaaggaaaaaccaagttcatctcaatctaaagatgcatcccaatctacttccactgtcactgcaacattagttcttccagcaaattcacctggagtccttaggggtgatgtgtctcaaagcatcaatgtggatggttttgaagagtgttctcttgcagcgctatgtgaatcatcagggaaaaattcaacagattcagtctctaacggacatgaagaagacatgattacactagagcctggattgactatgccaaggcccatggtgccagagattcattcaagcgaaaacccagatcagccaagtccaatctcagtgttacaacctccatttgaagattataataataataatgcatcacatgagtccttgaactgtatgaagagtggtgaccaggggtcacaggtgccactgaagtccaatttaattgacaaatcaccacctatagaatcaatagctaggaccctatcatgggatggttctagtgcagaagtggcaagttcctatgcattaaaacccttaatggtttcttccttggactccaaggtagaggatcaagagtggcttctcttggtccacaaactactatcagcagctggacttgatgatcaacaccaacatgactcatcttacactagatggcattcccttgagagcccattggacccatcactgagggacgcattatacgccaatctaaatgagaaggagcctcagccaattatgcatgagcgcagaagaaggaagatgagatcaaaccacaaacttgtgtttgactatgtcaatgctgcactattggaacttgttggttatgggtcagaaaagtgcttaaagagaagtaagagccactacagggtccaagtccaagagggtgcatcagcagcagcatctcccttattggtggaccacattgtggcccaaatgaaggaattaatagcaagtggggtgaggtgtgagtgggaaaatggtggggccagcaccagcctggtggtagaaaatgttgtcagaaaagaggttgtgcaaatagggtgggttgagcttatggaattggagattgatattttggggaaggagattgaaggggacttgattcaagagcttgtggagaatgcagtggttgatttgacaggcagggcctctgagtccctctcttga

SEQ ID NO: 68671 - DNA, 672 bp, Glycine max
  Peptide Sequence Number=SeqID_160356
atgggagaagtgaagctactgggagtttggcctagtggattcgtttacaggatcatatgggctttagagctgaagggcgtaaaatatgagtatatacaaggagaattcaacaagcctgatttctctgatttgctgttgaagtataacccagtttacaaaaaggttccagttcttgttcttgaaggaaagccaatcgctgaatccatggttattcttgaatacatagaggaaacatggccacagccacacttgcttccacaggacccgtatgagagggccgtggcaaggttctgggttagttttgcagaggaaaagagcgtttcttttatgtcattctttgtgagtgttggagaagagtttcagaaggcaagaaaggaagtcagagaagtgctcaaagtattagaagaaaccattggggacaagaagtattttggtggtgaagaaattggactgttagacataaacttgggatggatagccttgttttttggagtcattgaagatgttgttggtattaaagttttagttgtggatgatttccctcgcttgtttacttggattcagaacttcagggagcaccccgctatcaagacaaacttcccaagtcaccaagagttgtttgattattacaagcagaagagggagaccatggttccatcccagatagcatga

SEQ ID NO: 68672 - DNA, 960 bp, Glycine max
  Peptide Sequence Number=SeqID_160357
atggagctggtgacgatgtcaagaacaagagtggtcctcatgaccctcaccctggtggtggtgacagttctgaacaacacagagagtgcagaaagtgctcgcactttctatgtgttcggggactctctagttgacagtggcaacaacaattacttgccaaccacagcacgcgctgactctcctccttacggcatcgactatcccaccggtcgccccactggtcgcttctccaatggctacaacctccctgaccttatcagccagcatattgggtctgaacccacgttaccatacttgagccctgaactcaccggacaaaagctattagttggggccaatttcgcttccgcggggataggaatccttaacgacactggcatccaatttgtggggatcttaagaatgttcgagcagtatgcgctgttcgagcagtaccagcaacgattaagtgcattagtgggagcagcgcaggctcagcgaatcgtgaatggggcactgttcctcatgacacttggtggtaacgatttcgttaacaactactttctcactcctgtgtctgccaggtctcgccaattcactgtccctcagtactgtcgttaccttatctccgagtatcgtaaaattctcatggtgtcggacactgacatggacgcgtgtcaaacaccggaatcgacaaggagttggagtaggttgtatgagttgggagctagaagggttcttgtgaccggaactggtccattgggctgtgttcctgctcagcttgctactaggagtagtaacggagagtgtgtacctgagttacaacaagctgcacaaattttcaacccacttttggtccaaatgacaagagaaatcaactcccaagtgggctctgacgtatttgttgctgtcaatgccttccaaatgaacatgaacttcatcaccgaccctcaaagatttggtctctcaacatttgcttga

SEQ ID NO: 68673 - DNA, 654 bp, Glycine max
  Peptide Sequence Number=SeqID_160358
atgggagaaaaagtggtttgtgtgcatacattagaagaaggaaagcaggagaacaatgaggagtcaaggacggaactgaagcgtgactacgaccaatgcgttgctgatactgaacctcacctgtctcctaataagaaacaagcaaaagaagtttccaatgatgaagtgcgctctgaggtttctaaccccaacgtttctgcagcagagcttgcgcaaacttttccagatatcagtatccaaccaactgaatccgaaaatgtcaaccatgcagagtgtggggaactgacgtctacttgtttggagaattcaagttctgatgagaccttgagtgatgaagccggtgaacagaataataataataataatacttctcagagtgataaggacacaagtagtgctgcaatgacatcctgtgtagtgatggaaatccccaagcatgcaagttcatctggtatcaggaaaattacttttaagttcagtaagaagaaggaggactatgattaccaaccgcctccacctatgcaccatcctgctctttacaatgatggcaattacattggctttcatgggaatgtgaagaatatttggcaagggatgattgtaggggtgaccataattaagacagcttttcaacagtttaccaagttctgttaa

SEQ ID NO: 68674 - DNA, 261 bp, Glycine max
  Peptide Sequence Number=SeqID_160359
atggtgggggtcgtttccgacggagtcggcgtcgaagatgttggagcggagatcatagccatcaaggagagcttcaactcgctgtttccaattaggataattgttgggaagaagtttggtgacattggtgaaagtgatgcaaggaaggggtttggatggctcatgggggttgggaatgaaggagttgttgtcggccatgggaggcaagggtggggaacgacgtccttaattgaagaaatagggaatgggtggatcgtttag

SEQ ID NO: 68675 - DNA, 1638 bp, Glycine max
  Peptide Sequence Number=SeqID_160360
atggctgattccactccgactgcaactccttcaaacgacatcgtatcaagctctttccgacgaacggtcaccttatacgattggtggttggttatagccaaaaacgacttccaaggaaagcgtttagccgtcgctggcgtctcgtcgagaaaggatgaggcaacgcgtgtgtttgtttctgctgctgttatcaaaagatatgacgtgttttctctcgagactgcggatgggatatgcgtcataatcaggggcttcatcaacgagcagcgcactctcgaaaatggtttttccgccgaggttttccaccattttttatttggctttcctccagactgggaaaggtatgctctagattgcttcaaagaagaacctaccactgatgctgatttgggtagtgttgttcctgataatgcaccagctagctgtccaaaaattttatctgatggtgtggaaaaatctattcctacctgtttggtatcaccagaggaggcctcaggagatcacgaaatgtcattccccgaaaatgaatgcaacgtgtcaaaggagatgggtggggttcatgttgcttgtagtagtggtgggaaaagccatagtttcaagttgcacaatattaaagtatgccagcagaagaagcagcctgcttctgaatgtcttccgaaccatccagataatgagaactctagttcagtggccttggagaattgtaatgtagagagactggaaagtccgacaacacccattcagccgcaattgtggagtgaatattcaaacgatgcttgtgtggaaaatgctattcctacttctttggcatcagaggaggccccgggagatcatgagaagtcattccctgaaaatgaatccaacgtgtcaaaggaaattaatggggttaatgttgcttgtagtagtggtgggaaaagtcgtagtgccaggttgcatgatattaaagtataccagcagaagaagcctgcttctggagggtctctgaagcatccaaataatgagaactctacttcagtggccttggagaattgtgatgtaaagggactgaaaagtccagcaacacccattcagtcacaatcgtcaagacaactaagcacatcacctgggcaggtaattaaaaaatctgcatccaaaatttctagaacattgtcaccaaagactgaaggctgttataagaaaaagagagtgacagttgaaacaaaagtggtcatgcccaagggaaaactgaataaatctgcatctgctttgaaaaatccacgagaaaaggatctaagccccttggccaagggaagccaacagaaaatatccacatttactccagagtcactaagtttcagaaaatccagatccggtaggttgcttctacctcccttagagttttggcgcaatcaaataccaatttataatgcggaccacgagattacagaaattcgggatggtgcatctctgatatcaccttgtagaggtttttcaccatcattgagtagacgacatttcctcagattaaaatatctatgcacacttgatgggttttctggaaaatttaggagtcaacttgatgatttcattgatcaattaggtagaatatccactgaagttctagcactatttatgaaacaacatatctcacagtgttaa

SEQ ID NO: 68676 - DNA, 3984 bp, Glycine max
  Peptide Sequence Number=SeqID_160361
atgggagaagaagtggtttgtgtgcatgcattagaagaaggaaagcaggagaacaatgaggagtcaaggacggaactgaagcgtgactacgaccaatgcgttgctgatactgaacctcacctgtctcctaataagaaacaagcgaaagaagtttccaatgatgaagtgcgctctgaggtttctaaccccaacgtttctgcagcagagcttgcgcaaacttttcaagatatcagtagccaaccaactgaatccgaaaatgtcaaccatgcagagtgtggggaactgacgtctacttgtttggagaattcaagttctgatgagaccttgagtgatgaagccggtgaacagaataataataataataataataatacttctcagagtgataaggacacaagtagtgctgcaatgacatcccgtgtagtgatggaaatccccaagcatgcgagttcatctggtatcaggaaaattacttttaagttcagtaagaagaaggaggactatgattaccaaccgcctccacctatgcaccatcctgctctttacaatgatggcaattacattggctttcatggggatgatgaagaatatttggcaagggatgattgtagtggtgggtcgttagaaagcccgtgtggaatgggatatgttcgtgatggagatttggacttgtacactcgcaatatggaattgaaaatgtccaagaaagtagtccccaactgctaccctacaaatgtcaaaaagcttttatcaactggcatccttgacggagctgtagtgaagtatatttacaatcctggaaaggttgagctacaggggattattgatggtggcggatatttgtgtggctgttcaatgtgcaattactctagagttcttagtgcctatgagttcgagcagcatgctggagccaagactagacatccaaataatcatatattcttagaaaatggaagaccgatatatagtattatacaggaaataaaaactgctccactcagtctactagatgaggttataaagaatgtggctggttcatctgtcaatgaggagtccttccaggcttggaaagaaagtcttctacaaagcaatggcaaggttcaggctcataaaagttatagcaccaaacttgtcggtatgcctcatacaaacataagcctcgttaatggtggtctcaagttaatttgcttagtcctgatgctttgtcagccagtgctttcaggatttgggaattgtcaatctgtagaaagtacaagccatttgtcatctttgcatgtaccgagtcattatgagcagcacatgtatatgaatcagacaactgatgaatggaagcgtgtggtgaaaaagccaagctcctacacttctaactcaggtgtactgcagaaaagaagtgctgatggttgcactaagagaagggacaatgatttacacaggttgctttttatgccaaatgggctaccagatggtgctgagttggcttactatgtcaaaggacagaaattacttggaggttacaaacagggaaacgggatagtctgtggttgttgtgatatagagataagcccttcacagtttgaagcccatgctggaatggctgctaggcgtcaaccttaccgacacatatatacttccaatggattaacacttcatgacatagctctatcgttggcaaatggtcaaaaccttaccacgggagacagtgatgatatgtgtgcagtatgtggagatggaggagatttgattctttgcaatggatgccccagggcatttcatgcagcctgcttgggtttacagtgtgttccagacagtggttggcaatgtctaaattgtatagataatgctggtaatggaagagaatcttctattgtgaggccaatcatgatacgattgacacgcgttgataaaacaccagaagttgaaatgggaggatgtgttgtttgcagggaacatgatttcagtgttgctaaatttgatgaacgaacagtaataatttgtgaccagtgtgagaaggagtatcatgttggctgcttgcgggacatggggctatgtgagttggaagagctgcccaaggataagtggttttgttgtgatgactgcaatcgaatatatgctgctctacagaattcagtttctgctggagcagaaattataccagcttccttttcagaactaataatcaggaagcatgaggacaagggattatgtacctatggggccatgaatgatatccagtggagaattttaagtggaaaaagtcgttatcctgaacatttaccattgctttcacgagctgctgcaattttccgagaatgttttgatcccatagttgccatttctggtcgtgatctgattcctgttatggtctacgggagaaatatttctggccaagagtttgggggaatgtattgcattgttttaattgtgaattatgttgtagtatctgctgggcttcttaggatttttggccgtaatgttgctgagcttccacttgttgccacaagcagagcacatcaaggaaaaggttattttcaagtgttgttctcttgcatagagaggttgctgtcttctctaaacgtggaaaagttggtgcttcctgcagccggggatgctgaatcaatttggactaagaaattgggcttccgaaagatgagtgaagatcaggcgtttaattctcccctacgcaatttgaggatccgtgccgtttcaaccaaagagaatcacataccagctgctccaatttttctccccgaaggaccttggaaccagattccaggtggagttactgctgccgagggattcaaagctgcgggaatgtacggaggtttacgtgccaaaggagaaaagcctgatctcgcgcttgtcacgtgcgatgttgatgcagtatctgcaggatcgtttacaacaaatgtggttgcggctgcaccggtgttatactgcaaaaggacgttggatatttccaacactgcacgtgctgtgttaactaatgcaggtcaagcaaatgcagcgacgggcaaagaaggttaccaggacatgatagaatgtgtggaaagccttgctaagctattgaaagtgaagccagaagaagtattaattgaatccactggtgtaattggtcaaagaataaaaaagggggcacttttgaactcacttcccactctagtaaattcactgtcatcttcagttgagggggcagattctgcagctgtggcaatcaccactacagatcttgttagcaagagtgtggcaattgagtctctgattggaggaactaaggtcagagttgggggaatggcaaaaggttctggaatgatccacccaaatatggctaccatgcttggggtaataacaactgatgcccggttaaccagtgatgtttggagaaagatggtgcaggttgctgtaaaccgaagtttcaaccagataactgtagatggagatactagtactaatgatactgttattgccttggctagtgggttgtctgggcttggttgcatatcttctctagacagtgatgaggctattcaacttcaggcatgcctagatgcggtaatgcaaggtcttgccaaatcaatagcttgggatggggaaggagcaacatgcctcgttgaggtctgtgtgactggtgcaaatagtgaggctgaagctgcaaaagttgcgcgttcagttgcatcatcttcacttgctgctatatatggtagagaccccaattggggacgcattgctgctgcagctggttactcgggggtttcattccatcaagatttacttagggtagagctgggggatattttactaatggatggcggggaaccacaattatttgaccggcacgcggctagtagttatcttagaaaggctggggagactcacgacacggttaaaattcagatatcagttggcaatggaccaggacgtggacaagcatggggatgtgatttaagctacgattatgttaaaataaatgctgagtacacaacatag

SEQ ID NO: 68677 - DNA, 1668 bp, Glycine max
  Peptide Sequence Number=SeqID_160362
atggcgcgaccaaggattcttatgagtttctttatggatttaaacatcttgaatcaaatgttgaatgctgcatctctaaacagtcatgtgatgtgcttttatgtgggtgggtggggtgttctctttatcggcaatgatattttgcataagttaggcaaggtcctcaggcacatcattgccaggattgcatgccgagactatcctcacgcgcgacatctttgtggtaaatttccattctcttccacaccccacaagcagcactgtagccagtgccattgttatgtatgtgactccctagcaccatgtctcaagtggggcactggcatttcgagttctgatcattgtcacgcaaatgaaactgaggtgtggcaaattcagagaaaaaatttcaagctgggccagagttccccattaccagcttcaactaattttggcacttcactcagaccaggacatccccatcataatgaacttctgcctccttgtgttaataacttgtctccaaattctgtattaccgaatcaagcatctatatccactgcagtgtgtagtatcccctcactcagctccatacctcaaacccaggcctctcggctaccaacaacgcgtttcctctctgcctcttcaccaaattccagtgttcaaaatcaggtctttaggccaattaacacccctataatgtccccagccaccaacataacaatgccaaatggtgcaaaccatggtatgcgtcggggatcaagacctactttggtgagaaacaaataccagcctcactctgtaccaaggccagcactgggtgtacgtagtcacaccatccaaagggagcgaggaaatggttcaagcagtttaagacctaaggtccttcgtcctcatatgatgtccaggggtgtaggcagtgctgggaacacttcgatggcaaataattctcatggatcatctgtcttcggcaatgctggtaatatgacacaacaacatctcaattattgtaccacaacaggaatgccaaattacagaaattgcaatgggccatctgatctttgtcacccaacaaatatatcattttactcacagccgagctctctaccagctagcctgagttgtgttaaccagcataatgtggctgctgaaacacaggcatatagccagccattgccccagtcaaatatcattcagggtttcgatcaaaattgtatccaagttagtcgtgctccttcaagttatgtggcacacccaaatagcagtcagcatggaaaagagcctcaaataagaagtcaaaatggaaatgccagtggaattactacacaatgtggaacagtaagtcaagatacttgccaaccacaaccacatgaagagtcaccaagggaaactgctggaaaattttcagcatttgactcaagttggatagataatactggtcaaagcattctacaaagctcaggatctgtagtgcaaccacccaatgtcaaggagattgatgctcagtttactggaagcaatgaacctctgattgaaagctctcaattacccaattcaatggttgatttagatgactgggttttggaaaaaaacccttttccagtgttaacagatggggttttaccatctgatatgaatataccatctccagatctttactcaattgatatgaacatgggtttatggtaa

SEQ ID NO: 68678 - DNA, 135 bp, Glycine max
  Peptide Sequence Number=SeqID_160363
atgggagggggtgtgcccatcgagcttgccattgaccaaaaaggaattagtctcaataaaacaaaggctgactcagaaaaagaatctgataaaaatttatccctgcaggataacaattcaaattttagtccctga

SEQ ID NO: 68679 - DNA, 1227 bp, Glycine max
  Peptide Sequence Number=SeqID_160364
atggaggcaccatctgtcattgacattgacacgctcaaccttaggatgttcgtggggacttggaatgttggaggaaagtcacccaacgagggattgaacttgagggattggttgatgttgccttcacaagctgacatctatgtcattgggttccaagaaattatacctctaaacgcaggaaacgtgcttgggccagaggacagtggcccagcatcgaaatggctgaaccttattcgtcaagccttgaactctaacacaagctccagtggagaaaattctcctacatcgtcttttaacagtagaaggcaatgctgcccaaatgaacaacactattattgcctagcagcaagcaaacaaatggtgggtatcttcttgtgtgtgtgggtacgtgcggatctttacaagcatgtcagcaagttaaaggtgtcttgtgttggtagaggcatcatgggctatctaggaaataagggttcaatatcaattagcatgacattgtaccacacaacgttctgcttcgtttgtacccacttggcctccggagagaaagatggtgatgaggtgcgaagaaatttggacgtttcagagatattaaagaaaactaaattttcacactcattcaaagcacttggccaaccactccctcctgaaagcatattagagcatgataagataatttggcttggggatttgaattatcgccttgctgctgcttacgatgatacacttgggctgctgaagaagaatgattggcaggcactattagagaaggatcagctaaggatagagcagagagctggtcgagtattcaaagagtggaaggaagggaagatatactttgctccaacttacaaatatttatttgattctgaccaatatgttgcccaaactaacaagtccaaggaaaaacgacgaactccggcttggtgtgatcgaattctatggagaggtgaaggcgtggagcagctatggtatgtgcgaggagagtccaaattctcagaccacaggccagtgtattcactattctcggttgacgtggacttgacatgtaacaagctaagtagtccctctattgctgcatcagatagcagctcaataatctcaacaaggtcgtgttcctctagacccttaacaaacgctgccttgtcctcatcttgctttgctaaagttcaggctgaggaacaacttttgttactaaccagggtacatagacacagggttctgacttag

SEQ ID NO: 68680 - DNA, 258 bp, Glycine max
  Peptide Sequence Number=SeqID_160365
atggaggtttttctgaatttacctttaattgcttttgcaggatccagaaggtcttttccatgtatacttgatcatgaggctgcagggattgtggaaagtgttggagaaggtgttactgcagttcagcccggtgatcatgtcatcccttgttaccaggctgagtgtgaagagtgcaagttttgcatattaggcaaaaccaatccgtgtggcaaagttcgagccgccacaggggtaggggtcatgctgagcaatcactag

SEQ ID NO: 68681 - DNA, 645 bp, Glycine max
  Peptide Sequence Number=SeqID_160366
atgtcttccgaatctgttcttcctctccccgaaaatcccatcattgtggggtttggtggggttggagtcgattttcttgcagtagtgccatcttttcctaaacccgactccaagatcagaaccactgaattcacggtccaaggtggtggaaataatggaaatactatgacatgtgctgcccgtttgggcttaaagccaagaataatttctaaggtttcaaatgatggtccaggtaagactatgctggaggaactagaagctgaaggggtggatacctctttttttgtgtctgaagagcttagagttacaagcacgtggagattcttcctcctacaaatgcaaaaaagggaaggaaaaaaagtctcgaaggaagggacttcaccatttagctacatcatcgttgacaaccaatcgaaaacaaggacttgtatattcactccaggatatcctgaaatggtccctcaagatctttcacgagccaatttgttatctgcactggatggagcaagagtggtctattttgatgcaaggatgcctgacaatgctcttgtcatcgctcaagagaaaaatttccacaggcaagtaactcatactatatcacaaagtaaactactagagaatatcataagcacttgggacctgtga

SEQ ID NO: 68682 - DNA, 929 bp, Glycine max
  Peptide Sequence Number=SeqID_160367
ttgatgatcaaagcaagaagatggagacaaagaagaacgccaaggcagatactggtgaatctcctaatcctgcacacagtggatcatccaaacccaaacgtgtaactttttcggatcaagtggatgtttgttgtgatggcttaatccgtgggaaaaggtttacaccagaggaagatgagaaaattaagttggctgtttttgattatatagagtctcatggtttgggagatgaaggtctagatatggttctccattgcaaatctcatcctgaaattagagattgttggaaggaaattggagcagccttacctcagaggccttatgttagtgtgtatactcgtgctcatattttgtttgaaaggggtgaggatcgtaagtggacacctgaagagtatgaatttttacggaaggtcaaggagcaacatggatctgattggaaatcagtagctgaagcattgggcaaacatcgatttcatgtaaaggatgcatggcgtagaataaaattaaccaacacaaaccaaggacgatggacccaagaggagtatcaaaatttatttgatttagtaaacctggatctacgtgtgagagcttcacaggattatagaaaatcaaaacatggtatgctgcgagataatattggttgggaggcaattggtgacaaattgaccactagatccagtgtgctctgctgcaaaaagtggtatgataaattaacgtcgcctatggttgccaatggtgtatggagtgatactgatgactatcgcctggtaaatgctttatttactttggatgcttgctgcatggaggaggtagattgggacaatctgcttgagcataggcctggtgatgttgaaattcttgcaaaaagattttgccctgacttattggaagtaagagaggcctttgatgaaaaacctgtgatttgttga

SEQ ID NO: 68683 - DNA, 384 bp, Glycine max
  Peptide Sequence Number=SeqID_160368
aggcaggtccagggtaatgcaccacaggctgcggacgtgccgccacctcatcaggctggtccagccggattgtttgatacggagcagtattgcggcatttggttcgccagcaggtggccaaccaccgggcacatgtacagactcatgattgtcttttatcagatgagtctcagcctgcagagccagggctttacttcttttccgtgccctactccgaaccagttcagggcagaggtcgcatggcctggagattggcctgaggcccaggcaggagaggcaccagcgggggcaccaacagaggctcccgacgaggcagatgaggcccgcgaggacgaagagatgaccgatttacttgatttcttaggagggagcggggccacatga

SEQ ID NO: 68684 - DNA, 207 bp, Glycine max
  Peptide Sequence Number=SeqID_160369
atggttgacgatgttgctcagaggagtgaagatgtgcctcagatgaccgcggacatagatgtgactgttgtagaggacttaggtcgtgatggtgctgaggggtcacatgctgatgagggatttcctggtgggccccgtgacccatcagttttgacttcatttgcggagcatgtcgcacatgccatttggactggacatgtattataa

SEQ ID NO: 68685 - DNA, 145 bp, Glycine max
  Peptide Sequence Number=SeqID_160370
ccaagctcaatgcacgactggtgccaagctcaaatccacttactcgcgctaagcgcgagggtggcactaaagcacaccatagtgcctatttcgagaaaagagctctggaggcagcaagaggagcagcttttgcagagagacctag

SEQ ID NO: 68686 - DNA, 1735 bp, Glycine max
  Peptide Sequence Number=SeqID_160371
atgcaagagatcgtcaaaggttttctgaattttcaacagaatgtgtttcctgaaaggaaggatcttttcaagagtctggcgtccaaccagaatcctaaagctttattcatctcctgttcggatagccgtctggtgccagagctggtgacgcagtcggagccgggccagctgtttgtgatccgtaacgccggtaacatcgtcccgccgtttggtccggagccgggtggcgtgtcagcaaccatcgagtatgcggtggtcgcgctgggcgtaaccgaaattatcatttgtggtcactccaactgcggtgcgatgaacgcgattgcgtccaacgccgatctcgagagcatgccggcggttgaccactggctgcactacgccaatgcggcaaaagcggtggtggaagagcgcaactacgaatcggttgagaaacgcctcaacgaaatggtgaaagagaacgtgattgcccagctcaacaatatcaaaacgcatccttccgtttcggtcgcgctgcgcaaaggcaagctgcgcctgcacggctgggtttatgatattgaaagcggcggcattattgccctgaccaaaggcgactgtgaaaaggagaatcccatgcgtttatggcgtgttgcgctgctggctggcgcgctcagcggttcctttaccgcgctggcggctgatgtccaggtgcaggtattacaggacaagctcgatcatccgtggtcggtggcgtttctgcccgaccagcaaaccctgctgattaccgaacgttccggacagctgcgcagctggcagccgggccgggggctatcgcagccgattagcggcgtaccggacgtgtgggccaaccgccagggcggtctgctggatgtggtgctggcgccggacttcgcgcaaagccgtcgggtgtggctcagttataccaccgccgatgacaccggccgcgcgggcggcgtagtgggttacggcacgctcagcgcagatctccgtcagctgcaggattttaaggtggtgctggagcaaacgccgaaactctccggcggtgccaacatcggcacgcggctggcgtttgatcgccagggctatctgtacatcgcgttcggcgataactttgccagccgcagcgcgcagcagctggacaaactgtcgggcaagattgtccgtctgacgcaggacggcaaggtgccggcggataatccgtttaaccatcgtcagggcgcacgcgcggagatctggtcttacggcgtgcgcaacccgcaggggctggcgctcaatccgtggacgcagcagatgtgggagagtgaacacggcccgcgcggcggcgatgaggtgaatctggcggcgaagggcaaaaattacggctggccgctggcgacgtatggcattgattacagtgggcagaaagtgccggaagcgcagggcagcgccgttgccggcactgagcagccgctgttttactggcagcaatcgccggccatcagcggcatggcgttttacaatagcgcgcgctttccccagtggaaaaactcgctgtttatcggtgcgctgaaagataaaagtctgatccgtctgcgcgttaacggcgagaaggttgaagaggcgcagcggctgctgagcgaccgtggcgaacgcatccgcgatgttcgtcaggggccggatggttatctgtatgtgctgaccgatgaggccaatggcaagctgctgaaagtcgggctggcggatgccgccagcgccgcgcgcg

SEQ ID NO: 68687 - DNA, 195 bp, Glycine max
  Peptide Sequence Number=SeqID_160372
atggattgtcatcatcaaaaagggggagattgtggaagcaatgacttccaagattattttgatgatgccaaagaatctagagttaagcaagtttcaaagaatcaggagtcaaaaagcttcaagaataatcaagtttcaagaatcaagattcgagaacaatcaagatcaagattcaagaatcaagagaagacttaa

SEQ ID NO: 68688 - DNA, 345 bp, Glycine max
  Peptide Sequence Number=SeqID_160373
atgactgaagcacgtcaaaaaggggtacggaaacaaaataggggaggagcttgccacccagctcgcccaggcgagctcaggacgcccaggcgagccaggttgcttcctccagaagcaaccgccttctggaaggcccaagtgggcctgctttcgaaaaagttacgaaaactcacggattgcgtaacaatacttccttttggtttccgtcacattacggaatttcacggatggagtaaccacgcttccttttggtttccgccttctcgggacttcacatattgtgcaacaaacggtgccaagtacttcgaagcagtcaatcaaaggttgcatgccatcaagcaatag

SEQ ID NO: 68689 - DNA, 240 bp, Glycine max
  Peptide Sequence Number=SeqID_160374
atggttcccccattgttcctgttgttggttgtattgttgtccatactggaatccggaaaatccacctgcattaaaattgtttctgggctggttccccatggatacaacatcaagattgatgagctccaccataaattgtacatcttgcaacctgcaaaacataagaatgtgaagtatgcacaaaatgaatttgagttggcaacttacttagtgtttcagtcaatgcctcaagttgcttag

SEQ ID NO: 68690 - DNA, 1056 bp, Glycine max
  Peptide Sequence Number=SeqID_160375
atggtgctgttgcatgccacctacgtggtggtgcaggccgccgcgctggggtggctggcctggaagatggaacgggccggcgtcgccgccgaagaactggcccggctcagcgcgcacatcgggcgcgaagtcggcgtgttcgacctgcggttcgacgggcagggcatgcacagcgacctgggccgcagtttcaagaccaccatggacgcggtgcatcggaccatgagcgaggtgcgggcgaccgcgacgtcgctatccgtcgccttgagcgagatgatgcagggcaatcagcagctcgacgcgcacgcgggcacgcaggccgaatcgctggcgcgtaccgccgcgtcgatgcgcgacctggcggccaatgtccatgacaacgccgcgcgcgcgcagcaggcgcggcaactgaccgaccaggcgcgccagaccgtcgacgcgggcagcgccgtcgtggcgggcgtggcgaccatgatgggcgaaatccagcaggagtcgaaaaagatctcggaaatcatcggcctgatcgacagcattgcgttccagaccaatatcctggcgctgaacgcggcggtggaggcagcgcgcgccggtgagagcgggcgcggcttcgcggtggtggccaccgaggtccgggcgctggcgcagcgcagcgccagcgcggcgcgcgacattcgcacgctgatcgaaggttccctgcacaagaccagcgagggtttccgccaggccgatcacgcggccggggtgattcgcgaggtggtgtccagcatcgaccaggcggcacgcatcgtcggccagatcggcgaggcggggcaaacccagagcgcggatatcgacgcggtaaacctggcggtgtccaacatggacgaactggtccgcgagaccgcgtccgaggtggcccaggcggctcgcgcctcggccgcgcagcaatcgcaggcggcggccttgctgcgggcggtggaagtgttccgcctgcaagccgacccagcggccgatgccgtggccgcgccgggcgcgcggccgccatctgccgcgttgaggttggcgggcgcgtga

SEQ ID NO: 68691 - DNA, 546 bp, Glycine max
  Peptide Sequence Number=SeqID_160376
atgaaggtcgatatggagaccatgaaggaacaaatgacaacgatgatggaagcaatgatgagcatgaggaagatgatgaaggataacactgctacagttgtttctgcgagtattgctactgtgatgaactcgattcactcgaccggtttcaatcaagtgaatcgcccagtctcaaatgtagtaggtcaaggaggcgaggcagcaaaaaatgtatgtgggcctcatcatgttgaggttcagagtaagcattccttcttgccatatgggttgcctcctaattatacaccgcccactattgtatacgcttctggtgagaatatcaacaattctgcacccgtactcattgagaatcagcaaccccaatctgatcatgcacatgtctctcaacccatgggggaaacacatgaagtcccccaagacaacactctgaccggggcagtcattttctggcatccctgtgctgaatgctcccagaatatctcaatgtcgcctgttatcacaacccttgcattttgtaaggggagaggggcgttccctagtacttga

SEQ ID NO: 68692 - DNA, 102 bp, Glycine max
  Peptide Sequence Number=SeqID_160377
atgctccaaccccctaattacccctgcccgcatcatcaccatctaatatgtgctcagatatgggtatttgcttccttcttatgttgccccgtcataccctag

SEQ ID NO: 68693 - DNA, 519 bp, Glycine max
  Peptide Sequence Number=SeqID_160378
atggaggaatccagtcgggaaaataacaaagatcacatttcccagtcaagagggtccgctcttgacggtgaagaacacattggagaatggaggaatccaatcgggaaaataacatcaaaggccgctggaaacttgtatggaaaagaattccgctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcactaagcgcggcgggtgtggtggttacgcgcagcgtgaccgctacacttgccagcgctgatgtccggcggtgctattgccgttacgcaccaccccgtcagtag

SEQ ID NO: 68694 - DNA, 231 bp, Glycine max
  Peptide Sequence Number=SeqID_160379
atggcgttaagcatgcctttgagagctgagagcttggcggatagagtgcaaaaaacagagaacaaaggcgcaaaacaaagcaaggatgcaaaaaccttagcttttgggagaatcttaggtttaggagtgatttctaggtttctagaggtggaggagacatccccaccactgtgtaatatgttatttcctctgaaaaccctcttcctgcttgtgaaaggtgttgccttgtga

SEQ ID NO: 68695 - DNA, 369 bp, Glycine max
  Peptide Sequence Number=SeqID_160380
atggagtcaggtgacatgcgggggtaccgtatggttacccgcaccttccgtcaaccacgggcaaacaagtccgttgacgtgcagagactaacatcgtcttctgcaccttttgccatccagggacagcgagtcaggtggcaggcggagataccttatggtcatccgcacctttcgtcaactgaggcgaatgagttcgatggcatcaggatgatgttggtttttactctcgtcattcggagacattcaagcccgacgacacacgagattcttctctgctgggcagggacgatcaagtttgatggcgtagggaagtgtcatggttccactggtcgggatattgatcggccgaatgatgttccgctcgaatga

SEQ ID NO: 68696 - DNA, 411 bp, Glycine max
  Peptide Sequence Number=SeqID_160381
ttggaactcttacgtgccgatcaacgtctcatttcgccaaaagttggcccagggcttcccggtatcaacaggacaccaggattatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaaatcctcctagctattatcctactgcaataattcttgctaagaagaatgcccatgttgtggcaattccacctagaag

SEQ ID NO: 68697 - DNA, 204 bp, Glycine max
  Peptide Sequence Number=SeqID_160382
gtggagcgaatgaggcaatcctaccccgcaagggcattggctagaagactccaagtagattgggctagagatccaaggaaaggccctagggttctcatgagccttagggtgagcttagctattagagagcttctcaaggaagttttctcaaagaagcttctcaaggaagttttctcaagaaagcttctcaaggaagctacctag

SEQ ID NO: 68698 - DNA, 195 bp, Glycine max
  Peptide Sequence Number=SeqID_160383
atgcctccccccccccccttacggcgccgggaagggacaacggtcggccgtgaccctatcctccatttgcctccatccctaagtacctgcaagcaggagacaaacaatacatggccaatcgtgaccggccatcgtcttaccttggttgatttctgccgtcaactcgtctcgacttctgaccatggcccaagatga

SEQ ID NO: 68699 - DNA, 534 bp, Glycine max
  Peptide Sequence Number=SeqID_160384
gttgtaccatctgtggtgaggctcatgaaacaggccattgtattcccattgaagaaaatactcaagaagttcactacatgggaaatcaacagagacaaagatatactcaaggaggattctcaggcttccagcagagtccttataatcaacaaggacagtggagatcacaccctggtgacaatgtcaaatcataaaagcactgagttagcactgaaaaaccttgagatccaggtgggtcaactggccaaacagctagctgacaagtcttccaacaactttagggaaaacactgaaaaaaatcgcaaggaggaatgcaaagttgtgatgacaaggagtaagaggtttgtggaggtggaggatgaggatagtgttgtgttaaagaaggaagctgctttgaagaacggtactgacaaaaggaaggatgatgttaggggttgtcgcaacctacccttcggcgggagggcgacgcgtgactcgcgggatgcgtgttccacgaaaggaatacgcgcggagtcgccaccaacatttatttga

SEQ ID NO: 68700 - DNA, 363 bp, Glycine max
  Peptide Sequence Number=SeqID_160385
atgaagacattgtggaagatgaaataccttgaagaatcgaagacagtgaaggaagaaggaaaaggattggatgtagaaggaaaggaagcaagtgatcaaggtaacggtgacccgaaatcgaacatccactccattcaaaggggagatgaaattttcgataactggtgggagcggaagtgggcgaggctcacgggtgcgcttcccaaaggaggaaagatgcacggagtcgccaccaacgaaggtattagcacctctcacgtcgacaaaagcagggcttttgctcctacgtaccctcctttggagaggaaatcagacctacgtagttctttcttatgcatgaatcaagcgattctttttacttga

SEQ ID NO: 68701 - DNA, 174 bp, Glycine max
  Peptide Sequence Number=SeqID_160386
atggagaaagagagggttgagatgtgggaaataaccttaataatacaccatgaaggtacctttatcaggaatgaagctgatggaaaattggagtatgttggtggggagttagatgtgaggggagtgagaaggagcaatatggcagagtctgggattatgctcatgagcttttaa

SEQ ID NO: 68702 - DNA, 252 bp, Glycine max
  Peptide Sequence Number=SeqID_160387
atgtcgtcatctgcaccttcccaagagatgtcagcatcttccagccgagactgcgaaaaaatctcatttgctatccataagactcaaagcccgataacatgcagtgactaccgtcgtcatctgcacctttcctggagatgtcagcgtcttctagccgagactgcgaaaaagtctcatttgctatccgtggcaggcggagatacccgagtggttatccgtacaaagacaacttctgttaatcccgacccgtga

SEQ ID NO: 68703 - DNA, 687 bp, Glycine max
  Peptide Sequence Number=SeqID_160388
atgtgcaaatttttggagagagagaatgcagagatgaagtttccggaatttggcaaatattataaaagggagtcacaatggcaacctgattatcacaatgaagcagaaggatttcttaatctggatgatctgttaatgcaattcagggatacggtagagtcaatgcaacaagcctatagaaggactgaaactcagaagaacgtgaagagattgaaatacatcaagaaagcattcttcaagttatcaatccatcatcaattaaccaatgaagaagaaaaacatgaagtctccagcatccgggaatatccttgcttggccactgttggctacgttggagggaaagataaatgtagattggaactcagtgtggagaataaaaaaatctcttttgacctctttgaagccatgaaacactcagagataggtgatgcctatttcgaggaagaagacgtgaagcaggaaatagcattattagcttcaaccatggtactacaatctcctttggaaagagaacctggttatgggatagattgcttagtttgtgatgaagagcttgatgatccaaaagatagttgtgttgatcatgtggtttttgaagaattgaaaaaaaatgagaccaatagaaaagcccaaagtagaattaaagacccttctggcacatttaaagtatgtattcttggaagatga

SEQ ID NO: 68704 - DNA, 2049 bp, Glycine max
  Peptide Sequence Number=SeqID_160389
atgacggcggtcgcggtgtcgccgatagccaatccgctgttgttggtggcgaagcgggcggcgacgatcccgcttaacgccagcaccgagcccacggagagatcgacgcctgccgtgataatgacgaaggacgatcagggtgttttcattgctgagaaaatagttgctgctccaggccccctgagcgacctgatattcgccaatcagcgccacgatcaggcacagtgcgaaaaaggcgatgataatgccgtatttgtgcatacggcgcttattgcgggtgaaaatgaaattcctggtgataaggagtgggcgctgctcattttttttctctctctgttaaaccgcaagtttcatcagtgctgcctgggtcgcatcggctgccgaaagctcgccggccaactgcccgtcacgaaacaccaatatgcgatcgctcatgccgataatttccgaaagctcggaggaaaccataatgatccctttgttttgcaaggcgaactccgacataaatcgatagatctctttcttggccccgacgtcgataccgcgcgtcggctcgtcgagcagcaaaacctccggatccagcagcgcccaacggcccagcaccactttttgctggttgccgccgctcaggttgcccaccggctgttcgccgtcgtgggttttaacgttgaagcgctggatcatgtcgcgggttcgcgcctgctcccgtttctcgctgacaaaccccatccggctgatggcggcaaaagaggcgatattgatgttttcactgacggaacggcacagcaccaggccggtttccttgcgatcttccgtcacgtaggcaataccgctgtcgatggcctcgcgcggagagtggcggttcagcgtcttgtcgcccaggcgaatcgtgccgctgtcggcatgctgaatgccgaagataaggtcgagaaattcactgcggcccgatcccaccagcccatagatgcccaggatctcaccgtgcttcagctgcaggctgatatcttttatcttgctgcgccaacacaggttattgaccgccagcaagacctgtccgccgggctgattgaatttggcgaactcgctgtcgtactcgccgccaataatgtgttcgatcagctgttcacgggtaatgtcggcgatatagccttcatggatataggcgccgtcgcggaaaatggtgtagctttgctgaagcgtctgaaagattttctgcgcatcctcttcgccaatcgccgaggtgggttcatccatgatgatgatgtcggcattggcatgcgacagcgccttggcgatctcgaccagctgctgttcggcgacgctcaggttgcgcattttttctcgggcgtcgatcttgaaatcgagttctttgagcaggctggtcgtgcgctggttgagcgttgcgaaatcgacgaaccccaggcgtctcggctcgcggcccagccaaatgttttcggccaccgtcagatccgggatcgcgctcagctcctgctgcacgatggcgatgccggcattgagggcttcccgcggatgatgaaattcgcagcgttggccattgataaaaatgtcgccgccatcgggttgaataaagcccatcagaatgctgagaaaggtggatttacccgcgccgttgccgccgcacagggcatggatggatccgcgccgcaggcaaaactccgcattcttgagcgccacgaccgggccgaaggctttcctgacgccgctgacctccagcaggtagcgttgataaagcgtctcgtattgcgcctgcctgccggcgtttggcggcgtgcgcgtggcctcatccagcgcaacgaagcgttggcacagttcggccagcaatgcggcggcgttccggcgcggatcgtcggccaacatcgtcgcccacatcgcctgaatggcgccgcccagcgccgcggtctctttggctttcagacagaccaccgggcatcccattacgtccgcgacgatttgtcgccaggcggcgctgcgggcgccgccgccggtgaggcggatttcgcgcgcttcgatgccctgacggcgaaatag

SEQ ID NO: 68705 - DNA, 511 bp, Glycine max
  Peptide Sequence Number=SeqID_160390
gattcattcccctccaaaacctctcctcttcactccgctgataaatcaactagtggaaactcgattaacacctctgagtttgagaaacggattatcaaggttgaacaatcggtgaatatctttctcacggaatatacaccggacatatctggactttgtgcaatgtcgcactgctttccatttccaccacgaggatatacaaacaagggatatgaaaagaaggctacaacagaggacatggaattactgacaaagagttgggcagcattggtggagaaagttagattggtgctcaatgagtatccacaactcaggctaacccaagggagaaaagtgatagagatctgtctaaccatcaaatgggacaagggcaaggctcttgaatttttgttagaatcattagggtacgagaattcgaatgatgtatttccaatctatattggtgatgatcaaactgatgaggatgcttttaggttaacaaatgctgccacgcctagtcagttagttagag

SEQ ID NO: 68706 - DNA, 208 bp, Glycine max
  Peptide Sequence Number=SeqID_160391
acataatatcgaaattcccaacggtgatattgctcttaattgggttgcgaacgtggtgctcaaatttcacgacgatccaacggtgaacgagtccgagatcatcgtttttctgagacatgttaggtggcctgcgggaaaaagagagggttttgggaaaagagagaagaaacaacattgtgagggagagaaggctgaggagtcagtctga

SEQ ID NO: 68707 - DNA, 447 bp, Glycine max
  Peptide Sequence Number=SeqID_160392
atgtctgtgccaacaacatatgtttttatgaaaaggttcctaaaggcagctcaagcagacagaaaggaacatgctgcttcagcagttctcaacttcagtgaggactgcacacctcatatgttaacgccatacttggatggaataaatggtaaacaaattatgcaagaaggtgccttaactgctttggcatcaattgctgattattctcaggtgaaggacattgttcaaggtgctttattccccgaagctggtctagataatagagttggtcatgctaggggagtaggtggactcgtgattgttcaagatcttgacttgttatcctattacggtggagcaccgtctttgaatccaacgccgtcgaaagtttacgacggtcctataaaacccgtcttagaaaaacattatcttctaagacggaagttagctaacgaccgtcttagaaag

SEQ ID NO: 68708 - DNA, 165 bp, Glycine max
  Peptide Sequence Number=SeqID_160393
atgactaacaaccatcactatagtgttactcatcaatttgatgtctctcatgacattcaaaacagtgttgaggggaaaataaagcagacaatggagaaagccttttgggattgtatcatggaaaatgaagcagatgaaaaaaggcctttcatcatattcttctga

SEQ ID NO: 68709 - DNA, 543 bp, Glycine max
  Peptide Sequence Number=SeqID_160394
atgaagagaaggctatactacactactaaaaaaaagcttttctacatcggtcaattaacatcggttattgcaaaaaccgatgttaacgaaagcgcggtggcatttttaaaccgctcggtcgacacccacattgccccacattcatttcgatattgtcgaaaaccgctagctggaacccacagaacctcctatcgaagaaaagtcgaagaaaaccctacactgctgttggaactgtgtgggtcgaaaaaaccctacacttctcttggaacagtcgtgggtgctcaaagatcaaagctttctacgctgccagttaacaagttgattgtgctttttctggttttcaagcttgacgagagttacacgccgagcaaagtttccatccgtgccggtgatggttttcacaacttgaaggagaataagaccgtggaacttgtgaaggcaactgggtgggtttatctatccttgtctggagttaatcctagaaccacttacaacaagcaaattgatacatggattctgaatcctctccagcctatttactaa

SEQ ID NO: 68710 - DNA, 245 bp, Glycine max
  Peptide Sequence Number=SeqID_160395
atggtggcttttttggaattgatcactctgaagacattgattgcagcatttctgaaactcgccattaccattagacaagactgtagtgcaccgttcgggttgcggttaactagggagtttcattataagcagcttgaagcaatagagggaatgtccatgacaagcttgcggcaagtattgaaggtcacaacggaggtcatggcagattgcgaaggtcatggcagggtgaaaggcgagagtgagat

SEQ ID NO: 68711 - DNA, 495 bp, Glycine max
  Peptide Sequence Number=SeqID_160396
atgggaagacaattggggtttttggaggagaggaatattttggatgaaatactagttgcaaatgaggttgtgcatgaggtgaagactaagaagagagcttatcttatatttaaggctgattttgaaaagacctgtgacacggtctcactcttacaatttgcagataataccattttcttcttcaaggattccatgcaagaatctattaccttgaagaatgttcttacaagagttgcaagagtattgaattccgcaacaatgtccactcctttcaactactcggggcttccaattggagcaaacgcaaggaagcttagcacatggcaaccgggagaccagtcaaggtcacagtgttttgtgagaatgctccaaccatatgggatcaacataggcttaaaggagcactcaaaccgtgtgacccccaaggtctacattccgaagagtccgtcagggcctctccctcctgattcaggtccaacccagaaaacattttag

SEQ ID NO: 68712 - DNA, 465 bp, Glycine max
  Peptide Sequence Number=SeqID_160397
atgttatatgcaataaagtctacatcgggttttagcaccccgtccccaaggaaccctcgcaaattgcagcggtgcttcgagctcgagattagagaagaaaaagattcaacctttgtggaagaggacggaaaacccagaacgagaagacaaatcgcgcgaactaagaaggagaaacctaactccgttccaccttcaaccccatctccaaagagtgaagaagagaatggtggtaatctggaccatgttggacaggtgtgttttgtcggccttgtcgcaattggggattctcttattgggtgtttcgtttttctcgaattcgatttgtcaaaagtatgcaactgccagtgcacctctgatgggcttcttctgctttgtggagggagggacgtcaatagtgttattatttttttatgctctaaacgggatttgtcatgggcataccttactagttcctgggcaaaatag

SEQ ID NO: 68713 - DNA, 339 bp, Glycine max
  Peptide Sequence Number=SeqID_160398
atgaccacactccaccacaccaatcagcagcctcccactggatttaaatctcacaccaatcaccacactccacaaccgtctcctaaccactctacttcccaaaagctcaccttatttccacctcccactcctctacctaacccggattgcaaccacctaagctcatttttcaaagatctcacaataagtcaaagtatcgcaccaccattgagctcccttcaccgcacccccacccttgatatgataatccaagttcccaagctcatatttttgtataaggacctctctccaaagacatattttctcactgaaaaacatccatacccatttcccctctaa

SEQ ID NO: 68714 - DNA, 255 bp, Glycine max
  Peptide Sequence Number=SeqID_160399
atgttgagaagcatttcctcaacttttctttctccctcctatatttcagccgatgcatttccggcaaacttctccctctttctttctgtcgctctaatattttggttgcctttaagagtgactttgggacaagtgaatgctatgtatgacccggcatttgagagggctggcgttccaattgatcccattctcaggttgttcaacgcaaattcagcagagaaaccagccgaagaagtgcctgaaaatccgaattga

SEQ ID NO: 68715 - DNA, 210 bp, Glycine max
  Peptide Sequence Number=SeqID_160400
atgatgaagaagtggcagcaccaaatgagtttttgtactccacctccttcaccaactcattcaattcgtgaaacatcatctttcgaagggagctcaaaagctatggaagacaaaaggtggagacaagccatggaggaagaaattaatatcatcaagaaaaatgacacttgggagttatcaaaacttcctaagaatcatgaagcaatatga

SEQ ID NO: 68716 - DNA, 207 bp, Glycine max
  Peptide Sequence Number=SeqID_160401
atggataagtggcaaagacaatctccacaaacacgatctccacaatgtggttgcattcacagaagcacaagcgactttgacacaaggagaaagaagaagaacgatagggttcaagcgcaaggagaaagaagaagaacgatagggttcaagcgcggatgttactatggagtagttaacatcggttttggaaaaaacgatgttaactaa

SEQ ID NO: 68717 - DNA, 318 bp, Glycine max
  Peptide Sequence Number=SeqID_160402
atgtcgcttccacgcagtaattttacattttccggatcaatggcagcagtgtatggcatgtctccaatgatattagcattgatggtaaacccaagtaagagcacatcccctatttacttgattcctaggtttcctggaaaaaataatggcaaagagagagattggagagtaccagttgaagcaccttcacagttgtggttgctccatgttggcaatgcctttgaagttagacaccctcatgggaatttggacatacaaatacaagctgctgcttgctcttaccagtggttcaatttcagcaagttatttggtaattaa

SEQ ID NO: 68718 - DNA, 216 bp, Glycine max
  Peptide Sequence Number=SeqID_160403
atgtcagtgaaaaacctcgtcgggcgcctaggagtacatgacaagacaaaccacacactagcaagtcaagtcactctcactagaatgctccaaccatatgggatcaacataggcttaaaggagcactcaaaccgtgtaacccctaaggcctacactccgaagagtccgtcagggcctctccctcctgattcaggtccaacccagaaaacattttag

SEQ ID NO: 68719 - DNA, 459 bp, Glycine max
  Peptide Sequence Number=SeqID_160404
atggagcgatattctcaaaacattcactccaagaacatccttccagagaggaatgttaatctttttgtgatagagtatgatgaatttcgacaagagctgataagaagaaactggcacaaggccttgacccaacatatggacgggcccattaatgtggcactgatcaaggagttctactcgaacctgtatgaccctgaagacaaatctccaaaacaggttcgagtcagagggaagctgataatgtttgatggggactcaaagaatacattcctggagatgcacctcatcctggagctagaggagcagtacacatcatactcacttttatgtcgaactcgcataaacccctatgagctggctgctaggctctgtattccagggaggggatttgttttaaatgcaaagggtgcaccatggaagttgcttaggaaggacctcaccactcttgcacagacatag

SEQ ID NO: 68720 - DNA, 195 bp, Glycine max
  Peptide Sequence Number=SeqID_160405
atggcgctaagcgagccttcgaggacaaaaagccctacaaagctgaagttggcgaaaaatagggatatgcttgagagcctatgcaatagagagacacaacatgacaagggagcaccaaaaacctcatctttcaagaggattctaggtgataacttgccatggaaggctaaagcttttgttgggaatttctgctga

SEQ ID NO: 68721 - DNA, 237 bp, Glycine max
  Peptide Sequence Number=SeqID_160406
atggggaataagtgggaagtaagaaaaagctcaaaggggctatcaaaggaattaattcaaggtaggctcatttggctagaggcttataagaacaaaatgcctaaatcatctcccaacatgcatgtgaagcaagaagtatcaacaagagtaaagccaaggctattgtgcaagcaatcaatggggcaaaacatactgaataaaatagatgatgatgactcaaattctcaccaagggtaa

SEQ ID NO: 68722 - DNA, 336 bp, Glycine max
  Peptide Sequence Number=SeqID_160407
atgtgtcatccagagcaaaggtgtccacagtggtggcttcagccacatgtatacaatcatcaaattcctatacatcaggtctacccatacaaaaacaaaggagtaaacctaatagtaagtcctagatacacccaccctcaaaagtatataaaactaatccatggaactgtccactatgatgaagagcctccgctgatcgccatctcccccgggccactatcctccgtagaatctgcctcagatgccgacatgacttcctcgggagaatccacctcaggaagtgggtcctcatcgccctctagaaagtcagagcatccacagcagctcaggaggtag

SEQ ID NO: 68723 - DNA, 207 bp, Glycine max
  Peptide Sequence Number=SeqID_160408
atggtgcggtggctattgtacactatccctagcgccaactatagtttacggtatacttactcatctaagcaatggagtgtctctggtttggatttcagcaataatcataattttttatttttgctttctaaagacacgaccatgtgggattcatctcaaaaggaacaggttcattggtttgagcccaagatatcaccaccccgatga

SEQ ID NO: 68724 - DNA, 657 bp, Glycine max
  Peptide Sequence Number=SeqID_160409
atgttgcatgaccgagatgttatgaaccaccacgtcttggtcgtccccgaaaacaatctgcgccagaagagtagtcttctcaacatcgatagggtttttccaaaagaggaaaagctgcaacaagaacaaagtactcctgacagtgtagttaatagagatcaaaacaccatacctacaaatccaactactgctcctaggcattttgtaaactttgtctatgacacgaaatttgagaggacgggtattcccatttaccccatctcagattattcaaaccaccatcaccaccaccatcagggttcttcacaccgtcacaagagggaccaaggccacctccctgtcaacaccctccacaaggttgccatcaaggctgtcgatgttctcaccgtcatggccatccgagtcgagctctctccctctgcgatgccatggatccagatcagggctcttcaaaagcctggaagcaaccacatagcagccgtcaatgtaacaccctctaataaccttcctacaccatctcatcaggatgactcctcaaatcatgaggcaaacatctttcaaggttgtgcagatgcagtcaagttagaggcctatgcagatgcagttaggttttcctccctcattatcaggcatatggagattcttcattcccggatt

SEQ ID NO: 68725 - DNA, 693 bp, Glycine max
  Peptide Sequence Number=SeqID_160410
atgctaattcgtcacaaggagtactacattcgcatcgtcgatttggaagtcaacattgttctcgagcttgccgagcagttaggccttctcggccaggccttgcactctggccgagcccaatatgtctccctggatttttgcaacaaggcccaagttctaaaagcgttggagggagttgaggtggtgttccacatggctgctccaaactcttccattaacaactaccagcttcatcattccatcaatgtgcaaggggcgcataatgtcatcgatgcttgcatggtgttgaatgtgaagcatctcatttacactagctgtctcgtttaccctagctttcccagcatcttcttcgatgatgttcatggaattcataatggaaatgaaacaatgccttatgtgcattcagtacacactttagcaacttacttgagaatacctaatgatcattattcagcaacgaaagccgagggtgaggcattggttattaaagctaatgggactaatgggctcctaacgtgctacatacgccttagcagcatttttgggcctggtgataggttgtcgatgtcttcactagttgctgctgccagaaaaggggaatctaagcgtggtgtttcctacagcgaaatcgaaggggctgaggacatcggcttttcttcgagttttgaagtattctatgggaggagtacttga

SEQ ID NO: 68726 - DNA, 294 bp, Glycine max
  Peptide Sequence Number=SeqID_160411
atggcccgcacaaataaaacaggggagatgacgactgaggccacaaaggaaatcgctgagaagatcgattcctttgaggagcaggtgacacagggatccttcgtcccccatggacgtcaggatgttctcaccactgctattggacgtctagagcaccctggacgtgttcgtgctgctggagccggtgtcaccatcaagcaatatttcggatcggctccacagatgtcccgcagttcttcctccctacctcttgaagaattacaacaactgacccagcaaatcgggaccagctaa

SEQ ID NO: 68727 - DNA, 351 bp, Glycine max
  Peptide Sequence Number=SeqID_160412
atgactaatgcaaactgtccgcaagaatcattgcattcagtctcaaacgggaatctaagggtttgtgtgtgtgtgtgtgggggtcattcaagggtagcaaaggatcatcatattctaaacatcatcaaccacaccatgcacatttatattgctggcatagacaaattcccagagagagaaacaggcgctacaatctctgaattgatatggtttgcagaaaagggacacccaattaccatcagcttgcaagaaacctataagggtctaaaaaatatagcttatatgatttggaatgaaagggcattgaattggttccaatggttagaactatggacaagggtcatgatttag

SEQ ID NO: 68728 - DNA, 381 bp, Glycine max
  Peptide Sequence Number=SeqID_160413
atgtcatcctctgttccactgtttgagtttgcatcattccccattgctgcagagttagtagcatcacccaattcatcatcttcacttactcttttattaacaccatcatttttatcaaagacaaatccaacaaccccaaccacaacaccaacatcatcaggtggtcaatggtgtgttgctaaccagggagcttcatgtagaagcaagcttcatgatgaatcaagattgattcaaagagttttgatgataacaaagatgatgacaaaaagcaaagctcaaaagtcaagaacacttcatgataacaaagatgatgatctcaagaatcaaagaatgagttcaagattgaatcaagaacacttcaaggttcaagaggaaatttga

SEQ ID NO: 68729 - DNA, 723 bp, Glycine max
  Peptide Sequence Number=SeqID_160414
atgaggaaaggggcccttgcagccgatcaagatggtgtggacgacactgtctgtgagaaatacgacataagcaaggaaaaatgggcccagttttgccaaactcgcagagacccttcttgggaggatgtgcgcaaaaaggcacaagtcatccaaaaacaaaacactgccccccacattttgtctcgtgggggttatgaatatttggagcaaaagctcctggctgagaagaccaagaagaagctggaggaagatgcacagtcaagaagcgttgatggcatcatcgaccctccatccccggtcagacgccatgtgaagtggaagatggcccgcacgaagaaaacgggggagatgacgactgaggccgcaaaggaaatcactgagaagatcataagtccttttcaaccaaccattagaattatatttcaatattttgtgaatgccatgtacaactgtgtgttttctatgcaggattcctttaaggagcaggcgacacagggatccttcgtcccccacggacgtcaggatgttctcatcgctgctattagacgtccagagcaccctggacatgtccgtgctgctggagctggtgtcaccatcaagcaatactttggatcggctccacggacatctcacagctcttcctccctgcctcctgaagaattacagcagctgacccaacaaatcagggaccagctagaggagtccatcacagatgttaaataa

SEQ ID NO: 68730 - DNA, 102 bp, Glycine max
  Peptide Sequence Number=SeqID_160415
atggctgaaaaagagaaggatgagaagatagtggatggagataaacaacaactggctaagttcaacaagagacatctgagaacgaagtttaatttgaattag

SEQ ID NO: 68731 - DNA, 186 bp, Glycine max
  Peptide Sequence Number=SeqID_160416
atgttagaaccaagagggtggggaggatttgttctcaaagaaaaaatcaaatgtctcaatgagaggctgaagctatggaacaaggaacaatttggagtcacatttaagagggttcagaacatagaggcagaaattaataagctggaaactgagtcagctgataggattttaacccctgaagaatga

SEQ ID NO: 68732 - DNA, 330 bp, Glycine max
  Peptide Sequence Number=SeqID_160417
atggtcttggaagaggacgtgaacatggccaaggaagaagagatcgtgacaattgtgataataatgaaagaagttatcaacccactagagaccaatgaagcaaaatgcttaaaggatagcataaaagatgaagcatggggatgcctcacatcaaccatcctaaccaattgtgcgaagcatgtctcattggcaaacatgcaagtgttcgaccaaggaagatccaagcttgatgatatgagtgtgaagcatgtgttcattggttataatgcaagttcaaaaggctacaagttgtacaatccaatcaatgggaagaatgttgtaagcagataa

SEQ ID NO: 68733 - DNA, 279 bp, Glycine max
  Peptide Sequence Number=SeqID_160418
atggcagcagtgtatggcatgtctccaatgatattatcattgatggtaaacccaagtaagagcacatcccctatttacttgattcctaggtttcctggaaaaaataatggcaaagagagagattggagagtaccagttgaagcaccttcacagttgtggttgctccatgttggcaatgcctttgaagttagacaccctcatcggaatttggacatacaaatacaagctgctgcttgctcttaccagtggttcaatttcagcaagttatttggtaattaa

SEQ ID NO: 68734 - DNA, 1000 bp, Glycine max
  Peptide Sequence Number=SeqID_160419
aacttgtaaaaggattttacaaggtagtggaactctcaagcgggttgcttggggactggacgtaggcacaagggggagtgttgctcctgtggttcttgtgcaactgaaaggtgtgttaagtatgggaagagttctattgcggatgatctttctgcaattaaaggaccttgggctatcatctactggcaggatagttcgaggattctttagtttggctgagatgcatttggatgtcaagattgatcgtaatgggataggatgtcttagttactgggaagagctaccatgtggaatatatagtatgcatgttgatgcttcaaaatcaagtgtatacctggacaggagagcaccaccaattcttgaggaacctcaatcatccgagttgtcttctatctttccacaaacaagggaatctaaaacaggggcacctgaggctaacataatgattgaaggtcaacctatgagagttacccttgaagactactctagttctgttgtgccacaattcttcactaacatgtatgcacacttagcgacttacattgaaatctgcaatacagtcaagattgcagggaacagtcttaatacttgggatgaagtggtagaaaaatttctgaagtatttcccggagtctaagactgcagaaggaaaggcagccatctcttcatttcaccaattcccagacgaatccttgagtgaagctctagaaagatttcggggaaagattaaattgaagacccctaaagaagaaatggaactaattgaaaatatggctgcaagttgcaacatttatgggggagcccatgaatctggatgctatattaccataaatgacacacctcaagagcatggttcgaattataaccaacaacaagggcaatggaggtctcatccaggaaatcaattcaacaaggaccaaggtggaccatctaataggcctcagcaacaagggcctagcctatacgacatagccactatgctggaggagaaccttgcttag

SEQ ID NO: 68735 - DNA, 324 bp, Glycine max
  Peptide Sequence Number=SeqID_160420
atggacgggcccattgatgtggcactgatcaaggagttctactcgaacctgtatgaccctgaagacaaatctccaaaacaggttcgagtcagagggaaactgataaagtttgatgggaactcactgaatacattcctggagacgcccctcatcctggagctagaggagcagtacacatcatactcactcttctaccgaactcgcatagaccctcaggagctggctgctaggctctgcatttcagggaggggatttgttttaaatgcagagggtgcaccatggaagctacttaggaaggacctcaccactcttgcacaaacatag

SEQ ID NO: 68736 - DNA, 366 bp, Glycine max
  Peptide Sequence Number=SeqID_160421
atggctacaaataggtgtttcccaagtcaaaagcgcaaaagaaaggatggtgacttgagcttgaaagaacaagtagcattcctcacattgaaagtgaaagaattagagagtaggcttcacgttaaagaggtggatgggcaacctaattcaacaacaaaaaatgtgaaagatagttgcatgctttttttctgcaatattcttgaagtctataattgtgttgctaatgaaaaactacacaatagaccattatctctcaatcatgtgaaagttttgattgggtatgtgatagagtcagatgccccgctaccactacctatagaggatgtaggaatcatggtagtgttggatcaagtggccttggaataa

SEQ ID NO: 68737 - DNA, 129 bp, Glycine max
  Peptide Sequence Number=SeqID_160422
gagaaagaagaagaacgatatggttcaagcacaaggagaaagaaaaagaacgatagggttcaagcgcaaggagaaagaagaagaatgatagggttcaagcgcgcgggttgtgcaatttcagaactttaa

SEQ ID NO: 68738 - DNA, 87 bp, Glycine max
  Peptide Sequence Number=SeqID_160423
atgtttaagccgacaatagcaaccaaagaaaatgaagtcataaatctaagttcatggccaaaaactatgaaagcaaagaagaggtag

SEQ ID NO: 68739 - DNA, 676 bp, Glycine max
  Peptide Sequence Number=SeqID_160424
atgaatgtttattacacatgggttatgcctttcttgaattcgaggagagatctgagctctgggagggaggaggaaggagtagagatagtgagcaaaagaagagacaacaacaacgacaagaatgaagttggaggagttgctgttaaggatccatctgctccccatggagttcgacttttgattgaggactatccttatgcttctgatgggctagagatatgggatgctatcaagtcttgggtggaagaatatgtctcattctactacaagtcagatgaggaacttcaaaaagaccccgagctccaagcttggtggaaagaacttatagaggtgggtcatggggatttgaaggataagccatggtggcaaaagatgcaaactcgtgaagagttggttgaagcttccgctaccctcatatggattgcttcagctcttcatgttgctgttaactttggacagtatccatatggaggtttaatcctgaataggccaactattagcaggagattcatgcctgagaaagggtctcctgaatatgatgcgttggctaagaaccctgagaaggagtttttgaagactattactggcaagaaagagaccctcattgaccttacaattatagaaattttatcaaggcacgcatctgatgagttctaccttgggcagagagatggtg

SEQ ID NO: 68740 - DNA, 96 bp, Glycine max
  Peptide Sequence Number=SeqID_160425
atggatccagatcagggctcttcaaaagcctggaagctcaagtttaaattaaacccaggaatctcaaaccagtctgaactcccaaaacgtaattga

SEQ ID NO: 68741 - DNA, 174 bp, Glycine max
  Peptide Sequence Number=SeqID_160426
atggataagagcctgaagcgcgacgctcagtggctaagggcgaggaagaatccagaagaagatgagctgtcaggttcgctgagcgcaccgctccaggtcatcaagcgcaccgcttcagctcatccactaagcgagagaagcgcgctaagccaaaatccacttatgcacgcttag

SEQ ID NO: 68742 - DNA, 375 bp, Glycine max
  Peptide Sequence Number=SeqID_160427
atggccacgaccgaagccttggaacaagaaaccaagaaggctcgaaaggaagaacacggtcggaacaagttccgaggaactttatggggtagcaatagtgagcttaagctccgaagagccaaaagggatcagtcgtggatcgaaggcatgatcttgaaagacgagttaaaggcttgccataggtcgaaaagaagcttgtccgagaagctagaggacgagtacgccaaggtatcagtcctgcaagcggaaagggaggcaagggaaaaggccaaggcaatggcggatgtgtactcggctcccgaggaggttcacgggctcctcaattattgccaacacatgattgatctgatggcccacatgattagaagccgctaa

SEQ ID NO: 68743 - DNA, 228 bp, Glycine max
  Peptide Sequence Number=SeqID_160428
atgaatgattggagtacaagcattggttttgctccagtgtattgtttccttgagccccagtctatacgttgcgcaaaggacacgcatgaagaatgtcaacaatacatagaaacgtgggtcagggaatcacatcaggaagtctacttaggaccttacttgaatcatgcaatgaagaaaatatgcagtaatttccaaggcaaggacaatgcacctccacctccaccttaa

SEQ ID NO: 68744 - DNA, 528 bp, Glycine max
  Peptide Sequence Number=SeqID_160429
gatttttatgccaacctttacatctttgaagacccttcaccaaagaaagtcagggtcagaggccaccaagtgaggattgatgcagatagcctcaacacattcttggagaggcctcatgtagttgagggcgagactttaccagcatattccagatactgcaggttgcctacagattataaagagattgaggttgccttatgtataccaggccgagggtttgttttcaactctgagggccatcctgggaagattctcaggaaagatttgatgactcttgctcaggtgtggagtgttctctcatattccaacctggctcctacttcacacacctcagacctgacagtagatagagctaggctgatctttggcctagactctcagatggacataaatgtgggagcccttatctctggccagatcacatctatagcccagtctaactcttctagacttgggttccctactctgatcaccgcctgtgtaaggccagaagggttaattatgatagcttggctttcgagcgcttga

SEQ ID NO: 68745 - DNA, 402 bp, Glycine max
  Peptide Sequence Number=SeqID_160430
atgcaattaggaggattcgatgaaaggacatcaattcaaatcctggattttcgaattgagagagatattgagagaaatcaagaattctcgctatttcttagattcatggacccaattcaattcagcgggatttttcattcatatttttttccatcaagagagttttataaaactcttggactcccgaatttggagtatcctactttcacgcaattcacagggttcaacaagcaatcgatatttcacgatcaagttgattgttccgctcctgtatcttccaaaaggaaaaagatctctgagagctatttcctggatccgaagagagtactcgggttctcccatactaaaaagtatatcatgcctgatctaactggggttcgcggtggtggaggaactggatag

SEQ ID NO: 68746 - DNA, 392 bp, Glycine max
  Peptide Sequence Number=SeqID_160431
gaacaacaagctgagtgggtaaacgcgcagagacagactctgcgccctttatcattcaggaacaacaagctgagtgggaacaacaagctgagtgggaacaacaagctgagtgggcaaacacgcagagacaaattttgcgccctttatcaatcaggagcagtgaggcaggttccgcaggcagggaggggcaactgtcataccctaatttcgtctggggaccatccgtcgttgggatgtgaccctcatttgacctcttcgaggtacttggcacccatcattaggcaattcgtgaagttccgtgacatgccggaagtcaaaagaaagcattgtagcacaatccgtgaagttctgcgacatgccggaaatgaaaaggatgtgttagtgcgcaatcc

SEQ ID NO: 68747 - DNA, 225 bp, Glycine max
  Peptide Sequence Number=SeqID_160432
atgctagaggacgagtatgcgaaagtatctatcctgcaagcggaaagggaagcaagagagagagtgatagattcattacacaaagaagctatgatgtggatggataggttcactttcactttgaatgggaatcaagagcttctgaggctgttagccaaagccaaggcgatggcggatgtgtactcggctcccaaggaagttaatgggcttctcgattattgttag

SEQ ID NO: 68748 - DNA, 1147 bp, Glycine max
  Peptide Sequence Number=SeqID_160433
atggatgggttggtggacctggcagcgattgacatttttctcacctttcatgaccgcaatgaaagcctggttgtcgctatcttagccgatctatatgacaccttcgaccgaagatgtgaaaagaacagtacaaggattgtttgctgtactccggccctctacgtatggttggtttcccaccttttccgccaagaggtgagacatgcttgcccgctagaaggccaccgctcatgcacagagaaaaaagaggcaagttgggaccgactcttagcaagcaaagaaggagcgtctgtcaactggttcccccgatggaaagaaggaagaaccgagattcttatttcgtgcggaggatttccaaatgtttccttgatggggacaaggggttgcattaattacaatcccatcctcgccataagacaactgggctaccctatgagaggggcaccattagaggaagacctcacacctattattgcacgaggtttcaatagcaccaacgcgcaaggcatgggagatggtgcaaaagaaggacaaggaactcagaggcaggtagaactcgagaaagcccaaacagtcaaagaaaagttcaaatcagcagctattaggatccgaaaagagaacgccgaactaagagacataaatatagccaccaccaaggccttggaacaagaaaccaaaagggcccatagggaagaacatggccgaaacaaatttcaaggggctctgtggggtagtaacagcgagcttaagctccggagagaggaaagggaccaatcacgagtagacagtttgatcttgaaggatgaatttaggatttgcctaaggtccaagagaagcttgtctcagcagttatgtgagatcgagaccaacatgttagccatcatcaacaagtaccaagaagaattaaatctagccacggcccacgagcacaaagtggcggacgaatatgcccgagtgtacacggaaaaggaggctagaggaagggtcattgactcgtttcatcaagaggcaacaatatggatggagcaatttgctcttactttgaacgggagtcaagaacttccccgattgctggccaaggccaaggccaaagcaatggcggacgcctactccgcccccgaggaaatccacggactcctcaactatt

SEQ ID NO: 68749 - DNA, 2406 bp, Glycine max
  Peptide Sequence Number=SeqID_160434
atgacgtttgaccgcgcggcgcagctggtgccctatctgcagcagctgggtatcagccatctttacgcctcgccgatctttaccgccacccgcgactcgacgcacggctatgacgtcaccgacgccaatgagattgacccggcaattggcggacgcgccggttttgaccgcctcagcgcggcgctgcagcaggccgggattggcctgatcctcgatattgtgcctaaccacatggcggcgtcgctggaaaatgcctggtggcgcgatgtgattgaacacggggaagccagccgctacgcgcgctactttgatatcgactggtcgcgcaggctgacgctgccgttcctcggcgaggattttgaccgcgtgctggccaatgatgaactcagcatcaaggccgatccgcacagcggcaatccggcgctggtctattacgacagttactatccgctgacgcccgccagctggcagcagcgtaaagacgaggtgctggcgttgcgcgatcgcgcggccatcgcggaactgcatgcgcaacagccgtggcagctgatgaactggcgtgaggcgcgcagcgcgctctcctaccgccgcttctttgaaattaccgggctggtcggcgtgcgcgtcgaagatgacgagcggtgtgtgagcgggctgcgcgtcgatcacgttgacgggctggccgatccgctcggctatctgcaacagctgcgtcaggccgcgggcgacgcgtgctatatcacggtggagaagattctcgcagacggtgagcaactgcccgccgactggccggtgtccggcaccaccggttacgagtttatcgccgcgctgtcacatgcgctgattgatgataatcagatcgatatgctgcatctggcctatgaagcggtatccgctgaacgtaacgacgtggcggctggcctgcgtgcagcgcgtgaactgatggtcgatcgcaactttgccggggaattcagccgcctgctggcgctggctaccgaggcagccgatctggtgcatcgcaacttcagtgaggctgagctgcacgtggcgctgcgcgaactgctgatcgccttcccggtgtatcgcacctacggccggaaagccggtatgccgctggaaggcgaagcgttgctgttacaggtgctggagcaggttaaacacagcgcctcgcctgcggcgctgagctttttgcaggcattactgctgggggcgatcactgaacagggcgagcaggatgcggcggaattccgcgcccgcttccagcagctgaccggcccgctgatggcgaaatcggtcgaagacacgctgtttttccgcaatcacgtggcgctggcgatcaacgaagtgggtgccgaaccgctgccgcacgcgttttcgcttgaacgctttcatcgcgaaatgcaaacccgcctgcagcaccagccggatggcctgtcgggtacctccacgcacgataccaaacgcggtgaggatgcacgtgcacggctgtataccctgagtgaagcgccggcgctgtgggcggagaacgtgacgcgctggcgccagatgaatcagccgcacgtggtcgcgctggcggacggcccggcgcccgaaccgccggttgagtggatgctgtaccaggcgctggcgggcgtctggcccaccacgctgcagccggaggacacggcggcactggacgcgctgcgcgatcgctttttgccgtttgtggaaaaagccctgcgcgaagcgaagttacgcaccgactgggcggacagcaacgaagcttatgaaaatgccgtgctggagtatgcccgccagctgctgtcacccaccaatccggcgttcctgcaggacttcagccacgcactacagccgtttatccgtgccggactggttaacagcctgagccagacggtgatcaaactgaccgcgccgggcgtgccggatatctatcagggctgcgaagcgctggatttcagccttgtcgatccagataaccgacgcgagccggattttgctcagctgacagcgcagctggatgtccacgccgcgccggatttcgccagccagcaggactggctgagcggccggctgaagcagcagatggttgcgcgcctgctgcatctgcgccgcgaccatgcgcaactgttccgcttcggtgattatcaaccgctcagtgcatcgggcgaacatgcggaaaaagtgatcgcctttgcccgtcaggacagcgactacgcgctgctggtgattacgccacgactgattttcaatggtgcacagtggagtcatacccgcctggcactgccggaatcgctggcgcatcgccactatcgcaatgtgctgaccggcgagaccgtagtgattaataacgatgttacgctggacaatgtgagctatagcgcgccgctggtgctgattagccagtag

SEQ ID NO: 68750 - DNA, 1110 bp, Glycine max
  Peptide Sequence Number=SeqID_160435
gaccttttcatgctgatctccactgaggatacgcgcactttcaacaccgacatccgcctggcggcgacgctggccgccgtggcgggcgcactgaacactgcggcgttcgaaacggttggtttcttctccgccaacatgaccggtaacgtctcatccctgtccgatcatctggcgaaagccaatctgcatatcgggctgttcttcctgctgattgtgctgttattcatcgccggttcgtcggtctcgacgctgatcatcaattccggccgcaggcggcagatacgcggcatctacgccatcaatattctgctcgagggcattgcgttgctgcgagggcggcgtgttgctgattctcagcctgagctttctgatgggcctgcaaaatgcggtggtaacgcgcatctccaatgcccgcgtgcgcacgacgcaccggctaaaactgcattgctacaccgtgctggcatttctcgctggcggcgtgctgggcattctgctgctgcagtggctaagctacgcgctgctgatcgtcattgggttactgctcagtgcgctggcgctgtcggcgctgaaacgtgcgggcagcaatccgcttcacgcccgctaaggaagggaatcatgatctcgctcgaggaccgcctgcaagccatctggcagctgcttagcacagccaccacatcgcgttcggctttcaccctgatgcagctggcaacggtgaccgctgacggccagcccagcctgcgcaccgtggtgatacggcagtttttacccgcgctgccggccctgcgttttaccgccgatcggcgcagcgccaaaatgcaggatattgcagcccagccgcaggtggcgttactggcttatgatgccgccagtcgcgttcagctcaggctggcaggcacggctcagcgcgttgacgatgcacaacagcgtgccgcagcctggcaagcattgcgcccgcactcacacgcgttgtttcagtcaccggtcaggccgggcagcgtgattgcccatcctgatgacgcacagcctgccagcgcgcaaaaggcgggcaccgggcccgacgagcactttgcgctggtgcagatcaccttgcacagcgtggaatggctggat

SEQ ID NO: 68751 - DNA, 369 bp, Glycine max
  Peptide Sequence Number=SeqID_160436
atgattgcgcgtgtaggtaaagctagagcagcagtggaagaactgaagagatttcttgccgcaaaatcgttggaggaagtgaataggaagctggacaagttctacatggtccttatcttgagaagtctacattcagattttgatcatgtgcgtgatcaaattcttgtaggtgaccaagtcccgtcaatggactctctcattactagacttctttgcgtgcctcaagccttgaaagaagaaaatttagctgaaagtgtggaaacatcagctatggctgcatctcgtggaagagggggaggtcgcaacaatagaggaggtcgtggatgtaaaagaggacttattaccagaaatatgatcaaagacacctga

SEQ ID NO: 68752 - DNA, 146 bp, Glycine max
  Peptide Sequence Number=SeqID_160437
cccatgggctcgaaatctaccctaaggctcatgagaaccctagggcctttccttggatctctagcccaatctacttggagtcttctaaccaatgcccttgcggggccgtgctgagcgattcaacccctgcatctatagctggctag

SEQ ID NO: 68753 - DNA, 774 bp, Glycine max
  Peptide Sequence Number=SeqID_160438
cagttgaacagaaaacaaaaccagagtaaggtaattgtggccgatgccaattcaggaaacagtaaaaccatttataccgaaacggatcctgcgtggatcgatatcaaatcccgttggaacgacaatgatccgagcggatgggactggatcaacaatggtaaagaatttggatggttatctgaaaaagacagatggagacacatttataaaatagacctgaacggaaaagaaacactgattacaaaagatgattttgatgtgataaaaccggaattttttgatgttcctaacaaactgatttactttttagcttcaccaaagaacgccactcaggaatatttgtacaaagtgagcatgaacggtgggaaatccgaaagggttactcctgagtcttatcctggaactaacaaatacagcatttcatccaatggaaaactggcgatatttagtaacagcagtgttaatgcccgttccaatggctccattatatcgcttcctgatcataaagaactggtagctgcaaaaaattccaccaaagcagacccttcgagatctaaggcagaatttttccagattacaacacaggatggaattaccctggacggatgggtggtaaaacctaaaaactttgatccgaataacaaatatccgatcgtctttacagtatatggagaacctggagcccaaactgtaaccgatagcttttatacgggctggaacggcttatatatcggagatatggctcaggatggctatatatatgtctcaacttga

SEQ ID NO: 68754 - DNA, 67 bp, Glycine max
  Peptide Sequence Number=SeqID_160439
gatgtcaatccttaccctcggaagcaacaacaacaacaacaacaacaacaacgccttatcccactag

SEQ ID NO: 68755 - DNA, 367 bp, Glycine max
  Peptide Sequence Number=SeqID_160440
gcttagaaatgggactggaatgtggaaggggcctttggtaatcgattaccagtgctgggtaatcgattacacagaggaacaggccactgcgcagttcatccatgatcgagtggagatggagtgcctagagggagcttgggagaccctcgaaggcaatgcgaggtgccgattccggggcacgattcgattcacggctacttcattggtgcatctagaggaacccgcgcgcacgcttcagcgcactgtggagtggatattacctacgcctacaccatatcatctagtggagccagtccaagtgatcgaggtgacgtcatctgaggaagaccctgaggaagacccagaggagctacctcctgagcctgct

SEQ ID NO: 68756 - DNA, 195 bp, Glycine max
  Peptide Sequence Number=SeqID_160441
atgaatagggagtctactttaatttggcaggatgcgaagaggatgaataagaagtgcagtatagaatgtgaagaagatgaagagatgtgtactatacgtagatatatctctatagaagtgttttttatgtgggatgagaaagcggtttttggaagttcagaagacaatctgatagcagagcaagcggcgatatga

SEQ ID NO: 68757 - DNA, 549 bp, Glycine max
  Peptide Sequence Number=SeqID_160442
atggcgcctaccaggcaccctctggacccggataagtccaacagggccctgggatttcccgccttgatcacaggactctgtcagttgttcggcgtccctgtcgcacctagcaaggtgattcggccgcccatcaaccgagcttttattgagaagtactgcacgcagagacaggtccaggatgatgcaccacaggccgcgaacgcgccgccacctcatcaggctggtccagccggatcgtttgatacagagcagtatttgcggcatttggttcgccagcagtcgaccaaccaccgggcacatgtacagacccatgattgtctttatcagatgagtctcggcctgcagggccagggctttacttcttttccgtgccctactccggaccagttcagggcagaggtcgcatggcctggagattggcctgaggcccaggcaggagaggcaccagcggaggcaccagcagaggctcccgacgaggcagatgaggcccgcgaggacgaggagatgaccgatttactggatttcttaggaggaagcgggaccacatga

SEQ ID NO: 68758 - DNA, 393 bp, Glycine max
  Peptide Sequence Number=SeqID_160443
atggccagcaatacaataaacagcagggacaatggaggaaccaccctagaaatcaattcaatagagatcaagaagagcacagagtctgccataaagaatctggaggtccaagtgggagagcttgcaaagcaattggcagatagatcatcaagcagctttacagctaatacagagaaaaatcccaaggaggagtgtaaagctgcgatgactagaagcagaatggcaatccatgtggacgagagtgaagctgagaagaagatgaaggaacataaaccacaactggcacctaagccagcacttgaacctgtttctgattttgtagaacttgaagagattaatggggaggctgaagatgataaggaagaaaagacaccaataaaagagaaagaataa

SEQ ID NO: 68759 - DNA, 447 bp, Glycine max
  Peptide Sequence Number=SeqID_160444
atgtaccctccactagaactgattcacaagagatgtaccctctcttgttctcagtcaacaacccaagtagatgtactctctacttgtaccacaaaggatgtaccctccaatgtgttaagacaaagatctcaggcagttaaacctttgatactttgtgaatggggatacaaaagaattctcaggcgggagaagggagacacaaaagaattcaggcggttagtcctttgttcttttggaaaagggagaagagagacacaaaaagaattcagtcggttggtccttggcgaattctttttggcaaagggagaagagatgaaaagaatgaatagcacaagttttctaggtttagaaaaccagaaaactttggaaaactttatgcacaaagaagaagaagaagaacaaagagattcaaagcttgtaaaggttgttcaagatagattggattga

SEQ ID NO: 68760 - DNA, 336 bp, Glycine max
  Peptide Sequence Number=SeqID_160445
atggcgaaaatgtgcagaatgatcataatttgtctccgcatgtcatcgggctcgccgcctatagatgaaaaaagacacagaattaccataatttgtctctgcgtgccatcgaacttgatcgtctctagatgtcgaaaaggtgagaatgaccataatttgtctctgcatgtcatcaggcttgctctggatgacgaaaaggcgcatagtgatcataatttttctctgcatgtcatcggagattttctccgtggatgcaaaaggcgcagaatgaccataatttgtatgtgcgtgccatcagactcgatcatctccggatggcgaaaaggttcagaatga

SEQ ID NO: 68761 - DNA, 396 bp, Glycine max
  Peptide Sequence Number=SeqID_160446
atgtggagcaaaaccatatcaaggttcctcttgtacatgatattcccactcaggaagaagccgactgccaaccttcgtagctttctcttgtcgttgtcagaagcctcccgtaggtattccttgtcttcgatatatcacttgatattgaagtaccaaggtttaccatcttgctcctcttctatcaagcagcaatgttcaaacttgccgcaaggtcaattggaacatggatgccagagtggcaagggcatcaaccgtctgattctcctctctaggaatatggtgaaaggatacgtcatcgaagtactctatcagttttctgatgtaggcctggtagggtatcaacttatgatccctggtctcccattcccctctcaattggtggattaccaaggctaa

SEQ ID NO: 68762 - DNA, 537 bp, Glycine max
  Peptide Sequence Number=SeqID_160447
atgtcgttcaccaagggaaagataggtgtaaatgaaatagctccaaagaaactctccacgaagaggtctagaagagacgccacagaggaaggatccagtgctgcctcagagtttgatagtcatcgtttccggagtgctgagcaccagcagcgcttcgaggccatcaggggatggtcattccacagggagaggcgtgtccagctcagggaggatgagtatacggacttccaggaggagatagctcgcagacgttggacaccgctggtgactcctatggccaagttcgatcctgagatagtcctagagttctatgctaatgcctggcccacggaggagggagttcgggacatgcgctcgtgggtaaggggtcagtggattcccttcgatgcagatgcccttagccagttcctgggcgacccgctaattttggaggaaggccagcagtgtgagtttagccagaggaggagcagggctgacgatttcgatgaggaagccatcgcccagctattgtgcataccgggacaggattttgcctag

SEQ ID NO: 68763 - DNA, 291 bp, Glycine max
  Peptide Sequence Number=SeqID_160448
atgcttttaccagagaagaatgtggtagtttactatatagagtttgatgagttcaaggaggaactcgagagacgccattgggatgaggagttgactaactttttggacggcaatattgatgttgccattgtaaaagaattctatgcaaacctctatgaccccgaggacaaatcacctaagcaggtgagggtgaaaggtcatctgattaagtttgatgaggatactcttaacatatttttgaagacccctgttgttgtggaagagggggaaacactttgtgcatatttctga

SEQ ID NO: 68764 - DNA, 234 bp, Glycine max
  Peptide Sequence Number=SeqID_160449
atgatgacaacaaaagatgatgacaaaagtgatgaacaaaaagctcaagtgaatcaaagaacatctcaagagaatcaagaacaagtcaagagttcaagaagaaagcctacaaaaaagaatcaagattcaagattcaagatctcaagaatcaagatcaagattcaagaatcaagaatcaagactcaagatctcaagcatcaagatcaagattcaagaaaaaagactcaagaatga

SEQ ID NO: 68765 - DNA, 990 bp, Glycine max
  Peptide Sequence Number=SeqID_160450
atgaggttgctatcaagtgcttttgggcagcccaacaatcaagagttcaaacaattttctgattggctactgggcataggtgatgacaaagttggacaagctaatgatggattttctgaaatcaccatcccagatgagttccttataaagaactatactgatcctatccatgctattgttgaagccacatatcccaacttgatacataactatagcaatacagattacttgcaaaaaaaaaaagttgttcttgcctctaaaaaagatattgttgagaaaataaatgattatgtcttatcactgatacccaatgacgaaaaggagtattgtagcgcagatagtattgataaatcagatgaactactcaatcctgctttcggattattgacacctgaatttctaaattcattgcaaacatcaggcatacctaatcataaattaaaacttaaggttggtactccaatcatgctaatacggaatttggaccaggctgatggattgtgcaatggaacgaggcttattatcaccagacttggttctaatgtggttgagtcagaagtcattattggacctaatacaggaaatagaacatacatacctagaataaatatgtctccatttgattctccatggccattcaaacttattaggagacaatttccatttatagtttcttatgctatgactataaacaagtctcagggacaatcattggaacacgtaggattgtatttgccacacccaatttttagccatggccaattatatgttgttctttcaagagttaaaagcaataaaagactacatattcttattcatgacaatcaaggtatgcttccatcctacaattcaaaagcgttgcatttaaatgctgttcaaatattacgccagtattcatccctgttattacaacaacatctaactcaacattgtatattccaacttttccactctcaaatcagatttagacgagttagaccccgtgcttaa

SEQ ID NO: 68766 - DNA, 411 bp, Glycine max
  Peptide Sequence Number=SeqID_160451
atgacgatcttccggacgaagttcgtgagtacttccggaattcccaaattctttttccggaagaagtatttccgtaaacttttcggaacaagcttttccggaaggtttccggaaatacttcttccggaagaagaattgttgaagggcaatttggccacttcactgtttgctgggtgccccagcaataatgctgggaatgtgtgcattggaccacaaagagcaaatgctcaacaactttggaattgtgttctaagaggcgcaagtgagaagtccaaagtggagaggtccaatacattaggtgcatgttatcaggctataaaatgtaatattctaaagtccttcaaaagctataaactattcagaagcaactatgaaggttcgtatagaaaagcttttgtgttgccctactaa

SEQ ID NO: 68767 - DNA, 769 bp, Glycine max
  misc_feature (21)..(21): n is a, c, g, or t
  Peptide Sequence Number=SeqID_160452
atggctgcctctggacctatnttctccttctccgggactccgaccatcactactgctaagctgaactggaagaatatccctcgtggtctgcttccgtggaactttggtttctcgaaggcccaggaaatttttgtcaatgatatccaaagcttgtttgacgcaaccatgaaggttatagccctcaagcaaactagtcatggcatgatcgctcatgtgggtaaggctcgggctgccgtggaagagttgagaaagttccttgtagctgattcattggaagaagtgaacaggaaacttgacaagttctacatggtccttattctgaggagcttacattcagactttgatcatgttcgtgatcaagtacttgctggggaccaagttccatctatggattcccttatcactagacttctccgcgtgcctcatttattgaaggatgagaatcctgccgatggtgtggagacgtcagccatggctgcgtctcgaggaagaggaggtagccgcaacaacagaggaggttgcagtggaaggggtggacgtcctcattgcacttattgcaagaggatgggtcacacccaagagaattgttactcgttgcatgggtttcccgacaaggtcgcacaggagtatttgaagcttaaatccgagaaacccaacaaccaagctcaatcctcatttgaaccatgtttttcaacagcttgtatctctcaatccattgaaggttctagtccttggatactcaactcaggtgtctctgatcatatttctg

SEQ ID NO: 68768 - DNA, 280 bp, Glycine max
  Peptide Sequence Number=SeqID_160453
gtcacaggttgtaccatttttggtgaagctcatgagacaggccaatgcaatcccactgacgataacactcaagaaattcatttcatggggaatcagcagaggcaagggtacactcaaggagggttttcaggcttccagtaaggtccttataatcaacaaggacagtggaggacacaccttgacaaccagttcaataaagaccaaggtggatcctcgaacaggccaattcaacaagggcctaacatcttttagaggacaactaagttggaagagaccttga

SEQ ID NO: 68769 - DNA, 112 bp, Glycine max
  Peptide Sequence Number=SeqID_160454
agcctccggtagcacagccgagacagcgatgggttctctgccccagcggggatggagcgaaagaagttttgagaattcaagagaaggtcacggcgagacgagccgtttctaa

SEQ ID NO: 68770 - DNA, 153 bp, Glycine max
  Peptide Sequence Number=SeqID_160455
aagtactgcacccccaggcaagcacagggcgaaacaccacagcagcctggggatggccagcagcgggcaacagacgcaccgccatcacctctagagttcacctcagctctccacaaaaaggtagaaagataccttggatatgcatgtatgtag

SEQ ID NO: 68771 - DNA, 147 bp, Glycine max
  Peptide Sequence Number=SeqID_160456
atggcaattggacggggcggggcagggacgggtattgcctccccagttctcaattccgactctccaacattgttatactattttcatacgcgtcaggtatcagtgcatttgtctacaaaaatcatcaagaaaaaaattaacaagtaa

SEQ ID NO: 68772 - DNA, 1566 bp, Glycine max
  Peptide Sequence Number=SeqID_160457
atgattcgtccacacatgcatgaaacatgggatgatcactactcaaataacattactacttccttgccattttcatctccaacaaccccatcaaacccttatccaaagccagcaacagaaaacaaccattgcctcaacatggggcagaataatgaactctgtgattggatggaggaacaagttagcgacttcaccaaacaccttgttgaagactttccagaaacaacaaccacttctgataacttgctttctaataacccaacaagggttaacattgcttcccatcacaaccttaatgttccctcactactttcacccaaattcagtcaaagaaaaccctcatgtttatttagaccccagtttgagtccttcaccaataatgaccccccaaacttcaatcttcacattcaaacaaatacctcaactttagatcaaagccaacacaatgttgtttatgatcaagggttgagcctaataacccttctaatggagtgtgcagtggcaatctcagttgacaacctaggtgaggctcataggatgttactagagctaacacaagtgtcctcaccctacaaagcatcatgtgctgaacgtgttgttgcttattttgcgaaggccatgactagcagggtgatgaattcatggcttggagtgtgttcccctttggttgatcacaaaagcataaactcatcattccaagtgttcaacaacatctcccctttcatcaaatttgctcacttcacttcgaaccaagcaattctagaagcagtgagccattgtgacagcatccacataattgacttggacatcatgcaagggcttcaatggccagcttttttccacatcttagccacaagaatggagggtaaaccacaggtaacaatgacaggttttggagcctcaatggaactccttgttgaaacaggaaaacagctcacaaactttgcaagaaggcttggcatgtcactgaaattcctccctattgcaacaaagattggtgaagtaattgatgtgtccacgcttcatgtgaagcctggtgaggcagtggcagtgcactggcttcagcattcactgtatgatgcaactggacctgattggaaaacattgaggctccttgaggagttggagccaagaatcatcaccttggtggagcaagatgtgaaccatggaggaggagggtctttcttagaccgttttgttgcttccttgcactactactccaccctctttgattcccttggagcatacttgcacaatgatgatgaaaaccggcaccgtgtcgagcatggccttctctccagagagatcaacaatgtgttgggcataggaggacctaagaggagtgaagacaagtttaggcagtggaggaatgagcttgctaggcactgttttgtgaagcaggttccaatgagtgccaattcaatggctcaagcacaattgatattgaacatgttttcacctgcttatgggtatagccttgcacaagttgagggaactttaaggcttggatggaaggatactagcttgtacacagcttctgcatggacctgcagtaattctagctag

SEQ ID NO: 68773 - DNA, 1398 bp, Glycine max
  Peptide Sequence Number=SeqID_160458
atggagcatgtgattggtggcaagtttaaattgggaaggaaaattggtagtgggtcttttggggagctctatttagctgtcaatgtacaaactggagaggaggtggctgttaagctgttcctaacaatcccatcttgttctgccaaacaattccaggaacctgtgaagaccaggcatccacagcttcactatgagtcaaaactgtatatgcttcttcaaggaggaacggggattccccacctcaagtggtttggagttgagggagactacaatgtcatggttatcgaccttcttggaccaagtctggaagatttattcaattattgtaatcggaagttcacattgaagacagtgttaatgcttgcggatcaattgattaacagagttgaatatatgcattcaagaggtttccttcaccgtgacataaagccggacaattttctaatgggtctaggacgaaaggcaaatcaagtgtatgccattgactatggccttgcaaaaaaatatagggatcttcagactcataggcacataccatacagggaaaacaagaaccttacaggcacagcacgctacgcaagtgtcaacactcatcttggaattgaacaaagcagaagggatgatctggaatctcttggttatgtgctcatgtatttcttaaaaggaagtcttccctggcaaggactgaaagctggcaccaaaaaacaaaaatatgataaaatcagtgagacaaaggtgtcaactcccatagaggtgctctgcaaatcatatccgtctgagtttgtatcatacttccgctattgccgatcactgcagtttgaggacaagccagattattcgtatttaaagagacttttccgagacctatttattcgagaagggtaccagtttgattacatttttgactggactatgttaaagtatccacagatcagtggcagctccagagggaggcatgtcactggcaaggcagctatgcatgcaggtccacatgtacaaaaagcagaaaagatctcagttgggaaagaaattcgagagaaattttctggtgcagttgaagtgttctcctggaggaaccctgcaaatgctagtcctcgtggtgatcacaccaaacatagaagttttgaggatgcaccagtgcaaaaggatttgcactatgcgcaacacaattccactcgatatggcagcagttcaagaagagccatgatctcatcgaacaggccaatatcctcaggtgaccatactggcaggcaaaccataactgggagccgtccatctggtgctcacagagttcaaccagtgtatgacaccaaacaagcaacttatacgcatggtggctctataagaggccgtgatgatcctctgcggaactttgagctcctcaatatcaggaagtaa

SEQ ID NO: 68774 - DNA, 408 bp, Glycine max
  Peptide Sequence Number=SeqID_160459
atgggtctggttgggaatatccctgcttcaatgggggttcatttgaaaaaactaagttatattgggcttgataacaataaccttgatgggtctgtgccttatggccttttgcagtatgctagtgagatcaatttggagaacaacaaattgagtgggagagtggaattgttctcaacaacaacaaaagtaggacaaaaggtgaagcttgcagggaacaaaggactgtgtgtggacaacaaagttgttggtggtggtgtcttgggtcaacaacaactgaaagcctgcaagaaaactgatgttcctgatgctgtcgttttcagtgggacttcttctctgctgctgcgtttttattctctcgctggggtggtggttgttgtcttctttgtcttcatcttcacgggattttga

SEQ ID NO: 68775 - DNA, 576 bp, Glycine max
  Peptide Sequence Number=SeqID_160460
atgtcttttagatcattagtattttattatgtacagcttctcgtgtattctgtgaataaacactgcatagaatcaaatgatttcctgatgtattccaaggaggatgagagcctaaggagatggaaagagaagctgttaggatgcatggaaagtgatttggatggtcagatacatcctgaagtgaaattccattccattggaataatctctgaggattttggtgaagttattacttctttatctgtggatgaaagccaaaatggtcatattctgtttactctcagggagggctctcattatcagcttaagctcaaattcagtgttctgcacaacatcgtgtctggcttgacatactgcaacactgtgtggaaaggagggcttcaagttgaccagagcaaaggaatgttgggtacctttgctccccaaaaagaaccatatgtacatgccttaaaagaggacatcactccatctggtgtgcttgcaaggggtgtatactctgctaagattaagtttgaagatgatgacagaaggtgtcacatggaactcaaatattcgttagagataaagaagaggtag

SEQ ID NO: 68776 - DNA, 1470 bp, Glycine max
  Peptide Sequence Number=SeqID_160461
atggttaagactagaggatcaggccgtaccttaagtagtgttgttggcagaggtctggggagaggggatggtcatgattctgacggtgctccccaacgtcgaaggccgaccgcatcggcgcgcaggcaacgggtacctgttactattgccaatgatgtgcctgcggtacttgcagactcgcctacgatacctgcagactcgcctgcggtacctgcggctgagcctcctgttgttggtgatgaggtgatgattgatgctgacgcacaagacaccggtgcagaggatgacgcacacgataccgatgcagacgatgctacggatgatgatgaggggtttcctggtggacctaaggacccatctgtgcttacgggctatgctgaccatgttgcagcgagcgtatggttcggagaggaacgtcatgagttaaggttgtcctcccatgggagaaaggtgcgtaaattaggcaagcctattcctgcaattgaggagctcgttgctgggacaggattaagtcccttgatcgcgtgttcagtagacaccggcgatcagggacttatatcctcgtttgttgagaggtggcaccgggagacttctagtttccatcttcttgtgggggaggtggtgttgatgctggttgagttactgatggtttcactagaggtagccgtcgccgagataggacagtgttgtggaccattcttagacgccctgcgtgacctcactcagactaggaggtatgcatggggagctgttggcctcgtccatatgtacgatcatcttaatgatgccagtatcagcactagccgacaggttgttggttacatcacgttgttacagtgttggatatacgagcactttccgtcagttgcagagtgcaacgttgatcctgactacggcgaggattccagatgtctgttggatgccatatgccgagcatcgaccggtccaggcgtttcagctgatttcatgatattccgatcaactctgttgggggcatgttgctgtcaggccattcctgctccgcctgtcgattcatgggtgtcacttgatgacatagacgataggtggatgcattaccctgaccatcttgcgccaacatgtgagatgtgcgttgtgccaggtcagtgtgcgctggactacattgactgtttcttctgcatttctcatccactcatgatcgcgacacaaccatcaaatcctctgccaaatgcacatgctgcgcagcccagacatgtccctcaggtcccagatgatcttgccaggtctaatgtcgacgagcccatacatgtagtggaggcttgcgatgtgatcgccaagaggttggagcgtcatctcagcctaggggtagtcacgccagacacatcaacacatgaggtaatcgaagaatgcctcaggattgtcaggagtgtcacggaagaccgcattgtgtacgtgaggtcacgatgtaggcgccgcatggatcaatcgtag

SEQ ID NO: 68777 - DNA, 1863 bp, Glycine max
  Peptide Sequence Number=SeqID_160462
atgaggaagcgccccgaccaaatggaaaaaggggcagcagcaaagaaccagaattcccgcatttgctttttggcatccctttctgccttcttctggtttttgctcctttacttccattttgtggtccttgcaggagataatagcaatagaaagattagttataataatcaagttgatcttgatcactcaaccctatcaacaacacctgtttctgttagttatgaacctcccccaacccatcaagtgcaagcccctcctagaaagattggcttccctgacaccgacactgacaccctacacgccaccaagaagagtttccctttcatgagagcaatgagagcttctgagaacaagagtgatccctgtggggggaggtacatttatgtgcatgaccttccctccaggtttaatgaggatatgttgaaggagtgccggagtttgagtctttggactaatatgtgtaagttcacaaccaatgccggtcttggtccaccccttgagaatgctgaaggggtgttctcgaatactggctggtatgctaccaatcagtttgcggttgatgtgatatttggcaaccggatgaagcagtatgagtgcttgacaaatgattcctccattgctgctgcggttttcgtgcccttttatgctggatttgacatagcgcgttacctttggggttataatatttcaacgagggatgcagcttcacttgctctggttgactggctcatgaagaggccggagtggagcacaatgaatggaagagaccattttcttgttgcaggaaggataacctgggatttcaggagactgtctgaggaagaatcagattggggcaataagcttttgtttttaccagcggcgaagaatatgtccatgcttgtggttgaatccagcccttggaatgcaaatgattttggaattccatatcctacatacttccaccctgcaaaggatgctgatgtgttcatgtggcaagatcgaatgaggcaactagagaggaagtggcttttctcctttgccggtgctccccgtcctggcaaccccaaatcaatcaggggtcagttaattgatcaatgcagacggtcaaatgtttgtaaactgttggaatgtgactttggcgaaagcaaatgtcattctcccagcagcataatgcagatgtttcaaagctcgcttttctgcttgcaaccccagggtgattcatacacgcgaagatctgcttttgattcaatgctggctggttgtatacctgtcttcttccatccaggctcagcatatacacagtatacttggcatcttcccaagaatttcacaaagtattctgtcttcattcccgaggatgatattcgtaagaggaatatcagtatagaggaaaggcttagtcagataccccctgagcaagtgaagatcatgagagaagaggtcattagtctcattccaagactagtgtatgctgatcctcgctccaaattagaaactcttaaagatgcatttgatgttgcggtgcaagcagtaattgacaaggttacaaatttgaggaaggatattattgaaggccgtacagatgacaacttcattgaggagaacagttggaaatatgctttgctgcctgagggagagcacgaggtaggacctcatgaatgggatcctttcttctccaaaccaaaggatggtttttctgatttctgcttcatgtatttctcctcactacttagtggttccaagaatgatttgggaggaaatataaacaaaattattacagttaatggcaccagaacaagtttaaccattgaagtcatggatagatcagttgaagtttcatttctccgatacatcagcctgccatacacgaaaatgcgttga

SEQ ID NO: 68778 - DNA, 780 bp, Glycine max
  Peptide Sequence Number=SeqID_160463
atgacatatggtaaatccaagaaatctgatctgagagaaaacctcaaattttcatttgggggcgggggtgccgaggaggctggcctgctggagctcgaggtcgttgagctgctgctcgcggtccatctcgacgatcagagggacgacgaggacgaggaaggtggtgccggcgatccacgcggccttgccggtgctgcggaggagcttcttggcgacgaatgcggcgtcgacggcggcttccttgccgcggtgaatccaaaggtgaaagtgagagtcccagagcaagaagaagaacttgttcatccggaaaacaatagtggaacttggatgttttcaaagttaattgagttactatactttaaagaagagaagaatcagaatcagaatgaatgtccaccctcaatttccgaaagcacaaaggcttgtactcaacatgtagaaactggagtagattttgatgatgtttcaacttccacaggattattcaagagtatcaaccgagttggtgagagtccaaaagtaaatgcaagagcttgttctgttatacgcccacgtgcagtcttatctagtcccgaaaatgatggattaattggaagcataaatgacttgaaccacagtgtatcttcagctcacagaaagaacaatgcaaaagtgaagatagaaggccaagctaaagttttgtctattcaggtgaaggaaggaaaatattcggacaaggaggaatgtgaggcattcaacaaaggcagaactccttccaaagtgcatgttagaaacttttaa

SEQ ID NO: 68779 - DNA, 50 bp, Glycine max
  Peptide Sequence Number=SeqID_160464
atggaggtgggaagaactcagaaaagcagtgaagtcgtggaagtgttgat

SEQ ID NO: 68780 - DNA, 2715 bp, Glycine max
  Peptide Sequence Number=SeqID_160465
atgaagggagaacatttcttgtggaagttgtttaatatacacaacgattatgctgaaacaattaaggatcttgaagatgaggaaaaaagccgtgaaggtgttgttaaagagctagaatactttgaaagtgaagctagtaaaaagaaaaaagagcaggctaaatatctgaaagagattgcactacgtgaaaagagaattgctgagaaaggcaacaagcttgacaagagtcaacctgagcttctgaagttaaaggaggaaatgactcgtataacttcaaaaattaaaaaagggaagaaagagcttgataaaaaaaaggttgaacggaagaagcatgatgctgatatagcattactacagaatgacatccaggatcttacagcaaaaatggcagaccttcaggaaaagggacgagatgttgatgacgagcttgatttgcaaggcaatgacttggaagaatattttcgcatcaaagaggaagctggaatgaaaactgcaaagcttagagaggaaaaggagcttctagataggaaacttaacgctgatagtgaagctcaaaagaacttggaagaaaatcttcaacagttaagaaacagggagtctgaactgaattcgcaggaagaacagatgcgagcaaggcttgaaaaaattcttgataattctgcaaaaaataaagttggccttgaaaacttgaaaaaagaactacgcgtgatgcaggacaaacatcgtgattccaagaaaaaatatgaaaatttgaagttaaaaattggtgaattagaaaatcaactacgtgaattgaaggctgatagatatgaaaatgagagagatgttaggttgtctcaggctgttgagactctaaaacgcctgtttcaaggagttcatggtcgcatgactgatctttgtagaccaacacagaagaagtataacctagctgttactgttgctatgggtaaatttatggatgcagtcgtagttgataatgaaaagactgggaaggaatgcatcaagtgcaagtttgatccctccttggagaaggcaattctctttgctgttgggaatactctagtttgtgatgatcttgaggaggccaaaattttaagctggagcggtgagaggtttaaagttgtaactgtggacggaattctgttgacaaaatctggcacaatgactgggggcactagtggtggaatggaagcaaggtcaaaacagtgggatgacaagaaaattgaaggacttaataaaaagaaagagcagtatgaatcagaattggaagagctaggatcaataagagatatgcaccttaaagagtctgaagcatctggaaaaattagtggacttgagaagaaaattcaatatgctgagattgaaaagttaaatgatgctgttaacaagagcaatgcagatgtacgtaagcttgagaagaggataaatgaaattactgacaggatatacagagacttcagcaagtcagttggggttgcaaacatccgtgagtatgaagaaaatcgactcaaggctgctcaaagtatagcagaggagaggctgaacctgagtagccaactctcaaaattaaaatatcagttggagtatgagcaaaatcgggatatgaattcacgaattcaagatttggaatcttctcttggtgctttagagaaagatttaaaacgtgtacatgacagagaggctgcagcgaagttagcagctgagaatgctacggaagagattaatcaacttaaggaagaagctaaagagtggaaatcaaagtcagaagattgtgaaaaggaaatccaagagtggaagaagaaagcttctgcagccacaacaaacatatccaaacttaatcgtctgatacactctaaggcacagattgatcagttgaatgtgcaaaagcaggaaatattagaaaaatgtgaactagaacagattagcctcccgatcatactggatcctatggatactgatagctcagtaccaggtccatcttttgactttgatcaactaaatagggcactgaaagataggagacactcagacagggataaaattgaggtagagtttaagcaaaaaattgatgccttgatatctgagattgaaagaacagcaccaaatttgaaggcattggaccaatatgaagctctgctagaaaaagaaagagctgtaactgaagagtttgaagctgtcaggaaagaggagagggaaaaaacacagagattcaatgaggttaagcagagaagaaactcgttgtatcttatctgtcttctgatgaagccaaagtttgtgttggatgcagcatacctaaacttggaaaatgacgatgatccatttctacatggcatcaaatacactgctatgcccccaacaaagcgcttccgtgatatggagcagctatctggtggggaaaagacagttgctgcacttgcattgctattctccatccatagttacaagccttccccgttttttatattggacgaagttgatgctgcgttggacaacttgaatgttgccaaggttgctggctttattcgttcaaaatcttgtgaaggagcaaggattagtcaggatgttgatggtggaaatggtttccagagtattgtgatatcactgaaagacaccttttatgacaaagccgaagcattagttggggtttacagagactctgaaagaggctgttcgagaactctcacctttgatttgactaaataccgagagttctaa

SEQ ID NO: 68781 - DNA, 2519 bp, Glycine max
  Peptide Sequence Number=SeqID_160466
gccatctgtcgcacgccatccgcattcagggtcagtccgggcactccagcgatccggcgcgcggcgtgaacgcgatcgagctgatgcatgaatccattactcagctgatgcagctgcgtaatacgctgaaagagcgctatcaccacgacggcttcgccattccgtatccgaccatgaactttggccatatccacggcggcgacgcggcgaaccgcatctgcgcctgctgtgagctgcatatggatatccgtccgctgccgggactgacgctgagcgatctcgacggtttactcaatgaagcgctggcaccggtgagcgcgcgctggccgggccgtctgaccgtaggtgagctgcatccgccgattcccggctacgaatgtccggccgatcatgaactggtgaaggtggtggaaaagctgctgggcgtgccgacagaagtggtgaattactgcaccgaagcgccgtttatccagcaattgtgcccgacgctggtgttagggcctggatccattaatcaggcgcaccagccagacgagtttattgataccgcatttattaagccgactcatgcgcttatcactcagggtcacatgaacgaacaatattccgcaatgcgaagtaatgtcagtatgctcggcaaactgctcggggatacgataaaggatgcactgggagagaacatcctcgatcgggtggagaccatccgcaagctctctaagtcatcccgtgcaggaaatgacactcatcgtaaggaactgctctccacgctgcaaaacctgtctaacgacgagctgctgccggtggcacgcgcgttcagccagttccttaacctcaccaacgtggcagagcagtatcaaaccatttcgcgcagcggcgacggtgctaaccatccggagctgctgaaaaagaccttcgagcgcctgaagcagcagagcgatctcagcgagccggccatccgccaggcgattgaggagctgtcgctggagctggtgctcaccgctcacccgaccgaaattacccgccgcacgctgatccacaagctgggcgaagtgaacagctgtctgcagcagctcgaccacagtgacatcaccgactacgaacgcaaccaggttatgcgccgtctgcgtcagctggtagcgcaggcgtggcacaccgatgagatccgtaaatatcgcccgacgccggtagatgaagccaaatggggcttcgcggtggtggagaacagcctgtgggaaggcgtaccggcgtttctgcgcgagctaaaccagcaggtggaagagagcttcggcatccagctgccagtggattttgtgccaatcaaatttacctcgtggatgggcggcgaccgtgacggtaacccgaacgtcaccgcaccgattacccgccacgtgatgcagctaagccgctggaaagccgccgacctgttcctgcgcgacatcggcgtgctggtgtccgagctgtcgatgtccgagtgcagcgacgaagtgcgcgaactgtgtggcgatgcggaggcgctggagccctatcgtgtaattctgaaacgtatccgcagccagctgatgagcacccagagctatctggagcgccgcctgaagggcgagcgcctgccgcgtccggccgatctgctggtctctaacgatcaactgtggcagccgctgtttgctatttaccagtcgctgcagcagtgcggcatgggcatcatcgccaacggccagctgctggatacgctgcgccgcgtgaaatgcttcggcgtgccgctggtgcgtatcgatatccgtcaggagagcacccgccacaccgaagcgattgccgaagtgacgcgctatctcggactgggcgactacgaaagctggtcggaagctgataagcaggcgttcctgatcctggcggcagaagcgccgcagggctcgattgccgcctatgtgatttcgatggccaaaacgccgtctgacgtgctggcggtgcatctgctgctgaaagaggctggcatcccttacgcaatgccggtggcgccgctgtttgaaaccctcgacgacctcaacaacgccaatgacgtgatgagccagctgctgaatatcgactggtatcgcggcttcatcaacggcaagcagatggtgatgatcggctattccgactcggcaaaagatgccggcgtgatggcagccagctgggcgcagtatcaggcccaggatgcgctaattaaaacctgcgataaagccggcattaccctgacgctgttccacggacgcggcggttcgattggccgcggtggcgcaccggcgcatgcagccctgctgtcacagccgccgggcagcctgaaaggcggcctgcgcgtgaccgaacagggcgaaatgatccgcttcaaatatggcctgccggaagtcaccatcgccagcctgtcgctttacaccggggcgattctggaagccaacctgctgccaccgccagaaccaaaacgcgaatggcaggagatcatgaacggcctgtcagcctattcgtgcgccatgtaccgcggctac

SEQ ID NO: 68782 - DNA, 1659 bp, Glycine max
  Peptide Sequence Number=SeqID_160467
atgtatagaaacataggacgtactggtatgcaaaagtcttacgattacgatgccattgtgattggctccggtccgggcggcgaaggtgcggcgatggggctggtgaagcagggagcgcgcattgcagtgatcgaacgctaccacaacatcggcggcggttgtactcactggggaaccatcccttccaaagctctgcgtcacgctgtcagccgtatcatcgagttcaatcaaaaccctctctatagcgatcacacccgactcctgcgctcctcgttcgccgacattctgaatcatactgagaacgtcatcagccagcagactgccatgcgtcagggcttttacgagcgtaaccgctgtgagctttatcagggcgacgcccattttgttgatgccaacaccatcgaagtggaacagccagacggcacgcgggagcgcttaaccgcagagaagtttgtcatcgcctgtggttcccgcccgtatcacccggcggacgtcgattttacccatccgcgcatttacgactccgactccatcctcaacctgcatcatgaacccggccacgtcatcatttatggtgcgggcgtgattggctgtgaatatgcgtcgattttccgcggccttaacgtcaaggttgacctgatcaacacccgcgatcgcctgctggcgttcctcgatcaggagatgtctgattcgctctcttatcacttctggaacagcggcgtggtgattcgtcacaacgaagagtttgagaagattgaaggtgtcagcgatggcgtcatcatgcacctcaagtccggcaaaaaggtcaaagccgattgcctgctgtacgctaacggccgtaccggtaataccgattcactggcgctggaaaacgtcgggctggaagccgatggccgtggactgctgaaagtgaacagtatgtatcagaccgcacagccgcatatctatgcggtgggcgacgtgattggctacccgagcctggcctctgccgcttacgatcagggccgcattgccgcgcaggcgatcatcaaaggggaagccaccgcgcacctgattgaagatatcccgaccgggatttacaccattccggaaatcagctccgtcggcaaaaccgaacagcagctgacggcgatgaaagtgccgtatgaagtgggccgtgcacagtttaagcatctggcgcgcgcgcagattgtcggcatgcacgtcggcagcctgaagatcctgttccaccgcgaaaccaaagagattctgggtattcactgctttggcgagcgtgcggcggagatcattcacatcggccaggccatcatggagcagaagaacggcgctgctcatagcggctgcgcagaggcgatcccggacgatacaccagcgcgatggtgcgctgcggcaccgcgacggcagcaaagtgatgccgctgccagcggctaccatgttgcgcagcgtttccaggctggtcgcgcggaaatgggtatcttcatcagcgccggcttcgaagcagaagcccatcgcctgatcgcgcagacagtgaccatcttccagcatcagcagtttttcaccggccagatccgacatcggcacgcgatcgcgatcgtgccacgggatgatcctgatagatcgccagcttcattggctcatcgaacagcggcacttcaataa

SEQ ID NO: 68783 - DNA, 324 bp, Glycine max
  Peptide Sequence Number=SeqID_160468
gtgagcgatatatatccacgcattgaattggctaacggccaaaccaaatacagtgattcaaaaagcattcaaatgcctaagctgcgccgtattacacagatgaccagagtgatgagcaaaatgacggcgatagtgacgaagtctatttcgttgaagcctatgggaagagatggcaccgtgaggcgccatttggcagaggagattccgattgtggtgcctaggtacgtcgtagctgaaggcgccgccgacgacaggcatgtcgatgaaaaactcggtgtagtagaaggcggagaggagggtgcagaagccggcaatggcaattaa

SEQ ID NO: 68784 - DNA, 579 bp, Glycine max
  Peptide Sequence Number=SeqID_160469
atgagacagtggttcgcttataggcttcattccaggtcaaatgaagcacaaactttattgcattctaggaaactatttcaacaattcattgttgaaggatataccatggttgaatcggagaggcttagctacatcagaaacaaccaaaagaaacttagagttgacaagtattgcagcttacaaagttcattggatgttggaacaaacaaaggcttaactaaagggaaaagagtcattttaccttcaacctttgttgggatcccacgttacatggatcaactttattttgatggtatgacaatatgtagtcatgttggtttcccaaatctttttattactctaacatgtaatccaaattggcctgaaattcgtagattactttcacctttgaatatgaaagcaacagacaagccagacattgtctcacgaattttcagattgaaatatgaacaaatgctttcagacttaacaaagcatcacttgctcaaaaaagttgttgcatgtaagtgtgagtatgaacaggtgtataaactatctgtgcaaaaagaaagaaaatcacgcgagagaaatgatgtgtaa

SEQ ID NO: 68785 - DNA, 213 bp, Glycine max
  Peptide Sequence Number=SeqID_160470
atggcttcgagaaagctttccacaaagagatctaggagggacgccgcggctgaagggaccagtgtcgctcccgagtttgacagccaccgtttcaagagtgctgagcaccaacaatgtttcgaggccatcaaaggatggtcgttccaccgagacaaatgggtccagctcagggacgatgagtacacagattttcaggaagagatagctcgttga

SEQ ID NO: 68786 - DNA, 285 bp, Glycine max
  Peptide Sequence Number=SeqID_160471
atggctaaagagaaacctcgacgagtgaccctagaagattactcaagtacatctgtgccgcagttctttactagcattgcgtggccggagtcgtcttatacgactaactttttgtcacaacctacccatttgcgggtgagcgaggagaggctcatgggtgcgtcttccataggaggaaaatgcgtggagtcaccaccaacgtttattgaaaggaaaacgttagaaaaactaaagaaaaccggtcatgaagaatattccagattcgggagttatctttacgtttga

SEQ ID NO: 68787 - DNA, 1095 bp, Glycine max
  Peptide Sequence Number=SeqID_160472
atggcatcgttcagccagatgcagtcccaatttcagtcccagatgcaatctcagggacttgcactgcctccaaagcctctggttggtccctcaggtcctcgagtaggcacaaaggagagttgtgttgatccctcaagaaatgatcctgagacgggtgactcagataggtgcggcttgtacatcgaagcaaatcatgcctgcctggttgccctgaggagagtttatgagggatcgactattgttcataacactcctttattgcctagccaagtaaaggtgggtgtggaggaggttaaagatccagatgctgcagttcctgtacccactgatgaggtttccttggttgggcaggcaattctcaccttccttgcttggtcttcacatctggtcaagtctttatcacaacaggtactgtactcttactatatgtttcttctttttcaattacttcattcagtgtgcctcaaattagcccatttaactttttttcatgaacaacctgttgtgtctccggcaaaaccacctcaaaagtcgaatccggaggttgatgatccgctttatctgatgacattgaccatcccggagcttttcttgaggccttaccaggttacatgggatgccaccgtgtttagggtctttaattcagacttcccgctctacataaagcatgaagacctctccgaaatcgcacacggtggtcaatgtctcagcatatcagtgttacagttgtggattctgcatttgactgaaacaagtatgcgagcggagaattttgatatctatggattccttgagccacagtccattcagaggtctggacaatcacagtttgagactgaaagttacataaagagttggatgcagagttcaaaatgcgatgtctaccttggagcctacctgaatggcggacactggcagatggtggtcatcatgcccaaggaacacctagttgtctggttttgttcattgcataacaggtcagacaactaccttaaggggatcattaacaggtcagtgttcttttcaatgcatttgaattcaaatgcctcaacaacaccactttttaattgttactcgcctggaacagtgctttaa

SEQ ID NO: 68788 - DNA, 285 bp, Glycine max
  Peptide Sequence Number=SeqID_160473
atggcgaaagtagagaaaaccatggcaggattagcaactgatcaaggaaccgacgtgaaccaacccattagattaccaaacactagggacaaccaaatcaatttctcctcatggctccacaacaaccttaaccacaacaaattcatgggtgcaagcactgaggaccccatgctcatctcacaagatttctataattatgcatatcggaagtgtagccgattggctcaactcgctcccacatcattcactaaccacatgggaggaagtcaaagacaaattccttaa

SEQ ID NO: 68789 - DNA, 177 bp, Glycine max
  Peptide Sequence Number=SeqID_160474
atgagaggcactatgcacgagcctcaagcaaacctaggggcagatcataagttcttacctggagtagagcctgacacaagagttgaaaggaaccaaagtacaagcaatactctcaaggttcttactcaatataaccctcaaaaactctttgagcctctcaaatcctttctttcatag

SEQ ID NO: 68790 - DNA, 246 bp, Glycine max
  Peptide Sequence Number=SeqID_160475
atgaatttgaagaaatgtccaaatgccctaggtgtggggtatcacggtacaaagtcaaggattataaggagtgtagtattcatgaaaactcaaagaagggcctcgcagcgaaggtgttgtggtatatgccgatcgttccaaggtttaagcgtctttttgctaatggagatgatgctaaagaccttacatgacatgcaaattggagaaactgcgatggaatggttgctggaccaacggcctcaataa

SEQ ID NO: 68791 - DNA, 300 bp, Glycine max
  Peptide Sequence Number=SeqID_160476
atggtagccataacccctgctaggtttcgtcaatctccattttttcgaggatacgactcgaacgcaacgtgtgcttgtcatggagaagccccgaggcgttccattgagcattgtagggccctcaagagtaaggtgcaaggtctaattgatgcgggctggctgaaatttgaggagaatcgcgtgattttcaagtgcaagccattggtcaatttgctcaagcgacctgtgctcctgagtttggacttccaagaccgttcaatcagagattactcgtcttgcacgttggtggggttgccgtaa

SEQ ID NO: 68792 - DNA, 444 bp, Glycine max
  Peptide Sequence Number=SeqID_160477
atgggtcgtcgtcccttgcctagctctggaaaaatggaaagcgccgctgcaaggcagcctatgggttcgagtgagcaacattctgcccagtgtgtctttaaaggatcgcgcccacaagacacgcagtggacccggagaagcccaacaaggccctggggtttccagctctggttacgggcctctgtcactcctatagggtgcccgtcccccccagcaaggtcatgccatcgtgacatagggatcgcgcctgcaagactcctagtggacccggagaagtccaatagggtcttagggtttccaactctgattacgggcctctgtcagttctacagagtgcttgtcgcccccaacaaggtcatcaggcccctattaacagggctttcatcgagaagtactgcgcccccaggtaggtgtagggcaaggcatcacgacaacgggcaatag

SEQ ID NO: 68793 - DNA, 234 bp, Glycine max
  Peptide Sequence Number=SeqID_160478
gagggagaggccctgacggactcttcggagtgtagcccttgggcgtcacccagtttgagtgctcctttaagcctgtgtcgatcccacatggttggagcattctcgcaaaacagccgcctaagtgatgcaatcctccctaggaagggaccaatcactagaaccatgagcaagaggctccaagaagattgggctagagctgctgaagaaggccctagggttctcatgaaccttagg

SEQ ID NO: 68794 - DNA, 342 bp, Glycine max
  Peptide Sequence Number=SeqID_160479
atggagatcacatcctggccgcctcaacaagggcctaacatcttccagaggactaccaaactagaagaaaccctggctcaattcatgcaagtgaccatatccaaccataagagtactgagtcagccctgaaaaaccttgagattcaggtgggtcaactgaccaagcagttagttgagaagtcatccaacaactttggggaaaatattgagaagaatcccaaagaagagtgtaaagttgttgtaacaagaagcgggaagcttgtggcggctgaggatgaggacgttgttgctttgaaggagcaatttgctttcaaggacactactgttaaaaagaaaaatgag

SEQ ID NO: 68795 - DNA, 597 bp, Glycine max
  Peptide Sequence Number=SeqID_160480
atgtcttgcctagtgatcataactccgaccatcctctgccgaagtgtcagctggtgtatgccacccaccaggcaccctctagacccggataagtctaacagggccctagggtttctagcattgatcacgggcctttgccagtcattcagggttctcgtcacacctagtaaggtgattcgaccgccgatcacccgggccttcattgagaaatattgcacgcctaggcaggcacagggcgatgcaccacaggccgcagacgcatcgccaccacctcatcaggctgatcctgctgggtcattaggcatggagcggtatctacaacacttggtttgccagcaggcggccaaccaccgggggcaggtgcagatacatgagtgtctctaccagctcagcctcagtcagcagggccagggtttcattccttttgcgtgccctactccagatcagtttagggctgaggtcgcatggcccgaagattggcccgaggcccaggcaggggaggcacctgcagaagctccgagcgatgtagaggaggcctgcatggatgaggagatgacagatttgctcggtttcttgggagggagcagagccacatga

SEQ ID NO: 68796 - DNA, 390 bp, Glycine max
  Peptide Sequence Number=SeqID_160481
atgttacggaaccttgtggattacataatcatcccctttttgacttacggaatattacggaacctcactaattgtgcaacgatgcttccatttgatttccgatgggatacacctattcatgtggatgctgcaagtagtgcctttattgctccattcctttatccagagttagaatgggattttagacttccatttgtggagagcataaatgttagtagccacaagtacgagcttgtttatgctggcattggttgggttatttggatgaccaaggatgatttaccagaagactttgtcttccatattaattaccttggagctgaccaacccaccttcaccctcaatttctctaaaggttctagtcaaatcattgctcaatcttattcttag

SEQ ID NO: 68797 - DNA, 274 bp, Glycine max
  Peptide Sequence Number=SeqID_160482
atgactaggggcaatccaagtgatttacaaccctttgatcctgaaatagatagaacctttcatagattagttaggcataatttgcatcctggtcattctgtgcattttgagcattctgttgagggtgattctgaatattctaattttgagcattccactactaattttcataccgagaacatggctcaacctcctcctcatgagaggactcttagggagatggctgcacctgatttcacttatgaaagcttgtgcattaaatatcctgatgagg

SEQ ID NO: 68798 - DNA, 428 bp, Glycine max
  Peptide Sequence Number=SeqID_160483
atggctcaacctccacctcgtgagaggactcttagggagatgattgcacctgatttcacttatgaaagcttgtgcattcaatatcctgatgagggtgttccatatgttctcaagactggactaatacatctgttgcccaagtttcatggtcttgcaggtgaagatcctcataagcatcttaaggagttccatattgtttgttccaccatgaagccccctgacgtccaagaggatcatatctttctaaaggcctttcctcattcgaagcaaacccatgacaaaagcagtatactaccttgctcccaagtttattttcagcggacagatgaccttaagcagggtgttcttggagaaattctcccaaatctagaggaccaatcctccacaaaacaagcagttcggcccctcgactttctagaatgttgttg

SEQ ID NO: 68799 - DNA, 393 bp, Glycine max
  Peptide Sequence Number=SeqID_160484
atggccccgaggaaacttgcctcaaagagatccaggaaggataaagcggccgaaggaactagttccgctcccgagtatgatagtcaccgctttaggagcgctgaacaccagcagcgtttcgaggccatcaagggatggtcatttctccgagagcgacgcgtccagctcagagacgacgagtataccgatttccaggaggagatagttcgccggcggtgggcatcgctggtcacccccatggccaagttcgatccagacatagtcctcaaattttatgccaatgcttggccaacagaggagggcacgggtgcggatcatgcgcaccaacatgaccaccctgactcagatatggatgactttgctgctcagcaacatcctgcccagcgatcataa

SEQ ID NO: 68800 - DNA, 951 bp, Glycine max
  Peptide Sequence Number=SeqID_160485
atgatcctggcgaacatctcggcggcacgtttcgtcgaaaaagccaaagagccggcgctgttccgtattcacgataagccgtcgacggaagccatcaccgcgttccgctccgtgctggctgaactgggtctggagctgccgggtggtaacaaacctgagccgcgtgattacgctgagctgctggagtccattggcgaccgtccggatgcagaaatgctgcagacgatgctgttgcgctcaatgaagcaggcgatttacgatccggaaaaccgcggtcacttcggcctggcgctgcagtcttacgcccactttacgtcgccgatccgtcgttatcctgacctctctctgcaccgtgcgatcaagtatctgctggcacaggagcaaggtcataaaggaaacaccactgaaaccggtggctaccactattcgatggaggagatgctgcagctggcgcagggcgtggtgattcaggttgccagccgccagttcctcgatgagaaaagcgaaggcgcggtgcatcagggcatcattgcccgcgtgaagccgggacgtcagtatcaggaaaacgatctgccggatctgttggcgcagttcgatcaaccgttcctgctgatcctcgacggcgtcaccgatccgcacaacctcggcgcctgcctgcgtagcgccgacgccgccggcgtgcatgcggtgatcgtgccgcgcgatcgttccgctcagctcaacgctacggcgaagaaagtcgcctgcggcgcggcggaaagcgtgccgctgatccgcgtcactaacctggcgcggaccatgcgtctgttgcaggaagaaaacgtgtggatcgttggtaccgccggcgaagccgaccatacgctgttccagagcaaaattcccctcaccctgaccctctccccgaaggggagagggaaaagaacagtcataatgagaaccatcaatgagtga

SEQ ID NO: 68801 - DNA, 672 bp, Glycine max
  Peptide Sequence Number=SeqID_160486
atgtccctgaggacaaagcaccaaagcaagttagggttcgagggcaccttcttaagttcgatgttgaggccagaccctcaagagctggcaacccggctatgtatcgctggaagggaatttgttcttaacactgagggcttgccatggaagctcttgaggaaggatcttacaactctagcacagacctggagtgttttatcttattctaacctagccctgacttcacatacctctgatcttaatcttgacagggctaggttagtttatgggctagtaatgaagatgaacatgaacataggagcacttatatctgaacagatcttgctcattgctcagtccaactcctcgaggcttggatttctagccctcatcactgccttgtgtaaggcccgaggagtcaccttagattctctcacttatgagtcactcagcccagccattaatttggcttatattaagaagaattgttggaacttggatgacccttcggtcacttttccagggacccaaaaatctagggctagaagatctgaggccccatctccttcagctgcccctactccccctacttcttctctcccttcagcactagcagccccagttcttctaggtccctctgctcagagctcagagcctttcatgtctatgcttaagagcctgcaccaaggctag

SEQ ID NO: 68802 - DNA, 1668 bp, Glycine max
  Peptide Sequence Number=SeqID_160487
atggcagcagaatggagaaggaggaaaggtgattggagacgccacttcatggagaagatgaggcaagaacaagctcaccaccataggaagccatgggctcatgaaaacccagggccttctcctgcatctctggcgcaatcttcttggagtctcctagccatggcactagtgctgggtccccttcttgggaggattgcatcaaaaatgaggaatgaaattgaagaagaaaacaagcaaactctaggaaaaatgaaacaggagttgaacgaggccatcaaaatagagttgtctcaaaggggattggtgtacacacccccgattgacatggatatacagatattaggtgcacgcgtgagcacaaagggtagcaatgctgaaattgttgtccatgcatcaggggaagaacatgatgctaatgttatattgactatggggttgtatgtgcaaggtgataattgtacacgtttggtggccttgggaaacatatatgatagggggctagcctctggctcgcctgggccatcaaaagacttcaatgttaagaaaccagttcgcttgggcgagctgcagctcacctgggcgggaagaggagttaaggaaggggttctaaggcaagcccttgacacattcattgcatggccggaaaatcttgtcaaacttgtatcacatgaggattcacatgttactcctaagaaagtggttgaacatgttaaaaggtcgaatgatgttggtgcaaaggatctattgcgtcagttgattagggccatgtatgacatttacgacaaccctgataagttgttatgggataggagtaaatttgggattccaaatgcggatgcattgttcttcttaacattttcttatgtaaatgaaataatatcaggcgtgtccaatgggaacatggttatgaagcttcatcatagccttatcattgttgttgaagaatttgcattaatggagtgggatgagtcccattctagcgcttgttggggtgactttcccaggttgtgtcatggtgatcatagtcaattgctcattgataatcccgttaaagctttaatatatagaggtgatacaacaaattggttgtggggtcaatcattagctggcacttaccatggacaggttggcggtgaggtctctctctcgatcgcgcttgtcggtccaacgcaagtctctattacgccaaaacgaaaggaatttagtatggatttcaaaaacaaggtcaaaggtaacattcggggtcaaatacccttgtcaaaacataaagagctgaggggtgtttcggattctacaaatggaaacatcattttgaaattccgatcacgccaatgtgatcaaggattgagggattttctccatcgaatcttcgaggaggattctgagaattctactccgattaaagtgttcctcttgaagaggagagtgaaaaatcttgtttttcacgctgaggacggctcacttagcgcacctttgggccgctcagcgcaattcccctcgattggaattgcgcttagcacaccattctcacttagtgggagaccaaaagttattacttttcaaaatcccaatggtcagactgtagaaacatatcttagggagatgcagacaaaatttgaagacgatccaacggttaatgaattcggtattgcgatttcgctgaactag

SEQ ID NO: 68803 - DNA, 258 bp, Glycine max
  Peptide Sequence Number=SeqID_160488
atggccaagccggtgatgaatttactcaaaaagacaaagcactttgattggagtgaggaatgtgatgcctttcaacaattaaaagtgacaccaacaactccaccgatacttaccaagccaaaaactagcaaaaggcttattcctagcacatgggaaacttccttgagaagcaaggaaggtagcttccttgggaggataaaggaagaaagcttccttgagaagctagagggaggctacttacacccctcaaatagctaa

SEQ ID NO: 68804 - DNA, 243 bp, Glycine max
  Peptide Sequence Number=SeqID_160489
atggtcaagtggggtcctgaacttcatacgtcggctaggagagggactgttgtagcctttgcagataattctcagcttgtagataatagtcgggagcttacagataatggagccccaccacatggttccaatgcgatccttgcagcaaatactatcccatgcattgccctcccttcaacatacgcacatcaacctccttcaaagaacatggctactacttcgacacgtgcctcatccctatga

SEQ ID NO: 68805 - DNA, 222 bp, Glycine max
  Peptide Sequence Number=SeqID_160490
atgcagcagatattctacattttggtcggccctgagcgtcgtctggaggttgtcgggaaaggttcttcttcttcttcagccaccattgttgccgtgaagaggttgcgaggtgcattgaggaggttttcgttcatcgttgagggagcttcgtcaccgtccatcgtcgagggagcttcgtcaccgtccatcgttgagggagcttcgtcaccgtccatcgtcgag

SEQ ID NO: 68806 - DNA, 363 bp, Glycine max
  Peptide Sequence Number=SeqID_160491
atggaaagtgggaagaatcatatgctaagcttccaaaaagttttgggaaatttgcaatcatgtgttcccggggctgtggtcactactcaaacaaaattggtgtttaaagagggagaaatgggtacacatttgtggagaagatgcactgatggcatcttaggaatatccataagaataagccaagtgcagagacctaagccccacttaaaactaccagaccacctagaaggtgatgtaagctccattggagcttgtaggcctaggatcttcttcatcaatggattcctttgcttcttggaagatgaatggcagcaaaatggagaaggaagagagagaatagatgccacttcaaggagaaggtga

SEQ ID NO: 68807 - DNA, 345 bp, Glycine max
  Peptide Sequence Number=SeqID_160492
atgactaaagcacgtcaaaagggggtacggaaagtaaatgaaacgaaaataaaaagcacgcgaaacaagtggggaccaccaaggggaaaagagggagaagcttgccacccagctcgcccaggcgttctggaggaacttcttggaaggcccaaaaccttacgaattgtgcaacaatgcttccttttgacttccgacatgttacagaacctcacggattgtgcaacaatgcttccttttgactttcggcatgttaaggaacttcacggattgtgcaacaatgggtgccaagtatctcgaagcggtcaagcaaaggttgcatgccatcaaacaatggttcttagatga

SEQ ID NO: 68808 - DNA, 597 bp, Glycine max
  Peptide Sequence Number=SeqID_160493
atggcattggcacatgatttggagaggagtgacccatggaacaagtgggtagcaaatgttttgaatgtatgggggtttgcccaaattcacattgacgtttgcatttcggaagaagtggagatggctccgaagaagctttccacaaagaggtctaggagggacgcccatggggaaggctccaacgcccccatggagtttgacaatcaccggttctggagtgccgaacaccagcagcgcttcgaggccatcaagggatggtcgttccacagggagaggcaattccagctcagggaggatgagtaccctaacttccaggaagagatagctcacaggcattggaaacgactagtgacccctatggctaaattcgacccggagataggggttcaagacatgcgctcatgtgtgaggggtcactggatccccttcgatgcagatgccctcagccagttcttgggccatcgcccgactcctgtgcataccggggcaggatttcgcccgaaccgctgcgcggaggtgggtgcggatcatgcgcaccagcataactaccctaacccagatatggatgacactggtgctcagcaacgtcttgcctag

SEQ ID NO: 68809 - DNA, 1986 bp, Glycine max
  Peptide Sequence Number=SeqID_160494
atgccggcgtcaactcggtcccagactgtaccgaacgagtcaaactcggaacacgatgccctaaaggagaagatgaaatcgcttcttgcgttgtacgagcagcacaagcagaagcacggtgctgctgcagcagcacctcctcccagcaagaacccttctttgaagactgggacccgcattctggtgttcgttagggttaggccgttggcgaagaaggaaatggaagcgggttcacggtgctgcgtcagaatcgtcgatcgccgcgacgtttacctaacggagtttgcgtccgagaaggattacctcaggctgaagaggctcaggggtcgccattttgccttcgatgcttcgtttcccgattcggctactcagcaagacgtttattccaccacaacctcagaacttgtggaagcagttctgcaagggaggaatggatcagttttctgttatggtgccaccggagctggaaaaacttatacaatgcttggtacagtggagagccctggtgtaatggtgttggcaattaaggatttgttcaataaaattaggatgagaagttatgatggaaaccatgcggttcatttgtcctatcttgaggtttataatgaaactgtcagggatttgctttcacctggaagacctctggttctcagagaagataaacaggggattgttgcagcgggtcttacacaataccgagcttattccactgatgaagtgatggcattgcttcaacaaggaaatcggagcagaaccacagaaccaactcgtgcaaacgaaacatcttcacgctcccatgctattttgcaggttgtggttgagtaccgagttagagatgctgcaatgaatattattaaaaaaatgggcaagctctcactgattgatcttgcagggtcagagagagctcttgccacagatcaaagaacagttagatctcttgagggtgccaatataaaccgatctcttctggctctaagcagctgcattaatgctcttgtagaaggcaagaagcacataccataccgaaattcaaaactcactcaacttctcaaagactcattaggaggatcatgcaacacagtcatgattgcaaacataagcccaagtaacctcgcattcggtgaaacacagaacacccttcattgggctgacagagctaaggagattcgaacaaagtttatcacttctgcaagtacagggttcaacctttttttaacctgctttatgtgtatccaggcaattaatgcaaatgaggacctattgccagtgcctgagacagaaacagaccaggccaagctagtacttgagctgcaaaaggagaatcgtgaattgcgaatgcagctagcacgacagcatcagaagattatgacactccaagcacattcctcagctcccccaacaccaccttcagctacatctcttctttccactcctccaacttctgccccaccaagtgaaaaacgaaggaccaggccctctttgttagctgcaacacatttcactccagaggccaagaacaagggagatgaggtagctgttacaatcagaacacttcaacaaagagttaaagccttggaggcagagctagagagagtgaaaaaggattacagcttgcagctaaagcagaaagatgatgtcattcgtgagctttcacaaaagggtgggaaaaaagtggtagcaacaagggctagtctacggccaaaggaggcaaacactggagaattgaagagtccaagctatcgtttttggtcaccagtacaaactgcaaagaaacgaagcttttgggacataactactgctaacagcccgtcagtcaccacattgaatgggagaaaaactagaagtcatctcatttctgaacctactgcacatccatctatgcttcttcagcttcttggattatattattcagcccggatttgctcgaaaaaagggcgatatttaaacgtggggtcttcttggaaggagttacaagaggaagtttaa

SEQ ID NO: 68810 - DNA, 552 bp, Glycine max
  Peptide Sequence Number=SeqID_160495
atggatgaattcctttctagcatttggaactctgatgataacaaccaagttaacccaccactacccacccttgatgaagctgcaaagggtaaaagtgtagtagcaacagaacccaccaccatttcccagccattatctctccctcccccaatttgcaagaaaactgtagatgaaatttggtctcagatccacaaaagccaaccacactacaatgaagctaacaatagccttgccaagaatgagccactactcaaaaggcagcaaaaacttggggaaatgactttggaggatttcttagtaaaagctgtggtgaagtatgtaaattgggggaaagatatgcagggtctcattctgagcgttttgatatatatattgcctactttcgaaaacggcccccaacgggtgcagagaaacacgaggaactggaaccagagaggcggaacgcaaactgaggcaggatttcagcatccaaaaagttccagtttttctcctttatggctgagtatgtggtcgaatcaaaggaaaaggtgggccctttttggctccaattaa

SEQ ID NO: 68811 - DNA, 193 bp, Glycine max
  Peptide Sequence Number=SeqID_160496
gccaaaagaagagaaggttcaagtagttgatgtctcgctaagcgaggcagattcgcttagcgagtggcatctgctaagcgaggcatacaactcgcttagagggttgggaaaccctagaagaggattattcaaagatgtgctcgcccagtgtgccgctagctcgctaagccaaaattcacttactctcgcttag

SEQ ID NO: 68812 - DNA, 231 bp, Glycine max
  Peptide Sequence Number=SeqID_160497
atgctacaatgcgaagggttttcctatgatctcagacatgattttgcaattcccaacggtgagaatgctcgaaattgggttgcgaacgtggtgctcaaatttcatgacgatccaacggtgaatgagtccgagatcatcgtttttctgagacaggttttgtgggctgcgggaaaaagaaagggttttgagaggaaaaggagaaaaacgaaaatgagaggcagaggaggctga

SEQ ID NO: 68813 - DNA, 414 bp, Glycine max
  Peptide Sequence Number=SeqID_160498
atgtctttcattctatggcttgctaaaaggaaccggctgcttactcttgacaaagttgcttttttgaacaagggttccctctgccatttatgttcaaatgaggctgagtcaaatgctcatttgttcttttcttgcaggaaatctctccaagtttgggctcacatttgtgatttggctcctttccgcaggcgtttcacttctttgcagtgcattactgactctttaattagggacagatccacatcaggtgttcaagaaaaatttcgttgtctggctatagcaattacagtctactgcatctggatgtctaggaacaagctgatttttaaagattatcaattttctgttatagaggttattaacaagattaagtttcttatgtatagacaagcgcatctgttgcatttgttttaa

SEQ ID NO: 68814 - DNA, 507 bp, Glycine max
  Peptide Sequence Number=SeqID_160499
atgcacgagggtttccagaaaatcacatttcaaatgttgaagtatctcatggtgtttctcctgactttgctacatatttgtaaacaacacgcattatgtggaagcaatgtcttccaagattattttgatgatgccaaagaatcaagagttaagcaagttccaaagaatcaagagtcaaaaagcttcaagaatcaagtttcaaggaatctagattcaagaataatcaagtttcaagattcaatcaagtttcaagaatcaagattcaagaataatcaagatctagattcaagactcaagattcaagaatcaagagaagactcaatcaagataaggtacatcctttgtggcacaagtagagggtacatctacttgggttgttatactgagaacaagagagggtacatctcttgtggatcagttcaagtggaaggtacatccacttggttgttcaaagagaacaagggagggtacatcccttatggatctttggcttgtaaaggattttaa

SEQ ID NO: 68815 - DNA, 630 bp, Glycine max
  Peptide Sequence Number=SeqID_160500
atggaggcgagtgataaggtccttgaagtagagcagaagtacaatgagataaggaagccagtttacaataaacgaaatgatgtcgtcaaatctattcctgatttctggttcactgcttttatgagtcatcctgccctttatgaacttctgaatgtagaggatcaaaagatatttatgtatttgggttctcttgatgttgaagataataaagatgtcaaatcaggctactcaatcacctttaatttcaatcccaatccctattttgagaatataaagcttacaaagacttttaccttccttgaagaaggaacagcaaagataactgctacccccataaaatggaaaatggaaagagggcaagtttctttagttggtttagtgactgttgcagaattaatcaaggatgatttatggccaaatccactcacttatttcaacaatgttctgaacatcaattggtttcagaaacaacccaatggcaacgacgaggtcagcatgacaatgaatatttccgcagacttgcagtcccttttcacatggaacacaaaacaggtttttgtttttctagctgctaagtatgaaactcctaagaattccttgaaccaggttttagtttcaatttctaagtaa

SEQ ID NO: 68816 - DNA, 225 bp, Glycine max
  Peptide Sequence Number=SeqID_160501
atgacaacgggttcccaaaactcgcaagagatctctctcgcttcacctctccgttggaaccatgatctctgcacagggcaaccaccaccgccactaccaccattagtcataggttcctggctccaccgacacctctcggcaacacttcaccacggatcgcttcgagatcttctccgtcaagcaggaacctacgtccctcactcttatgccgttacgcggtcatga

SEQ ID NO: 68817 - DNA, 270 bp, Glycine max
  Peptide Sequence Number=SeqID_160502
atggataattctaatgatgaatggtttgttaacttggaagatgacaacgatgttaattctagtgatacaaatagttctaatggaagtgatgctgaagtggatatagatgttgacaatgaagaaggggttgaagatgttgacaatgaagaagaggctaaagatttgtattgttcaaactatgtgccattaattccaatgtaccatggcttgtctaatgctgataaagctaagggggattcattgcatgcccaaggtgttagagcatgttag

SEQ ID NO: 68818 - DNA, 153 bp, Glycine max
  Peptide Sequence Number=SeqID_160503
atggcggcagaatttgtgacatgctatgaggcatcaaatcatggcacaaactccatggtagcagatcctcttactaagggacttccacccaaggtctttcatgagcatgttgctcacatttattacactttgtacattaaggttattaaatga

SEQ ID NO: 68819 - DNA, 1044 bp, Glycine max
  Peptide Sequence Number=SeqID_160504
atggcttattacaaatcgctgagttccatcactgtgtcggatattgaatcccatggaattgcaagagaagacgctgccactctccaccatggtctcgcagaaatcattgaaactcacggcaatggcacccccgccacgtggcagcacgtcagcaacagcatcctcaaccctgaacttcccttctcctttcatcagatgctgtactatggttgctacaaggattacggttccgacccacccgcttggatacccgacccggaaagtgctgctttgactaatgtttggaagttgctagagaggaagggtgaagagtttctgtgttcggcatataaggatcctattacaagctttgatgatttccagaaattttctgtctcaaaccctgagatatattggaaatgtgtgttggatgaaatgagcatatcattttccaaaccacctgaatgcatcttacgtgatagcccctcaggggaaagcccattatcacacccgagtggtcaatggcttcctggagcatctattaatccagcacagaattgcttaaatgtaaatggcaaaagaagtttgaatgatacagtaataatatggcgtgatgaacaacttgatgatctccctctacaaaggatgacactcgaggaattgcgtgacgaagtttggttagttgcatatgctctcaaatctctgggtctggagaaaggatctgcaattgcgattgatatgccaatgaatgtcaagtctgtggttatctacctagctattgttcttgcaagttatgttgttgtatcaattgctgatagttttgcagctagtgaaatatcaaccaggcttaaaatatcaaaagcaaaagtggcaggatttataccgctaaacttggatgctggtgtagctgatgacatgattatagagaagaggtggaaaaagattgttgcatcacacatggaggtccagattaatcagaatttgctttcattcggacctccaccagagccaccaaactctacccgcttgcaaggcagtgggtcattcccagctaagctacaatga

SEQ ID NO: 68820 - DNA, 1416 bp, Glycine max
  Peptide Sequence Number=SeqID_160505
atgggtgtcaattttgtggctaattgcggtgttatagtaatttacttttcctgtctcattcttccctttccttcctcttgtttcattaatcaggatcttattatgcgtggtgacaaaagtatccccctttacagtagagttgtggatgcacagtcacctatggcagtagttatccctaccaaaggatctgaatttagcatgaaactgcgtaatggtgacgtctcttggcatgattttttggagaaagtcaataatctcaaaggcaaggaattcatagctactgaacaaccaatagagacattcacaaacattctcttttcttctggaacaacaggtgatccgaaggcaattccatggaccaatattactcctctaaaagctgctgcagatgcatggtgccacatggacgttcgtaaaggtgatgtagtgtgctggcccactaatcttggatggatgatggggccgtggctagtatatgcatccttgctaaatggagcttcagtggctctgtatattggatcccctcttgggtctgcctttgccaagtttgtacaggatgctaaagtaacaatgcttggtgttattccaagtattgtacggagttggagaagtacaaattccacatctggctatgattggtcttctatccgttgctttggctccactggtgaagcatctaatgtggatgaatacctttggctgatggggagagctctctacaagcctatcattgaatattgtggtggtacagaaattgggggtggatttgtttgcggatcactactacaggctcagtcattagctgcttttagcacaccagctatgtgctgcagtttgtttattcttgatgatgaaggccttcctattccacaaaatgttccaggaataggtgagttggctcttggtccgctcatgctaggggcttcaaatacactgcttaacgctgaccattacggtgtctatttcaaaggaatgcctctcttgaatggaaaggtattacggaggcatggagatgtatttgagcgtactgctagaggatactatcatgcacatggtcgttcggatgatacgatgaaccttgggggaatcaaggtgagttcagttgagattgaacgcatatgcaatggagtagatagcagcattctggaaacagctgcaataggggtaccaccttctggtggtgggcctgagttgttgactatagctgttgtattcaaggattcaaatagcacaaagcaagatttacaccaattgaggatgtcttttaattcagctctccaaaagaaactaaatccactgttcagggtttctcaagtagtcacactgccatctcttccaaggacggcatccaacaaggttatgagaagggttttgcgacagcaacttagcgaaactaaccaaaattctaaaatataa

SEQ ID NO: 68821 - DNA, 225 bp, Glycine max
  Peptide Sequence Number=SeqID_160506
atggagcattcagatttcatgaggcctaattttccacacttgaaacaagatcttcctttgggattcttgttcttcataaacttcttgaattttctaacaatcaatgttagattctcgctctctgaaccttatgcactttcttcattactcccatcactagatggtatggaggattttagtgttaagcctatacttctcttctatttagcttcctcttctatttag

SEQ ID NO: 68822 - DNA, 816 bp, Glycine max
  Peptide Sequence Number=SeqID_160507
atggtcactacattaggcacattcttttccttagacgtagctttatgtgaggtcctcgttgatgacactggtgttagtgagatcaatgatgacctaattaacaatgttttcatccacaagctcagtagcagcttcaggctatgtgtcacaacctacccttcggcgggagggctaggcgagataaaaagtgcgtcttccaaaaaaggggagaacgcacgggagtcgccaccaacgtttattcgaggaaagtgggtcgacaagggtgttgcccttgctcctacgtatcctcaggaaatgagggggtttgagactttggtagcttgcccaagcgagctgttgcttcaccctgaagcgagccagaagctagcctgggtgagccagggtccagaaaaagctaaaaatgacccttctgcccctcctcttggattgagaggaaatggaggtggacgctgcttggatgtagaggatggacgtcttcacgatggagataaaggagcatctagtgttgtttcactacttgatgatgaaggaggagagggaggagcccattccttttcaactatcttaggattagccttggttgctctgaacagggtgccataccctaatttcgtctggggactatcattcactgatgttttgattcttgctagccaaactgctttccaacaccctagctcgcctaggctagcctttagcttgcctgggccctcaaatgacttcagggtgaaggaaccagctcgcctgggcgagccagttactttaggagctgaggaggggttccaaggttcaaaagtggagagaaagaagaagtaa

SEQ ID NO: 68823 - DNA, 201 bp, Glycine max
  Peptide Sequence Number=SeqID_160508
atgcaagttcagggtcagtcattgaaaggtttgaaatggttcacagagttaaaagaagaagatttcaagtgctttggaggaaaattgatggaaaaacttgaagaaaaagccttgaagaaaagagtagaagaagggacagctcgcttagtgcataagccaggaccagcatgtctcctcgctcagtggccagctcaggcttag

SEQ ID NO: 68824 - DNA, 771 bp, Glycine max
  Peptide Sequence Number=SeqID_160509
atgaacctttcattatggcagaacaagccagaaaagtcttttacgtcgaagatccatgtgattcaagattgtcaatggttctacaaggaagagcaagtgggtcataggatcaccgccaagctcccctccgcatttagatggtcattcacagatcaacctagaccagcggttaacttcgatgctacaactgggagaggatcagacccacataaagagaagctccacagctatttgggggtagtagctcgagaaaagattccaattgtacatagcaattggatagatgtaccggaatctctaaaggagctagtgtgggacgaaatattgggaattaggaaaagagcacgggaaattcaaaaacacaacggttgtccccatttactgctcgtggaggatatggactcgttagaagaacaaatgacacagagatcctttgttccccaaggtcgtgacgatatactgaacactgccattaggcgaccggagcatggaggtcgtgttcatgcagcaagatcaggtgtgacaatttctcaatactatggaagggcatcatgtggctcaagcagctcctccacatccatcagccaacaacagttggttgagataattggaagccttaaggaagagtggaggaatgagattatagtcaaccttaaggaggaaattgatgtagctccatgtagagcttgtaggccttggattttcttcatcaatggagtcctttgctttttgaagatcaatggcaatggaatggagaaggaggaaaggtga

SEQ ID NO: 68825 - DNA, 318 bp, Glycine max
  Peptide Sequence Number=SeqID_160510
atggataaagctatctctagaatatgtccattggatttaatgatgaaatatgtgcaatttcagttgagcttagctcatgagtgggctaagcgtgcatccaccgctaagcgcatctttagcgcgcttagcacaatagaagaatctggcagggcatcaatatcaaggccgtgtgctaagcatgagatcagtgcgctaagtgtggagcagttgtcttcagttaggctcagcgcacgactgacactaagctcaaatccacttactcgcgctaagcacaagggtggcgctaagcgcaacgttgcgaatttagagcctatttaa

SEQ ID NO: 68826 - DNA, 316 bp, Glycine max
  Peptide Sequence Number=SeqID_160511
gtggggtgggatatcgccagtcgagaacgaccttgaatggcaatctgaagggaagagacaccaaaaatgggttttcctttgtcggcagtcgcttaccttgctgaaaatttatctggtgtcgatttcaggccgaacttccacattattccataaggcacgcgtgacaatgatgattttaaaacaacgtgcaaaattagtcatggctacagccaggtgggcactcaagcatcccgtttatggcattgtgatactacggttgggaattacacagatagacacaacgtttccaagttatgttctttcatcagttcaatga

SEQ ID NO: 68827 - DNA, 111 bp, Glycine max
  Peptide Sequence Number=SeqID_160512
atgggtttgactgagaacaagagagggtacagctcttgtggatcaattctagatttttacaaggttgaaagaaatctcaaggaccgcaggtcacttggggactggaggtag

SEQ ID NO: 68828 - DNA, 417 bp, Glycine max
  Peptide Sequence Number=SeqID_160513
atggctttgcagtgcagatgggcctggggtggtccaataagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 68829 - DNA, 577 bp, Glycine max
  misc_feature (47)..(47): n is a, c, g, or t
  misc_feature (92)..(92): n is a, c, g, or t
  Peptide Sequence Number=SeqID_160514
agctagagtaatgggtccagtagaggaggtacaagagaagatgaagnctgacatggaggacatgaaagagcaaattgccacgatgatggagnccgtgatgagcatgaagaagataatcgaagctaatgcggttacaattgccgctaccagcattgttactaaggtgaacccgatgcccccatctggcctcaaccaaatgaatcatccaaccatagatatggtaggcaaagatttgggaagtagggacggcccccatgatgtgcaaaatcaaaacaagcatgccttcccgccatatggcctgcctcccaactatacaccacccaatgtggcgtacactcccaatgaggatgtcaataactccactcccatactcgttgagagccgacaaacccaaactaatcatgcacatgtctctcaaaccgtggaggagacacatgaaattccccaccataatccagccgactccaagccttgcctcggatatgccactgaagggcaagcagttggtgatatacccctgcaaaacactttggaggccctcagtatcacccataaccacaccccttgcattccatag

SEQ ID NO: 68830 - DNA, 441 bp, Glycine max
  Peptide Sequence Number=SeqID_160515
atgggtttccggggcttccgggacacccggtattttcgaagctggattgcttctggaggaagcaacccagctcgcctgggcgagctgggcggcaacctcctccccttttttcctataaataggctgaaggtggctgttctaagggtccgggatccccctggtgatgtatttaagctgttttgggtgaaaaaaaattgtttccgtgaagaaaatccaagccgaggtgcttccgtaacgcttcccatatgtttccgtaagcaaatccgtgaaggttttcctccgttattcaccgttcttcatccgttcttcgttcttcaacgggataaaaacaacttaaccaaacattttgttcacaaagaactacgtaggtctgatttccttatcgcaattaaggaatacgtaggagcaagggaaacaccctcgtcgaccacaaaaagataa

SEQ ID NO: 68831 - DNA, 468 bp, Glycine max
  Peptide Sequence Number=SeqID_160516
gattgatggggacccggcattgagaggaacgaggataagggctacgtgggagtacgtgagctcagttggaggtgggcaacaggggatggcgggtttatacgtgatttgtggatgtggagaattgtcttgcaccatcgcccgaccgccacctagtaccacatgtgatggtggtacctggagatatgtcgcgggggtcaggagaccttggggacgtcaggcgagctcctggcagtcaacagataaaagaacaaagaccacaaagcaaggaggcttgtctggtggctggccaactgtgaactttgagtgttatatgggatatggcctctggcttaaaaacgagatcaggaagctaagagggcttctggtaatcgattaccaacggatcgtgatggcggcacaactaatccatgaccgagtggagatggagtgcctagagggagcttgggagaccctcgaaggcaatgcgag

SEQ ID NO: 68832 - DNA, 144 bp, Glycine max
  Peptide Sequence Number=SeqID_160517
atggagaagacaatgaagaacaaggaattaaaatcaatggcagcggaatggaaaatgaggaaaagtgattggagacgccacttcaaggagaagatgggtcaagaacaagctcaccaccataggaagccatggataagagcttaa

SEQ ID NO: 68833 - DNA, 261 bp, Glycine max
  Peptide Sequence Number=SeqID_160518
atgggtgccaagtacctcaaagtggtcaaacgagagtcgcatcccaacaatggatggtccccggacgaaattagggcgcagaatgaccataatttgtctctgcgtgtctttggacgcgatcgagcctgggtggcaaggcgcagaatgaccataatttgtctttgcatgtcaccggacacaatcgccactggatggcgaaaaggtgtacggaatgaccataatttgtctccgcccgcctctcgacttactgtcctcgaatga

SEQ ID NO: 68834 - DNA, 2135 bp, Glycine max
  Peptide Sequence Number=SeqID_160519
cgctgcacgataagattgtcgcggcacgcggcgcgggcggtaacggttacgatgtggtgctgtttgatgccatctggccggcggaattcagtaagttcgacctgttgcaggatgtcagcagccgcatcagcgcagatgaaaaagagaaaatcttccccggcgcaatgaacaccgtggtgttcaaaggcaaaacactgggcatgccgtggatcctcgacaccaaatatctctattacaacaaagcgatgctggaaaaagccggcatcaaagatctgccgcaaacctggcagcaggcggaagcgctggtgtgtgactacaccacgctggtctccggcttcggcggcaaattctataacaacggtaagctcgatttctcaacgccagcctcgctgcaggcggtgaagctgatgaaaagctcgctcgatgagggtctgaccaacccggcttcgcgcgaatatctggaagaggacgtgcgcaaagccttctccaacggcgatgcggctttcgctctcaactggacctacatgtacaacatggccaacgatgccaaacagagtaaagtcgccggccaggttggcatcatgcccgcacccggcgatgcgcccaatcgtttcggcgcggtcaacggttcgatgggtctgggcattgccaaaggcagcagccatccggagcaggcatggcagtacatcagttacatgacttcgcagccggagagcctgatcgctgctgccgacaaatcgctgaatgtcatgctgtcgcgtccggaaaccgctgattactcacgtctctccaacaccctgcagcagcagctgcaacaggttctggtcggcagcgcgacaccggaagcggccatgcaggcgtatgctgagtttgcgtcaacgcgaacaacggcaggcatgggtgctgctggcacccatgctactgcgccgcaatggattggcctggagaactatctctacgccattaccgatgcggattttcaaacctcgctgtggcgcacgctctacttcaccgtggtgtcagtagcgattgaaggcgtcatcggcgtgctggttgcgctgctgctcaaccagaaattcgccggacgtaacgtgttgcgcgtgctggtgattctgccgtgggcgctaccaaccattgtgaacgccatgatgtggcgcctcaatttcaatccggactacggcagtatcaacgccctgctgacacaactcggtatcatcgatggctaccgcagctggctggggtctccggcttccgcgctcaacgcggtaatgtttgccgacatctggaaaaactatccgctggtgacattgctggtgctggcggcgctgcagtcggtgccggaggatctctacgaagcggcgcggctggatggcgcatcggcatggcggcgttttcgtgccatcacctttccggcgattgttggctcgctcagcgtggcgctggtgttacgcaccatcgacgcctttaagatcttcgacatcatctatgtaatgacgcgcggcggtccggtcgacagcaccaaaacgctgagcttttacgtctatcaggaatcattcagctacctgcgcgccggcagcggtgcggcttatgccatcgccgtcggggaagtgcctatgaaggttaaactgcgtacctgcgctaaatacgcggcggcgctgctggtggcgctctccgtcgtggctccgatgggctggctgtttctgatgagcgtcagcgccaccagcgatctgacacgcgtgccgctggagtggctgccgcgccagtgggatttcagccgctacggcaggctgatctcgctggaacccggccagcccggcgcgctgttcctgcatgcgctgggtaatagcctgctggtgtcaaccggcgcaacgctggtgtgcctgctgctcgcgatcccggcagcgttcagcttctcgcgctatcgcggccgtgacggctggctgttcgcgtctctggccatctatatggtgccgccggtggcgtttgtgctgccgctctactttctgctgcagcagttcgatctgctcaacacccgacccggtttgatcatcgttgctgctgcgcattacgctgccgctggcgaaaccggtgctgggcgcggcggcgctgtttggctggctgctggcgtgggatga

SEQ ID NO: 68835 - DNA, 495 bp, Glycine max
  Peptide Sequence Number=SeqID_160520
atgtcctgcgctatccccaaccttatttatcctgactatgcttatcagacgataataaattcaggagagcgcatgaaactactttatttcgtttcgcttattgctgcagccggttatttactggctttcttacctaaactgcgcacccgtcgcgagcctgtggcttattgggggtgctgggcttatttaggtctgaacgcgcgtttactggtggaaaatatcgacggccatatcgttgatattggcggtgcggaaagagtgggcgatcgttatcgctggcagctggatggtaaagatgccgggggagaaacggagcaggaagtggacgaattactggccgaggtggaaaaacacctgagctttttgttcgtcgatggccagtttaccagcctgcccgatgtcagtgctgattatggcgatcggctggataacgcgccctcacggcaaattgcactacccgagctcaacgaccgcgatgaagatatcgtgcgttaa

SEQ ID NO: 68836 - DNA, 651 bp, Glycine max
  Peptide Sequence Number=SeqID_160521
atgaagaagaagctagaggaagctgcagagtcaggaagcgttgattgcatcattgaccctccatcccccatcagacgccacgtgaagtggaagatggctcgcacgaagaaaataggggagatgacgactgaggccgcaaaggaaattgctgagaagatcgattcctttgaggagcaggcaacacagggatccttcgtcccccatggactagctgacccagcaaatcagggaccagctagaggagtcgatcacagaaaaagtggctcggcaactcatggcatcgttcagccagatgcagtcccagatgcaatcttagggacttgcactacctccagagcctctggtgggtccctcaggtcctcgataaacgatcttgagacgggtgactcagataggtgcagcttgtacatcgaagcaaatcctgcccgtctggttgccctggggagagtttatgagggatccactattgttcataacactcctttgttgcctagccaagtaaaggtgggtgtggaggaggttaaagatcctgatgctctagttcttgtacccactgatgaggtttccttagtggggcaggcaattcacaccttccttgcttggccgacacatctggtcaagtctttatcacagcagcgtgcctcaaattag

SEQ ID NO: 68837 - DNA, 235 bp, Glycine max
  Peptide Sequence Number=SeqID_160522
ggaccgcggccgcaagacattcagtggacctgaagaagtccaacagggtcttggagatgccagctctaattacgggcctctgttagttctatggagtgcttgtcgccctcaacaaggcaggcgcagggcgaaacaccacagcagcctggggatggccggcagcaggcaacagacgcacagtcaccacctccaaagccccttagctcatccacaaaagttggagcgttgcctatga

SEQ ID NO: 68838 - DNA, 285 bp, Glycine max
  Peptide Sequence Number=SeqID_160523
atggccccaaggaagcttgcctcaaagagattcaggaaagacaaggcggttgaaggaaccagttccgctcccgaatatgacagccattgttttaggagcgctgagcaccaacagcgcttcgaggccatcaaaggatgggacgacgagtataccgacttccaggaagagatagttcgccggcggtgggcatcgctggttacccccatggccaagttcgacccagacgtagtcctcgagttttatgccaatgcttggcctacagaggagggtgtgcgagatatgtga

SEQ ID NO: 68839 - DNA, 363 bp, Glycine max
  Peptide Sequence Number=SeqID_160524
atgtcacgccttctagctcctaagcaacagtgccgtccaagcatttgcataggggagatcgacaaccaagttgacaccgcacacagccatgactcacacatgtgccgcctgagcatgcttaaacacaacctcactctagacgaaactgaactggagttgcacaaggctaaaccacatggtcagatcagagaaggggctgatgaaatagaagagaagactgcgaagttgaaaggaagtgagaaggctctagttgcacggcatgaagctcgtcatgctgtagtaggtactgcagtagcaaaccttcttgctggacagccacatgttgaggtaaaccatggttatgtcgatatttttggccattaa

SEQ ID NO: 68840 - DNA, 555 bp, Glycine max
  Peptide Sequence Number=SeqID_160525
atggctccgaagaaactctccacgaagaggtctagaagagacgccgcagcggaagggtccagtgccacccccgagtttgatagtcatcatttccggagcgccgagcaccagcagggcttcaaggccatcaaaggatggacgttccacagagagaggcgtgtccatctcagggatgatgagtatacggactttcgggaggagatagctcgcagacgttggacaccgctggtgactcccatggccaagtttgaccctgagatagtcctagagttctatgctaatgcttggcccacagaggagggagtgcgagacatgcgttcgtgggtgaggggtcagtggattcccttcgatgcagatgccctcagccagttcctggatgacccgctagttttggaggaaggccagcagtgtgagttcagccagaggaggaacagggccgacgggttcgacgaggaggccattgcccagctattatgcacaccagggcaggatttcgcttggaccgctacagggaggcgggtgcggatcatgtgcaccagcatgaccacttcttga

SEQ ID NO: 68841 - DNA, 575 bp, Glycine max
  Peptide Sequence Number=SeqID_160526
ggaccagctggaggagtcgatcacagaaaaagtgacttggcaactgatggcatccttcagccagatgcagtcccagctccaatcacaaatgcaatcacagggacttgcactgcctctagagcatgcagttggtcgctcagttgcttgtgttagcacaaaggggagttgtgttgatccctcaccgaccgatctagagataagtgactcagacaaatgcgggttatacatcgaagaaaatccttctcgcccggttgccctaggaagagtttatgagggatccacagttattcacaacatccctttgttgcatggccaggtgaaggttggtgttgaggaggttaaagatgcagaggctcccattcttatacccactgatgaggcaattgtgtctccagcaaagcctcctgataggtcggatcctgaggtcgatgatcccttgtatctgatgacattgaccatcccacagcttttcttgaagcctctccaggttatgtgggatgctatcgtgttcggggtgtttaatccagactttccattatacatcaagcacgaagatctctctgaaattgcacacg

SEQ ID NO: 68842 - DNA, 351 bp, Glycine max
  Peptide Sequence Number=SeqID_160527
atggggttggaccaagcgcaatcttttgagaaaaggttttatcatgtcaaagtcaaaaatctagaagtagccagcttgagaaagctggggcagtggatggatcaagtgcaatgtcagtcttttagcaaggtatatgggaagatctgggatttggcaatgatagaagtgtcagttgaagccattgcatctctcactcaatactatgatcaatcgcttagatgcttcactttcggggactttcagttaacaccaaccatagaggagttcgaggggatcttaggatgcctgataggaggaaggaagccatacctcttttctgggtactatccttctatggcgaaagtagcataa

SEQ ID NO: 68843 - DNA, 273 bp, Glycine max
  Peptide Sequence Number=SeqID_160528
atgtataaagcaacaacatataatggtggaataagccatggaagaaggagctttaccaccaagagagtgccttggaaaagaagcttagagaggaagcttcaatggaggaaaagaaagagagagaggggggagcatgaaattgaaggaggaaaagagggagagaaattgaactttgaagtgtgtctctcaagactctcattcatcaaagttacaacaagtgttacacatgcttctatttatagcctaggtagcttccttgagaaacttccttga

SEQ ID NO: 68844 - DNA, 441 bp, Glycine max
  Peptide Sequence Number=SeqID_160529
atggccccgaggaaacttgcctcaaagagatccaggaaggataaagcggccgaaggaaccagttctgctcccgagtatgacagtcaccgctttaggagcgctgaacaccagcagcgcttcgaggccatcaaaggagggcgtgcgagatatgaggtcctagatgctattggccagttcctgggataccctttagtgctggaagagggccaggagtgcgagtatggccagaggaggaaccggtccgatgggttcgatgaggaggccatcgcccagttgctatgtataccggggcaggattttgcccggactgctgccgggagacgggtgcggatcatgcgcaccaacatgaccactctgactcagatctggatgactttgctgcacagcaacatccagcccagcgaccataattccgacctccccctgccgaagtgtcagctg

SEQ ID NO: 68845 - DNA, 585 bp, Glycine max
  Peptide Sequence Number=SeqID_160530
atgaggggagcaccgacgggagagagcctctcgcctttccttgtgagagattttggcgcgcaaagtttcaagattgtacaaagagtccacaaggcgtgggaaagcctgttaagaaaagataaagaacttaggggcatccgtaatggcatcatcgatggttatcatgaatggctgaaagttcatacacgagggttagattggctctccaagttgaaaattatcaacgaggagaacttcgaagctccggaagaggatgaagaagtccgagctctaaaaatagagctaggaaaggcaaaactcgccaaagaaaaattcaagttagtcgctacagacgtccgaaaagagtgtgtcgggttacgagaagaaaatacaactcccgaacctttcacgattaaagttcatagaccacgtcttttccggtttttccgacgtttttctcaaataaatgttggtggcgactccgcgcattttcctcccatggaagacacacccatgagccctgtgtcgccttcccgccgaagggtaggttgcgacagttggcgactccactggggaccttttttaagtgagttaggccaattttag

SEQ ID NO: 68846 - DNA, 322 bp, Glycine max
  Peptide Sequence Number=SeqID_160531
atgccaatgattgataatgatacctataatcttcagtgtatgtgttttaatctattgcagagtctacctagattccaacctgaaaatttggagcagaataagactatattcgagagggttaatgaactggctgcaaaaaagggatgtactccatctcaacttgcattggcctgggttcatcaccaaggaaaagacgtgtgccctatacctggaaccaccaagattgagaactttaatcagaacattggggctttgtcagtcaaactaactccagaagacatggcagagctcgagtcctttgctgctgcagatgctgtcaagg

SEQ ID NO: 68847 - DNA, 393 bp, Glycine max
  Peptide Sequence Number=SeqID_160532
atggagctatcttttgctcagcacgtagcagatccgcctacaccagtacatgagagaccagctgacccctctactcctattttagagataccaaaggactctaccacactggtcctgacattgaacaccactcctccatctacacctgagcttcagttttcagatgaggaggggggacggattactactcctccggggacgccaactcatcttctccttgaagcggcgtctcctctctctcttccttctccattccactgccattcatcttccaagaagcaaaggattctattgatgaagaagatcctagtcctacaagctctagtggagcttacatcaaccgtaccttctgctgtgagagagggtgagggccccagtgctcagaaagtctga

SEQ ID NO: 68848 - DNA, 393 bp, Glycine max
  Peptide Sequence Number=SeqID_160533
atgggtagggattgcttagcgcaattctccattttcaacttttttgggagccccatgaattgcgttttcgttcatgtgtcctccactttagagtttggagctatggtgtcctccacctttgagtttggaggtttgggtagggattggttagtgcaattttccattttcaaccttttttggagccccatgaaatgggttttcgttcatgtgtcctccaccttcgagtttggagctatgcgtagtgattgcttagtgcaattctccattctcaacctttttcggagccccatgaattgcgttttcgttcatgtgtcctccaccttcgagtttggagctatgcgtagtgattgcttagtgcaattctccattctcaatcttttcggagccccatga

SEQ ID NO: 68849 - DNA, 243 bp, Glycine max
  Peptide Sequence Number=SeqID_160534
atgtccccaatggagtcgccaattgtcgcaacctacccttcggcgggagggcgacgcgagactgacaggtgcgtcttccatgggaggaaaatgcgcggagtcgccaccaatgtttattcgaggaaaacgtcggaaaaaccggaaaagacgtggtctacgaactttaagtgtgaaaggttcgggagttttatttactcacggggaagggtgtttcccttgctcctacgtatccctcaattatga

SEQ ID NO: 68850 - DNA, 258 bp, Glycine max
  Peptide Sequence Number=SeqID_160535
atgaaagaagcacaagctcggaaggtagtcatgcctcacaaaatatatgtatctcaaagatcaatcaagaacaatttaagagttcaagataagaatcaagaagaatttaagactcaagaagaaagtttagagtcaagaatcaaaattcaaggttcaagatctcaagaatcaagatcaagattcaagactcaagattcaagaatcaagagaaggcttaatcaagataagtatgaaaagtttttctcaaaaattgagtag

SEQ ID NO: 68851 - DNA, 177 bp, Glycine max
  Peptide Sequence Number=SeqID_160536
atggtgatgatgttgtggtgtaatggtgacaaatgcagtattaatggtggtaacaatgacgatgtcattgataactataatggtggtggtgatgttagtaacgacgatagtgacaatgacgatgattgtggtagtgtggtggtggctgcaatgacattgttgcaatgctggtggtga

SEQ ID NO: 68852 - DNA, 534 bp, Glycine max
  Peptide Sequence Number=SeqID_160537
atgtgggattgccacacactctcctccaatgtgagggctatgataggatcgctatccaggccagtaaatgtcgtaggctggaaacgtgctatatgtttggagtttatggagaaggctgatgtactggagtattatgctaagacagtgaactcccccagtggttctttctatataccagctgttttaagggttcctcaattacttcaggttgttaaaagaagaatagtcaagaacaatcttagccgaaaaaatatactatttcgggacaattacacctgtcacacaataaacagaaactccttttttcctagcccatccaaatccagggttaaggaggagggttgtgttaggccctgggcagccaacataaaactcaatatatcgaacacgttagtaggccagatgaattgggagaggattcagggaaatgaatttagacagaacccaacaagggcttgctcaattatgaaaagggaaactaatggaggagagatctttctccttgttctgttcgctttcactcaagcaatataa

SEQ ID NO: 68853 - DNA, 1291 bp, Glycine max
  Peptide Sequence Number=SeqID_160538
atggagaaaaactgggttttgagatggatttttgtggtggggttgatgtgtttgagtgtggaagggattggtgtgaattggggaactcaagcaacccacaagttgccaccagacacagtggttcagatgttgaaggataatgggattaagaaagtgaagctttttgattcagatgactccaccatgagtgctttggctgggactgggattgaagtcatggtggctatccctaataatcagcttgctgagatgaatgactatggcagggccaaacaatgggtcaagaaaaatgtcacacgttacaacttcaatggaggagttaatgtcaagtatgtagcggtcgggaacgagccatttttaaaatcctacaacaattcattcttgaatatcaccctccctgcactgcagaacattcaaaatgcccttaatgaagcaggtcttggagacaaaataaaggctacagtgcccttaaatgctgatgtgtatcagtctccagagagtaatcctgttccttctgcaggaatatttaggcctgatatcagtggtctcatgacacagatagtgcaatttctcagcaagaatggtgccccatttaccgtgaacatttaccccttcttgagcctttatggtaacgacgattttcctttcaactatgccttcttcgacggtgtggacaatccggtaaacgataacggtactccatacaccaatgtctttgatgcaaattttgataccttggttgctgctctcaaatcagttgggtttggggacctgcctattttggtgggagaagtaggatggcctactgaaggggacaagaatgccaacgcaggcaatgctttgagattctataatggccttctgccaaggcttgcagcaaatagaggcaccccacgccgccctggatacattgaagtttatctatttggactcatcgacgaggatgccaagagcattgcgccaggaaacttcgaacgccattggggaatattcagatacgatggacaacctaagtttccaatggacctttctggtcagaaccaaaacaaatttctcataggtgcacagaacgtgaaatatcttgctcctaggtggtgcatgtttaatcctgatgccaaggatctcagcaaacttccagataacattaactatgcttgcacctttggagattgcaccgcgcttggatatggttcttcgtgcaacaatttggatgcaaatgggaatgcctcttacgcgttcaatatgtacttccaagtgcaaaatcagaaccccatggcatgcaattttcaag

SEQ ID NO: 68854 - DNA, 120 bp, Glycine max
  Peptide Sequence Number=SeqID_160539
atgctatttatggttctacccggtggtgtagataatactgttagcccttgctttgtggcttcgagccctgactcgagggggcatgttgcgagtcccacatcgggtggttcacattcatga

SEQ ID NO: 68855 - DNA, 207 bp, Glycine max
  Peptide Sequence Number=SeqID_160540
atggtgtgtttaaatagaggagcgtgtgcatattacacctcacacgctgtaagatccgtggtgtgcaaggcacttgctgaggaagcctacaattggaatttaaggaatgatggcaacaattccccacacaacaaatggaaggaaagtaaaaaagcagtgcatgttgagaagaatattcgaaaggctttcacagtttcacaccaataa

SEQ ID NO: 68856 - DNA, 318 bp, Glycine max
  Peptide Sequence Number=SeqID_160541
atggcctatgctgtctcaattacttgcactaatagtaacgatgctgctcgtgccgagatttttaaggttgctgatggttcttctagtccttgccttttagctggctatgatgctatatattctttatcattcgaggatgccaaatccacttatccacattttcagaaatcgaaatttccatatgtatgccaggatcttacataccattatacattgctcgttgatggatttggcctagatccatttcaagagattacagtggcggaaggaattgaatatcgagatgctattgtggaaacagcatggcctggcctctag

SEQ ID NO: 68857 - DNA, 147 bp, Glycine max
  Peptide Sequence Number=SeqID_160542
atgagtataccgtaccgaatgtttgagagaaaggaacttcccacctacagagagggaactggggagaaagactaccgtaccgaatctccgttagacgctctaaatgatcactgttgggtcataccgttgagaagttcttcgtgttaa

SEQ ID NO: 68858 - DNA, 387 bp, Glycine max
  Peptide Sequence Number=SeqID_160543
atggaggggaatgaacataaatgtaaatctgatagcaagatatggctcaaggagtgttgggtggggtatctgagagatctgagcatgtacgaaaaaattgatgaagtaaacttctttgggagtttaggtgaagctaaactaagacatatgggaggaggaatggaattccacttcatgcgtgatgcaagcatattcgctaaagtagtcgaaaggtgtaggactttggtagatatagataagagtacagagaacatgaacaagatcaattttgctcgtattcttgtccaaacatccgcgggcatgcacatgtattttgcacaaggtgtagatgtaatgaatgatgagttcaacagagaagtggatgtggcaatggctgaggtggtttag

SEQ ID NO: 68859 - DNA, 1104 bp, Glycine max
  Peptide Sequence Number=SeqID_160544
atggaattggcaatgaaggtggccgaggccgtccatgtgctgaaccacgatacgcaatcctgcaaccgcgtcgcagcgaatcagtggctcgtccagttccagcaaacccacgccgcctgggatgtcgccaccgccatcctcaccgccgatcgccgcctccccctccccgccaacttcgaggtcgagttcttcgccgcgcagattctcaaacgcaagatacaaaatgaaggttatctactgcaattaggagctaaggatgctttgttaaacgctctccttcttgcagtcaaaagatttagtactggtccacctcaggtgcatggtttctctttctttgtgatactgctaatcctcttttcaagggagcttttgacacagatctgtcttgcactctctgctcttgtacttcaagttgctgcacatggaaaccctatcgagcagcttttttacagtctccggaatctgcagagccaggatgatggcaattttgctgtcctggaaatgctcactgtcctgccagaggaagttgttgacaaccaacgtatcgattctaaaattagttcattacacaaaagccactatacccaagagcttctctcccatacacctatggttcttgagttcttgctgcagcagtctgaaactaattttgatggttctgtgcaacaacacgaaaggaataggaaaattctacgctgcttattgagttgggttaaagcaggttgcttctctgagatttctcccggaacattgccagctcacccacttttaaattttttgttcaactcattgcaggttcctttatcatttgatctagccatcgaagttcttgttgaacttgtgactaaacacgaggcatcttatgctaggggtggtttagcaagctataagttgatcattaaaggtcaattttatggatttttgggtgctgtgaattacataatggaagttggagttgaagcagagacaaagttgcagatcgagacttcaatgaactccagaaataaaacaaccttcaagccttcaacgaatgccagcagcagattgagcagaggacagatcgaggaagagagcatgcagaggaagaagggaaaagcagtgtaa

SEQ ID NO: 68860 - DNA, 822 bp, Glycine max
  Peptide Sequence Number=SeqID_160545
atgatttcattccaaagtgtattagtacagcagtttggtatttatagtgagctcttcattggtgggtgggcatctcataatctatcaatcccttggaaagaagtggaaagcaagctttttgctcttaatgctgtatacagatctctagcagatgctgttggttcttattccaagtggatatctgcttttaaggaaaattttagagccttgctattatttcttgctattgggatttcagaacctctatcttcgaatgcttgtgcatctgccttgcgtaaagtctgcgaagatgcttctgtagtaatttatgaaccttcaaatttggaaattttaatgtggataggagagggtttagacaagtggcatttatctttggaagatgaggaagaagttatgcatgctataagtctgatccttggttctgttcccagtcgagaactaaagaacaagttattggctaaattgctttcacctagctatgaagctattgggaaacttgttgatccagagatcagcctttctcttaaacagaaccctgcttcttatacacaagttttgaatgcttcctcaagagggttgcacagaatgggaactgtattcagtcatcttcccatatccatggcaactgagcctgctgcagatgactcaatactttcactgctaagggttttctggcccatcttggagaaattttttggctctgagcatatggaaaatggcaatttatccgtagcagcttgccgagctctttcactagctgttcgatcttcaggtttacccacttggacacatttgtttacagttctttggttcctcttgtga

SEQ ID NO: 68861 - DNA, 936 bp, Glycine max
  Peptide Sequence Number=SeqID_160546
atgaagagcatggtgacgccattgacgagggtcttaccctttcgtcacccaaatggctataatacccttcccttctctcttacacgctacccttcctcaccgaacttctccttctccttctcccctctcactctcactctttccatggccgcttcaccacaatcctccgctccgactgtgtcgcctggtgatgctaacatcaacaaagatggtgtatttcaattgattcaagcacatcaggaaaaagctgctagacttccaccagttgaggaaattcgaactgtccttgatcgtagcgtgcgtgggatgctctctacattctcgaagaagttcgatggttatccatcagggtctatggttgactttgcttgtgattcaaatggatatcctatattagcagtgagcgacttggcagttcattcgaaggacctaactgccaatcctaaatgttcattgcttgtggctagagatcctgaagataggactgatttagtgattactgtacatggtgatgctatctctgtacctgaaaatgaaagagaagccgttcgagctgcatatttggcgaggcatcccaatgcattttgggttgactttggagacttccgattcttgcgcattgaaccaaaagttgtacgatttgtgtcaggtgttgccacggctttgttaggatcaggagagtttagtggagatgagtataaatctgcaaaagttgaccccatagctcagttttccaagccagtggcgtctcatatgaacaaagatcatgctgaagataacaaagtgattgtgcagcattggacctcagttccagctggttaccagggtgatactttcaagcttcgtgtacctttccctcgacgtgctgaagatagaaaggatgtgaagactctcattgttgagatgcttcaagctgctaggcctaaagttgattga

SEQ ID NO: 68862 - DNA, 729 bp, Glycine max
  Peptide Sequence Number=SeqID_160547
atgggtaaagctcgggcaacagtagaagagctgagaaggtttcttgtgcctgattcgttggaagaggtcctggctaaagatcaagtcccatcaatggattctctcattactaggcttctctgtgtagctcatgcgttgaaggatgaaaatctcactgaagttgtggaaacatcagccatggtggcacctcgtgggagagggggaggccgtaacagtagaggaggccgcaatggaaggagtggacgtcctcaatgcacatattgcaagaggatgggccatactcaagaaaattggtcttaccaaagattagggtggagattgacacagtttgaggatggaaggagaaggattcccaacatgagatctcgcataaggatggggattcctattatttgggtagagaaatcagagtttgagagagaaaagaagaaaccaaatgctaacccaaggaagaagtgcaataaagattcattgagcctcattcctaaagcccctttacctagaaggccaacttgggagaggatagggcttgagcccggatataaatcctataaggatgacatgcaagggaataatggagatcaaggaaagccttcaagggaaaaacgaagagcttgggagaggaagaatctaattgggctaggaagcccaacaataagggaaagagctaagaaagaaaaggagatgttgcttgaaaaggagatcaacaccaccaagctcaagcctaaa

SEQ ID NO: 68863 - DNA, 201 bp, Glycine max
  Peptide Sequence Number=SeqID_160548
atggccacaagcccttggattatggatcgggccgggtattttagtcaaatccacttcaacactccgaagaacaaaaatgctactccttcccatgctttctctctctccctccttcccctctctcgcttcaaaccgttatctccaatttcgacctcgtcggagccgccgcgtctttcgatgcgctgccgcggagtccggtga

SEQ ID NO: 68864 - DNA, 318 bp, Glycine max
  Peptide Sequence Number=SeqID_160549
atgttagccatcatcagtaggtaccaagaagaattaaatctagccacggcccacgagcacaaagtggtggacgaatatgcccgagtgtacgcggaaaaagaggctagagggagagtattcgactcgttacatcaagaggcgacaatgtggatggaccgatttgctcttactttgaacgggagtcaaaaacttccccgattgctagccagggccaaagcgatggcggacacctactccgcccctgaggagatccacgaactcctcagctattgtcagcacatgatagacttaatggcccatataattaggaaccgctag

SEQ ID NO: 68865 - DNA, 234 bp, Glycine max
  Peptide Sequence Number=SeqID_160550
atgtcgtaccggatgtcacgacatcacgcttcagaacatgcagattatatgtgtccgtatgaacagattaaacaacacttccagtattctcgagcaggatgtcaggacattgtatccgacatcgtggatccttcaacttcaattcatcacttaggccaaggataccgcaaagagctgctttgcggccatcggggtgtccgaggaggaggtgaaaaatgcggcagacacggttaa

SEQ ID NO: 68866 - DNA, 180 bp, Glycine max
  Peptide Sequence Number=SeqID_160551
atggaagaatttctccaagaacaccctcttaaggtcatcccagctggtaatggacctgggagcaagctgaatgctcaaaatcagaatgttcagaatcaccagcaacagaatgctcagaatgcacaaaatgcacggaatgctcaaaatgcacagaatgatcaagatgcacactatgcctaa

SEQ ID NO: 68867 - DNA, 510 bp, Glycine max
  Peptide Sequence Number=SeqID_160552
atgaccagaggcaatccatctgacttacaaccctttgatcctgggatagataggacatttcatagattagttagacatcatttagtaccttttgagcatcctgagcattctgctattggtgattttgagcattatagttttgaacattctgattttgagcattttgagaacatggcacaccctccaccccgtgagaggactctaagggaattggttgcacctgatttcacctacgaaagcttgtgcatccaataccctaatgaggatgtcccatatgttcttaaaattggactgatccatttgcttccaaagtttcatggccttgcaggtgaagccccgtacaaacatctaaaagaattccatattgtctgctccaccatgaaacccccagatgttcaggaggatcacatatttctgaaggcctttcctcattctttagagggagtggcgaagggttggctttattaccttgctccacggtccatcacgagctgggatgacctcaagaga

SEQ ID NO: 68868 - DNA, 333 bp, Glycine max
  Peptide Sequence Number=SeqID_160553
atgttggctgaaaaatatcagtcgttgctttacaacggccgatgtcatcaattgttgatgagaatcatgaaactggccaaaatacagggtaaaggcccaagtggagaaggacgaaggcccaagtggagaaggacaaagcccccgaagtggagaaggatgaaggcccaaacttaccaaggtaatccttgtggcgtctaccctgacttatcttccttcaccggaagtggcgtctacccggacttatcttccttcactggaagtggcgtcatccaaaacctccgtagcctgtatcaaacgatctgctcctactcaggttcacatcaatgcgcctga

SEQ ID NO: 68869 - DNA, 385 bp, Glycine max
  misc_feature (61)..(61): n is a, c, g, or t
  misc_feature (131)..(131): n is a, c, g, or t
  Peptide Sequence Number=SeqID_160554
gctgatcacaggactctgccagtcgttcggagtccccgtggcacctaccaaggtgattcgnccgcccatcacccgggcttttattgagaagtactgcacccagagacaggctcaggaggatgctccacagnccgcgggcgcaccaccaccacctcatcaggctggcccggctgggtcatttgacatggagcagtattacggcatttggttcgccagcaggcggccaaccaccgggcacatggtagaggtcgcatggcccggggattggcccgaggcccaaggaggagaggcgcccccagaagctcccggcgatggagaggaggcccacgaggacgaggagatggccgatttgcttgacttcttgggagggagtggagctacatga

SEQ ID NO: 68870 - DNA, 378 bp, Glycine max
  Peptide Sequence Number=SeqID_160555
atgccgcacgtgctgtcgctgtgtgccagcgacggcgatgcgctatggtgcgccaactgtttctacgtgttcgatgaagcgcgcatggcgttctggctgatgaccgaagccgatacgcgtcacggcgcgctgatggcgcgtcatccacgcgttgccggcacggtgaacggccagccgaaaacggtgctgctgattaaaggcgtgcagtatcgcgggcgtatacaactgaccgatgaggcgcaggcgctgaaggcctatcagtcgcgctttccggtggcaaaaaaagtcaccgcgccgctgtgggaaattacgctggatgagttgaaaatgaccgataacgcgctggggtttggcaaaaagattgtctggcagcgttag

SEQ ID NO: 68871 - DNA, 676 bp, Glycine max
  Peptide Sequence Number=SeqID_160556
atgtcccccattttcaaagggggacatgccctcaccttcagagggcttcacaccctcgccatcagaggactgcatgtcctcaccttcgtagggctacacgccctcacctttagaggaccacacatcctcaccttcagaaggctacacgccctcgccatcagaggactgcatgttctcaccttcagagggctacatgccctcgtcttcagaggactacgtgtcctcactttcagaggactgcatgtcctcacctacagacggctacacgccctcgccatcagaggactgcatgtcctcaccttcagagtgctacaagccctcgccatcagaagaatgcatgtcctcaccttcagaggactgcatgtcctcaccttcgtaggcaacacgccctcacctttagaggaccacacgtcctcaccttcagagggctacacgccctcgccatcagaggactacatgttccccaatttcaaaggggacatgccctcaccttcagagggctacacaccctcgccatcagaggactgcactgtcctcaccttcagagggctacacgccctcgccttcagaggactgcgtgtcctcactttcagaggactgcatgtcctcaccttcagacggctacacgccctcgccatcacaggactgcatgtcctcaccttcattgaggctacac

SEQ ID NO: 68872 - DNA, 294 bp, Glycine max
  Peptide Sequence Number=SeqID_160557
atggagaacattttaccacatgacaaggatgataattatatagatgatgatgagagtaaaaagagaaccagaggttttacacatatgctagatgtgtgggacttgccagatggagaattcatacttgttgaagtagatcattggggcaatcctatgggttgggaagggaaaactctactgattgcagttgggagcttggtaaggagacaccaatgtgctcctatcaattttcttagctggaaagacatgccaaaggactatattactgacatagttgaattaattcaggtctag

SEQ ID NO: 68873 - DNA, 204 bp, Glycine max
  Peptide Sequence Number=SeqID_160558
atgctttccaagtgtaatagacaaaaaggaagcactgagtgtgggtattacgtgatgcactggatgtcaacaataatcctaggaagtttcaagaataattgggaaacgtatttcaatgatgctagaccagtggaactagagagattgaaggcacttcgcatccagtgggcaaagtattatttgaaagttagaaatgaaacttag

SEQ ID NO: 68874 - DNA, 402 bp, Glycine max
  Peptide Sequence Number=SeqID_160559
atgagcaagaggctccaagaggattgggctagagctgctgaagaaggccctagggttctcatgaacctcagggtgaccatttgcttactacaccccattgccacatcatatagtcacactttgtgcatgtccttcatgctttacatgcctcataacacctgtcataccctaatttcgtccggggaccatccgttgttgggatgcgaccctcgtttgaccacttcgaggtacttcgaacccatcgttaggcaattcgtgaagttccgtgacatgccggaagtcaatgaaggcattgtagcacgatctgatgttcctccagaaggcggttgcttctggaggaagcaacctagctcggctgggcgagctgggtggcaagcatctccttccttttcctataaatag

SEQ ID NO: 68875 - DNA, 948 bp, Glycine max
  Peptide Sequence Number=SeqID_160560
ggtggacctttgggtactagtaccctcacccttagagggctacacgccctcgccatcagaggactacacgtcctcaccttcagagggctacacgtcctcgtcttcagagggctacacgccctcacctttagaggactacacatcctcacctttagaggactgcacgtcgtcgtcttcaaagggctgtttgccctcgccttcagagggctacatgcccttaccttcagaggactacacgtcctccctttcagagggctacacgccctcgcctttagaggactacatgtcctcaccttcaaagggctgcacgccctcgccatcagtgggctgcacggcctcaccttcagaggactgcatgtcctcaccttcagagggctgcacgccctcgccttccgagggctgcacgccctcgccttcaaaggacgacacgtcctgaactttagagggctgcacgccctcgccttcagagggctgcacaccctcaccttcaaagggcgacacgtcctaaacttcagagggctgcacgcccttgcctttagagggctatgctcctcactttcagcgaccaatgcacaaccagaggaggaggctatcgcccaactactgtgcataccggggcaagatttcacccgtgccgctgcaaagagacgagtgcggatcatgcgaaccaacatgaccactcttacacaaatatggatgacgttgctacttagcaacattctacccagcaactgtaatgccgatctccctctacggaaggatcgcgaccacaaggcaccctgtggacctggaggagtccgacagggccctggggtttccagctctggttacgggcctctgtcagtcctacaggatgcccatacccccagtaaggtcatgccatcgtggcatagggatcacgcccacaagacacctagtggccccggagaagtccaacagggccctggg

SEQ ID NO: 68876 - DNA, 96 bp, Glycine max
  Peptide Sequence Number=SeqID_160561
atgaggtgggtcgttacattagtggtatcagagcagggagtgatggctggacagaatgatcgtgtgatagcggatgctcttcaagccttagcttag

SEQ ID NO: 68877 - DNA, 198 bp, Glycine max
  Peptide Sequence Number=SeqID_160562
atgaagaaggactacgaggcgggcaagcagatacagggcgcccagcggcagggccatgacaaaacagaaggcataatacaggatcagcaccccacctttgccgatggtatcggcgaacagtccgcggtgccaaaattcttcactcgtgaaccgcagggcggccgtttcaatgccttttttagcactgggatacagtaa

SEQ ID NO: 68878 - DNA, 723 bp, Glycine max
  Peptide Sequence Number=SeqID_160563
atggaaggtaaaaacagccagttgcaacaacgcaaagatgacgcgctgccgcgcggcaccggtaatctttgtcagtggtatgtcgatcagaccgaaaacgccacgctgcgtgatgttgagggcaatagctggattgatttcgctggcggcatcgcggtgctcaacaccggccaccgtcatccgcgcatcgtgcaggccattgccgatcagttagcaaagttcacccataccgcgttccaggtcacgccgtatgagagctatgtggcgctggcggaacgcatcaatcagcgggtgccaattgccggtaaagccaaaaccgcttttttcaccaccggcgctgaagcggtagagaatgcggttaaagtggcgcgcgccgccacccgtcgtcacggcatcatcaccttcggtaacgcctttcacggccgcaccttcatgaccatagcgatgaccggcaaagtggccccttacaagcgcgattttggcccgatgccggcctcggtgtttcacgcccgctaccctaacgcggtgaccggcatcagcgttgaggacgctatcgccagcctgcacgacctgttcagccacgacatcgcgccgcaggatgtggccgctatcgtactggaaccggtgcagggcgaaggcggtttccacatcgcgccggcagagtttcttacgcagctgcgcgcgctggccgatgagcacggcattctgctgattgccgatgag

SEQ ID NO: 68879 - DNA, 427 bp, Glycine max
  Peptide Sequence Number=SeqID_160564
atggcgctggatatggcattgctgcatgcggtagtggcggtggcaaaagccggtggatttcgcgaggcggcgcgcatgagcggcagcaatccgtcgcgtttgagtgatgcggtgcggcgcgccgaacagcaactgggcgttcggctgttcaatcgcactacgcgaacggtggtactgaccgaagcgggccgggctttgatgtcacggctgctgcccgccatgaacgaagtggatgcggcgctggatgccctgaacacgttccgtgacacgccgggcggcacgctgcggctgaacgtgccggtcagcgcggcgcggctggtattaccggcgattgtgccgggatttctgcagcgctatcccgacatccggctggagattgtggcggagagtaatgtgcaggacatttttcgcgacagctgcgatgccg

SEQ ID NO: 68880 - DNA, 1479 bp, Glycine max
  Peptide Sequence Number=SeqID_160565
tgcgctgctgatctactgcctgagcaaacggatgttcgccagccgcaaaatagcgctcaccgccagcgtgatctttcttacctcgctgctggtttacggcatcggcacctatgctgtgctcgatccgattctgctgttgtggctggtggcggcaatgtgcagcttttggtttgctgcgcaggcgcacagtacctcacagcggctgacggggtatgtgctgctcggcgcggcctgtgccatgggcttcatgacccaaaggctttctggcgctggcggtgccggtgctggcgattgtgccctgggtgctctggcagcgacgaaggcgatttctggcactacttcttttgggtcgaacatattcagcgcttcgcggagagcgatgcgcagcataaagcgccgttctggtattacctgccggtgttggtggcgggctgtttaccgtggctcggcctgttgccgggcgcgctgagcggcgcatggcgacagcgtcaaccgcacgctgctgcgatctatttgctcagctgggttgtactgccgctgctgttctttagcatcgccaaaggcaaactgccgacttatatcctgccgtgctttgcgccgctggcgttgttgatggcgcattatgcgcacggtaacaccgcgcgcctgaagcaggcgttggtggtaaatggctggatcaacctgctgtttggtctgggcgccacgctgctggtcgtggtggtgctggcaccatgggggctggcgcaccatccggtgtacgcgcgcgatgagttgctgcgggtagtgtgcgctgcgctggcatttgccggctgggcggtgatgggctggttaagcctgaaaacaggccgctggcaactggctgcgctttgcccgctggcattggcgctgctggtcgggttggctatcccgcaaaaggtgcgtgatagcaaacagccgcagagcttcgtcagcgccgttcggcctcagctggcgcagagccgctatctggtggtggacaattccggcatcgcttctgcggtcgcatgggaattgcgccgcagcgatatcactttcttcgatgaaaaaggtgagctggagtacggactgggttatcccgatgcaaaaacgcgctacgtcgacggggaagccttcgctgactggctgcgcctgcatcgccgacagggtccggtggcactggtgctgctgctgaattctgacgaaaagcaagcggatgcgcatctgccggtgccggatgatgtgtatcagcagggacggctgcctgctcagttgtgccgcccagctgtgtcagaaacaggcggcccactgcggcgggcaccgcctgttcggctggctggggctcagcctgctgctgctcacggcgatgctgctgtggctgctggtgctgcgctgctgccggctcaaccggctctatccgctgctcagtctgagctatgtgctggtgtggctggcgcgcgtcatttctctgccggccttgcatga

SEQ ID NO: 68881 - DNA, 358 bp, Glycine max
  Peptide Sequence Number=SeqID_160566
atgggtgcagaagacgaggtttgtctctgcgtcctatcaggcttttcgtcttataaacagcaaaataaagtttatacggataaccactcgggtatttccgcctttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 68882 - DNA, 575 bp, Glycine max
  Peptide Sequence Number=SeqID_160567
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaagtcggcttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 68883 - DNA, 1221 bp, Glycine max
  Peptide Sequence Number=SeqID_160568
atggagttaggagttaggagtttctcgaagaaattcatagaggataaggcacaagaatatgaaaacaaaggagagtggatgtatttcatgagtatcctagatctcttaatatatagagtgatccttttccctagcatgattgaccagattgatctggcggcggttgatgcgttcttagcttatcattatcgacgggaaagtcctgtagtatccatcccttctaatgtgtactatactctggacttgagctgggagaagaaaagcactagagtagtcatctgttgtttacctgaactctatgtgtggatggtgtcttgtttcgtgatgctcaatgggtcgacaattcgttggttcccaaggtgggaagaggtgcctaatgtgttatgtcgatgtggagcattcactaacatccctttgatgggaccaaagggttatgtcaactataaccctatgttggggatcagctattcacagtggttggagaatagggtgcgagaagtcaagctgctgaaaaagacaaatggtgaaggggtcaaaatagatgtacctattgagacagaagaggtcagaaaattgaaagcagaattgcagaaatccatggggacaaaagaaaagttgaagggagtggttatcagggaaagcttgaaggagcaattaggcatgatggaaaagaatatgctagtaattatcggtcgatatgagctaaagatgatgaaggattggcaagatctagaaagcaggaggtggatgaataggtttgcactcacgctaaatgagagtcaagagctcccaaaattgctggctatagccaagacgacgactgacacatactctgctcccgacctagaacaaatgaaggccgatatggaggccatgaagaagcaaatgacgatgatgatggaggcaacgatggacatgagaaagataatgggggctagcattgctacagttgttgctgctagtactgctacagagagggacccagctcacccaccttcttttaatcaagaaagtcacctagtaacggatatggaaggtcaaggaggcgtgacgggagtagccacatatgggcctcaatacacccagagccatacttttccaccgtatagtctgcctcctaactatacaccatccatggccgtaccagtacctgccataaatgttactaatcctacccctatttgtactgagaataacccagctcaacccaatcagacttaa

SEQ ID NO: 68884 - DNA, 585 bp, Glycine max
  Peptide Sequence Number=SeqID_160569
atggcaggagcgggtgacaatggtggtgtatatcatcaactggacgcaatgactacacaaatgcaacgtttgttgaaccgtaacaaagaagagctctacaggcgaatagtcaaatcttccttgtttactcttaaacctctatcccctagagaagtgtgtgatgaccaaatcagaatgagagaaaagagagaacaagagaaagaaaataaggcgagtgaagtgaggaaagtgttgcctgctcatgaaccactctatctacaaggcatagaacatcaagttgatctccttcccggagcttcattgcctaacaggccaacttacgaaagcaatccccaagagactcaacgtaaggatgcacatgccaaagttgagtatgtgaaaggattgtatgaccaagtgaaggtgcaaattgcaaagaagaatgaaagttatgccaagcaagccaacaagaaaaggaaggaagtggtacttgaatccggtgatgatcctagacatttgagggcaaatgtttaccaagaaggagggaatgatgagaatcctgaaactggccaactacaggctaaaggcccaagtggagaagggtga

SEQ ID NO: 68885 - DNA, 914 bp, Glycine max
  Peptide Sequence Number=SeqID_160570
aggacttatacgccttcgccttcgtaggactaggcgtcctcaaattcagaggactgcacgtcctcgccatcagaggactgcacgtcctcgcctttaaagggctatatgccctcgccttcataggactacacgtccccaccttaagagggctgcacgccctagcctttagagggctacacgccctcaccgtcagaggactacacgtcctcgccttcagaggacttcatgtcctcaccttcagagggctacacgccttcgccttcgtaggactaggcatcctcaaattcagaggactgcacgtcctcgcctttaaagggctatatgtccttgccttcagagggctacatgaccttgccttaagagggctacacgtcctcgccttcagaggacttcacatcctcaccttcagagggctacacgcctcaggactgcacgtcctcaccttaagagggctgcacgccctagcctttagagggctacacgccctcaccgtcagaggactacacgtccttgccttcagaggactttatatcctcacctttagagggctacacaccttcgccttcgtaggactaggcgtcctcaaatttagaggactgcacgtcctcgccatcagaggactgcacgtcctcgcctttaaagggctatatgccctcgccttcataggactacacgtccccaccttaagagggctgcacgccctagcctttagagggctacacgccctcaccgtcagaggactacacgtcctcgccttcagaggacttcatgtcctcaccttcagagggctacacgccttcgccttcgtaggactaggcatcctcaaattcagaggactgcacgtcctcgcctttaaagggctatatgtccttgccttcagagggctacacgccctcgccttaagagggctacgc

SEQ ID NO: 68886 - DNA, 1253 bp, Glycine max
  Peptide Sequence Number=SeqID_160571
agagctgcacgccctcgtctttcgaggactgcacgccctcgccttcagagggctgcacaccctcacctttagaggactgcacgccctcaccttcaaaggactggacgtcctcaccttcagaggactacacgtcctcgccttcagaggactgcacgtccttgccttcagagggctacacaccctcaccttcagaggatgacacatcctcaccttcagaggactgcacgtcctcgtctttagaggcctacagaccctcaccttcaaaggactacacgtcctcgccttcagaggactacatgtcctcgccttcagagggctacacgccattaccttcagaggactacacagggctacacgccctcaccttcagaggactacacgtcctctccttaagagggctacacgccctcaccttcaaaggactgcacatcctcgcctttagaggattgcacgtccttgccttaagagggctgcacgtccttgccttcagaggacttcacgtcctcgccttcagagggctacacgccctcacctttagagcactgcacatccccgccatcagagggcttcacttcctcgccttcagagggctgcatgccctcgccttcagaggactacacatcatcgtcttaagacagcttcacgtcctcaccttcaaagggttgcacgtcctcgccttcagaggactacaagtcctctcctttaaagggctccacgtcctcgcctttagaggttgcacgtcctcgccttcaaagggctacacgccctcgcctttagaagattgcacgtccttgccttcagaggactgcatagggctacacgccctctcctttagagggctacatgtcctcgcctttggaggactacacatcctagccttcagaggacttcacgtcctcgcctttagagggctaaacgtcctcgcctttggagggctacacgtccttgccttcagagggctgcacgccctcgtcttcaaaggacttcacatcctcaccttcagagggctacacgtcctcacctttgaagggctacacgtcctcgacttcagagggctacatctcctcgccttaagagggctacacgtcctcacctttagagggctgcacgccctcgtctttacaggactgcacgccctcgccttcagagggctgcacaccctcacctttagaggattgcacgccctcaccttcaaaggactggacgtcctcaccttcagaggactacacatcctcgccttcagaggactgcac

SEQ ID NO: 68887 - DNA, 300 bp, Glycine max
  Peptide Sequence Number=SeqID_160572
atggaggctgacggaacaatggtgaacgaggtggtgatggtggcaaaggcaataatggtggtgatgacaatctatgatgtttgtggagcaatggtgacaaagatggtcatgcatgggatgctgatttcaatggctatggaagaagaggtggtggccaaggtggtcgtggcaaatgtgatggccaagacaatgatcccggtggcgacaataaggcaagccacaacggtggagccaaattctgttacaattgcaagcaccctgcctgcttgtgctaaattgaaagaactagatttaggctga

SEQ ID NO: 68888 - DNA, 504 bp, Glycine max
  Peptide Sequence Number=SeqID_160573
atggtgcaaggtgccagtgctgcacaggacacagtggcgcaagtacacattgtatttgatatgacaagttcatcatcctcctcatccaattttgatgtggtatgtggaccacgtgaaaatgatgtgttgtggatgcaaaagcaacatgtgtcccaacataattggaacaaggatgtagataaaaaaattaagaatgaggcgagtgattccaacttatcaagcacaaatattgatgggattgatatgtgtgaacaataccttggagtcaggccaaatgctaatgcattggctgacgaaaacacattgaaattaagctggttggcttcaaagtttgcaaatatccaggactatgtggacgacgaagagcacctcaaaatgtttgcacgtgcttggattttgagatttattagaggtgtcttgttggtggataaaagtagtaaaagagtccccatgagatatttgcaatttctggtagcttttaaagagtgcaacacttatgcgtag

SEQ ID NO: 68889 - DNA, 225 bp, Glycine max
  Peptide Sequence Number=SeqID_160574
atggtgctttctgtcactgctaccaaggatttggacacaacttcgcactggaatcagccaacaaaacaaaattatatattcaatggtcgtcatgcaacagcttcctctgcagctgcttggtcagtcttgctgacagtagcattcaataatgattatttgaagctcctttctggatgtcctggcatgcttgattccagagtgcccttgatgaggaaaaacgtgtaa

SEQ ID NO: 68890 - DNA, 162 bp, Glycine max
  Peptide Sequence Number=SeqID_160575
atggatgctgttgaacagatattaaggtacttacaatctacaccaggaaaagcaaatgacagaaggtctaccgctgtctgcttcacttttgtgggaggaaatctagtaacttggagaagtaaaaagcaacaagtagttgctagatcaagtgctgaaatatag

SEQ ID NO: 68891 - DNA, 198 bp, Glycine max
  Peptide Sequence Number=SeqID_160576
atgggaagcggagttggcatgattccagttgttggtggtgacttcacagagaaagaacatagggagtgttggctgggcatcgagtttagaggccatggaggcttgggtggcagtgaaatggagttgagttacagtgagttcggcaatggtggcctcgaggtggtccaggctagatgtggaacgtgcagattcccttag

SEQ ID NO: 68892 - DNA, 893 bp, Glycine max
  Peptide Sequence Number=SeqID_160577
atgacaaaaacctttttcttggtggatatcataatatttgtgcaacaaacgcgtgaaccagattcaagtcaagggcttaaacctcaatgggcccttaccgcaaaacctgaaccagctcggcatgctctccaatgtgggcctccagaacaacaggctcaatggcccattaccctcctttcgcggactgtttctgctttggaccataataacctcatcgccaccaccggcgactggaagttacccgaagcactccaggggtcaactaagttgaccaatttctcttgttttgtggttgaacaaccagcaggaagagcgtctcagtgggggattgatgttgtggctattatggtttcgctcaccagtctgtggcttcaaggaaacgctttcactgggacatttcccgagaacattagggatttgagctctctaaaggatcttaaccttaatggcaacaacctcattgggttggttcctcaaggtttgggtggcataaagctagacatgctggatttgaacaacaaccgtttcatgggtccaattctggattttaaagcagttatggtgtcatattattttaatgatttttgtgtgagcaaatcatgggttcttttgagaatgatgaagagaggagtagttgttgttaatggtgccttggttgtcccattgtggctcttcgacgagggttcgcaggagcttgggttgttcatgaatgcattaccaactgcagagaacattagcaggaggaatattgtggtgccaaaatctaatggtgtgtgcccatttagcgggttggttgaagaatccagggatcatgttctgctttggtgtaaagaggtgtgggaaatttggctgaaatgttattcttggcttgagctgtcatttgtgttttcggg

SEQ ID NO: 68893 - DNA, 705 bp, Glycine max
  Peptide Sequence Number=SeqID_160578
atgagaggtagagagtgggagaaacacaacgacggtttgagtgaaggagggagggaggtcttctttgcaccatggagggacagaggtgggcaccattacaactttttatgcttcctagatgttaagaatgatagaaaacttgagaggacgttggatacagtttgtattggaactaagaagatgcatgttaatacacccaagttcatcaaattcgacaagcagataaagaaagatctgaacctcagagatagaggccaaaggaaagttcgtcttatgcctatgcgctcaagcaacctggagaggagacaaggcaaatctggcaaaagaaaaagcatatgtgtactaaggaggcatatatggcgtggaataccattgcaagcttggggacctgaatgctttgcaaaagtggtgagtgggtacgagacctttgtaaaagtggataaaggtattaaggagctagagagtctagacacgttaaggattgttgttagagtctcagaagttggaatcgaaggctttttggagagtgacattggcataaaaattgcatccttgggcttggattttgatggagatatggaaggggaagaggaagatgtggtggggaaacaaccagtatatgtggaagctagtgatggtggtgcctacaaaacattctcacgaggcaacgaagtggaggcatgtgtagaggatgaaatctggtag

SEQ ID NO: 68894 - DNA, 897 bp, Glycine max
  Peptide Sequence Number=SeqID_160579
atgttcctttcagtcagatactccttcacgctcttcttcattctcctcctcttatcaccttcacacattgcttcaacaacaccaacactagctcacacactaacacaatcagccaccaaaatagccatcacaaaccgcaacatccatagccttaacaatgctggaagaggcaccaaaatcaccggcatatcgcaattcaaacgatacctgcatcgttttgggtacttacaaaacaacaacattagtttcagtgatgaatttgatgccgtgttggaatcggctctctttagataccaacgaaaccttggactccaagtaaccgggaagctcgattccaacacggtttctcaaatgatcacaccaagatgcggtgatccagacacaaacacaacaccccatcatcacaatcacgttcacaaaacgcgcttaacgaagaattttgtgtttttcccgggaaaaccacgttggtcacgttccatgccaatgacactaacctatgccttctcccgtgagaacatgatccatagtttgagcatgaaggagataagagaggcattccaacgtgcattcacaaggtgggcttcggttattccggttagtttcgttgaggtgagtgactttgaactcacggacataaaaatagggttttacaatggggagcatggcgatggtgaaccctttgatggggtgcttggagtgttggctcactccttctcgccggagatcggccggctccacctcgacgcagccgagacgtgggcggtggacttccggtcgaccacgtcagaggtggcggtggacttggagtcggtggccacacatgagattggacacttgctggggttgtctcatagtttcggtgaaagaggctgttatgtatccaagtttgaggcctaa

SEQ ID NO: 68895 - DNA, 183 bp, Glycine max
  Peptide Sequence Number=SeqID_160580
atggaggtttgtgggttatcgtcatgcgacgcggtcgatggtgtgtctagtgcggtggaggcggttgttaggtgcactggttatagaggtttgggggagaggcgattagggtttgcttgggagaagaacagtaagaagggagtattaagaaggctaaaatatttcttggtccttgtaaattag

SEQ ID NO: 68896 - DNA, 98 bp, Glycine max
  Peptide Sequence Number=SeqID_160581
atggactttggagagaacaacatgttcagccttaacacccacaccaaagaggaaaacgaaaacactcctaacaataacaacaacattgtcaatgtttg

SEQ ID NO: 68897 - DNA, 213 bp, Glycine max
  Peptide Sequence Number=SeqID_160582
atgacaacttggaggatgctcgacgagaggtgtagatcatgcaccacctcaccggccactgtaacatcatggagctcaagggcacttacgaggactgccactccgtcaacctcatcatggagttatgcggcattggcgagttcttcgaccggatcattgtcaagggctactactccgagtgtgtcgctgccaacctttattgccagatcgtga

SEQ ID NO: 68898 - DNA, 489 bp, Glycine max
  Peptide Sequence Number=SeqID_160583
atgggtagacatgatgaatgtcaactttacattcaaacatggctaaaggaatcacaaggtgagatctacctaggagcttacttgaatcatgttatgaaggaattgaagagattccatggtaatccctcccagagtaaacctttacttgcaactcaccggattgacgtaaagggagtttgtgcgcacttgcttgatggttgcataagtgctggtgcaagggttgaatcaactaggcaaaaccttgatgcctcttttgttaacgcttttgataagttaatgactattacatcatctagtgattctttaggaaattgggttttcaaaaacatggaacatgggaagactagtgctgcaacaagtctagaaatggtagtcctaagggactacatagataaagaagatgccacaatcaagattggtgcaattatgggattgggaatagcatatagcaaggtttactggaaacttgaagtggaaagtacagcttaa

SEQ ID NO: 68899 - DNA, 414 bp, Glycine max
  Peptide Sequence Number=SeqID_160584
atgaccaaacatcaaagatcaacgaagcgtgatacatcttactgggagtatgttgatgctttacattctgtgcaaaataataattcttcaatcaaacgtagtacatcatcatatgaccaggcaattccaagaaggattatgccgatgttggatcaatttcattcgtgcattcacaattccattgaaaatattgtcaatgtcaaagatgatggtaactatggatatcgtgcaattgctgtcttattaagtgtgggtgaagattcatggtcgttggttcacgaccatttgcttaaagaacttaccaaatggtctgatgagtatatcaacctccttggtgacatagacaaatatgaggaattaaagaggcccctacttgttgatggattatccatgttactatggataagtgcatga

SEQ ID NO: 68900 - DNA, 1314 bp, Glycine max
  Peptide Sequence Number=SeqID_160585
atgacgacggcgtttgagcgtcacgcgcttcctctgtttctgtttctgtttctgactccgattatcaatgcctccattcacgactactccaacgaacccttcactcatcgctccgacgccttcttcttccacggcggcagcgaggccctcttcgccaaatccttcatcaggttcgaaacggtgacgtttgcgcgtcctcgcgagtccgcgagcgtgcatggtaggatgcagtcgaacacgggtttggtggaggcgataatccttgaggttcgggatcggaaccggatcggaggctcgtacctgaaatccgatctgatttgctgcgatccgaagctggccaaagaccgcaactgcaacctcggcgaggtcatcatccagaagaaccccgacaaccatgaactccccaaacgcatcaaaaccttcttccaaggtaccgatgagcaggtccagatggacgctgtaaccctcgagatcaacgccaccggcatgtactacctctacttcatgttctgcgacccttcccttaagggcaccaccattcagggaaggaccgtgtggcgaaaccctaatggctacttacctggcaaaatggcccctcttatgaccctctatgggttcatgtcactggcttacctgttgcttggtctagcttggtttctgaggtttgttcagttttggaaggatattatacagctgcattatcatatcactgctgttattgctcttggaatgtgtgagatggcagtgtggtactttgagtatgccaattttaactccaccgggactaggcccatggggattacactctgggccgttacttttacctctgtgaagaagacgctgtcgcggcttctactgttggttgtctctatgggttatggggttgtccgccccacgctaggcgggaacgtgattgcctacagagtgctgcttcttgggctgctgtatttcagcgcctccgaggcgcttgagctcgtggagcatttgggaaacatcaatgacttctccgggaagactaagctgcttttggtgctccctgtgacaaggagaaacttggctaaactggagctctaccgaaagtttacaaacacgctcgcggtgtctgtgctgctgtccattgcgtggattggctttgagctatacttcaatgccactgatccattgagtgaattgtggcaaattgcttggattattccagctttctggtgtctgctttcatatgctctcttggtggtgatatgcatcctttgggctccatcacggaaccctactaggtacttgttcttcccatggtcttggtgtggtgaatgttag

SEQ ID NO: 68901 - DNA, 135 bp, Glycine max
  Peptide Sequence Number=SeqID_160586
atggggtcgagtcagatgccttggcttaaaaagaggttctatcaagtcaagatcaagagcctaggaatcgccagtctgaaagagttaggacagttgatggaggtctccacggaggccattgcctccatcgcctaa

SEQ ID NO: 68902 - DNA, 873 bp, Glycine max
  Peptide Sequence Number=SeqID_160587
atgttggtggaattactcaaggtcaacgttgcagaggcgagagctgagacgattcaatgtcatgactcttatgttcgactatcgtggttatgtgacgtgtatgagatgaagatcgaggtatgtcactggatcgtagcagtgcgagcgtatttgttgcatctgcttggatgtacactctttgctaacaagagtgccacacacgtgcacgtggtattcttggatgcactacgtgacttaacgcagagtgggggttacgcttggggcgttgctgcacttgtgaacatgtatgataatttaaatgatgcgtccaagagcacgacgagacagcttgcaagatatatcactctattacagtgttggatctacgggtattttccatccgttggttccgctgttcctgccaaggattatgatgagaggagagtatggggccccttaacagtcattcatcgaccggagagggttatacgacagtttggctacatccagactattctgccacatcctgttgcgtcttcgctctttgttgaagaaattgatgatagatggatgcagtttggtgagtacattgcacttgtagggcaattatgtgcagtgcctggccactgttcgccagattacatggattggttttacatgatctcgcacccattcatgagtccagcacagccaggggatcttcctagagtttcgccggatggctttgtagcaattgattataagttggagaggctactaaacttgaggatcttgatcgaaggaacagaagcctatactgttgttgaagaatgtatgggcattgcaagaagctacattggccaaccaactgtaggtcacagattgaggcgtaggcggcgtatggatagtcattga

SEQ ID NO: 68903 - DNA, 300 bp, Glycine max
  Peptide Sequence Number=SeqID_160588
atgcattatgtctcattcatttttaacattcacgtactcaaggatcaaaacataatatcaccaagtcaatcaatatcgatcaatacacaagcgttatgcaacatatacactaagattcaatcctatatgcaatgtggtaccatggtcacactattttgcgagaatgctccaaccacatgggaccaacataggcttaaaggaacactcaaaccaagtatatttacccccaaggcctacactccaaagagtccatcagggcctctccctcctgattcaggtccaacccaaaaaacattttag

SEQ ID NO: 68904 - DNA, 210 bp, Glycine max
  Peptide Sequence Number=SeqID_160589
atgcagagacttgataaaaaatttgacgagcagcttccacctcccagtaggggaggtgacgatcactctagacgacgtttcatcactcctgcacattccgattactggcgcgctgcattcattcgagccgctggcattcagggacttgggccaggcaggggcattctcttggggagcggtcgcattggtccacttgtacgatcagcttaa

SEQ ID NO: 68905 - DNA, 129 bp, Glycine max
  Peptide Sequence Number=SeqID_160590
atgtggcgtctcccatcatcagaccttgaaaaaggtatgtatgtcttcaacaccccaatcccaaccaatagggaagatgagatcattgctaaaggcccgttagaaaataagtatgatggctatatttga

SEQ ID NO: 68906 - DNA, 204 bp, Glycine max
  Peptide Sequence Number=SeqID_160591
atggcggctgaactgctggttgagcagggccatcaggtggtgctgcacggacgcaacgccgcgcgtgcccgcgccgcgcaggaggcgctaccgcaggctgaagccgtggtcagcggcgacgtgataaccatcgccggtgcccgcagtgtggcgcagcaggttaatgcgctcggcagatttgatgcggtgatccacaacgtggcg

SEQ ID NO: 68907 - DNA, 414 bp, Glycine max
  Peptide Sequence Number=SeqID_160592
atgcaacaaggacagacatatattctcgtagctacattccctgaacctaactatggtgttaaaatggaaaaccacgaaggtctgaccgtggcttcgttctcaaccgaaaccgcgaggcaagtttggaagattctgcttcgattgaagggttcctctcagtgtggggtttcaacggagaacaacggcggtccgtggtggccaccggtggttgtgggtgatggagaagaagcttgggacattggaaatggttttggaagaaggaaggagaaagaaaatggtgtttttccaaggttacacgaaatacaaaggctgaaacactcaaatgcttatgctctcgggaaacgaagcgtttctcacacaccagaagacatatcgcagatcgcaacgattaggttgtggaaatctgtcctatga

SEQ ID NO: 68908 - DNA, 1137 bp, Glycine max
  Peptide Sequence Number=SeqID_160593
atgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgcta

SEQ ID NO: 68909 - DNA, 348 bp, Glycine max
  Peptide Sequence Number=SeqID_160594
atgttctggggagaaacattttacctgagaggaagttctgaggaccgtccaccaaagcagtccagagtcagaggtcatttggtgaagattaatgctgacagtctcaacacattcctagagacacctgtggtattagctgagggagagactctacccgcatacttcagatactacaggttgcctacagacttcagagagatagaggctgccttatgcatacctggccgagggttcatcttgaactctgagggccatcctaggaagattctcaagaaggatttgactacactagctcaggtgtggaggccaaaggggttgtctctgacagccttacctttgagcacctga

SEQ ID NO: 68910 - DNA, 204 bp, Glycine max
  Peptide Sequence Number=SeqID_160595
atggataaccatcagcatggaaatcatagtgatccagcacaagccaggataaagaaaaaagctaatattcttgattcatcagaggatgagagttctgaatcaacacaaggctctgattcagtttcttcacctgaaaatcaaaattgtatgtcctcaactaatgagcctgcaattaatagagaacgtaagaattactattcataa

SEQ ID NO: 68911 - DNA, 690 bp, Glycine max
  Peptide Sequence Number=SeqID_160596
caatctggagcaattgaacagcctaaagcatatgctgcaaacatctacaatagacctcctcaacctcagcagcaaaatcaaccacaacagaacaattatgacctctccagcaacaggtacaatcccggttggaggaatcatcccaaccttagatggtcgaatccttcacaacagcaacaacaacagccttattttcaaaatgctgctagcccaagcagaccatacgttcctccaccaatccagcaacaacaacagccccagaaacaacaaacagttaaggcccctccgcaaccttcccttgaagaacttgtgaggcaaatgactatgcaaaacatgcagtttcaacaagagactagagcctctattcagagcttaactaatcagatgggacaattggctacacagttaaatcaacaacagtcccagaattctgatagattacctttgcaatccgtccagaatcccaaaaatgtgagtgccattgcattgaggtcgggaaagcagtgtgaatctaaagagaagcagcatatccctcctccattccctccaagagcaatttccaacaaaaaaatggaagagacagagaaggagatattggaaacatttagaaaagtagagagttgtgcactcataaccggaagcttaaaggaagtgaaagaattagcatgggcagaaatgtctccgcattga

SEQ ID NO: 68912 - DNA, 315 bp, Glycine max
  Peptide Sequence Number=SeqID_160597
atgaaggcttctggtaatcgattaccaagggggtgtaatcgattaccaggtttagaaatgaagaggaatgggtcactggtaatcgattaccagatcgtgatggcggcgcagctaatccatgatcgagtagagatggagtgcctagagggagtctgggagaccctcgaaggcaacacgaggtgccgatttcggggcactattcgatttacggcgacttctttggtgcatccagatgaacccgtgcgcacgcttcagcgcactgtggagtggatactacccacgcctacaccataccatctagtggagccagtccaa

SEQ ID NO: 68913 - DNA, 354 bp, Glycine max
  Peptide Sequence Number=SeqID_160598
atggagcttgcatcacttttcaggtcttggagaggatcaataataatgcctataggtggagctgatatagaggaggaggaaccaacagatttgagggcaaatcctcttcaagggggaggggatgatgcaatcctccctaggaaaggaccagttaccagagccatgagcaagaggctccaagaggattgggctagagttgataaagaaggccttaggctaagctctagcttctcaaggaagcttctcaaggagcttctcaaggaagttttctcaaagaagcttctcaaggaagttttcttaagaaagcttctcaaggaagttttcttaagaaagcttctcaaggaagctacctag

SEQ ID NO: 68914 - DNA, 396 bp, Glycine max
  Peptide Sequence Number=SeqID_160599
atggttatagcaacgatggtggtggtggtggtagtaactagtaacgatgacaatagtcatgttggtggtggtcacgttgatgatcattatgacaaaaacgttcatgatagtaatggttgtaacatcccaaaaagggggttcgttttttacgtgggtgccgccattgacaccggcgggaagccaacatcgggacaagcacggcagaaatgggtaccgccatttctcctggcgggacatgcctacgtgggcagtcccgcctttggagctggcgggataggggcaaagaagacccgcctttggagctggcgggataggggtctgttcatggctggtcacatcacagcagggcctatggcatatgatgatgcactcacatggcatacacaaacacattaa

SEQ ID NO: 68915 - DNA, 507 bp, Glycine max
  Peptide Sequence Number=SeqID_160600
atggcagaatcatcgaagaagcgaaagggaacatcctccaccactgctgctgctagccatcgccgccacggaccatctaaagcacccacagcactaattcatccttccttatcatctccacgatcatctactctattttctttagatgatcaacgtctatggtacaactctcaatttccttctaggatcatcttagaccctaagtacctagacacagatttctttaatgatgagacatttgactgttatcaagtgtttcaaaactctggattggttgattttatgtccttaaaattgccttactatcctgaacttgttaaaatcttttacagcaatttaaaaattcaggatggcattatttcttctgaggtgcatggtatttctatgatcattgatcaatctctgttcttttcattgactatattacccagtcaaggtgcaccttttgagggcaccattgttgatgactggaaattcgactattctagtcatgatgcttgccgtatg

SEQ ID NO: 68916 - DNA, 447 bp, Glycine max
  Peptide Sequence Number=SeqID_160601
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaatagttcttgggcagagacatcgattgtcacatggatagctcatatcatggcaactggctctccttag

SEQ ID NO: 68917 - DNA, 1080 bp, Glycine max
  Peptide Sequence Number=SeqID_160602
atggctaacggtgagtctggcgctcgtgctgacctggacgatcaccgcggggatggtgttcgcgatcctggtgtggcaggcgggtgtccgcggcatccgtatcgatgtgccgtggtcggatcaggtgctgcacttctggctgcccgccgtgacggtggccgcctgggcactcgcccccggccatcgcgcggtgccgtggcgtgtggtcccggtcgcgctcgcctatccggtgatctggggtatcgccaccatgatccgcgggccgttcattggctggtacccgtactacttcctcgacccgcggcaggtgagcggcccgatggagttcgtggtgtcgtcggcgatcgcgctcgggacgttcgccgccgtcgccacggccctcgtgctcatcagcaggatgccgctgcacgggcgcctgggcagcgatgccgaggcgatcaccgatgcgctcccgacgcctgcggcggagcacgcgggcgaaagggtctctcagacgtagagggtgagcgatgcgagggcggcctcgatcgcctcgtcctccgcgagcttcgcgaactcgacggctgccgctgcaccgacgataccgacgaggacgttctccccggtcgacgggcgcaggttgatccaggtggggatcgccacgtcggcgccgacggcgtgccagatcgcctcgtcgttctcccagaacggttcgtcccaccacagccagaccgtctcgatggcgcccatgccgagcgcggcgaccgcgccacggttggagaacggcaacggcgggtcgaactcgatgctgccgtcctggagcacaccgagcggcacggtcacgacgacgcggtcgaacgagagcgcctcgccggtacccaggcgcacactcacgccggagtcgtcgtaggcgaggcgcgcgacgggggagttgagcccgacggtgacgccgtccagcgcctgctccacgaacggggtgaggtcgccggtggccgctgtcgggtcgcccgtgggcagcggtggcgtgaaccagctggagagctcgtcggctccggcgcccgtccgcgcggcgaggatcgtgagcagggctgccgtgtccgg

SEQ ID NO: 68918 - DNA, 912 bp, Glycine max
  Peptide Sequence Number=SeqID_160603
atgatcattaatcaatctttgttcttttcattgactaaattacccagtcaaggtgcaccttttgagggcaccattgttgatgactggaaattcgactattctaatcatgatgctcgccgcatgatcgactgggctcacttggttcggtaccgaatgcataaggcattatgggccaatgcacctcttccatatcctcaattggtcaccctttttctccgtcattttcaaattcctcttgatgatgaaccttttgttcaagtcaagcgatcctttgctataggtgctggtgcagtcacttcatttggttaccgtaaggatcgtaatggtcaatggctgaagaaagatgcgctacctccacaagacgagcgtactccctctcctcctcctcaacgagatgattccttcacccttctgactgaagttctttcaaagttacgaggcctctgcacctatgttggtgaacgattcgattctttggatggttgctttgaaggcatggatacccgcatcacccaacttgaagaggatgaattaaattgttatcatcaaaaagggggagattgtagaagcaaagactttgcctttgatgttttgatgatgccatatgatcgtgaagttttgatgccttataaaaatgcgtttctcaagtttaattcaagacaaaaatccaagaatacaagatacaacatcaagaagatctctagtgttttaggaagggaattccaaattcaaactgcaaaagggattaagagaccgaggtctcttgttgtaaagaaatatgaacacaaagtgatgcaatcctaccccgcaagggcattggatagaaaactccaagtagattgggccagagatgcaagagaaggccctagggttcttatgagccttagggtagatttcgggcccatgggctaa

SEQ ID NO: 68919 - DNA, 553 bp, Glycine max
  Peptide Sequence Number=SeqID_160604
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaggtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaatgtccggttgtcgctatgctagccgacctatatgacaccttcgaccgaagatgtgaagaaagcaatgcaaggattgtttgctgtactccagctctctatgtggggctggtttcacacctttttctccaagaag

SEQ ID NO: 68920 - DNA, 369 bp, Glycine max
  Peptide Sequence Number=SeqID_160605
cctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacggggagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 68921 - DNA, 768 bp, Glycine max
  Peptide Sequence Number=SeqID_160606
atgagcaatgcctggcccaacccttttcgtcgtcgtttgctggcaggggaaaccctgattggcagctggtgcgccctcgccaatcctctcaccacggaagtgctggggctggcgggctttgactggctggtgctggacggcgaacacgcgccgaacgacatcaccacctttattccgcagctgatggcgctgaaaggcagcccgagcgcgccggtggtgcgaccgccgtgcaatgagccgatcatcatcaagcgtctgctggatattggcttctataacttcctgattccgtttgtggaaactgcagagcaggcagcgctggctgtggcctccacgcgctatcccccggaagggatccgcggggtctccgtttcgcaccgcgccaacatgtttggcaccgtcccggactacttcgtgcagtccaacagcaatatcaccatcctggtccagatcgagagccagcagggtgttgataacgtcgatgcgattgccgccacccacggcgtggacggtatcttcgtcggcccaagcgatctggcggccgcgctcggacacctgggcaatgccggtcacccggacgtacagcgtgccatacagcacatctttgcccgcgccagcgcgcacggcaaaccgagcggcattctggcaccggttgaggcggatgcccgccgctatctggagtggggagccacgtttgttgccgtcggcagcgacctcggcgtattccgctcggccacgcagaaattagcggacgcttttaaaaaataa

SEQ ID NO: 68922 - DNA, 124 bp, Glycine max
  Peptide Sequence Number=SeqID_160607
atgatgctctcctacaacctaagacaaggtagatggagattacaatttacaagctcagggttcaagtcattcaatcaaaaacaagctcaacatgggtgcaagggattcatcattcatgaacagg

SEQ ID NO: 68923 - DNA, 737 bp, Glycine max
  Peptide Sequence Number=SeqID_160608
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 68924 - DNA, 306 bp, Glycine max
  Peptide Sequence Number=SeqID_160609
atggctagatttttgaatggcttgtataaggacattcaagatgttgtagagcttcaaaactacgacaacatggatgaacttatacacagagctgtgaaagtggagcaacaattgaagaggaaacaaaccaacaagaagacttcatacacttattcatcttggaaggataaagacacgtccaagaaggaggaaacaatcttcatgatgatgaatcatgttaattcaagtagttttgatgatgacaaaaagcccaagagaatgatttcaagattgagtcaacaagttcaagttcaagatcaagattaa

SEQ ID NO: 68925 - DNA, 848 bp, Glycine max
  Peptide Sequence Number=SeqID_160610
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcctattcaaacaatgctttgaataagattgcggagccatatgatcagcacgatgtcaactcgcctacatattctaatgaagagccatcaagcaccacgcctttggtagttcaaatgcgtcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 68926 - DNA, 519 bp, Glycine max
  Peptide Sequence Number=SeqID_160611
atggccccgaggaagctcgcctcaaagagatctaggaaggataaagcggttgaaggaaccagttccgctcccgagtatgacagtcaccgctttaggagcgctgaactccagcagtgcttcgaggccatcaagggatggtcatttctccgagagcgacgcgtccagctcagggacgatgagtataccaatttccaggaagaaataggtcgccgacggtgggcatcactggttacccccatggccaagtttgatccagacatagtcctcgaattttatgccaatgcttggccaacagaggagggcgtgcgtgatatgaggtcctgggtgaggggtcagtggatcccgtttgatgcagatgttatcggccagctcctgggatatcctttagtgctggaagagggccaggagtgcgagtatggccagaggaggaaccagtctgatgggttcgatgaggaggccatcgcccagttgctatgtatatcggggcaagattttgcccggactgctgccgggaggcgg

SEQ ID NO: 68927 - DNA, 483 bp, Glycine max
  Peptide Sequence Number=SeqID_160612
atgactaggggcaatccaggtgatttacaaccctttgatcctaaaatagatagaacctttcatagattagttaagcatagtgtgcatcctaatcattttgtgcattttgagcattctgagtattctgttgctggtgattctgaatattctgattttgagcattcaactactaattttcatattgagagcatggctcaacctccacctcgtgagaggactctcagggagatggttgcacctgatttcacttatgaaagcttgtgcattcaatatcttgatgagggtgttccatatgttctcaagactggattaatacatttgctgcccaagtttcatggtcttgcaggtgaagatcctcataagcatcttaaggagttccatattgtttgttccaccatgaaaccccctgatgtccaagaagatcatatctttcaaaaggcttttcctcattctctggagggagtggcaaaagattggatctaa

SEQ ID NO: 68928 - DNA, 231 bp, Glycine max
  Peptide Sequence Number=SeqID_160613
atgaggaattggaagacaacactgatgaagacaactgcagtggaatgcttggagcgatttgtatcagccatctgcaccatatttgggaatgagtacttgaggagatcaaataatgaagacatcaaacgcctactacaaatgggaacggcacgcagatttcctgcggatgacatttatccagactttgccatgtctgtgaagaccatctcaatgccacaagaagaaaaatga

SEQ ID NO: 68929 - DNA, 286 bp, Glycine max
  Peptide Sequence Number=SeqID_160614
gctctgcacacgactggcgctaagctcaaatctacttacttgcgctaagtgcgagggtggtgctaagtgcaacatcgctgtcgcaacctacccttcggtgggatggcgatgcgagggctcacgggtgcatcttccaagggaggaaggtgcgcggagtcgccaccaacgtttattcgaggaaaacgtcggaaaaactagaaagggtgtttccctcgctcctacgtatcctcaattgcgaataggaaatcagacctacatagttcttttagaactaaacattggttaa

SEQ ID NO: 68930 - DNA, 174 bp, Glycine max
  Peptide Sequence Number=SeqID_160615
atggcagagggaaagcagagatataagatgggagtagctgcggcgtttggtggaggtgaagaggggaccacagcatggatagggtccacagtctacacaggcaaacctaatttgccttgtaaatttcaattcagaacttggataaccaaagatatttttggtaacacgagatag

SEQ ID NO: 68931 - DNA, 2157 bp, Glycine max
  Peptide Sequence Number=SeqID_160616
atggaagagaaactaaagtacccctgtctctcttccttgttaaccctcttcctctgcatctccgccacttccactaacccacacaactcccaaacccaaacccttctcctccataccctccctgacccacccacactctcatggcccgaatccgccaccgtagaacccgacccggaacccaccacatccctctcccttcaccacatagacgcactctccttcaacaaaaccccttcccaactcttccacctgagactcgaacgcgatgccgcaagggtcaaaaccctcacccacttagccgcagccacaaacaaaacccgacccgccaaccccgggtcgggtttcagcagctccgtggtatcgggtctctcccaaggcagcggcgagtactttacgcgcctgggcgtgggaactcctccgaagtacctctacatggtcctcgacaccggaagcgacgtcgtttggctccaatgcaagccctgcaccaaatgctactcccaaaccgaccaaatcttcgacccatcaaaatccaaatccttcgccggaatcccctgctactcccctctctgccgccgcctcgactcccccggctgcagcctaaaaaacaacctttgccagtaccaggtttcttacggtgacggctccttcacattcggagatttctcaacggaaactctcacgttccgacgcgctgcagtcccgcgcgtggccatcggctgcggccacgacaacgagggactcttcgtgggcgccgcaggtttattgggcctcggtcgcggcggcttgtcttttcctacccagaccggaacccggttcaataacaaattctcttattgcctaaccgaccgaaccgcttccgctaaaccgtcttccattgtgttcggtgactccgctgtttctcgaaccgcccggttcactcctttagttaaaaaccctaagcttgatacattttattatgttgagcttcttgggatcagcgttggcggcgcgccggttcggggaatttcggcttcgttctttcggctcgactctaccgggaacggtggggtgattattgactcggggacttccgtcacgcgcctcacgcgccctgcttacgtgtcattaagagacgcttttcgggtcggggcttcgcatttgaagcgcgcgcctgagttctcgctttttgacacgtgctatgatctttcggggttgtcggaggttaaggttccgaccgtggttctgcattttcggggcgctgacgtgtcgttgccggcggcgaattatctcgttccggtggataatagcgggagcttttgctttgcgttcgccggaacgatgagtgggttgtctattatcgggaacattcagcagcaagggtttcgggtcgtgtttgacttggcgggttctcgggtcgggtttgccccaagaggatgcgcgacgttatcgtcttgcttggggtttgggggtttaactgcagcaatctcagctaaacaagacagcaaccgccgcaactccttgaggaagaagctcctccttgatctcaaggtaaaccctaatcagattcccaacgaccctttctctgtttcgggcaatggcgttgaagagagtggtgttggtgttcagggggttgacaatgtggttgaagttgaaaaaccaaagtctaagcttttgcgtgagtctgttttgtggaataagttggggaattgggctgaccagtacaagagggatgttgagtattggggtgtaggatctggtcgtatattcactgtttatgaagattccattggaggtatcaagagggtggttgttgatgaagacccgattctgaaaagaagcaagggtggttttgttaaggctgtccaaggttttgttgcgaagccgagattgcttcccaggctttcggagcttgggaggaaagtgttgtacgtgttggttgttgtgtggatggtgaagaagttatttgttgcttttggagaaggagataaggagggcactgttgaagttgttgttgaaccttgggagacaccggcggtggacattaagaagcagttagataaagaacaacttaggaatagtattctgaaagttaaggattctgtttataaatcggtagtacatgattcgtctgataaagtgaaaactagattcacggagatggattataaagttcaataa

SEQ ID NO: 68932 - DNA, 1881 bp, Glycine max
  Peptide Sequence Number=SeqID_160617
atggagaatctgatacagttggtgaacaaaatccagcaagcatgcaccgccctcggcgatcacggtgaggaaggcgcaatgcctactctctgggacgcccttccttccatcgccgtcgtcggaggacagagctctggaaaatcttcagtgttagagagtgttgtcggaaaggactttttacctcgtggatctgggattgttactcggcgtcctcttgttttgcagcttcataagattgatgaagggagagaatacgctgaatttatgcaccttccaaggaagaaatttactgattttgctgctgttaggcaggagatcgctgatgagactgatagagaaacaggtcgcaacaagggtatttcatctgtacccatccatctgagtatctactcccctcatgttgtcaatctgactctggttgatcttccggggcttactaaagtagctgttgatggtcaaccagatagcattgtgcaagacattgaaaatatggttcgggcctttattgagaagatgtatgagctccagtggtggaagctaaacttcctgagcatgtcattgaatcctaattgcatcattttggcaatatctcctgccaatcaagaccttgctacctcagatgcaattaagatttcccgagaagtagatcctaaaggtaaggtgaagctgaaagtaaggaagatgttgaaaatacagaacctagaaggggaaaggacatttggagttttgacaaagattgatcttatggacaagggtactgatgcagctgagatccttgaaggaaaatcatataagctaaatttcccttggattggtgttgtgaaccgctcccaagctgatatcaataaacaagttgatatgattgcagctcggaaaagagagatggagtattttgctaatacccccgaatatagacatcttgcttccagaatgggctccgtgcatctaggaaaggtgctatctaagcatttggaatctgtcatcaagtctcggatcccaggcctacaatcactcattaacaagactatcattgaactagagacagaattgaaccgtattgggaaacctattgctgctgatactggagggaagttgtacatgataatggaaatctgtcgaacttttgatcagatatttaaagatcatcttgatggcatacggccaggtggtgagaaaatttaccaagtatttgataaccaatttccagcatctataaaacggctgcagtttgacaaacatttatcaatcgacaaggtgcggaaactaataactgaagcagatgggtatcaacctcatctcatcgctcctgagcaaggataccgccgtcttattgaatcatgcttagtatcaattaggggccctgctgaagcagctgttgatgcggaattaaagcagtatcccaccttgagggtagaactcggaagtgcagctgttgattcattggagaggatgagagaagaaagtaagaaatcaactttgcttttggtggacatggagtatggctatttgactgttgattttttccgcaaacttccccaagacgcagagaagggtggaaatccaactcattcacttttcgacagatataatgattcttatcttcgtcgaattgctaccactgtcttgtcctatgtgaacatggtatgtgggaccctgaggcataccattcccaagtccgtggtttactgtcaagtgcgtgaggctaagcgcagcttactggatcatttctttacagaattgggaaaaaaggagggaaaacaactagcttcactgctgaatgaggaccctgcaatcatgcagcgccgcacatcccttgcaaagaggctagagctatacagaaatgcacaatcagaaattgaggcagttgcatgggaaaggtag

SEQ ID NO: 68933 - DNA, 693 bp, Glycine max
  Peptide Sequence Number=SeqID_160618
atggaatcaggaacatggctacggagttcgttgttggtgacgttttgtacagtgagattaaggagggaagctgaaaggtcggggacgtggccagagagggcgttgttctgtaacctcaatgtgaggaggcatagcgaggatatcttcgtcaaaatctcgacgttgaaatcgttgcgggagaggtacagtagttccaggcttgtgcaatttaagagaggtgaaatggtgtcgttgaagcgatttttgtggaggttgaggaagcgcagtgtgaaggatgtaatcaaagcaggaacaacattggtggcggcggaacagacagtgtggattgaagcagaacagaatactccacccactgtcgccgccgccgccgccataccaatgtgcgttgttcctgctcaaaccttttactattcccatcatttccacgccgaattgcaggaagaagaagaagaaaagcgcattgatatagagaaggaagtgggagcagcgcactcgggttactttcgacccgaaacacaacacccccttccctcggtgcacaaccctagccatcaagccaccaaccactactacaccccaccccacccagcggccaaaaccaccgcaccacagacatcacccatcactttccactgtaacaccccaaatgaatcacaccgaaatgagaaggatctagaagatgtacatgtatga

SEQ ID NO: 68934 - DNA, 2091 bp, Glycine max
  Peptide Sequence Number=SeqID_160619
atggacaggtttcagggacagacccggttgtacaagagcaaaccaagtgacttccgcatggcactggaggaggcaatgctggcagaagatggtgttctggaatcacatttgggaagagaagaattaactggtgtagatgctcatcctgatggacttatggaggccactgtttcttatgttgatggggaatgctacggccaggatcaggatacaaggtgttgtgctggctgtggtctgatgtttccatgcaaaaccatgaagaaaattaaggattcaaatggtgcaccccaattttgttgcaaatattgttctaagttacgaaaatcaaaacaatattgtggcatttgcaaaaggatttggcatcactcagatggtggaaattgggtgtgttgtgatggttgtaatgtgtgggtgcatgctgagtgcgataaaatatccagcaaagttttcaaggatctggaaaatacagattactattgtccagattgcaagggaaaattcaattgtaaattaccagcatcacaaacatacaagtcaaatatcgaattaatagagaatagccaaaaatctatgatacccgagaaagtattggtggtgtgcaatggcatggaaggcttttacatcccaaagcttcatctggtcatgtgcaagtgtggctcttgtggttcaagaaagcagacacttagtgaatgggaaaaacatacaggttgcagatcgaaaaaatggaaacatagtgtgaaagtgaaaagtacaatgctaccactggaaaaatggatggaagaaaacattccacttgatggaatacctgagcagttagatcaacagcaggtgctggcctttttgcaagagaagtatgagcctgttaatgtaaaatggacaacagaaagatgtgctgtttgcagatgggttgaagattgggaagataacaaaattattatttgtaacagaattttggagttgttagtattttatttcaaattttatgaggctttaaagatgccaaatagcagtccaccaagaatgctatggggcaaagaatgttcaggattttacttcttgggtggtgctctaaagccaacggatgttgaaatgttgtgggttcatgtaacatgtgcttggtttcgacctcaagttgttttccaaaaccatgaggccatggaacctgccatgggaatccttaaaattcctcctaattcctttgtgaagacttgtgtgatctgtaaacagagccatggttcctgcataagttgttgcaagtgttctacttattttcatgtgatgtgtgcatcaagggcaggatatacaatggagttacattccatggagaagaatgggactcaagtaacaaggaagctaatatattgtgcaattcacagggttccaaatccagattctgtactggtggtacacacacccctggggattttctctcccagaacttcacttcaaaatcagaagggatgcttcaggggatcaaggctaattttatcaaagaatatagagcttaatgaatcttcaaccactgaaaatgacttagtagagccgctgtctgcggccaggtgtcgtgtgtaccgaaggtctcctaataaggatgctgatgaatctaaagtattcacttctttcaaggaacgtcttcaccatttatgggaaacggaaaaatttagagtttgctttggaaaatcgggcattcatggatggggtctctttgctcgtagagatatacaagaaggagagatggttgttgagtatcgtggtgtgcacgtaaggcgtagtgttgctgacctgagggaagaaaaataccgttcagaaggcaaggattgctatctgttcaagatcagtgaggaagtggtagttgatgcaacgaacagaggcaatatagcacgtttaataaaccattcttgcatgccaaactgctatgcaaggattatgagtctgggtgatcaggggagccgaattgttcttattgccaagaccaatgtttctgctggtgaagaactaacgtatgattacttgtttgatccagatgagcgggatgaattgaaagttccttgcctttgcaaagcccctaattgtaggagatttatgaattag

SEQ ID NO: 68935 - DNA, 729 bp, Glycine max
  Peptide Sequence Number=SeqID_160620
atggaggttttgcatggtggaatctacctgaacaagtttggagtgaaggtctattactttattaaaggcagtgatataattcttttctcaaaattgaccgtggtggagacctcggaggaattacagtcatcgactcaagcttctcatgagcccaagagtgaacaaccaaacaatcacacaactgatgctcctgttacagacacaggctcagcatctgctacaagtaatgacagcaaaaaagtttcacggcaggatattgagtttgttcagaatttaatagaaagatgcctacagttatatatgaataaagatgaagtggttaaaacactactgactcgggcaaagatagatcctggattcacaactcttggtaggcatcttaagaagttggaagaagagaacgctgatttcttcagggcctactatatcaggctaaaattgaaaaagcaaatactattattcaatcatttacttgagcatcagtatcatctcatgaagtgtccaatgcctgcaaaggttccattggctccaatacagaatggaatccatccaatgcctgtcaacaacctacctatggggtatccagtgctacagcagcctcccatgccagcaacaggtcaacctcatattgactccatgggttgtggtttatcaagttgtcatgtagttaatggagtccctgcctcaggcaactttcaccccattcggatgaattctggaaatgagtga

SEQ ID NO: 68936 - DNA, 2445 bp, Glycine max
  Peptide Sequence Number=SeqID_160621
atgccgccatctaagggcgtgatccccccaatgcatacaccacatttgcatcaacggtcagttgtggagggaccttggcacacaagcactcggatggccccacaaagaagtgaagaacaaagtcccgccgttgaggacacattgttgttgtttggcactagaatcaccattgccttcttcatcaacaacatggcgagttccatcaatgttgtcattgtgcttgggcagaggacgacaacacaagagggaggcctcgtgctttcgaggaggtatatgattcatattgggagtgaacagacactaactcttttctttgcagttgcagttgctgcaatgcctacaaagctattctcccaactacatcttctccatcccctcctccccatgaagccccgcactctcccccttctctccagacccttcttcttcccttcctccaagttcctccgaacctcaccgtttaaggttcgcgccttctcctcccgggagaaggttcccctccgcccctccaagagcctcatcgacgacgaggccgacctcagcaactgggttgacgaattgcgctccggcgggcccgatgaaatgcggtctggccggggcaatgaagtgcggaccggtcggagagaccggtttgccgattctggccggttcagccgcgatgacagggaacgcgaattccggccgccgaggaataataaccgggcttccgcgttggggaagagaaggggcgaggatttgaggaaggggggacagagtgtcggttcgaggagaaagtttcaaccgaggagtgatgatgatgataacgaggtaatgaatggaagaaagttgaagggtggtggcgttggagcctttcctagcgaggatgaggatgaagatgaagacgaagagagtgaagggagtgaggaggaagagatattgaacaagagtagaaccgctttgtttggtcaacaaaacgttttgaaccggaggaacaccgaaccaactccaagaccttcttctcctggaggaggatctgattcttatttgagtgaaaccagatttgaccaatgttcaatctccccactgtcattaaaaggagtcaaggatgctggatatgagaaaatgacggttgttcaggaggctactcttccagtaattctcaaaggtaaggatgtccttgccaaggccaagacaggcaccggaaaaacagtagcctttttgcttccatcaattgaagttgtggcaaagtcacctccaagtgatcgtgatcataggcggccaccaattgctgttcttgtcatatgcccaactcgagaacttgcaagtcaagctgctgcagaggccactaaactgctgaagtatcatcctaccattggtgttcaagttgtgattggagggacaagacttgcgttagagcagaaacgaatgcaagcaaacccctgccaaatccttgttgccacacctggaaggcttagagatcatactgagaatactgctggttttgcaactaggctgatgggtgtgaaggtcttggtgcttgatgaagctgatcatttactagacatgggatttcgcaaagacattgagaagataattgctgcggtccctaaacaacgacaaactcttatgttttctgccactgttccagaagaggtccgtcaagtatgtcatattgctttgagaagggatcatgaatttatcaatacagttcaagagggaacggaggagacacattcacaggtctgccagacgcatttagttgccccattggacaagcatttctctttactatatgttcttctgaaggaccacattgcagatgatgttgattacaaggtccttgttttctgcacaactgctatggtcactagacttgttgctgaacttcttggtgagttgaacttgaatgtgagagaaatccattcaagaaagcctcagagttacagaaccagagtctctgaggaatttcggaagtcaaagggtctcatcctggttacttcagatgtatctgcacgtggagttgattatccagatgtcactcttgttatacaggttggtttgccagcagatagagaacagtatatacatagactcggtagaacagggcgaagagggaaagaagggcagggcatactgctgctggctccttgggaagacttctttttatctaccgtaaaagatttgcctattgagaaagctcctgtagtaccttcagttgatcctgacaccaagaaaaaggtggaaaaagccctatccaatgtggagatgaagaataaagaagcagcatatcaggcgtggcttggttactacaattccaacaaaaaagtggggcgtgacaagtacaggctagtggagcttgcaaacgagtttagtcgaagcatggggcttgataaccctccagctatacctaagctagtccttggcaagatgggcctcaggaatatccctggtttacgggcaaaatag

SEQ ID NO: 68937 - DNA, 288 bp, Glycine max
  Peptide Sequence Number=SeqID_160622
atggctgattgggggccagtttttgtgtctgtggtgctcttcatcctcttgactccagggttgctgatccagattcctggtaaaggcaaaatggtagagtttggcaactttcagacaagtggagtgtccatattggttcattccatcctctactttgctcttgtttgtatcttcttgatggctattggagtacacatgtacactgcgcatctgtcaagtaaaacatcatggtctgtggatttcacaggatccgtgttttgttccaatggttctgatatttgttactag

SEQ ID NO: 68938 - DNA, 306 bp, Glycine max
  Peptide Sequence Number=SeqID_160623
atgacgacaaccaccacgatgcgagtagctcaacaagagtcattttggggggttagtagcttgaacaaggtagggcaggagagcttacattgccgatttcgtttcatttgtgaaaaagaggaacctgagagagagaatcagaggaagaagatgatctataggaagtggagtctccttaccggcccggtcgccattctcggcggcgtagtcgtcgccatcgccgccgcaaacgtcatcttcgtcaagaatgatcctttcctcaaaccagaggagaggaagtatgaaaatgaacctgctaccaagtag

SEQ ID NO: 68939 - DNA, 1719 bp, Glycine max
  Peptide Sequence Number=SeqID_160624
atgttggagaaagttgaagaatttaacacggagaggatgatggaggaatttgagagggtgacaaaggatgctgagaggattcaaagggaaaccctgaagaggattttggaagataatgcttctgctgagtacttgctgaatttgggcttgaatgggaggacggatcctgagagtttcaaggcctttgttccacttgttactcataaagatttggagccttatatcaatagaataattgatggtgatttttcttctgttctcactggcaaacccatcacaaccatgtctttgagatatatcacacctcttttgccttcagaaacagctagttggaattggcaaatgacaccaattccattgtgtagggaatttcccataaacaatggcaaggccttgggctttatctacagcagcaagcagttcaaaaccaaagggggtgtgctagcaggaactgccacaaccaatgtgttccgtaacccggggttccagcatgcgatgaaggcgattcagtccccactttgcagccctgatgaagtcatatttggtcctgattttcaccaatccttgtactgccacctcttgtgtggcctaatcttcagggaagaagttcagttggtgtcttccatatttgcacacagcattgtctatgcttttaggacctttgagcaagtttgggaggagctttgtgttgatatcaaggaaggtgtccttaacagcaaggtcacagtgccctccattagggaagccatgtctaagctcctaaaacctgaccctgagctggccaacttgatccacaacaagtgcatggggcttagcaactggtatggcctaataccagagcttttccccaatgttaagtatgttcatgggatcatgactgggtcaatggaaccttatttgagaaagttgaggcattatgctggagagttgcctttgttgacttctgactatggatcttctgaagggtggataggaacaaatgtgaaaccaacagtaccacctgaattggccacctacactgtgcttcctcaaattggctactttgaattcatccctttgagagagctagaggaaattaagggagatgctagtttcctttgtatggagcctaagcctgtggggctcactgaggtgaaagttggtgaggagtatgagattgtcatcactaatccagcaggcttgtaccggtaccgacttggtgatgtggttaaggttatggggttccataattcagctccagaaataaagttcgttcggcgtagcaatcttctgcttagcatcaacatagacaagaacacagagaaagatcttcaattggctgtggaatcagcatcacaattgttggcagaggagaaattggaagtagttgactacactagccacatagatttatccaaagagccagggcactatgtaatcttctgggaaataagtggtgaagcaagtgaagaagtgcttggtggatgctgcaactgtttggacaagtcttttgttgatgctggctacacaagctcacgcaaagtcaactgcataggtgccctcgaactccgagttgttcggagaggaacattccagaagatacttgagcattcccttgcactaggagctgctgtgagccagttcaagacatcaagatgtgtaggccctacaaacaccaaagtgttgcaaatattgaatgaaaatgttgtcaagaactatctcagtactgccttcaattga

SEQ ID NO: 68940 - DNA, 3897 bp, Glycine max
  Peptide Sequence Number=SeqID_160625
atggagaaattggcaagagctcagtatttgaagaacaaaaatcccaaggattgtgctttgctgtatattgcactgaatagagttcaagttttggctggccttttcaaaatcagtaaggatgagaaggataagcctcttgtgggctttctttctcgcaattttcaggatgagaaaaataaagctgctgctttaaaaaatgcttatgtcttacttggaaagcatcagctggaattagcaattgctttctttttgcttggaggtgatcattcttctgctataaatatttgtgctaagaatcttggggatgaacagcttgccttagtcatttgtcgtcttgttgagggccatggtggaccattggagcatcacctaattacaaagtacatacttccatttgcaattgataaaggagactactggcttgcaagccttctggagtgggaaatgggtaattactaccaatctttttatagaatgctagagttttcagtaaaccctgtgcctcgggagtccactgtcatgtccaattgtggtccctttctggaccctaccgtcggtttttattgtcaaatgttagcaacaaagaatagcatgcggaatgctgtgggggagcaaaattctgcaattcttttaagatgggcaactttgatgacagttgctgcactaaaaagatgtggtaatcctcttgaggcgttggagtatttctcgtcttcgcttagcatgcctgggactgcagatcaagagagtgaattaggtgacagtcatgatgtgctgtccagtactcttaagcctttgccaagaaaatgctctaactggttgtctgctaacatgtctgtgcatctggagttccatattaaattgaatttggcactttgctacttatcaaaattgataaaagagcatccaagctggcttgacacttttgcagaatataatggagaagcttctgattctgacgagtacatgatgcaatatgagaaatcagttgaaagttttaaacaaaagttatacacagggcttgctctatttgaacggaggtttttattggctcctcgctgtctaatcagtatgattttactcttactttgccatcatggatcattgtacattgggtatgatatgacagatggatacactcaagcagaactgtctcaaaagaagagcaatatatttgatgatttcaatttatattactctcggattaaacccctgttcaagactgcagaagaagtctcctttttctattcaagatttttttgtgcctgcagtatggaaaattctcaacaaaattcatctattgatagcaaacctaagtttttggatgcttttcaatgctgctttgaaggtgttttgatttcattgtggtttttaagagcaaattttaggattcagttgagttctatttgcaaagatcttgtcaaaacacatcttgatatcctggatttgtatgaatattatttacatttttcattagcttggcttcaaaaaaactcggaagcgcttttgtatatgttggaaccattcttggttgcacaatctaatgaccgtaatccttacaacattgatattgtgaatctgaagaagcttatcccaaaaattgggcagttgttggctcaaacttctttcatgtctaatatacaaaaccttcaactatccgaacgtgcagaagataaactagttgcagatataaagcattcaattcctgatgatgaaagatggaagattatagggacctgcttgtggcagcatatgtctagattcatgatatttaatttgaatctggttcttgccaaacttgaagatggtaaactgtcgggtcctttccacagaaaatatacttatggggagtcttatctcataaatatggattctgaaagcatcagcttgccagagaagattcggttagtcttgtttagcctatgtgatctactgatgacaacagttactcacatttcttcttatcatgttaaacaacaagcagaatttctgtggcagaaagtagggaatgatttgaatgtaatgactcttcaatggttaaaacaaaaatcagaattcagccagaaccaaaacctggacattttggaactggggaacatgaaagataactattcagttaatcagttattatgggatcgctgtgcggatcccaaattgatatctgattgctttgcacaggaaaaactcaattggccaaatgatttggatcagatgaatactaaaggatggaatgatttgtctataattatgacaggactgcataaaactgatgatacatgtggtgatggatgtaaacttagcactagatcttctaatcatgaagttggaactcctgttaaaggaacatctctaagtggcaatgcttctgcaagatcaaaccagaaagatataacttatacaaattttgcagttttccagagtcccagagaaatgtacaagagaaatggagaacttttggaggcattgtgtataaactctaccaatcaacgggaagctgcagttgctggcaacaggaagggttctgtgttgagttttttgttatgggtgggcattgaatgtggagccaagaagggtataatgttctttcattgggaagatgagattccttttagtggtaaatcagatgatcttttgtgggccacagctgattggcctcagaatggatgggcaggttcagaatccacccctgctccaacatgtgtttctcctggtgttggccttgggagcaagaaaggggcacaccttgggctgggtggagcaactattggtgtggactcttcagcttggcccagcaatgacttgacaggtggtggagtattaggaatgctaggttatactggtattggtgcctctggattaggttgggaaattcaacaagattttgaagattttgtggatccacttgccactttggagaacataagtaccagggctttgtctagtcatcctatgagaccttttttcttggttggttctagcaatacacacatttacttgtgggagttcaacaaagacaaagctactgctacatatggagtgctgcctgctgccaatgtccctccaccttatgcccttgcatcaatttcagccttgcagtttgaccactttggacaccggtttgccagtgctgcattagatggaactgtctgcacgtggcagctggaggttggaggaaggagcaatgttcgtccaacagaatcatctctttgctttaacggtcatgcatcggacgtcacatatttttcctcaagtggatcgataatagctgtggctggatatagctctaatggtgttaatgtggtcatatgggatactttagctccacccactacttctcgagcttccattttatgtcatgaaggtggtgcacacaccgtgtctgtttttgataatcatgtgggaagtggttctgtatccccccttattgtgactggtggtaaaggtggtgatgttggacttcatgacttccgctatatagctactggaaaggctaaaaggcataagcgtgctgataacattgggcaaagctctgtctcatctttaactcgtgataaggatcaaaatgtagatgggatgctttggtacattccaaaggctcactcagggagtgtcacaaaagtagttaccatcccaaataccagcttgtttttaactggaagcacagatggagatgtcaaactctgggatgcccagagcacaaagttaatacatcactggtcaaagatacatgaaaaacacacctttctgcagccaagttctcgtggatttggtggtgttgttcgggctgctgttacggatatacaagttgttccccatggttttctttcttgcggtggggatggaattgtaaagctggtacggctggacaatcacctgcgtgcccatggaattgagttatga

SEQ ID NO: 68941 - DNA, 336 bp, Glycine max
  Peptide Sequence Number=SeqID_160626
atgattcacggtactgatcgaaaagaattccagccgacgtcggccaggaaagatgaccgatcgaggtcggctaggtttttccgtgcgtgctcaaccgaagttttgtatcagccgacaccgccactttttcatttactcggcaaggaaaacatttgcccacctcgggaaatgatgagaatcatgaaacaggccaaatacagtctaaaggcaattatgagaatcatgaaacaggccaaatacagtctaaaggcccaagtggagaaggacgaaggcccaagtggagaaggacaaagcccccgagtggagaaggatgaaggcccaagtggagaaggatga

SEQ ID NO: 68942 - DNA, 3292 bp, Glycine max
  Peptide Sequence Number=SeqID_160627
catcgtggtcgccagccagattattcaggcgctgcaatccctcaccagccgcagctttaatacgctggacagtctggtgctgagcgtcacgcggattgatgcacacaggcacgacggtcagcagacggctgaagcggaatttggcggcacggtgcgcacgcacgataaacaggtgcgcgcgcagctggagcagcgtgcgcgcgaggtggtggtcaatatcgccgccgccagcggtgccacggccacctttagctggcatccggggccgccggtactggagaacgacgcccactgggcacagtttgccagtcaggtggcgcagcaggtgggttatcaggtgcaacaggctgagctgcaccttggcggtgaagatttcgcttattacctgcagcagctcccgggcgcgtttgtcagcattggcagcgccagtgaatttggcctgcatcacggtggcttcaaccccgatgaagcgctgatcgccccggcagcacactactttagtcagctggcgcaacaggcattgcagcagctaaacgcgcgatcgctgtacggcgataaggctatcgccggcaggctgcgccatgagcaaagagagacgattatgactgcaagacaactgcgcctcggcaccattctgcacggcgcatccggcaacatgtccgcctggcgtcatccggcggcgcaggcggatgccagcatcagttttgattacgcccgccgtatcgcccgtaaagccgaggctggcaaactggatttcctgtttgtcgccgatggcctgttcatcaatgagaaatcgatcccgcactttcttaaccgcttcgaaccgctgacgctgctgtcggcgctggccggcgtcaccgagcatctcggcctggtcggtacggtgtccacctcctacagtgagccgttcaccgtcgcccgccagttcgccagtctcgatcatctcagcggcgggcgcgcgggctggaatgtggtgacatcgccgctggagggctcggcaaaaaacttttcgcgtcagcagcatcccgagcatgcgctgcgctaccgcatcgccgacgagtacctgcaggtggtgaaagggttgtgggattcctgggaagagggcgcgtttgtgcgcaataaagccagcggtcagttctatgcgcctgacaaactgcacacgctgaatcatcacggtgattttttccaggtacaggggccgctgaacattgagcgcacgccgcagggccggccgattatctttcaggcgggcgcctcggaagatggccgcaagctggcggcgcgtcatgccgatgccatcttcacccatcagccaacgcgcgaagaggcgcaggcgttctaccgggatgtgaagcagcagctggtggcgaacgggcgtgaaccgggcgatctgcacattttccagggcgtcagtgtgatcgtgggggagaatgacgcagacgtcgagcgccagtaccagaccaccgcggcgctggtctcgattgaggatgcactcaactaccttggtcgcttctttgaccatcacgacttctcgcagtatccgctcgaccagccgttcccggacattggcgatattggccagaatagctttcgtagcaccaccgacgaaatcaaacgcaaagcgcgcgaacacggccatacgctgcgccaggcggcgctggaagccgcgacaccgcgtccgctgtttcacggcacgccacagcaggtggcggatggtctgcagctgtggttcgaaaccgaagccactgacggtgattccggttctccaggcgcgcggcctgacgcgtcgcgaatacccgggcagcacgctgcgcgccagctttggtctgaaacaaccgctcaaccagttcacaccacaataacgatgagaaaacacgctatgcagaaaaaatccctgattgtgctgctgttactgagcctgagcagtgcggcactggccgaggacgtggccgttaatggtcagcaggtgagccttgccgccaataaaacgcccatcaacacgccagagaatcctgccgccgtggcgcaaattccggcgggccacaaatttgccgtgccgggatcgttcaccgtggcggtggcggcactcaactcgccgccgctcacggtattcagcgacgacaataaaacgctgctgggcagtgaggtggatatcgcgcgtctggtggccgacagcctcgggctgaagctcaacatcgtgcccacctcgtgggaggactggccgctgggcgtggcatcgggcaaatatgacgcggcgatcaccaacgtgacggtgaccaaagatcgtaaacagcgttttgattttgccacctaccgtaaagattcgctgggcttctatgtgaaaaccagcagcccgattacctcgctgagcaaggcagaagatattgccggcctgcgcatcatcgtcggctccggcaccaatcaggaggccatcctgctggcctgggataaagagaatcaggctaagggactgaagcctttcacaccggtttataccaaagatgacgctgcgcagacgctggcgctacaggccgggcgcgccgacgcttacttcggccctaacgtgattggcgcatggaaagcggcgctgaccaaaaagacccggctggtgggtagcgtggacggcggctggccgaaggcggcgcacatcgcggtgacagtgaagaaagacaacgggctggtgcagccaattaacaccgcactcaatggcgtgatcaaaaacggtgactacgacaaggtgctgaaccgctggggtgaaggcgtggagcgtctggatcgcatgagccagcaatttttccgcgaagtgtcaccggaagcgccggagctgcagccgattcttgacggtctgtttggtgaatatgcagcacgctacggcgatttcttcaggaaacacaatgaagttgagctgaccgagtggtatctgccgccgcgcgggctgttcatcgtgctggagcgcgacggtgagatcatcgccatgggcgcctataaaccgtgggatgctaccaccgccgaactgaagcgcatctggacgcggcgtgacctgcgccgtcagggactggcactgctgatcctgcaggagctggagcgccgggcgctgcgcgcaggctatcagcgcgtgtttctcaccaccggttttcgtcagccggaagcggtacagctgtatatcggccacggctatcagccgcagtttgagctgcgcgaagatatggagatttacggccagccgccgcacgatggccggctgcgttttctcaaagtgattgatgtgcacaacgtggcacaggccagctaa

SEQ ID NO: 68943 - DNA, 270 bp, Glycine max
  Peptide Sequence Number=SeqID_160628
atggaagttatcatggagaaggacttccaaatgcactttaatttctgtaccactggtacttctaattatcaaagagaggggctgactgcccctttctctgattcagaaatcagagatgctatttggaagcctttgattaacaagtttaaagctaagctctccaagtggaatcagaagtacttatctatgggtggcaagattctggcaagattcttggctgggacagggaggcagccttcagcagaagtacaatcaattatttgtgattag

SEQ ID NO: 68944 - DNA, 225 bp, Glycine max
  Peptide Sequence Number=SeqID_160629
atgggtaggggtgaccaaatcctgttctcggaagatggttgggctgaggatgggattcccctaaaagaccaatttccagaaaggcagaaattgatgatttctgggtggaaaatcctaatttggttaagccagaaattctgcagcatttgcagagcagctgtattcagattcacaaaaaagatgagtggatctggaaaacagaccctactggacaatattcggtaa

SEQ ID NO: 68945 - DNA, 528 bp, Glycine max
  Peptide Sequence Number=SeqID_160630
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggagttagtcttgaagtcatgcgccggttaaaggctaaactgaaaggacaagttttggtgactgcgctcctcccaagccagttaccctcggttccaaaga

SEQ ID NO: 68946 - DNA, 483 bp, Glycine max
  Peptide Sequence Number=SeqID_160631
atgggtgccaagcaccttgcaaggaccaaagaaaggtcgcatgtcatcaagcaaaggtccccggacgaaattaggaggctaagttttttggaccaagggttatctgagccccaagtgaccataacggaagagatgaaaaccatatccaagcgatttgaggagcttgatgtttgtcacaaatcaagtgcatcatctcctgaccaggccattccaagaaggaccatgccgatgttggatcaatttcattcgttcattcatgatttcattgaaaacattatggatgtcaaagctgacggtaactgcgaatatcgtgcaattgctgcgttattaggtatgggtgaagattcatggtcattggtgcgcaaccatttgcttaaagaacttgccaaatggtcttatgagtatgtcaacctctttggtgaccttgacagatttgaggaattaaagaggtccctacttattgatggattatccatgaattaa

SEQ ID NO: 68947 - DNA, 96 bp, Glycine max
  Peptide Sequence Number=SeqID_160632
atgtacacgctcatactcagtaacaatctgtcataccctaatttcgtccggggacctttgcttgatgacatgcgacctttctttggtccttgcaag

SEQ ID NO: 68948 - DNA, 354 bp, Glycine max
  Peptide Sequence Number=SeqID_160633
atggctacttcacttgcctcgcctcctcctcctcctcctcctcctacagtagcatcagcgtctccgtctaccttgaagcggacacgcaaagccacacggctacgatccttggccactagaccacctggggcagagagaccagtggaacatgtcgatcttgctaccgggaaggccaacggtccccacaagaagaaattaagaacatatttggggattgtcgctcccgacaaggacagtgtggacgacactgtttgtgaaaaatacgacattagcaaggagaaatggactcagttttgtcagacccgcagagacccctcatgggaggatgtgcggaaaaaggcacaggccatctag

SEQ ID NO: 68949 - DNA, 519 bp, Glycine max
  Peptide Sequence Number=SeqID_160634
atgccgtatgtgaaagccgcggaggagttgttggaaatgactttccaatcttttgaggtagtgagcatcgcttccgtagattctctccctaggcagccccgcctgtctggtgtggcaatgatggtggcctgggtgatgttggggcacggctacgagcccgaaatgggtttgggcaaaaacaacggcggcagggccggcctagtaaaggtcagaggaaaccacgggaaatttggtttgagctataaacctacgcaggttgatgtaaggaaaaacatctcggaaaggaagaacaaaggccaaagcccgcggtcgggacagcaagccaaagaggttccaccgtgccacatcagtagaatctttgcgagtgtgggtttaagatgcaaaggacaagtcgccgcgatatgcgatgaggactcctcgaggggatcagatttggtacagccatgccttcccagtttccaactagggaattggcgggtggaggaacgcccggaggtttacacgacaagcataatgtaa

SEQ ID NO: 68950 - DNA, 171 bp, Glycine max
  Peptide Sequence Number=SeqID_160635
atggctgagaagaccaaaaagaaactggaggaagctgcccagtttggaaccactgacggcgtcattgaccctccatctcccattagatgccacatgaagtggaagatggctagcaccaagaaaactgggcagatgacatctgaggcagcaaaggaaatccttgagaagatc

SEQ ID NO: 68951 - DNA, 276 bp, Glycine max
  Peptide Sequence Number=SeqID_160636
atggtgaaagttggaacctctttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 68952 - DNA, 264 bp, Glycine max
  Peptide Sequence Number=SeqID_160637
atggcaaggattcctaacaagattaagtctattgatgggtcaaaagagacgcctaagcttgctgtcagaaacaccgatctttggttcgttgggactcccgtcaagtctgagcaagcacaaatggtttttgttgattctgagggtgatcaaattcatgatgtttgtaaagcggaccagctcaagtcttggaaagctaatttgaaggagaattccacttatgttatgcataatttcaaagttgtcaagaatgatggtcaatttaga

SEQ ID NO: 68953 - DNA, 588 bp, Glycine max
  Peptide Sequence Number=SeqID_160638
atggctttccaatcctttgaggtggtgagctgcgcctctatggaaccaagtccgtcgctaccttctctctccaaagtggccataatggtggcgcgtgttatgctcaggaacagatttgagcccggaatgggtctaggcaaggactgcctcgggaatgccgacgtggtcgatatcaagggaaatccatgcaaatatggattagggtacgaacccgggatgccggggaggaggaacgtgccgtcaagatttcgggcggatagggtatggcccggccgtattagccagtgtttcaccagcgctggaatggtgtccgaggaggagggtcgattctttgaggatcctaacaacgagggtttgacaatcgatttcgatcgagatataagccaaacgataaatgaggaagaggaagaggacgtcctgtcgccggaattggagaggttggtcgctcaggaagaacatgaaatgaagcctcaccaagaagaaaccgaattagtaaacttggggaccacgaaggaaaagaaagaagtgacggtaggaaccggtatgaccgcacctatccgccaaggcttgataacccttcttgaatag

SEQ ID NO: 68954 - DNA, 588 bp, Glycine max
  Peptide Sequence Number=SeqID_160639
atggcttctaggaaaagaaaggcaccctctacacctacccaagtcaaatttgacaaatccagattcacttcccaagaggctttggaaagatacacagatgttattgtgcctaggaagcttttgcctgagaggaacgtggttgtttattccacagagtttgatgaattcttagatgagctggcgagacgccattgggatgaggaattgactgatttcattaacggcaacctctatgaccccgaggataaatcacctaagatccctgttattgtggaagagggggaatcactctatgcttattctagatttgcactcctgaggcctaatcctcaggagttagctaccaagctctgtatcccagggaggggattcgagcttaatgctgatggatacccagtgaagattctaaggaagaacatgaccacgctcgctcagacatggagtgttctttctttttctaacttcattcctacctcccacacttctgatgtcactccagacaaggccagactcatctatggcattattatgaagatggacctgaatgttgggtacctcatctcccatcagatctccctcatagcatag

SEQ ID NO: 68955 - DNA, 384 bp, Glycine max
  Peptide Sequence Number=SeqID_160640
atggataaaattgatatctttgtccctcatcctctcacaaacgcgtcttggcttattcaactttcaccggaatgtgggtgcaagccattggtttgtttgctcaagcgacctgcgctcctgagtgttgacttccaagaccgttcaatcaaagattactcgtcttgcacaagtttaagggaagagaggaatgcaaacttgatttatattggttcggccacttcctgtgcctacggccagtcctcaagcaacccacttgagattttccactctctttgtaaaactccttttacaaagtctgaaccacgcatagacaacccttcccttgtgttcaggaatcctctacaacaagagacccatggtctcttaatcccttttcagaaataa

SEQ ID NO: 68956 - DNA, 765 bp, Glycine max
  Peptide Sequence Number=SeqID_160641
atgccgatctccccctgcggaagtatcagttggtctgtgtcgtcccgacataggggtcacgcctacaagactcccagtggacccgaagaagtccaacagggccctgggggatcgcgcccacaggacacccagtggacccaaagaagtccaacagggtcctggggtttccagctctggttacgggcctctgttagttctacggagtgcccgtcacccccagcaaggtcatcaggcctcctactaaccgagctttcatcaagaagtattgcgcccccaggtaggcagagggcgagacaccacaacagcctggggatggccagcaacaggcaacaaatgcaccaccgccacctccagagcccctcagctcatccacaaaaaggtagaaagataccttggatatgcatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 68957 - DNA, 495 bp, Glycine max
  Peptide Sequence Number=SeqID_160642
atgtctcttgccactctttttggcaaactgcaagaacatgaaatggaacttcaacgcctcaaccaaaatgaagagacagacaaaaggaaaagaagcatagcacccaaagcctcctcctcaatgcaagaagaagaaaaagaagaagaagaatctgatgatgaagaggacttctcactctttgtgaagaagtttcataaattcatcaaaaatagaagaatcgagaaatgccatcactttgacaatgggaagagatctcaagaaggttgcccaacacttaaatgctataagtgtaatcgacccgatcacataaaggcacactgccccacaaatgaatcatggccagaaaagaatgagaagaaaagccatgaagaaagaagatccaagaaggtgtatattgcttgggatgacaatgactcatctgatggttcggagaaggagatcaaccttctatccaaggactatgaaagcgatgggaacatctctcaagaagattaa

SEQ ID NO: 68958 - DNA, 216 bp, Glycine max
  Peptide Sequence Number=SeqID_160643
atgttattgcctagcgctgttcatgtgtcctccactttcgagtttggagttgtttttcatgattgcctaacacatccccttttcgccacttggcgtaatagcgaagaggcccgcaccgatcgcccttctcaacagttgcgcagcctgaatggcgaatgggacgcgccctgtagcggcgcattaagcgcggcgggtgtggtgatacgcgcagcgtga

SEQ ID NO: 68959 - DNA, 414 bp, Glycine max
  Peptide Sequence Number=SeqID_160644
atgaagccaaccatcactcctcttattaaagagttttttgataatattggcggaacaatgccatttgcaaatagattggctatttctaatcaatggcttttaaaatccgtgttgctttcacagttggctaaaaacaattccaccaatgctttgatacgctctacaacagctcttaccatgatgaaagggagtgacggaactaatgtactttcccctgaagttgagtttgtggttaatttcagattactttcagaagtggaagagattgacaataccagagaggcttctgcgatatcaccgacgaatgttagggcatataaagtgattgaacaggggattaaggaggtttaccctaattctttagtcactccttatcttaccattgccggaacagatgcttataaatatcagatt

SEQ ID NO: 68960 - DNA, 207 bp, Glycine max
  Peptide Sequence Number=SeqID_160645
atggcagctaagcgcgaatgcttgcggcaatttacactcacaattgccaaattttgcaaactctttctctacattctctctctccaaaaatttgcacaccttgcatctgtgctttctttatgcattgcctacttccaatcacaaagcaccagcgatacaaaagctgaatttctgcaacttccgctaagcggctccacgtgtcgctaa

SEQ ID NO: 68961 - DNA, 387 bp, Glycine max
  Peptide Sequence Number=SeqID_160646
atgccaaaaaaggaacttgttgaggagctttggagactccaggcagctcttggtgaacaaactgaaattacaaagggaaatcatggtgtggtgatcagggaagataagaacccaacaaacccctcctttgatgcaactacatcaaggttcttaattagctgcattttaccattttacatttctttgcttctctttgtgtatgatgtaagagataatatcatcgatcttgtcaaagacaagtggagaataagtgaagtatgcgatgaattgtgcagtcacacaattgtaagaccttttaagggtgacaagttcatgctcgatgagttttgtaatgagcttcactgtgggaattcgatgagtttaatcacgggaagcgcgatgagttaa

SEQ ID NO: 68962 - DNA, 189 bp, Glycine max
  Peptide Sequence Number=SeqID_160647
atgggtgttaaacattttgaggtggtcaaacgaaggtcgcatgccgacaaacaatggtccccggatgaaattagggaaggaggaattggtgttgtgggtgcttcagatggtccgtggtggcgatggccagtagaagtggtgatggaggacgttcccttttgcttcttcgatgattctgccattagatag

SEQ ID NO: 68963 - DNA, 591 bp, Glycine max
  Peptide Sequence Number=SeqID_160648
atgactaagtatgatccaaagatagtcatggagttttatgccaacgcatggcctacagaggagggagtcaaagacaagcgctcttgggtgaggggccaatggatccccttcgatgaggatgccattaatcagtttttgggacatccattggtcttggaggagggccagcactggatcatgcctcctagacacccagtggacccggagaagtccaacagggccctagggtttcctgctttgatcacaggcctttaccaattctatggggtgccggtcaatcctaccaagcttatccgggcccccatcagcagggctttcatagagaaatattgcatgcctaggcaggtgcagggagacatcgtccctggggtccatctccgctcacctgtggaggttagagcttcaaatgcacagagtcagaacaccagtcctttcctgtggcctacccccgagcaattcggggccacatttgcctggcctgaagatgcgcccgattttgagacagggacaggacccgtaggggcccctagggacgatgagggagctcaggaggatgatgatatggctaatgtgctggatttcttcacttga

SEQ ID NO: 68964 - DNA, 1116 bp, Glycine max
  Peptide Sequence Number=SeqID_160649
atggcagaatcgtcgaagaagcgaaagggaacgtcctccaccaccgctactgctgaccatcgccgtcacagaccatctgaagcacccacagcaccaactcatccttccttatcatctccacgatcatctactctattttcttcagatgatcaacgtctacaatacaactctcaattttcttctaggatcatcttagaccctaagtacctagacatatatttctttaatgatgagacatttgactgttatcaagtgtttcaaaactctggattagttgaatttatgtccttaaaattgccttactatcctgaactcgttaaagtcttttacagtaatttaaaaattcaggatggtattattcactctgagggcaccattgttgatgactggaaattcgactattctagtcatgatgctcgccgtatggtttgtaatgaccaggctgaaatgaccacctctgaggaggacttgattttgatgtgggctttccttactggtcgtcagatcgactgggctcacttggttaggtaccaaatgcataaggcattacgggccaatgcacctcttccatatcctcaattggtcaccctttttctccgtcattttcaaattcctcttgatgatgaaccttttgttcaagtcaagcgatcctttgctattggtgctggtgcaataacttcatttggttaccgtaaggatcgtgatggacaatggctgaagaaggacgcgctgcctccgcaagacgagtgtactccctctcctcctcctcattacggggcctccgcacctatgttggtgaacgattcgattccttggatggtcgctttgaaggcatggatacccgcatcccccagcttgaagaggatcgaggcgaggctcacgggtgcgtcttccataggaggaaaatgtgcggagtcgccaccaacgtttattgaaaggaaaacgttagaaaaaccaaaggaaaccggtcatgaagaatattccagattcggggttatctttacgtttgaggaaggtattagcacctctcacgtcgacaaaagcggggctcttgctcctacgtaccctccatcgaagaggaaatcagacctacgtagttctttcaaaaggcagtga

SEQ ID NO: 68965 - DNA, 192 bp, Glycine max
  Peptide Sequence Number=SeqID_160650
atggggataattttccttaaaaatgagtctcgtgatattatggattgttgttctatgaggtctatgttgcctgaagacccggggaatgtgaatcctgggcatgaatttatatgcatgtatgtggaatgtgatttctttgatgttgatgatgatgttgatgttgataataatactgagatgagatggtgttga

SEQ ID NO: 68966 - DNA, 291 bp, Glycine max
  Peptide Sequence Number=SeqID_160651
atgtcaatgaatgatgcccacttttcttggcttgccagagcttctaccttctcttccaagcgcttccttggtatccctatcaccccatttctattttgctacactcagtccaactcttgtgctgagattttgaccacttttgctactccttccatggaggggtataacccagaaaatagatatggcttccttactcttgggggaccagtcactagagccatgagcaagaggatccaagaggattgggctagagctgttgaagaaggccctagggttctcatgaaccttagg

SEQ ID NO: 68967 - DNA, 228 bp, Glycine max
  Peptide Sequence Number=SeqID_160652
gcggagataccttatggtcgtccgcacctgtcatcaaccgaggtgaacgagttcgacggtatcaggatgatgttggtttttactctcgtcatccagagacattcaagctcgacgtcgcacgagattcttctctgctgggcgaggacgatcaagtttgatagcgtggggaaacgtcatggttccactgggttggatattgatcggccaaatgatgttccgctcgaatga

SEQ ID NO: 68968 - DNA, 800 bp, Glycine max
  Peptide Sequence Number=SeqID_160653
accgccaaaagcaagtcgaaaatggggtggttggaataccgagaaaatatttggaggcaaaagccagaatcttggcaggaaaaggagaatgggccccgttcatagatattctcgcactgttgatcttcggaggagtcctctttccgaatgtggatgggttggtggacctagcagcgatcgacgcttttcttgcctatcataaccacaaggaaagcccggttgtcgctatgctagccgacttatatgacaccttcgaccgaagatgtgaaaagagcatacaaggattgtttgctgtactccagctctttatgtatggggcaaattgggaccaactcttaacaaacaaagaaggagcatctgtcaactggttccctcgatggaaggaaggaagaactggagttcttatttcatgcggaggatttccaaatgttcccttgatggggacgaggggttgcatcaactacaatcccgttcttgctataagacaacttggctaccctatgagaggggcgccactagaggatgagctcgagcctgtcatttcacgaggcttcaataagaccaacatggagacacttcagaaggtccgcaaggcatgggaggtgttgcaaaagaaggacaaggaactctggggcagtaacaatgggcccatcggtggctatcgtaagtggttaaaagcccacgtgcaaggtttggattggctctcgagtttgagaaccgctaaaagggaggaagttgaggcaccggaggaagacgaagaggtgcaggcccttaggatggaactcaagcaagctcaaaca

SEQ ID NO: 68969 - DNA, 417 bp, Glycine max
  Peptide Sequence Number=SeqID_160654
atgcatcatgttgaaacacttgttggccaaggaagctcaactgatattctctattggtggacattcaaggagttagaaaatttttatgcaaagatcaaagcctatcatgatcaattgattggcttttctgggaaagggcagcctgaggatacatcgatatctacactaagttcagtagagtgcactcgtatgggtacttggctctcgaaaaaatgtgataagcagattaccaaggtccttcaagctaatgcaaacctattcgcatggacgactttcgatatgttgggcaccgaccccaagttccatttccagaggatcttgattttccctgatgcaagacttactgctcaaaaagaagagaaagttgggggaagaaagaagaaaggtagtgatcgaggaaactgcaaacttgattga

SEQ ID NO: 68970 - DNA, 492 bp, Glycine max
  Peptide Sequence Number=SeqID_160655
atggctgcaaatgaagatgctgcccatgaatttgcaccaaagaagaagccaccttcagaggatgagaagaggaagaagaaaattgtgcccgggagtttgatgaaagctttgatgaggcctggtgggggtgatgctggaccttctgatggtgaccagattatctatcactgcacgattcgaactttggatggagtacttgtggagtctaccagatctgattatggaggtgaggtgattttagcagctagggacctttttggcaagggcatcccaataagacatgttttgggcaaaagcaagatgttattgggattgctagaaggaattccatcaatgttgaagggcgaagtggcaatgttcaagatgaagcctcagttgcattatggtgaggatgattgccctgtttctgctcctgatggttttcctaaagatgatgatcttcatttcgaaattgagctgatagaatttttcaaagccaaggcaaggatgtga

SEQ ID NO: 68971 - DNA, 420 bp, Glycine max
  Peptide Sequence Number=SeqID_160656
atgaagttaaaggcaaaagaaggaacagaaacgaaattggaattgaaagcagaaaatggaaaatgcattcatgtgaacagtaatacaaagctagaaaacgcagaagctggtaacaaggtcattttaggagaacttatgaacaggttgggggttgacaaaggcagatggatcaaaaagttgataaagccttcattgcatcgtacactttacaacgaccaagagattgagaactccattaaaagagaactagatcttgttgaagaaactaaggtcatggcaagagtaagaattgaggctaaaaagcaaagagcctcaaggagatatatctcaaggctaaaactaatggactttagagtcgggaacctagcatggagagttcaaagtgaagtaaagaaggactctaaggaaggaaagttgtaa

SEQ ID NO: 68972 - DNA, 282 bp, Glycine max
  Peptide Sequence Number=SeqID_160657
atggaagcagaatgtagatggaagaaagatgattggagatgccacttcaaggagaagatgagtcaagaagaagctcaccaccatatgaacccactaatccaagatcaagtccaagattctccactaagtgtgcttaggtgtcatgagacatcccataggcccgaaatctaccctaaggctcatgagaaccctggggccttctcttgcatctctggcccaatcttcttggagtattctatccaatgcccttgtagggtaggattgcatcacttagtggcctag

SEQ ID NO: 68973 - DNA, 159 bp, Glycine max
  Peptide Sequence Number=SeqID_160658
atgactcaggtagatgacccagactgggttggtgacccagatgttgtggaagtacttcttttgatggttggctctggtagagccaaacctttacttgtgctcctacctccccttagggaggttcccgttgccttaggtggcatgaccatttttctgtaa

SEQ ID NO: 68974 - DNA, 819 bp, Glycine max
  Peptide Sequence Number=SeqID_160659
atggctctgagctcgttgagtgttttcctgacaatcaaagaaaatggtcatgaggtcgacatagcctctagtctctacttgctcccctacgaagctgaggagtggaccgtcatgaggttggatgaagctaggaaaaacttcaagtctctagaatttgatgatgatgccctggatgacatggaggtggcgcttgcgggactggctggactatcctctataggagaatccacccataatggtctcactcttgcttggtggttgtctagccccttaacaaactgggctaggcagtttgatgggtacctccaagttgaaggcctcctcctggattgtagtgtgattggtcgtcagggcttgttccttttattcaacttgcctgacctcgttcttgaacctggacatttctttcatctggatgtagcctttggttcgttcacgcaactagtccatgctactagggacagtaattctccaaacctatccatgaatttgtatagagattcatcatctgcttgtcacagactggccagtgtggcagatgttacgatgagactagctagttgcatattgcgcattgaagcgctcaacaagggtgtcaaagctgttgatggaccttggagagagtccaccatactaggtcaggaaagcatccaggtgttcatctggatcggtggtctatcataccgctccaagttgagtggtttccaacccagagacttggtgatgcaatcctaccccacaagggtattggatagaagactccaagaggattgggctagagctgctaaagaaggccttggggttctcatgaatcccatg

SEQ ID NO: 68975 - DNA, 273 bp, Glycine max
  Peptide Sequence Number=SeqID_160660
atgaagagagtgagtgaagaaaagaaagaaagaagagagaaagtgaagatatggatctgtgagaaagaggaaactagagagagggggaaggagtgtggatctgtggagagagaaaagaggcggtgcttttggcctcacgcgcgtttaggtgacagtgtggtgcacgcgcctttcatgcatttttgtaacttctaccgtttcgggatggttacttactcggtttctctttgtcgatgggtcgtattgtttggcataacagcactaaacacgtga

SEQ ID NO: 68976 - DNA, 240 bp, Glycine max
  Peptide Sequence Number=SeqID_160661
atgacgtctcaggcagcaaaggaaattgttaagaagattgattcattggaggagcaggtgtcacagggttcctttgtcccccatggacgtcaagatctcttgactgctgccattgggcgactagaacaccttggtcgtgtgcgtgttgctggagccggtgtgaccatcaagcaatactttgaatcggctccacagacctcccgcacttcttcctccatggctcccgaagaactagagtag

SEQ ID NO: 68977 - DNA, 975 bp, Glycine max
  Peptide Sequence Number=SeqID_160662
atggacaattcaagattgaatacaatgattaatgcaaattgtccgcaagaattattgcattcagtctcaagcaggaatctaagtcacgcatttcgtgcaactctatacaaagggcatgcacatgggaatggaaacataaatgatcaattggatttaccaataacaagtgtccttcagagcacagggcactggtatgaaggtggattatggacaaaccatgcaaagcatcatccattggacaatgaaagacatgttgcaatagtgacaactgctactcttccttggatgacgggaacagttttagctataatcctcatgaaacacataaacaactgggttacaagagcatactgcaacaaggttgttcgtctctcagctgctactcaggatttaccaaagtctataatttgcaatgttcatggtgtgaatcccaaattgttgaaaattggagaaaatattgttgcagttagggagctggggcaaaaaccctttacaaaaggggcatatttcttgggaaagatggtgtgggcaaagggatatgaggagttgatagatttatcagcaaagcataaggctgaccttgatggtttcaagttagatgtatttcaaaatggagaagatgctaatgaaattcagagtgcagccagaaggttggatttgaatctcaactttcagaaaataagagatcatgcagatgattctcttcatggaaatggaactgagttatcttttaatcccccatatctttacaaactgaacaaggaaaataatggtgaaaagacaagtgtagataagggaaagctcattgctaagtcagcatcaatgcctaatctgacagaactagtagatggaggcttagcatttcctcactattgtcttattgggaatcaatttcagagattatgtataggagcaatacctgggacacgtgactatgacaaccagcactgtaaagaccttcatctcttgccttga

SEQ ID NO: 68978 - DNA, 1180 bp, Glycine max
  Peptide Sequence Number=SeqID_160663
atggccgtagaggaattgaatgaaaagcagctagaagcacctgttgaagaagtcgttactaatgttgatggtttttcaggcggaccccatgacacatcagttctcaaagattttgaaaatcacattgatttgagagaacatcctgagctgaagctatcttcccatggaaggcagatggctaagttcgggaggcttgcttcagagattgaaggccttgtggcagccagtggactaagtcctttgatcgcctattccctggatacagaggtgactatcaccttggatgacatcgcgtcattgctacatcttcctattataggggcgttccacagcttcgagctacttcatgttgacgttgttgtcgatatgttggtggaattactcgagatgaagatcaaggcatggggttacgcttggggcactgctgcacttgtgcacatgtatgataatttaaatgacgcgttcaagagcacggcgaggcagcttgcaggatatatcactctgttacagcattttccgtccattggttccactattcctgtcgaggattataatgagaggagaccacgtgcatgtcgatggacctctggcaaggcactgcctgtttccatgtatcaacgacatctggatagactgacccatgacgcggtgtgctggattccatacagtgaccacctttcatttagagaacttgaggtcatctcattattttccggccatctcagatggggccctttgacggtcattcaccaaccggaaagggttgtacaacagtttggctacatccagactatttcaccatatcctactacatcttcgctctctattgaagaaattgatgatagatggatgcagttcggtgagtacattgcacctcgaggggatcctcctagagttcctctggttcaacaatatgaggaatttgttgaaccacatgtgtatcagcaaccgatagcagaaatgacacctattgaggcagacgttgatgtgcatcatgttcgacatgcagtggatggttttgtagcaattggtgataagttggagaggctactggacttgaggatcctgatcaaaggaacaaaagcctatactgttgttgaagaatgtgtgggcatcgcaagaagctacataggccaaccaactgtaggtcacagatcgaggcataggcggcatacagacg

SEQ ID NO: 68979 - DNA, 258 bp, Glycine max
  Peptide Sequence Number=SeqID_160664
atgtccctacttgttgatggattatccatggttactatggataagtggatggatataaccgacatgggatatgtcattgcattaagatataatgttatccttgtatcgttgtctctgcaacaaagcatgacgttttttcctctcagaagtcaaccaccaacagattcttctgtgcatcgtgtaatatgtattggtcacgtctatgataatctttttgttcagtatatttatgacaccgttgtcccttaccgcctctag

SEQ ID NO: 68980 - DNA, 267 bp, Glycine max
  Peptide Sequence Number=SeqID_160665
atgacagaagaagagggaactgaggataagaaagaagaagaaacaaaagaggaagagaagctagaggaagaagagaaggtggtctcaccacctaaaaccaagagtcaaaaggcaacagaagctaagaaggaagaatcgccagtcttgccgcaggatctttcgtatcctaaggtaccgaccaagaagaataaagagcgctacttcaagcgtttcttagaaatatttaaaggactggagatcaccatgccattcggggaagccttgtaa

SEQ ID NO: 68981 - DNA, 933 bp, Glycine max
  Peptide Sequence Number=SeqID_160666
atggcctcccgtaaacaccaagcagtgcccacacctggggaagcgtccaactgggactcttcccacttcacttcaaagattgcctggcacaggtaccaggacaacattcagctccggaacatccttccggagaggaatgctgaacttggacccgtgatgtttgatgagttcctccaggaactcaggaggtgtcgatgggaccaggtgcttacacgactatcggagaagaggatcgatgtggctctggtgaaggagttctactcgaacctttatgatctagaggaccacaatccccgattttgccgggtgcgaggacaggtcgttcgctttgacgcggacacgattaacgacttcctcgacaccccagtcatcttagaggacggggaggagtacccagtctacaccagatatctcaacactcatcccgatccaaacaccatccccgccacattatgtactccaggagggcgttttgttctaaacgccgatggtcttccttggaagctgctgaggaaggacatgacgacactcgctcagacatggagtgtcctctcttattatgatcttgcacccacttctcacacatatgatgttaatcttgacaaggcacgcttgatctacagcttggtgagccggatggatatggacgtgggcaactttatatctcagcagatcagtcagattgcccagtccagtacctcgaggctcgggttcccgacgttgatcacagcgttgtgtgacattcaaggggtggtttctgataccctgatctttgagtcactcagccctacgatcaaccttgcttatgtgaagaagaactgctggaaccccgccgatccatccattacatttccaggggcccgctggactcgcaccagagcaccagcgtccatatccgaggcaccccctacttctcagccttcctcccagtga

SEQ ID NO: 68982 - DNA, 363 bp, Glycine max
  Peptide Sequence Number=SeqID_160667
atggagtccagtggtttcactgaagaagatgttaagctcaatgtgctggaccaggcgtggctcgaggcaatacatcatgtcggagaaaagcttggtgttccaaaacttggtttgggaggaatggatgttgggaaatccattctggagagctactcacgagtattagagagcttgacatcgaacattattgcatttgttgatgatgtgctttgtgttgatgacttgacaaaacattatgacccaatctcatctctcgttagtgtaatttctcacaagagcattgttgttccatactcaatacatggccaaaccacttctcctaaaccatcttttggcacaccaagcttttctttgacacactaa

SEQ ID NO: 68983 - DNA, 1083 bp, Glycine max
  Peptide Sequence Number=SeqID_160668
atgaagggcttaggtggtctagacgacatttattttgctagtctcatcgataagatgttgtgggatcaatgggtgtatcatgtcttcaacaagatggacgaagactctaagcacaccctaatagccaagggttcggttgtcgctaaacaacaaaagtttagcaagaataacctaaaagctataaaggttgacttagaacaaagtcagaaggaggctcctcaagtggatttggatgtcatcaacaagaggaagcaaaaaaggctagctatagccattgctgatgaagatcaagaagaagaggaagagctacttgcaaaggagcacaggacgaagaaaatacatgagctatatactacgtctagccctatgcatctaatggctgcaacctcaatcccacaaaggttgaaagacctaagtgaaactgatgaagaagatgaaggccttgtacaagtagcccttcagaagaggaaaatagttgccctaattgcttctaccccaaaaaagattaaaaaaactaatcccaagattggtgacaaggaatgggcagtttccttcattgggaacaaggaggatcaagcctcatcatcatcagataatgagtctatagacaacacttctatttttcctctccgcaaacatgtttcctctacacaaccgtgtccaccttcatcacccattcatctagagagaatcagaagggttgctccaagggaacccttaataaatgctcaaaggtttcctctatcattcattaatggtaaccctacacctataaccccatactctaagtttatctatgttgaacttgttgaaatggaaacaatcaatgtccaagcacctacatggacaaagtataacataagaataatccatatgcctcctcactggcttgcacctggcactaaacaacgagttcgcccttcaacagagcacgaaagagacccctcacaagaagttgaacctctgaaaagtgaattccaaacgaaggatgcggctaaaaagaaaggcttcaagttgtactacaatgaggaaatgccttcaaggaaaatgaagatggaaatagtcaatcatcctcgaaattag

SEQ ID NO: 68984 - DNA, 231 bp, Glycine max
  Peptide Sequence Number=SeqID_160669
atggataagagcttgaaggtaggaaaagatgagtggagggagagggagagatggggcacgaaactttgtgcctcaaatgaggttcatgagaaccttagggccttcttcaacagctctagcacaatcctctctgagcctcttgctcatggctcaggtgactggtcccttcctaggaaggattgcatcaatggttgtgttcttggtcttagtagagaaagcctacaagtgtag

SEQ ID NO: 68985 - DNA, 141 bp, Glycine max
  Peptide Sequence Number=SeqID_160670
atgatggtggtggctaggcttggtgcaaatgtgacacatgttggcacgaaggcttggaggcatgggtttgaagaaggaaaggggggtcgtgccacctattccaaaacaattattctgaaatatgatacgcttctgaaatag

SEQ ID NO: 68986 - DNA, 306 bp, Glycine max
  Peptide Sequence Number=SeqID_160671
atgggatcaaatcaggcaccctcttttaagaaaagattctaccatgtgaaaatcaaaagcctagaggtagctggtttgcaagaactagggcagggaatgggtcagctccaacttcaagccttccgcaagacatatggaaagatctgggatctcgctatgatagaatttgtaccgaccgtggaagaatttgaagggatcttgggatgcctgctagaaggaaggaagtcgtacctattttctgggttatacccctccatggcgagaataaccaaagtggtcaaagtctcagcacaagaattggactga

SEQ ID NO: 68987 - DNA, 1969 bp, Glycine max
  Peptide Sequence Number=SeqID_160672
tcaagagcctagaggtttccagcttgcgagagctagggcagcagatggatcaagtccgacgtcaagccttccgcaaaacatatgggaagatctgggatttggctatgatagaaattccgttgaagccatcacgtccctcactcaatattatgaccagtcgctaagatgcttcacgtttggggactttcagttggtaccaaccatagaagagtttgaagcaatcttgggatgcccgctaggagggaggaagtcgtatctgttttccggattatacccctccatggcaagagtatcgaaagtggtcaaaatcgcggcccaagaattggaccgagtgaagcaaaacataaatgggttggtagagataccaatgaagcacttagaggggaaggcgaaagctttggcagatcaaggagaatggacttcatttgttgatgttttagcactgtcggtatttgggatcgtgctctttcagaatgttgatgagctagtggatttagcagtgaccggcgcttttcttgcttatcaccacaacaaggaaagcctggtcattgctgttttggatgatgcttatgacactttcgacctaagatgcgaaaagagtagtgctagaatcgtctgttgtacacccgctctttatgtatggctggtctcccacatttttcgtcatgaaagtagacctgtctgtcccctacaaggtcatcgcatgtgtgccgagaaagggaaaacaaattgggaggaacttttggcagggttcccaaacgtccccttgatgggaacaaggggctaccctgtgagaggggcaccatcagaagagattatcgcgcctttcatcgcagaggttttagtgaaggcaatgcaaaaatacttcagagagtccaaaaagcatggaatgccgtggaaagaaaagataaggagcttagaggaagcaacaacgatttcaagtggggaagaagctgaagtccctgcggagagagaggaagtgcaagccttgaaagcgaaactggaaaggacgagagtggtcaaagaaaagttcaagatggcagccactagggtcaggaaagagtatgacgagttgagggatgtcaacatggccatgaccgaagctttggagcgagaaacaaagagagcccgaaaagaagagaaaaacgaactcaagcttcaaagggctgaaagggatgagtcaagagtggaaagtttaatgttagaggataagttgaaggcttgtcaaaggtcaaagagaagtttgaccgagcagctgagtaagaccgaagagaatatgttgacaatcatcgaccaatataaagagaagctaaacctagctgctagccatgagcaaagactagaggacgagcatgcaaaggtatcggctctacaagtggaaagggaagcaagagagagagtgatagaatcattgcacgaggctatgaagtggatggatagatttgctctcactctgaataagagtctagagcttccaaggctgttagccagagccaaagcaatggcggacgcatactcatctcctgaggaagatcatgctctgggtgagttcgaaccatacattatatatgccactgagggaccaacatttagtggcatgcctcagcccaatgcggcaggagctcctcaacaccgcccgttgcaacctctgcacttctcggtggggaggctacctccgaccatggccactaagggaatcaatgattatccatttgccgacatggcgaagctatgcttagtgcccgacatcgtcatccctcccaaattcaaagtgctagacttcgacaagtacaagaggaccacctgccccaagaaccacttaaaaatcttctcggatccgttcttagaaggacttgacatggctcctgatagaacccaattacaaaacatgagcaagaagaagcatgagtcctttaaggagtacacccagaggtggagggatttggcggcccaagtagcacccccatga

SEQ ID NO: 68988 - DNA, 297 bp, Glycine max
  Peptide Sequence Number=SeqID_160673
atgccgatccataataggatcaaaggtaggcctaggaccatcccttgcagcccccaatcaaaccatcaaagcatggattcacaaacaaattatctcacgaaatttgcaaagaacatgacaactagagcaccaaaataccacaatggaaagctaaaatttgaagggagatggtacttacttgtattaacatgttcaattttacttaaatgctcatggcaccctgttgatcgagccaattggctccggattcaatgggcaagattgagagtgtatgttattaaggacaataagaagtaa

SEQ ID NO: 68989 - DNA, 435 bp, Glycine max
  Peptide Sequence Number=SeqID_160674
atgttgatcacgggtctctgccagtcattcggggttcccgtcacacctagtaaggtgattcgaccgtcgatcacccgggccttcattgagaagtattgcacacctagacaggcgcagggtgatgcaccgcaggccacagacacaccgccaccacctcatcaggctaatctagctaggtcatttggcatggagcagtatttacagcacttggttcgccagcaggcagccaaccacagggggcagagccagggtttcgctcctttttcgtgccctactccagatcagttcagggctgaggttgcatggcccggagattggcctgaggcccaggcatgggaggcgcccgcagaggctcccggcgacacggaggaggcccgcatggatgaggagatgacagatttactcggtttcttgggagggagcggagccacatga

SEQ ID NO: 68990 - DNA, 405 bp, Glycine max
  Peptide Sequence Number=SeqID_160675
atgaggtgttacaagatgtgtgtcgtcgatgtccctgatgacaacaccaaagagaacattcgtttcttcatttggtcagtagtcatgttgaagttcataaaggcatgggtagtggttcatcctcgtatcagtgaagtttttactcagtttcttttgcgaggagattccaaaggaaaaagaaaaacaaaacaagaaaataaggctcaagtcattatggactatggccaaggggaagatgaattgcaacttgaactaggcacacaccttcattcaatgggcaaagccggtactaattgttgggtaatcaacgctccatcaaacaaaattgctcatacccacaaaggattgtgggagcacaacaaagattgcaccgtaggaaaaataataacaatcacaagaatttaa

SEQ ID NO: 68991 - DNA, 516 bp, Glycine max
  Peptide Sequence Number=SeqID_160676
atgttgataatcattgatcaatataaggagaaggtgaacctggctgctagtcatgggcagatgttggaagatgaacaagaaaaggtatcatctctacaaattgaaagggaagagagagagagggtgatagagttattccatggggaagccatgaaatggatgaatagattcgctctcactctgaatgagagtcaagtgcttccaaggttgttagccagagccaaggcagtggctgacatgatttggttcaaccctatgttctatggaatgttctatatgttgcattactcattccattctgtttttagcagtcattatcatcatcaaaaagtaaccatagtaacaaaaaagaacgaatgcgctttacggcactgtcgcaacctacctttcggcgggagggcaatgcgagggctcacgggtgcatcttccaagaaaggaaaatgcgcggagtctccaccaacgtttattgaaggaaaacgtcggaaaaaccagaaaggtgtggtctacgaactttaa

SEQ ID NO: 68992 - DNA, 840 bp, Glycine max
  Peptide Sequence Number=SeqID_160677
atggctccgaagaagcttcttgctaaaagggttaggaaggccgccacaggggaagaatccagtgcagccccgcaagcagagattgaatttgacggacaccatttccgaagcgaggagcatcagcttcgtttcaaagcgattaaggattggtctttcctcaaagaaagacgggtgcggggccaatggatcacctatgatgaagatgctatcaaccaattcctggggcattcgttgatcttggaagagggacaacattatgaatacgctgaaagaagaagccaggtgccaggttttgatgaagaggccataggccagctactgtgctccctgggacaggattttgcacggagcgtgccagggaggcaatgttcacgtagcacagcttatcttggatgccatctaccagtttgtaggtattgcacctctgagacactcagtggacccaaagaagtccaacaaggcactgagatttctagcattgatcacaagcctctgccagttctacagggtaccaatctcgcccacaaagctcatccggaaagcacaatagccggggtaagacctacagcagatgcaccactaccgcctccacatcagccaccgtccctagagtccatctcggctcacatgcaaaggatggagctccagatgcacacatacatgcagcatttggctaaccagcaggtagcaacctatagaggtcagttcaaagtcactgtcgcatggcctggggacatgcctaattttcagggaggtgtaggtcctgcaaagtctcaaggagatgaagacggagctgaggaggatggagatatggaaaatgtgatggatttcttcctttga

SEQ ID NO: 68993 - DNA, 331 bp, Glycine max
  Peptide Sequence Number=SeqID_160678
atggaggcttacactaaggtttttggcattcttggccttctagtatttgtgagcatttcagagattcatagagtggagggtgcaggggaatgtgggaggtctactactccagataatgaagcaataaagcttattccttgtgtctctgcagcaaaagatgaaaaggctgaagttactcagaattgtttgaaaaacctcgtcgggcgcctaggagtacatgacaagacatgcctcacaatgggtaagtcaggcttacaggagtactcaaaccggatgacccccaaggcctacactccgaagagtccgtcagggcctctccctcctgattcag

SEQ ID NO: 68994 - DNA, 459 bp, Glycine max
  Peptide Sequence Number=SeqID_160679
atgaaggcctacatagaggccttgaaggatcaaatggcctccatgatggaggccatgttaagcatgaagaaaatgatggaaagcaatgcggccacaattgctgccaccagtgccgccgctgaggcggatcctacccatccattcgccataaaccaaacgaacctatcaatcccggacatggtgggtcaaggaggagaggttctaggcaacacaggtggtccacacatggggcataataggaattcttacccctatggcttaccccccaactatacaccacctaatgccatacacatgcccaacgagaacgctaaccgcgccgttctcgttccctttgaaggccaacaaccccagtctgtaggggacacccatgaagaaccttgggatcatgctcaagatgactttgacccataccttacattcaccgccgagggaccgacatttaatgctatgccttag

SEQ ID NO: 68995 - DNA, 582 bp, Glycine max
  Peptide Sequence Number=SeqID_160680
atgctggaggtagaagtgaaagtagggggcataatagcagctactactggatttagctcatccccctctgcagtagtccatcatgacgagagtgcagcagttagtagtgttgcacttagtctactcttctactacactggttgggaggagatcaaggctgccatacgaaaggaggtcggtcccattcgtctatcgatgcatgcccgtgcagcaactaggtctcctccagagagcacagtgcgccccatgaaaccaataaagccccatacgctagatacagtattagcttgttgttcggatggctgggcagggactcgttcaatcggaatgggggggggagactactacacgggtgctgcttcccataccttgcatccgaacgagagctttccggatcaactttacaacatctctcttgcttccggcactcacactaacacttcggggataatgactaaatccaacaccaaaagacgtacactactacctactactactagtagctctgggttgttgaatcagtccacaagcaactatgaactacatcaaactggtatagaggaggatggataccgcatttga

SEQ ID NO: 68996 - DNA, 309 bp, Glycine max
  Peptide Sequence Number=SeqID_160681
atgcctactaggatgaatttacagttagcaaatcactccatccccagaccttatggagtgattgaggatgttttggttcagggaccagtcactagagccatgagcaagaggctccaagaggattgggctagagctgctgaagaagaccctagggttctcatgaacctcagggtgagcatttgcttactacacgccattgccacatcatatagtcacactttgtgcatgtccttcatgctttacatgcctcatgacaccgaagcacacttagtggagaatcttggaattgatcttggaatagtgggttga

SEQ ID NO: 68997 - DNA, 339 bp, Glycine max
  Peptide Sequence Number=SeqID_160682
atgcgagcacaaccagaggaggaggctatcacgcaactactgtgcataccggggcaagatttcacccgtgcagctgcaaagagacgagtcgggatcatgcacaccaacatgaacactcttacacaaatatgtatgacattgctacttagcaacattctgcccaatgaccacaatgccgatctccccctacggaagtatcagttggatcgcacccgcaagacacccagtggacccgaagaagtccaacatggtcttggggtttctagctctgattacgggcctctgtcaattctacggagtgcctgtcgcccccagcaaggtcatcaagccccctactaa

SEQ ID NO: 68998 - DNA, 423 bp, Glycine max
  Peptide Sequence Number=SeqID_160683
atgcataaggcattacgggctaatgcactcttcttatcctcaattggtcaccctattctctatcattttcaaattcctcttgatgatgaaccttttgttcaagtcaagcgatcctttgctattggtactggtgctataacttcatttggttactgtaaagatcgtgatggtcaatggctgaagaaggacgcgctacctcaacaagacgagcgtactccttctccttctcctcaacgagatgattccacaacccttatgaatgaagttcttttagagttaaggggcctctgcacatatgttggtgaacgattcgattccttggatggtcgctttgaaggcatggatacccgcatcacccagcttgaagaagatgtgacttatcttcgtcagtgcttcgatcttccaccgccttctaagtcttag

SEQ ID NO: 68999 - DNA, 237 bp, Glycine max
  Peptide Sequence Number=SeqID_160684
atgggttgtaatactgagaacaagagagggtacatctctcgtggatttgttcaagtgaagcgtacatccacttggtgtttcaaagagaacaagggagggtacatcccttgtggatctttgcttgtaaaggattttacaaggttaaaggaaatctcaagaaccggtggttgcttggggactggatgtaggcacaggttgtggccgaaccatttttatttccgctttacttttgtctaa

SEQ ID NO: 69000 - DNA, 337 bp, Glycine max
  Peptide Sequence Number=SeqID_160685
gacacttgttagcactgccacacctcttgagcttgaggttattcctcaagtaaaagagttgttggatgagggtttggttcgtaagagcttaaattcttgtgctttgttggtgcccaaaataggtgttattaggcaccaaatccctaagataggtggtatgatgaatgtgtcgagtggtgcaaccctcttttgtaaaatcatccatgcacccaaaatcttcattattcgtgtacttaaggactcattaggtagtgatcaaggggttcccgcggaacctaagagaataaaggtcattcctgggtggcctactccaccaagttttgagggaaaagcctag

SEQ ID NO: 69001 - DNA, 483 bp, Glycine max
  Peptide Sequence Number=SeqID_160686
atgtgggccgttcataaaggtttacaaattgattgggctcaccttgttagatatcgcatgcataaggtattgcgattgaatgccccattgccttatcctcatcttattacccttttccttcaacactttaacatccctcttgattctgaaccctatgttccaatcaagagatcattccttataggcgcttcagtcatagcatcctttggttatattatggagcatgatggctcttgggtaaagaaggggtctagaaatgttggtgaagaaggacatgagggagaagattcatctcttctttcgaagattttggaaaggtttgatggtcttcaaacctttgttggtgagaggtttgatactttggaattgcgagtggatatgcgcttcaatgaaatggagtcaagaatgacaaaggttgaagaagatgtatcttacattcggtcaagcttcgatcttccaccactgccaccaccatcatcttag

SEQ ID NO: 69002 - DNA, 348 bp, Glycine max
  Peptide Sequence Number=SeqID_160687
ggtggacccttgggtactactaccctcacctttagagggctgcacacccttaccttcagaggactacacatcctggccatcagagggctacacgtcctcaccttcagagggctacatgccctcgccttcataggactacatgccctcgccttcattgggctacacgctctcaccttcagaggactacatgtcttcacctttagaggactacatgtcctcaccttcagagggctacacgtccttgccttcggagggctgcacgcctccgcctttagagggctatgcgtcctcactttcagtgggctccatatccacaccttaagagaatttaaggtcctctgcccttaa

SEQ ID NO: 69003 - DNA, 579 bp, Glycine max
  Peptide Sequence Number=SeqID_160688
atgactgaggagcagcggcagctggcggccctttgcaaaatagagattaaacgctggcaagcagcatcagaatcgaatcccaatatgcgctatatggtagagctgatggaaatggccctcgcagcgctgacggctaggccaaagggattcattgaatctaaagctaacggaactgattgctttattctgaaaggattttatctgaatgggctggttgaaggtgacgaactctacaccgccccgccagcgccggtgcttcgggtgccggatgagatgcaccacaagcaatccccacatggcgaaagctctttatgggctatggggtggaatgaatgcctggcagaggtgaagcgcctcaacacccaaccttcaccaccggaggaggtagctcgcaagcattcatcattaactgcaagagaggcatacgagatagcgagggagctgctggcgctgcgtaatgcgttcagtgtgccggattgctgggaaatcgccgggcaaatattcgccactgaggaagaggctctcagctacggcttcataggcaagccagagccgctctacagcaagccagaggcctga

SEQ ID NO: 69004 - DNA, 145 bp, Glycine max
  Peptide Sequence Number=SeqID_160689
ggccaaggtcgcatggcctagagattggcccgaggcccaggcaggggaggtgcctgcaggagctcccagtgatgcagaggaggcccgcatggatgaggagatgacagacttgcttggtttcatgggaggaagtggagccatgtga

SEQ ID NO: 69005 - DNA, 129 bp, Glycine max
  Peptide Sequence Number=SeqID_160690
atggctctttacgggtcggcatttgcttactcaaaccccctcaggcggtgcttcccgtttgtccagggctgggcaagggacaacaatctatcggtcgtgaccctagcctttacatgcgtccgtccctaa

SEQ ID NO: 69006 - DNA, 410 bp, Glycine max
  Peptide Sequence Number=SeqID_160691
atggggcaaaacacaccaaatgattatgatgatggatggctcaaattctcacaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcggtgcttttgccgttacgcaccacccc

SEQ ID NO: 69007 - DNA, 1410 bp, Glycine max
  Peptide Sequence Number=SeqID_160692
gtcgactcctagaggatccccgatcgccctgtttaacgcctggcagcaggccggggcgcagcaggcgggggcgaagaccgaaacgccggccgtcaatgaggcggaggtggtggccatcgccgtggcccagggccgggatccggttgccgcgctgaaggcggctcacgacaaggcggatggcgataaggcgaaagccgccgccgcgaagccgccggagaacggcccgctgggcaaactgccggatccggtgtatgtgccgctgaaggccaaagcgctggaggtgatgctggcggaccagctgagctggattaccgcctggcgcaccgagcgctttgccagcccgcaatacgccgataagtattatcagcgcaaacctttttatcagcaggcgctgaatgagcagaccagcgcgctgccgtcggcggcggcgcccgcggaaagcgaagggccgcgagaagtgccgtttatcgataaggatcgtctggatcgcgcggcgtggggctatgactttgcccataccggtatcgtggcgctgctgggccaggtgctgctggatgtgatccccaccacgcagaccaaccagcttggcggtccgctggtggcggcgcaggagtcggaatatatccagatcaagaaaagcggcgatgcccggcgggcggcgctgatgggctcgccgacgatgctggatttttacgataactacgtgcatgacacgctggctaaatataatcacgacccgctgcactcctcgttttcccacggcgcgaacggatatgaaagatctgaatacggtatcgggcgtgctggtcatgacggcatgagcggcgctgatatagccgtattaaaccacggacctgatgccatcgtttcggtgcaggttgatggctacggagggcccagggcgaatccctacggtggcggtggcggaggacccgaagccatccctgatgatcatgcgagtcattaccagcgccacgggccgattaccgtgcccattgaacgctgggaaaaaggtgcggatagtccgttcctgcataccacctggacagccggggtatccggttccccagtcgccaccagactggaagcaaagagctcagaaaatacttatcaaacatatcagggaggaaattgtatgtccgataccgcagactccacgttaagtgctctgaaggcgcttattgcggccttccagaccggtgccaccccggtcgctgtcaaaacctccaccgcagaagcggccagtttaccgccgaattttcccgggccggatgataaaaagggagaaaagcctgccgataactctgtgctacagaaagccgaatacaacgagcgcggccgcctgccggcgagcagaacgcaggccgaaggcaactatgccaggcagtatctggaaggatatgtcgggga

SEQ ID NO: 69008 - DNA, 2921 bp, Glycine max
  Peptide Sequence Number=SeqID_160693
ctcaatctgtctcatgtgggtcagcaagttactctctgcggctgggtcaatcgccgtcgcgatctcggcagcctgatttttatcgatatgcgtgaccgcgaaggcatcgcgcaggtgtttttcgatgccgatcatcagcaggctttccagctggcgtctgaactgcgtaatgaattctgtatccagatcaccggtactgtgcgtgcgcgtgaagagaaaaaccgcaacagcgacatggccaccggtgacatcgaagtgttcgcccatgagctgaacatcatcaaccgcgcagaaccgctgccgctggactctaaccagaccaacagcgaagaagcgcgtctgacctatcgctacctcgacctgcgtcgtccggaaatggcgcagcgtctgaaaacccgtgccagaattaccagcttcgtgcgccgctttatggacggtgaaggcttcctcgacatcgaaaccccgatgctgaccaaagccacgccggaaggcgcgcgtgactacctggtgccgagccgggtgcacaaaggtaaattctacgcgctgccacagtcaccgcagctgtttaaacagctgctgatgatgtctggttttgaccgctactatcagatcgtcaaatgcttccgtgatgaagacctgcgtgcagaccgtcagccggagttcacccagatcgacgtggaaacctcgttcatgagcgccgagcaggtgcgcagcgtgatggagcagatgatccgtgaactgtggctggacatcaaaggcgtcgacctcggtgacttcccgcagatgaccttcgccgaagcgatgaaccgttacggctccgataagccagacctgcgtaacccgatggagctggtagacgttgctgacctgctgaaaagcgttgaattccaggtgttcgccggcccggcaaacgacccgaaagggcgcgttgcggcgctgcgcgtgccgggcggtgccgcgctgacgcgtaagcaaatcgacgaatacggcagctttgtcggcatttacggtgccaaaggtctggcgtggatgaagatcaatgcgcgcgccagcagtttcgacggcgtgcagagcccggtggccaaattcctgacgccggagatcgttgaagctattctgcagcgtaccgacgcgcaggacggcgacctgatcttcttcggcgccgaccgtgccagagtggtggcggatgcactgggtgcactgcgcctgaaagtgggccgtgatctgcaaatcaccaatgataaagcctgggctccgttgtgggtggtcgacttcccgatgttcgaagaggacgacgagggcggcctggcggcgatgcaccatccgtttacctcgccaaaagcgctgaccgcggaacagctggcggccgatccgacgcaggcggtggctaacgcctacgatatggtgatcaacggttatgaagtgggcggcggttcagtgcgtatccacagcggcaatatgcagcagacggtgtttagcattctgggcatcagcgaagaagagcagcgtgagaagtttggcttcctgctggatgcgctgaagttcggtaccccgccgcacgcaggtctggcattcggtcttgaccgtcttaccatgctgctgaccggcaccgacaatatccgcgatgtgattgcgttcccgaaaaccaccgcggcggcctgtctgatgaccgaagcgccaagcgaagccaacccggcggcgctggcggacctcggtatccagatcgcgccgaagaaacggcgtgatgaccccagcttctggcagtcggttaccggcagcctggagccgggcgaaacgccggcgcaaacggcgcagcgcgaagtggctgaagagctggcgattgatatcgccgcagaggggctggtgctggaagattgccacaaacagattgagtttgagatctttccgcactaccgccatcgctatgcgccgggcatcacgcataaccgggaacactggttccggctggcgttgcccgccgaacgccagccactgctgagcgagcacctcgccgcaccagtggctgacaccggccgccgccgccgcactaacccgctcgtggatcaggcgtcatcggcgcagcaaggttgttcaccgccagcgcacagcaaccggagcgtacatgagtacgtgaggattgcgcgcactgccggggaacaagattgccagcaagatagcctgcaccctgttaaagatcggagaatatgtaagatggctggacatagtaaatgggcgaatacgaagcaccgcaaagcggctcaggacgccaagcgcggtaaaatcttcaccaaaatcattcgcgagctggtgacagcggccaagctgggcggtggcgatgccggctccaacccgcgtttgcgcgcagcgatggacaaagcactgtccaacaacatgacgcgtgacaccatgaaccgtgctatcgcgcgcggcgtcggcggtgaagatgacagcaacatggaaactatcatctatgaaggttacggtccgggcggctctgcagtcatggtggagtgtctgagtgataaccgtaaccgtaccgtgggcgaagtgcgtcacgccttcagtaaaaccggcggtaacctcggcaccgacggttcggtatcttacctgttcagcaagaaaggcgtgatctccttcgcgccaggccaggacgaagatgccgtgatggaagcggcgctggaagccggtgcagaagatgtcgtgagctatgacgatggcgcgattgacgtctttaccgcgtgggaagaactgggcagcgtgcgcgatgcactggaagccaccggtctgaaagccgacagtgctgaagtgtcgatgattccatcaaccaaagcggaactggatgccgagacggcacctaaactgctgcgtctgatcgacatgctggaagattgtgatgatgtgcaggaagtttaccataacag

SEQ ID NO: 69009 - DNA, 621 bp, Glycine max
  Peptide Sequence Number=SeqID_160694
ttcgatgactatttctacacggaaaccgcgacatcgccgctcaatgacagcgccaccttccgccagtacggcgcgggctttgccagcaaagccgactggcggcggcacaatacccagctactgatcgaacaggtttcccgcacgattaaacagctcaagccgggcgttgagttcggcgtcagcccggcgggtgtctggcgcaatctgtcgcacgatgcggccggctccgatacgcgcggtgcggcggcttatgatgaagcctatgccgacacgcgccgctgggtgcagcttggcctgctggattacatcgcgccgcagctctactggccgtttgcccgccaggctgcgcgctatgacgtcctggcgcgctggtgggccaatgtggtacagccaacgcgcacccggctgtacatcggcgtggcgctgtataaggtgggtgaagcctcgaaaagtgagccggactggacagttcagggcggcgttcccgagctgaaaaaacagctcgatctgaatgaatcgctgccgcacatcgacggcaccattctgtttcgcgaagattatcttaatcagccgcagacgcagcaggcggtcgattatttacgtcagcgctggggaaaatga

SEQ ID NO: 69010 - DNA, 576 bp, Glycine max
  Peptide Sequence Number=SeqID_160695
cttttacctttttgcaaacccccaataagaaagaaccacaacttaggaaccaacaagagtcatcattcatgtagtgttaatggtgagggtattagtcataaggaccatctatctagaatcttagatgagttgagttccctcaagttatggaaagaaaaactagaaagaaaagaaagaggaaaagagagggttgaaataaatcaagatgagagggaacaaaaaggggaagaagaaagaaggaaaatactaaaagagttaagaaaagaaaaacattcctcctatagtagtcataactcttgcaagagcctaagtgatgaacttcgtgactattatgaaggaaggcataggtcacatcttagacctcactcccataggagagaaaaggaaagaaatcctcaagaggctaacattaacctcccatacttccatgggaaggacaatgtagaggcttacttaaattgggaaataagggtagagcaacaacttaaaaagaaagtctacttcaaaatcttatggctctcactcttatccaaagaaagatcaaggtcaaggcatcttaagggcggcatcttctaa

SEQ ID NO: 69011 - DNA, 558 bp, Glycine max
  Peptide Sequence Number=SeqID_160696
gttacaggttgtaccatctatggtgaggctcatgaaacaggccaatgtattcccattgaagaaaacactcaagaagttcactatatgggaaatcaacagcgacaaaggtatactcaaggaggattttccggccagtggaggtcacaccttggaaatcagttcaacaaagaccagggtggaccttcgaacaggccaatccaacaagggcctaacatctttcagaggactactaagctggaggagactttgactcagtttatgaaggtaacaatgtcaaatcataaactgaagaaccttgaggtccaggtgggacaactggccaagcagatagctgacaagtcatccaacaattttgtggcaaatacagaaaagaatcccaaggaggaatgcaaagctgtgatgacaaggagtaagaggtttgtggaggctgaggatgaggagagtgttgtgcacaagaagaaagctgctgaaaagaaaggtactgatggcaagaaaaatgatgtgagaggtgaaagcaatcaggaaaaagagaaacaaataatggtcaagaaaaaataa

SEQ ID NO: 69012 - DNA, 306 bp, Glycine max
  Peptide Sequence Number=SeqID_160697
atggtgcccatgtttcatactttgtatgttgtgtatgtacatgggggtgtggtgaccttgttggatatccctggtgggggaaatagagtgtttttcatgaggaaaaaatacttgtacttgggggcatgtcactctatttggaactcccttgagactcaggctgatcaccatgggggggggggagatgcctgtgcacaacagggtgacctcgatacttactgcctagttttcctaagtgagagtgttgtgtggacacgcttaggctatttcctaggggatggtaccacatttgcatttgagagttaa

SEQ ID NO: 69013 - DNA, 213 bp, Glycine max
  Peptide Sequence Number=SeqID_160698
atgcagctctacaagcttgtcaaaacccagggaaaacatgcccctggtccaaggctcgctaaacccaaggaatacaagtctataaaaaaccaaggtccctccttggtaccaaaaacccaaggtctacccttggtatgcacgcctacaaaacccaaggcaccccgttggtctgctcattcgcagcaactacaacggccaaagtccaaggtctag

SEQ ID NO: 69014 - DNA, 357 bp, Glycine max
  Peptide Sequence Number=SeqID_160699
catcctgagcattctgttattggtgagtctgagcattctgtggttggtaattttgaacattctaaaaatatggctcaacctccacctcgtgagaggactctaagggaaatggttgcacctgatttcacttatgaaagcttgtgcattcaataccccgatgaggatgtcccatatgttcttaaaattggactaatccacttgttgcccaagtttcatggtcttgcaggtgaagaccctcataaacatctgaaacaattccatattttctgctccaccatgaaacctccagatgtccaagaagatcacatctttctgaaggcctttcctcattctttagaaggagtggcaaaggactga

SEQ ID NO: 69015 - DNA, 171 bp, Glycine max
  Peptide Sequence Number=SeqID_160700
atggcttctttagtggatgatctagatttatccttgaagatccactttgatgcaatcctctcaaggaggggacccactagagccatggctaggagactccaagaagattgggccagagatgcaggagaaggccctaggattctcatgagccataggggctccatagtgtag

SEQ ID NO: 69016 - DNA, 300 bp, Glycine max
  Peptide Sequence Number=SeqID_160701
atgcagaagcctttggtgatcacttggaaaagttcagattgctctatacattctgaagttgaagcactagaacatatgatgaaaagagatagaggccatcaaaatgtgtcattggagaataagacaggagattcaactgtggtcaagatgagtgagaaaaataataatgccgatgtcggcgactgcatgattcttgatgaccatgaaggagaagagaattgttgtggcaaaggaacaaatgcgaggagtgttttttttttttttgccaagaagccaagaaaagataggagattcggctaa

SEQ ID NO: 69017 - DNA, 219 bp, Glycine max
  Peptide Sequence Number=SeqID_160702
atggatgtcgtgctaagcgagctccagaacgaagaagcagagcaaggatccaatttctcaacttttagagagattagggagctttcgagtgattgtgaggtgctaagaggtggaggagacatcccccctcctgtgaactttagcattgggaaatgtattgtttccttagaacttgatagagcagggctagataattgcatttctagggatagggtgtag

SEQ ID NO: 69018 - DNA, 373 bp, Glycine max
  Peptide Sequence Number=SeqID_160703
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtggactgcgctcctccaagccagttacctcggttcaaagagttggtagctcagagaacccttcgaaaaaccgccctgcaaggcg

SEQ ID NO: 69019 - DNA, 306 bp, Glycine max
  Peptide Sequence Number=SeqID_160704
atgaaagctctcgagaaattcaaatggtcttatcttttcactcggatgtctgattcagacacatcacatatcgagacgttgcaaactgaacaacgaaagcttcgagaaattcaaatggtaaaaaattttcacatggaagtccgtttcaggtgcataatatatcttgacgctcaaactgatcaccggaagctctcgagaaattcaaatggtcataacttttcactcggatgtctgattcaggcacatcacatatcgagacgctgcaaattaaacaacgaaagcttcgaggaattcaaatggtcataa

SEQ ID NO: 69020 - DNA, 183 bp, Glycine max
  Peptide Sequence Number=SeqID_160705
atgaacggacggcctagaatcagtggaatttcaacgtcttctttagtattcatgatcataaaatctgtagggaaagatcctctgaatgacaacactacaattgccttccaccacaatgttgtcactgtggatatatttgcccttctttgtcaacagatctttgagaaacttggagtagagtga

SEQ ID NO: 69021 - DNA, 693 bp, Glycine max
  Peptide Sequence Number=SeqID_160706
atggacatgaacattggagcccttatctcaggtcagatttcttctattgctcagagtaactcctctaggctcggatttccagccttgatcactgcccatgcagagctagagaagttacctctgacattaactttagaggggcaaggaaggcaagggttcgatcagctggtgtttccttcttcttctactcaaccaactccttccacttctactactcctacaccagctcctcgaggcccatatgctcaggactctcagcgctttgaatccatgcttcagagtcttcataaaggacaaattttgttaatgcagagcttgcaggttatagctcctccaggatccattctgatagtggagcagtttttagagaaggtacaggatgcatcatctgaggccaccatccctgagccattcattcttgaagtaggtgagacacaggtaaggcaggaggctgcggctctagagagatcaccacagacttcaccagatccaccttctctagtggtggatcaatcttctcttcagcagccagcagacccgtctacaccattacttgatcttctagaggatccttctacaccagtcttgggattgactaccactcctccggccactcctgtgctacgtcttacagataaggagggcactcaggatgaggatactcagtcacaagacctgtcacaggaattttaa

SEQ ID NO: 69022 - DNA, 524 bp, Glycine max
  Peptide Sequence Number=SeqID_160707
aaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtacaatgagcaacggattgaaatgcctcaaaatgttctttacgatgccattgggatatatcaacggtgttggaacctgttacgtgccgatcaacgtctcattttcgccaaaagttggcccagggattcccggtgctccagtggcttctgttctatcagctgtcctcctgtcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 69023 - DNA, 7245 bp, Glycine max
  Peptide Sequence Number=SeqID_160708
atggaggcaaaaaatgatagaggaccatttcttgtggttgtgccctcttcagttctacctggttgggactctgaaataaatttttgggctcctggtgttcataaaattgtctatgccggtccaccagaggagaggcgtcggctattcaaggaaaggattgttcaccagaaattcaatgttcttttgactacatatgagtatttgatgaataagcatgatagaccaaagctgagcaaaatacattggcattatataataattgatgaaggccaccgtataaagaatgcttcttgcaagttgaatgctgacttgaaacactatcagagctctcacagattgctgttaactggaacacctttacagaataatcttgaagagctatgggcactacttaatttcttgttgccaaacatattcaattcatcggaggatttctctcaatggtttaacaagccatttgagagtgctggagatagctcacctgatgaagtggatctgcaagctcaagcaagggctcatagaattggtcaaaagagggatgttcttgttcttcggtttgaaacgttctaccttttcatatatgctgaagttgcttcttctgctaaatgtaacaaggttcaaaccgttgaagaacaagtcagggcttcagctgagcacaaacttggcgttgctaatcagagcattactgctggttttttcgacaataatacaagtgctgaagatcgaagagaatacttggaatcactcctgcgtgagtgtaagaaagaagaggttgcacctgttttggatgatgatgctctaaatgatctcttagcccgaagtgaaacagagttggatatatttgaggctgttgacaaaaaaaggaaggaagatgagctggctacatggaagaaattagtgcttggacaggccgctgatggctctgactctgatattcctccacttcctgctcgtctggtcactgatgaagacctgaaacagttctatgaagcaatgaagatatccgatgtgcctaaggctgaggtagaatctagtggagtaaagagaaagggtggatatattgggggccttgatactcaacattacggcaggggaaaacgtgcaagagaggtacgttcctatgaagagcaatggacagaggaggagtttgagaagatgtgtcaggttgaaaatccagattcacccaacaaagtaaaagaagtggcagagaagagttgtccaacaaatacttccagctctgttgtatctacttctaactcacaacctgtggctgtgcctccagtggtcccaacattgccagctgtggagagtttgccggtagtggtacagcaagttaaagagataaccccacccgccaaacgtggtcgtggaagacctaaaagaataacttcagataagtcaccagctgtggtgatctctccagtaacttctggaactgttgaagtagacacgcagttacagaaaggaattgggtctggacatttagcatcatcaactcctgattctgttgctcattctgctgaagttgtaggtgtgaatgcacccgtgcaacagtctgatccgggagtttctcctaactcacagcctgtcattcctatgccttctattccaccaaattctcaggtagctgctgttcctgtttctgtacctattcaagcaagaggacaagggaggaaaagtcatggtggtgaaggaattagacgtagagggaagaagcaggtcatgacttcatctccaatccctgctggttctgttgttcctgatctaaaggttaatgagaaattggaagatacattggtcagtccttcttcaggtcaagctatctcccagagtgaaactgttcccagctctgctgcagttccccatccaccttctgcttctttgagcagtggaaaggatcctgtgggtgttgggattgttttgaattctcaggcaccccctcctttgccctctaatacaaccttgattcaaactgcacccacttatccgtccgtgcagatgcaaagtaaaggacaaaatcagaagtcacagactggagtttcccgccgtaggggaaagaaacaggcaacaatattagcatcggttccagatcttttacatcaggatttacatcaaactgctaatttacctatttcatcagacagtatgtctggtgaaaaagccactgagttaaagagcttgcaagcgaacaatgttcaagaatcaaaatgtgttgtccaggatcaagcatcacagagcgtaggtgatcaggatttaaaatcactgggaggatcagatgattcatccaaacagacagtgatcatgtcttcatgtgaagatagtatgatcaaatctccagggcaagatcttgacgaggttaagaatcctgatgctcatgattcttctgtgaaggttgttaaatcttctgaaattacctcatcgaaaattgatgaagtttgcaataactcagggaatgaaactttacttgtgacaacagtgcctgttaccgaggcgataaaggatcaacatttaggtggtaaaactcataatcaaactgttgaaacttcaaaaaccttcccttcagttgttgatacttcaattaattccttgactggcaatgaaactacagaaaacatcagcaagtctttagatcctgtgactccaaagattgttcccagtacattaagtactgtttattcttccacgccaggctctgaatctactcatccaggatcgattgaatccatgcccaccaaaaggcaaggtcgtaaaactcaaaatagagcagagccaccacggcgtagggggaaaaaatcaactgcagtgttacctgttgttcctgatgctgttactggtcaggatcctaagttaagtcatcatgcacagaattcatcaggagattcattgctgggtaaagccactgcgaatgtcactcaaacccaagcattggagatccttttaccctgtggagtagttagtcatgattcgaatagaaaagagagggcaaccaattctacccacaataagcaacagaaagttgcatcaacaaggattgatggtgcacctatctccacagataagatttctgtgcatgatgttgcacgggtaatgaaggaagttttctctggaacttgcataccaaagcctaaagctcatgattctgctgggagcgaagataggaatgcacctgttgtaccagtactgactaaagctgcagtggatgtcacttccaataaccagagtttgaaggataaagtgtattctgatatagcagctactggtgcagcatgccttacttcaaatgttgctgtgaatgttaacgaaaaacaaccagaaatggcatccaatatgcagaatttggagggtaaatcatgtttagatatgccaattactggggaacataacctgacatcagatgttaaagaaaaggctgaacagatgctacattgtgttgaaagctcaaccacggggtgtaaaatagctcttgatacaaccctcaatgctgtccaaaagaccgatgattcttctgagagacttcctaccagctgtgctctcaatgatttaaatatagatagttctagccatcagatgtgttcatcttcaggtgctgaacctcttgcagtaattgatcacaagattaaaagccaatccgactctttagagaagtgttcaagatcttctccacttgatattggtagcatgggatgcccaccaactccattggaaccagacacttttagcaataatcctgtaactagtcaggctgatacctgcactcagagccattcatccacaaacaaacctcctgtttccacagaactcatttctaatgaaaaattggaatctttggaaccatctttgaaatcttcatctcttgcttgtgttgacggctctgggtttttggttcagactgaaaatttgggtgatcaaccacaagtgatcccatcaagtcctgcaacagatcttcctccaatgacaatgatagtttctagtatttcggaacatgccgaagttaaaagtgaaacagagtctacattaaaagcttctgctgaactctcttctgatgaggggattgttgggtataaagttccttcttctcagttgctggagactgagaatcggaatccatttggacataattctcaaaaggtattagaaccctccgtgaaacagtgttcagaatcagcttctgaaatgaaagttcctgtgagtcctaaagctgttcaagttcagaaacatccagatgcactagaacctgctgatttgcatggtactccattgatcgagagttgcccaaaatctctctgtgaggaaaaaaaggatgatgggaattccatatgtgaaccgcttcagtcttgtgttgttgaacctataaatattgaccctgtttcccaagaaaatatagtattacccattcctattgagaatctaaagactgattcttctgaggcttgccatatggaaatggacacatcagacaggttagtgttgccacaaccttctggtttggaagctgtagggaatgatttggttggtatttctggtgttggcagtcttgtagagggaaataaatctgaagctgcagttctgcccccgtcaaccttgaaagaagagcaaaataggggattagctgtaacatgtacagttaggagttcagaacctttggaggagtcaatggagaagggtgtggctaacgactctagagtccaggaggaagcaaaagttgataaagtagaaaccgatattcaaatggattcatccattagtcagactttgcaagcaaaacatgagatttttcaagaaaatatgaattttccctcccatctaatgacgaaggaagaaaacatagaagtctcatcctcaaggcccctatctatcagttcatctccatcacatgaattgaaggattctgaacttgaactaggtgataaatatatatctcaggttggtgattctcagactggatctgaagataatatgttgaagaggttggatttagtttcatctccttcagttacgaaggaagaagtgctcagttctacatctgatattgatggttctggaggcctttcaacatctctgaatgttcatcaattagtaactgtcccggatgctgtcaagtcttcatcatcccaagtgagagaggaagaaaagattggagtatcttctgacagtaaattagttgtgaggtctgtatctgaaaatgacatggaaggaactgatcttttgccagaaaatcctttgctggaaatcaataaaatgtcatcagattccccaatgattattagccactctgtgaagggtcgagtgtcatttgtgaaagaagacaattcagtaattaaaattagtgatcaaatggatgcttctcaggtctctgagaataattcagaaagggttacttccaaatgcatggatgtaccttcttgcttccaaatggtggagggagataatgttgatatgttgtctgacaagggccctctttgcaattcccttgctcctagtgaaccaagagaccctttgattgagaatagtagtgatggcatcgaggattctattccaaatccattaccacaacagaaatcagaatgttctgaatctgagaaggttgatgaggtgaagacatctgatgttgtcagggttgatccaggactgatgtccaaaaacacagatttgccttcttccttggtgatggagcaagataaagctgatgcatcatatgatagcccactggccgctgcagaaccaaaatattgtttgactggagagaattgtgaagatgctaatgaggaaccgaatccttcagaagctgagattggtaatgaaatggatgcatctgatgtagctgggattaatacacaactttcatctagtaacaatattgtgccatcatctttcttgatgaccaaagatgataagattgtggtgtcatctgacaatggcccacaatgcagcgtgcaagtactcaagggatcggaagattgtcagactgaagggagctgtaaagatgccactgagggtccatctacaaatccagtactactgcaggaattaattattaattctgaagctgagacatgtaatgaaggcaagacacaggttcggctatctgtggaagatgtcacagcatcagggggaaaaagagaggtggagacattgtctgatgagggtccacaaggaatcttggaagcccaggatggatcaagaggactagctgactttgaggaaggggcagatatcccaaaaccctcggtatcagctgtgaagggggaagaaatcttggaagcccaggatggatcaagaggactatctgacattgaggaagggacatgtagtaaaagctgtgctgctgagatgggaaatttatctgaagtcccaaaaccctcagtatcagctgagaaggtggaaggaatcttggaatcccaggatggatcaagaggactagctgacattgaggatgggacagatagtaaaagctgtgctgctgagatgggaaatgtatctgaagtcccaaaaccctcggtatcagctgtgaagggggaaggaatcttggaagcccaggatggatcaagaggactatctgacattgaggaggggacagatagtaaaagctgtgccgctgagatgggaaatgtatctgaagtcccaaaatcctcagtatcagctgagaaggtggaaggaatcttggaatcccaggatggatcaagaggactagctgacattgaggatgggacagatagtaaaagctgtgctgctgagatggaaaatgtatctgaagttccaaaacccctagtatcagttgagaaggtggaaggattatctaaggaaggtatagttggcagccaagcaatagtgcaggtatcagaagaatctgaaactgttacgggagatggaattgatgttactccagattgtttggctgtgccagaaactgtgtcaaatgatggggcttcatctttgtgctcttcagcagcaggaagtgaacatgtggacagcttgtctgagaaggatttagttggcaactctgttgcagaactttacactaaagaatctgaagcaggtgtttctgaccaggaaaatcaagtagtgcaagaaaatgccatggaagatatggaacatgagtacttgtccgagaaggatttggttggcaacactgcagcaaaacttgacaccaaggaatctgaagctggtgttagcaaccaggaaagacaagaaaatgagttggacattgaaaaatcccctccgtctgcagcagagggctcctcttag

SEQ ID NO: 69024 - DNA, 546 bp, Glycine max
  Peptide Sequence Number=SeqID_160709
atgacattgctgctaagcaatgtcttgcctagcgatcataacttcgatctccctctgacgaagtgtcagttggtgtatgccatcctgacacggatgagcgtccacgtggcccaagtgattgctgacgccatctatttatttgcagccttcatcgaaaagtattgcacgcctaggcaggcgcagggtgatgcacctcaagccgcagacgcaccgccaccacctcatcaggccgatcccgctggatcactaggcatgaagcgttatctacaacacctggttcgccagcaggcggccaaccaccgggggcaggtgcagatacatgagtgtctctaccggttcagcctcagtcagctggggcagggtttcgctccttttgcgtgccctactccagagcagtttggggctgaggtcacatggcctggagattggtccgaggcccagacaggggaggcgcctgtaggatcccccagcgatgcagaggaggcccgtatggatgaggagatgacgaatttgctcggtttcttgggaggaagcggagccacatga

SEQ ID NO: 69025 - DNA, 603 bp, Glycine max
  Peptide Sequence Number=SeqID_160710
atgcaagagagacacattatttttaatttaggtgcggagggaagagtaaatgaaagaaattccatatcattcaaactactagtgagagttagagagagcatactctggaactcaaaattcattagaactgcagacttcgtggataccttagcacggtcaagttgtacccgtgtaactgtcattgcaagaagtctatatttaatttggcacatatcaggatcgacagcaagagacaaaaagaaacacagattaaaccttgtcctgcttttgccacaaaatcaaagccctatattgatgcataagaaaaagcactcaattttgatacataaagcagtaactattgctgtaaaaaattccaaagagcttaaaaggagaaaaaagaaacaaaaagttgtcatggttacacgttcatctactggcacatccctgatatccattttagagaaaggcaaactcttgaactctgagagaggaaaggaagatggagtggaggtagataaagaaggcctcaaactgggagaggagcatgagctaccctctaggctcatctgcgtggccatgtccctccttgaaagagctggagatacattggtgactgcataa

SEQ ID NO: 69026 - DNA, 3345 bp, Glycine max
  Peptide Sequence Number=SeqID_160711
atggggaggccctccaagacgcaggtttcgaacgacttttcctccgaagaggaagaggaggacgcctccgccgccgccagccaccagatcgtagacgacgaggaggagctcgaagcggtggctcgctccgctagctccgacgacgacgataattcgccggatgaagccgctgaagacgacgacgaggataaacaggacgagagtaatgttgatcctgaagttagcaagcgtgagaaggccagattgagagaaatgcaacaattgaaaaaacagaaagttcaggagatattggatgcacaaaatgcgaccattgatgctgatatgaataataggggaaagggcagattgaactatctcctacagcaaactgagctgtttgctcattttgccaagggtgaccaatcttctcaaaaaaaggcaaagggaaggggtcgccatgcatcaaaagtaactgaagaagaggaagatgaagaataccttaaaggggaagaagatggcttagcaaatacacgactggtgactcaaccatcatgtatccaagggaagatgagggattaccaacttgctgggctaaactggctcatacgattgtatgagaatggcataaatggtattctggcagatgaaatggggcttggcaaaaccttacaaacaatatctttgttaggctacttacatgagttcagaggaatcacgggccctcatatggtggttgctccaaaatctactcttggaaattggatgaatgaaattcggcgcttttgccctgttttacgcgctataaagttccttggcaatcctgacgaaaggaagcacataagagaggagttactcgttgctggtaagtttgatgtgtgtgttactagttttgaaatggtaatcaaggagaagtctgctttacggcgatttagttggcgttacataattattgatgaggcccatcgaatcaagaatgagaactcactcttgtccaaaacaatgaggctatacaatacaaactatcgactcctcataactggcacaccgttacagggtttacatggtgactatagaatgattctgaaaactgaaaaactgtatgaagtagaggtggaaatgctaagaggctctagaatggcctggaaaactgaaaagttgcatgaagtagaaaacaatcttcatgaactctgggctcttctcaactttcttttgcctgaaatatttagttctgctgaaacttttgatgaatggtttcaaatctctggtgaaaatgacgaacatgaggttgttcaacaactacacaaggtcctccgtccattcctccttcgaaggttgaagtcagatgttgagaaaggtttgccaccgaaaaaggaaaccattctcaaagtaggcatgtcgcaaatgcagaaacagtattataaggcattactgcagaaggatctggagggcgctgaacccggccctccctttacaacaggagaccatctcattacaaatgccggtaaaatggttctactggataagttacttcctaaactaaaagaacgtgattctagggtccttatattttcacagatgactaggctgctagacatacttgaagattatctcatgtttcgtggataccaatattgtcgcattgatggaaatactggtggagacgatcgagatgcttccattgaggctttcaacaaaccaggaagtgaaaaatttgtcttcttgttatctactcgtgctggaggccttggcattaatcttgctactgctgatgttgtcattctttatgacagtgactggaaccctcaagttgacctgcaagctcaggatcgtgctcataggattggtcaaaagaaagaagttcaagttttccgattttgcactgagtatacgattgaggaaaaagtcattgaaagggcttacaagaagcttgcacttgatgctctggtgattcagcaagggcgattagctgaacagaagactgtaaataaagatgagttgcttcaaatggttagatttggtgctgaaatggtttttagttccaaggacagtacaattacagatgaggatattgacagaattattgctaaaggagaagaagcaacagctgagcttgatgctaagatgaaaaaatttactgaagatgctatcaaatttaagatggatgacactgctgagttgtatgattttgatgatgagaaggatgagaacaaatttgatttcaaaaaaattgtgagtgaaaattgggtcgagccaccaagaagagaacggaagcgcaattactcggagtctgaatacttcaagcaaacaatgcgccaaggtggccctactaaaccaaaagagcctcgtattcctaggatgcctcaattgcatgacttccagtttttcaacacacacaggctgagtgagctgtatgaaaaggaagttcgctacctcatgcaagcacatcagaagaatcaggtgaaagactccatagatgttgatgaaccagaagatagaagggttaaaaagggtatttgcttggaagaatactggggagtgaaagtagctaagaacgcttatagtaattggttagttggtaagatggtgggtgatccattgactgccgaagagttagaagaaaaggagcagttgctagaggagggattttcatcatggagccggaaggattttaatgctttcattagggcctgtgaaaagtatggccgaaatgatataaaaggtattgcttctgagatggaaggaaaaacacaagaggaagttgaaagatatgcaaaagtcttcaaagaaagatacaaggaattaaatgattatgatagaattattaaaaacattgaaagaggggaggcaagaatatcccggaaagatgagatcatgaaagctattgggaagaagttggaccgctacaagaatccttggcttgaattgaagatacaatatggacaaaacaaagggaagttatacaatgaagaatgtgaccgattcatgatttgtatgattcacaaacttggctatggtaattgggatgagctgaaggcagcttttcgaatgtcgcccttgtttcgatttgattggtttgtcaagtctcgcacaacacaggaaattacaaggaggtgtgacaccctcattcggctggtagagaaggaaaatcaagaatatgatgagagggagaggcaagctcgtaaagagaagaaacttgctgctaagagcatgaccccgtcgaagcgttccatgcctagacagactgagagtccatctctgaagaagcggaagcagttaaccatggatgactatttgagctcgaagtcacattgcgattttcctgaacctgactttatggtattgtggcaggggaagaagaaaaaataa

SEQ ID NO: 69027 - DNA, 471 bp, Glycine max
  Peptide Sequence Number=SeqID_160712
atgctgacggaacctgatgagatagatgctgtgttcagttattgggttaaggagttaggtgggagttctttggagcttgccaagtatcctgttatttttcggttgagccttaagaagtggattgctcccagggcttccgtcgttcggtttcttgcagcgcaaggtctattggaaaggagtggcaacatggtcacgatgtttattatgtctgagaaaagattcctggacacgtttgtgaaacgttatgagaagcattcgtctcagttgttgaagatgtataaggaaagtgtgaatatgaatgttgccaatagcaaggagaacaagaagaaaacttgcttgagttttgcctgtggaaatttgttgtatgttttcctgcagaagctaaataaaggaagcacgagtcttttgatgaaagagagaattgatcatgcttgtgaaaaaaatggagcattctataaaccaggcaaataa

SEQ ID NO: 69028 - DNA, 345 bp, Glycine max
  Peptide Sequence Number=SeqID_160713
atggatgtttatatagtgattttattctcaggatctaagtatctcttgcatgctttatttgtccaggcattgcaattgggccaggattcttacaatacttacgagctgagaagtcaaagatgtcagatgtgtttgcgaactgattctctgcataaagtgatggaacgtttggcaaatccagttattggacttaattatgaagactgctgtgctgaaaattttgggttcactaacctggatttaggtgtgaggcggcttgtaattgtggaagctggcagcaagcgcgtagaaggcatcatagcattgagtgacatattcaacttcttccttggttataacagttag

SEQ ID NO: 69029 - DNA, 4350 bp, Glycine max
  Peptide Sequence Number=SeqID_160714
atggaagccaatactgagttcgaggaaggagaggctttcttctgttataaggatgatgatgacgacaacattgaccttgattctctctcttacattgatgagaggattcagcatgctctgggtcattttcgaaaggaatttgaagaaggtatctctgctgaccgtttgggtgcaaaatttggtgactatggctcctttttacctacctgtgaacgctctcctcctttgcgatcttgtccaaagactccacaaaaacacagtagttccccaaaatctcctagcaatctccacatggtggctgcatttcagaactcaaaagcacctccaaatataccaccttctatgaggcttggaactgcttcctataaagctcctccatttcgtaatataagagtaccttcagcggataactcagtaaagaacacagatatttcctccaatgaagtaatagagaagttcactttgaaagactgtgcaaataagtcagaaaatttgactgaccaaagaacactgaagttgcgaatcaaagtgaaatcagatatcttagcaaaaaagaaggcagtgatttacagtggtcttggactcgatgactctccatcttcatcaatggagaacagccatgaggaaagtgaagatatgccacatgtatctcaagaaacccctgaagaatctccaactagcattgttcagaaattgtgggaaaatgcagctgatgcagccagtcgtaattgtggttgctatgcacttgtggttatgatttctttcactatccctggaggtgtgctaatatcacctctacatgacagtctcctctacttgataagaaaggaaaaagctcatggaaacatcaaacccatgtattctcttaatggtcatcaagaacattattccatgtctactgatgaatcagattcttttgtgggggatggacatttgttgaagaaaaggaaggtgacagtggtggaccaaagtgacaagcagcatatgaatggtaaccattctgagaatgatatgacattgcatacgaagaaaaaattaagaagtagaactctaaatcgaaaggactttctatctaatgacctgagatgcactccactgtcaagttcaatttgtgatgctggtgaaacagatgaagtcactgttaaggcttttgaagtatccaaggaggttgataaagatggtgtgaaatgtagaatggtttccactgaagcagtgaaggaggatacactagagtcaatatctggtcaggattttgacaagattgagaagcaaaatacagggagtagctttatgcaaaaagttttagagcataaaacggaaatttttcagaataataattcaactgatcctaagattaatagcaagtgtaatgcatttgcaatttcaaaaaggatcaagtgtgatacaatgaaatgtaaggtggatcaagatactcaaaagtgtgaaactaatcaggaaggaaaggtaaaatctgaaagcaagaatgagtcaaaaggtgaaaggagtcctggaaaagttatgactgatgctgaaaaagatagcattggtactagtaataatgcaatggtaaatgatagaaagagtactggcattggtgttacttcttcgaaaagtaaaatgcataaaataaagtcaatgaaggataataaggtcacagattgtgacagagattcattgaaaggaaaaaaatcacaacggaaagttgatcgaataaatccaactgataggcctacccttaataaggctacagtaaattctatccttgatcatgtttataagagtgcatatatagtaaaggaaagaccaagtggcaataaagttgttaatcagttgtcagctgggccatgtgtaaaagatgcaccaggtgcattttctattgctgaaaataaaccaacttctgagattgttccgtcatcagcagcagcaacacctcaagttattgaagaagattgggtatgctgtgacagttgccagaaatggcgacttctacctatgggtttaaagcctgagcagcttccagagaaatggttgtgtagcatgctatattggctgcctggaatgaatcggtgtaacatcagcgaggaagagacaacgaaaacactttatgcttcttatcaaatgccgatttttgtgggtcaaaataacatgcaaaactgtgccactggacctgaaactgaagtgagatctgttgatgctctgcaacttggcctgaatcacaaaaagtccagttctgatgtaatgcttgatcgaggaaagaagaaacatggtattaatgaaaaggcaaggtcagtaatcaataatgacattgggcctgcagactcaaaccgtatgaagaaatctatttctaaacattcgagcaggttgaacaatttgatagaagaaaaaaacacacctaaggtgaaagaaaagcaaatgaatggaggtgacagaaatcattttagattgaaacataagatggaggataatcaacatggatctggaactgctaagaaatctaagactgaagatgtttactatgctgataaacaactgaatcctagcatggaatttaagaaggttggtctaaactcaagaaatggtttaccaacaaaggctagtgggaaaaatatggggaaatatgatgattattgttggtctgatgatctggaggacaagttggtagttccggtgaagaaaggagactgggcacagttttcatcagatgatggttcattggatgctacaaacagcagcaaaattggttcaattaagaaaaggaaaatgactgactggctggatagtgagaaacataacaaaacattgtccttggaaggcgatatgaaatgtggtaaagaaggcaatgtaaataggagggagaagaagtatatagttttgaatatggatgcaaaatcagtaaccgaaagggatgataaattggttagagaaagtggggtgaagcgagttttctcttcagacagcagggatgaaatggctattggaacagaggtgaaaagtgttaataaggtccagcagccaagaaagcacaaaaaaaatgttgcttcttaccaagctttggattgttttgatcaattgggtaaggatttaggctctggagaactttcattgacagcaacttcaagctcttctaaggtttcagggtctcataaagctagaactaaccttgaagatgtcagaggctcacctgtagaatctgttacctcatcacctttgtggacctccaacatggacaagcgtattttggcagcaggggacacatcagaaaaagatgatgcaagaaaacgtggtctttcaaaaagtttggataatagggaggggaagttatcagtaaaaatgaaggagagaatttcatatgacatacatcctgcacatggtaattgtggcagtggttcacatcttgaggagaaaatgaacaagagtaataaggaaaatgcactttcttggcagaaatctggtaaggttacatcattgcgggttaaggaaaaggacagaatttctggttcggaggttattagggataagatgaaggtttcagcttcagataatgatttttacaaaaatgatgtgagttatgagtcaagagttgatcctaatcatcatgcttctggtactgagacaagaaatgatgttaagaacagttctctgaagtctaatcacaagattgtcgaccctagtaagaaaaattcttcaagacattggtcaaatgaagctggaaaacaaactgtgcaaaaacaaaatgagattgggaatccagttctgaaagtggatgctacacgtagcactaatagaaagattatctcccagcagaacctgattcagaactttgtggaagaaaacatagctaatcaagtatgcactggatcaagagatgggaaagccaaagtgatcgcatcttccgaggataaagtgaaaagggaaacattatatgtgggttctagaactgcacctgagtcacaaaagggagatatgtctaatgggcacccagttcacgcttctggcaatgatgttcccaagtttgcgagaaatccaattgatgtttgttgcaaggttggagttaattgcagttcagaaagtttcatacctgatggacaactcagtgagtcaggtcctgtgacaacaaattctagccaaactgcctctagcattctggaagaagccacaaagctaaaagattctgcagatcattataagaattctgggtttgagtttgaaagtaatgagacttattttaaagctgccttgaagtttctacatggagcatcacttctagaaagttctcacagtgagagtagcaagcatggagagacaagtcaaatgcaaatatatgctactactgctaaactttttgagtaa

SEQ ID NO: 69030 - DNA, 708 bp, Glycine max
  Peptide Sequence Number=SeqID_160715
atggaggaaccgagcaaactgaagcgtgccatgattgattccttggctggggcaatttctggtggaatatcacggactgttacatcgccccttgatgttattaagattcgattccaggtccagctagagcccacatcttcatgggcattactacgcaaggatttggcttcagctacggctgcagcatcaaaatacactggtatgcttcaggcaaccaaggatattcttagagaagaaggcgtacaggggttttggcggggaaatgtgccggcattgctcatggttatgccatatacagctatacaatttacagttttacacaagttgaagacttttgcctctggttcttccaagacagagaatcacattaatttaagcccttatctatcctacatcagtggggcattagctggatgtgcagctacagtaggttcatatccctttgatcttctccgaactatattagcttctcagggtgaaccaaaggtatatcccaacatgaggtcagcattcatggatatcgtccatactcgtggattccaaggcttgtattctggattgtcgcccactctagtggagattataccttatgcaggcctacaatttggcacatatgatacatttaagcgatggggcatgattatctttttacccatcagtgaggactctgcacacagattactattgcctctatatgtcaatcactaa

SEQ ID NO: 69031 - DNA, 2760 bp, Glycine max
  Peptide Sequence Number=SeqID_160716
atggaatgcttaaaattagtccgtcacctggtggatgcagtacaagttaatgacctgaattgtattgacgaacaatctctttctccagaatattctggtgtttatgatgcttttggtgaaccagacatatttcctcgggtgggtgaccagtaccaggttgaaattccatctttaatttcaaaatctgactattactggcttctaaggaatccccatgaggcagagagcacagcaagtaggactctccataagtttcgagttggattacccatcccaataatttggattaaggatgtagagaacaataggcacgatcatcagaaaaatgcatgcaagtcaaatggagttaccaataaaattgaatcctcaaaactagaatgtatagaagagaccttgaatggtctggattgtgataaattaaagcctaaacttgggtccgttgacagtacattggtgaaattaggagaatcaggaaattccaatatgcagcaagaaacagagattgagatgtgcaagaagcatagagataaaggccattgtttagttcctggggctgcaagtgacacctggaatcaaattgaagaggccagtttcatccttggcttgtatatattcgggaagaaccttgttcaggtgaaaagatttattggcaataagaagatgggagatatactgtcattctattatgggaaattttataaatctgacaaatttcaaagatggtctggatgtagaaaaatgagaagcagaaaatgcatttatggccaaaaaatattcacaggaccaaggcaacaagagctcttgtctcgattactaccaactgtgtcaggggaatgctacaataaattacttgaggtgtccaaggcatttgtagaggggaaaatgcttctagaagattatgttttaactttgaaggcctcagttgggctcaaagctcttgttgagggagtaggagttggtaaggggaaagaagatcttacaggactcgctatagattctatgaaatccacacaagtacttcctgctcgccaagaaatacctgttggcaaagcatgttcattgcttactccttctgaaataataagctttctaacaggtgatttcagattaagtaaagctcgaacaagtgatctcttctgggaagctgtttggcctcgtttacttgccagaggttggcactctgagcagccagatagtcataattatgctgctacttctaagtattctctggtcttccttgtccctggagttaaaaagttttcaaggaaactagtgaaggggaatcactattttgattctgttagtgatgtcctgtgtaaagttgcttctgaccctgagctaattgagcttgagacgatagcagataatgattgcactagcaaagaaggaaatgggtggacaaaagatacaaaactggaccgtgaaaattcccctgatcaaccacgccactgctatctcaaggtaaaaactccaaaccacagtacagatgtcatgaaatttactgttgtggacacaagtctggctagtgaaaaaatgacaaaggtgagagaactgagaagcttgccatttgaaattttaaaagcttgtacttttgaaaatgactctgatgatgagaatacttctgaggagcaaacaaatgaatctgagtctgtcaataccacttgcttggatagggagaagaatgacattactaaagccagtaaatctaatactggtaagtgtgtctcttcacttttgaattgtttagaacacaatccttcaaaagaggagcttccaaggagcagcatgggttctagtagcctatctgctgcctccaagggaccaaagacagaattcttgagtaacacactcaaaagagatggtatgaagtgcccatcactccagagaatggtatctgacaacaaaaatgatctagtccctgttacaaaaagacggaggagattaactgcctgtagtcgtgcaaagaaaaatagcaacactgccaatttctttgtggttcccagagtaaatcaggaggaggccagtttttgcccggatccagacaattcaaaatctagtgcaaatgtaactgccaacgtctttgtggcttccagagtaaaacaagaggaagccattcctcacaagtcaaaatgtagtgagagtgttctttcatgggaaatcccaacccaggagaaaaactcatcagcagattttccaacccagaaaaacaaaacattagcagatcctccatcaaatcccagctcaatcatcaatggagaagctgttcgtgacactagttcttcaggcaataaggatcaatgtgataaaccccagccacggactatgattgaccttaacttacctgttccactggaagttgaagctgatgaaacttttgtgaatgaagtggcggagatgcagcaaaataacacaggcaaggaatcagatgatctcagtgttgtaacaaatgccaaacttagtgaacagcctgacattcacacccggaggcagagcaccagaaaccggccaccaacaacaaaagtgctagaagcttttgcctttggatatctagacagaaaggagaagtgcagaaatagagattatctccaggacagttcaacaaggccttcccgacgtgtttctcgcaaattggcaggctctagaaatggtggtactgatcttgaaaaagaggaaaaaacagatgttgtctgtaatgggaatggtaaccatagcattgacagtaatgtgatatacccaggctccacgtgtaatgaaagataa

SEQ ID NO: 69032 - DNA, 633 bp, Glycine max
  Peptide Sequence Number=SeqID_160717
atgggaatacaactccagcgccaaactcgcccttcagctcttcctcctcatggcgcgtcccgcgtgggacttctcccagttgccccaattcttcaacctcacctccctccctcccagcctcgcgtccgccgcagcataaggagcgagtgcgagaacgccacctcctcctcggattcctcgtacgacacgctgtgcgagattgtggattgctccaacggggtctgcgagcacgaccctgttcggttcatgcggccaatgctttcggctagtttctgcttgcagcctcccggggacacgaccacgcgccggtccacgttcgacgcggtactcgcggggtgcataccggttttcttcgaggagctttcggcgaaggctcagtatgggtggcatttgccggaggcggagtttgaggagctgtctgtgtttataccgaaggaggaggtggtgttcagagggatgaggattttggatgtgttgcaacagataccgagaggtagggttaggagaatgagggagagggttttggagttgatgccgagtgtcttttacaggaagcataatagttccccgggtctcaaaactaagaaggatgcggttgatttggccattgatggtacattggataagatttga

SEQ ID NO: 69033 - DNA, 219 bp, Glycine max
  Peptide Sequence Number=SeqID_160718
atgccaagagtgtaccagtggacagtggtggtgtactccgctgtggagcaaagaaagcatgccagaatggctatcaaagtggaggctcttttagccaacgaggtgagtttctttaggaccaggttttccccaatttgctgtgcggaagcaagcacgaagaaaaagttcctagcatgtacaaacgcatggaaacaaaatttctgggctttgacagattga

SEQ ID NO: 69034 - DNA, 1494 bp, Glycine max
  Peptide Sequence Number=SeqID_160719
atggccgtcgtaactagcaacggcaagcgccgccaacattggccctccgcgaattaccactttccatctcccaattccaaaagacccagacttccaacaatgtcccaaaaccacgcgcaatccgtgttatcctccagtagtatcatttctagaatttctacgtaccccgaaaccaagccacccctccatagggaggttcacgccccgtgtagaccacgtaagtttgattctcctgccttcaatagaagtgctcattattatcgcaaggaagagattagtcacgatgtgggcaacttgttaagtaaaaattaccaaagggcgaaaaattccgcgttagctagcattaggtttggggaaaagggcaaggaggtgatagaagtggatgctgatagttccaaggatatggtttcggaggaggattcgagtgtggaagaggttcgttttgtggaagaagatggacgagaagtgcgctccgtggtgacggagcacaagtggcaagagggtgatttggttgtgactgaggttaaggatttggatgctaaggatatgtgtggtggccctcagcagcagtcaacttcatccgtggtttctgagttgactaatggtgatctgaatgtggttaatgctgagaagatgttggacattctttctttgactccggatcatgatctttcctccgttcaagcctacaagaagttgctcgatgctcttggccagcgaacggatacccttaacaggctggaggctgaaattaaagttaacgagaagcgtatgtccacgtttgaattgttgcgcccgaagaaggaactagtagaggaagttccattggaaccttttattcctcttactaaagaggaagaagttgaggttgcacatgccttttctaccaaccggaaaaagatcttggtttcccatgagaaatctggcattgagatctcgggagaaaagtttcaatgccttagaccgggtgcatggttaaacgatgaggtaataaatgtgtaccttgaattgctgaaagagagggagagaagagagccacagaagtttctgaactgtcattttttcagtacctttttctacaagagggtttcatttctttcatggaaagtaacagtaatggaaatgctttctgagaaacgtcttaacatgttttgcacaatgttgttaaataactgttatggtgctgcaataacgtcatgcgtggcgtttttggaccccctctgccattcaccatctggtatttgccatcacatggagctgtccaccatggagcctgccgtgttaataagtggcaagaatgggtatgatttcaaatctgtgaggagatggaccagccaaaagaaattgggatatggcctacatgaatgtgataaaatatttgttcctatccataaagagattcattggtgcttggctgttatcaataagaaagataagaaatttcagtatctggactcactaagaggaacagatgcccaagtaatgaaagttctg

SEQ ID NO: 69035 - DNA, 864 bp, Glycine max
  Peptide Sequence Number=SeqID_160720
atgtttatcattgatgtctaccaggctagctatattgtagatgaagtaaaggacaagactggaaaagatattgatgtaagttcttggaaaaaagaatttgttgaagaccttcctgagcagcagaacgggtatgattgtggggtgtttatgatcaaatatgccgacttctatagcagaaacttggggctatgtttcaaccagattgtggactggactgattatacatatcatcccgatatccagagtccctcatatcagatacagcgggggttcctccaggtgtggggtcgtataaactcaaattgtgatggtgctgtttctggtggagttgctgcgtgtgggagagtcctacggaatcaggctggggcagtagtcgtctttgctcataatctgggaatgtgttcaatatctcaagctgagatatgggctattactatgggagttaagcttgcttgggataaaggttttacaaacttgtatgtggaatctgatttcaaatatgctattgagatgatggatggtattcagtgtgaggagagacatattcttggtgccacattctccgtgaggcaaacaagacagcagatgctcttgctaaatttggcgttgatgttagatggtcaaagtaaagttttttattctactcctagttttctttctgctcatgttttagctgatgtagctgctttgttgggggagagcatgattgatgatggtagctataaggatggggctactgatcccacattgctgtgctttgcatttgctttgtgggaggtcaagtgcactcacaatctacaccttttgaaagtttctcaagcttatgttcttgaaagagatatgtcatctacaccttttgattaa

SEQ ID NO: 69036 - DNA, 767 bp, Glycine max
  Peptide Sequence Number=SeqID_160721
ctagttctgtcaagcttaaagataagcgttgctctggttcttctctcaagactgacattgttgtcgaacaagataacactaacagtcccaacaccgcttctgcctctgcttcttcttttgagcgcaaggtttcgagatctagatctgttgggtgtggcagcagaagcttctctggggacttcttcgagagaatctctactgggtttggagattgcactctcaggagggtggaatctcagcgtgaaggtaagcctaaggggattggtggtggctcctccgccgtgagccgcggcggcgaacaccaccaccaccaccattgcatgaaagagagggtccggtgtggagggttgtttagtgggttcatgatgacttcgtcttcttcatcctcgtcttcttcctcgtattgggtttcttcttctgctgatgatgctgctgctgctgctgctgtgaatggcaaatcggccactgtagcactctctcataacagaggtaggagttggggttgggcttttgcgagtcccatgagggctttcagcggtaaaccttcttctaaagagagtaaccgaagggatattattagaggtgccagtgataagaatgccacgccaaatttatctgctataccttccttgcttgctctatgggcaattctctgggaaatcagaatccttgctggtggcagtgaatggagtgtgttcgaaaagagggaaatttcgaggagaaaatctcgatgcattgcattctctgtcatcacgtggcttgtttga

SEQ ID NO: 69037 - DNA, 248 bp, Glycine max
  Peptide Sequence Number=SeqID_160722
gcgaaacaactcgcaaagggttttatttgtatgatgataaacgcaaggctagtcctgatcctgaattgaaaaactatatccagaaggctaggagctttactggtttctccgttgatcctaaggtattgcagtcaaagcatctgatcttgatatttctgctgtcttgggcatgggttttccaccttagaggggaggtatcctattctggtctgactctcttggatccaagtacatatgttcaagattag

SEQ ID NO: 69038 - DNA, 2082 bp, Glycine max
  Peptide Sequence Number=SeqID_160723
atgaaggtcaagcaaaagcttcaccaagccatagatctgttgtactctcatggacttgcttcttttgatgattacactcgtcttgtgcttcattgtgctcgggccaatgacttcattcaagcaaagagactgcagtctcacatggaacttaacctttttcaacccaaagattccttcatccacaaccaactccttcatttgtatgccaaatttggcaagctctcagatgctcaaaatgtgtttgataacatgactaagcgagatgtttattcttggaataccttgctttctgcttatgcaaagatgggtatggttgagaatttgcatgttgtctttgatcaaatgccttatcgcgattctgtttcatataacacattgattgcatgttttgcaagtaatgggcattcaggcaaagcattgaaagttcttgtgagaatgcaggaagatgggtttcagcctacccagtattcccatgtgaatgcattgcaagcatgttctcagcttttggatttgaggcatgggaaacagattcatgggaggattgttgttgctgatttgggggaaaatacttttgtaaggaatgctatgactgatatgtatgccaaatgtggtgatatagataaggcacggttgttgtttgatggaatgattgataaaaatgttgtttcatggaatcttatgatctctgggtatgtaaaaatggggaatcctaatgagtgcattcatttgtttaatgaaatgcagttgtcaggtttgaagcctgacctagttactgtttcaaatgttctcaatgcttactttcgatgtggacgtgtagatgatgcaaggaatttatttatcaaattaccaaaaaaggatgaaatttgttggacaacaatgatagttggttatgcacaaaatggtagagaggaggatgcttggatgttgtttggtgacatgctacgtagaaatgttaaacctgacagttacaccatttctagcatggttagctcttgtgccaagctagcttccttgtatcatggtcaagttgtccatggaaaagtagttgtaatgggtattgataatagcatgctcgtgtcaagtgctcttgttgatatgtactgcaagtgtggagtcactttggatgctcgggtcatttttgaaactatgcctattcggaatgtgatcacttggaatgccatgattctggggtatgcacaaaatggacaagttctagaggccttgactctgtatgaaagaatgcaacaagaaaatttcaaacctgataatattacttttgtgggtgtcttatctgcttgtatcaatgctgatatggtaaaagaaggacagaagtattttgattcaatcagtgaacatggaatcgcacccacattggatcactatgcatgtatgatcactctccttggtcggtcaggtagtgttgataaagcagtggatctaatccaaggtatgcctcatgaaccaaattaccgtatctggtccaccttactatctgtttgtgccaaaggtgacctaaagaatgcagaattggcagctagtcatctctttgagttggatccacgtaatgctggaccttatatcatgctttccaacttgtatgctgcttgtgggagatggaaagatgtagctgttgtaagatctctcatgaaggaaaagaatgcaaagaagtttgctgcttacagttgggttgaggttgggaacaaagtccacagatttgtttcagaagatcactatcatccagaagtggggaaaatctatggtgaattgaacagattgatctcaatattgcaacaaattgggtataatccagatacaaacattgtcctacacaatgtgggtgaggaagaaaagtttagatccatttcttaccacagtgagaaacttgctcttgcatttgccttaattagaaagcccaatggagttgcaccaatacggatcataaagaatatacgagtctgtgatgactgccatgtgtttatgaagtttgcatctattactatatcacgaccaatcattatgagagattcgaacaggtttcatcatttctttggtgggaagtgctcttgcaatgacaattggtaa

SEQ ID NO: 69039 - DNA, 234 bp, Glycine max
  Peptide Sequence Number=SeqID_160724
atggctcccccagcagcaaagctaagagagattggtttggaaggctttgctctatggtgcagaggcagaagggccagtagcaataatggggtatttcctgcatcacaaggacgttgggtggttcaagtgcccaatgatgagatggaagagcttgccttgaatagcaaccaggcaaactgcaaattctgctgtgactgtgggactacatttttaagtcctgttagtttgaggtaa

SEQ ID NO: 69040 - DNA, 678 bp, Glycine max
  Peptide Sequence Number=SeqID_160725
atggcagtggcaggttgtcagaagcttctggaactgagcaccaagatcgtcgctgttggcagaaactacgctgctcacgccaaggaattaggcaacgccgttcccaaggagccggtgttgtttctgaaaccgacgtcgtcttacttgaaaaacggcggaaccatccaaatcccacacaacgagggctctctgcatcacgaggttgagctcgctgtggtcatcgccaagaaagcacgtgacgtctccgaatcctctgcgatggattatgtcgccggttatgcactggctctggatatgactgctagggaccttcaagctgctgctaagttgccaaagactgcagtgccaaatcctgatgatctagaattatggttaaagccaaagttagaactaggcttagaaatcggctcacttccagctctgacctctggtactcccccgggtgttggccctgtcaaagagggtcaaacaattactgctggcgttacaggccttgtggaccaagaactgaaggacaggggtgcaatgaaatcaagaacaaagggtgacaacatatcagaatttcttaaagaaatcgtagatgtgcttgctgatctcatcaggcctttcttgatggagaaagtgaccagccccttcaagtacaactacttcctccagaagcggtacatctctttgtga

SEQ ID NO: 69041 - DNA, 483 bp, Glycine max
  Peptide Sequence Number=SeqID_160726
atgtctggcttctataattttattatcatttttgcgactggcttgccaccatttcaggaaaaaggtattgaaacagcaaaacctgttattgaagccttaaaaagggaaggtgcttctgctattggagctgctggtttttgttggggcggtaagactgttactgaccttgggaaatccaaacatgtccaagcttcagtgttattacatccagcatatgtcgaagtggatgacatccgtggtattaagactccaattgctatacttggaggtcagaatgatacaattactcctccaaagcttataaaacaatttaagcaagccctacaaaatgctaaacctaaggttgatagttttgtaaaaatatttcctaacgtttcacatggttggactgtgaggtacgaccctaaagatccaaaagctgtgaaggctgcagagaaggctcatgatatcatgataggttggtttgataaatatctaaagtga

SEQ ID NO: 69042 - DNA, 351 bp, Glycine max
  Peptide Sequence Number=SeqID_160727
atggtgagggttagtgtgctgaacgatgctctgaagagcatgtacaatgctgagaaaaggggaaagcgccaagtcatgattcggccatcctccaaagtcattatcaaattccttttggtgatgcagaagcacggatacattggagagtttgagtatgttgatgaccacagggctggtaaaatcgtggttgaattgaacggtagactgaacaagtgtggggttattagtccccgttttgatgtcggcgtcaaagagattgaaggttggactgctaggcttctcccctcaagacagagtttaatttcgattaagaggatgtcaggaatttcaattgagattcatggattgtaa

SEQ ID NO: 69043 - DNA, 1791 bp, Glycine max
  Peptide Sequence Number=SeqID_160728
atggcggcgaagaagcaggacgccggggacaccaaaaagagaaagcgactcaatactgaagctcccaaggcttcgaagctcgttgcctcaaagaagcacaaaccagactccgttgctaaagacaacaagaacaagaagacggcccctcttaccggccgagaacgtcgtcttcatgccaaggaactagcagatgctagaaaaaagaagagaaagcgacatttcactcttgagcaagagcttgcacgtctgtgggaaaagatgagacgtcacaagattgctaaagaggacagagctaagctagtgactgaagctttacgaaagatgaaggggaagattccagagattgtgggctctcacatctcatctcgggttcttcagacttgtgtcaagcattgttcacaagctgaaagagatgcagtatttgaagagcttcggccacattttctaactctagcattcagcgcttatgctgttcacttagtgaagaagatgctcgacaacgcttccaagaaacaactagcaggctttatctccactctccgtggtcatgttgctcctcttcttcgccatatggttggatcgattgttgttgagcatgcttatgagttagcaaatgctgcacagaagcaagaactgctttcggaattatactccacagaacttcagttgtttaaggatctagtctcattgaaagagagcagattatcagatgtgatgtccaagttgggtctacagaaaggttcagttctgcgacacatgacgtcagtgattcagccaattttagagaaagggatagttgaccactctattttacacagagtcttaatggaatattttagcattgctgataaggaaaggaagaagattatcaaaggattaaaggggcacatagacaaaacagcttatcatcaatatgggtgcatggtgctggtttgcatcctttctgttgttgacgacacaaaactgattacaaaggttatcattcgtgagcttcagtctattctaaaggagcttgttctggataagaatggaaggcgtctcttactccaattactacatcctaatagttcacgctatttcagtcctgatgatcttgcttctctgaatttatctataccttctctgtctctcaaggatcagtcagaagcaagctttctgacagaaacttcaaaggtttcacttggtgacaaggaatccaaggaagacatagaggtggcagtggatgaagttaataaagataaaacttctgcggatgattctgacctagctgagagtgggaaaaaagacccatttgtcagaaggcaggagctattgatcaagagtggacttgcagatagtcttcttgatatatgtatcgagagcgtgggagaactgatacggtcaaattttggcaaagaggtcttgtatgaggttgcaacagggggttctgatggcataatgcacccagttttggatgataagataaattctctccacaacgctgtagcttctcttgcagcactgcctaaatcagaagattcacaagaggagcatgtccttgaaaatttccattcaagtcgcaccattagaaaactgattttggattgccccaactttgcttccaccttatgggaaaaagctttaaaagggaaaagtgagttatgggtgcatggccacagctgtaaggttatttctgcatttttggaatcaccagatccgactgtactaaaacttgttaaaaaagagctacagcctttaattgacattggaattctcaagaaccctaagcctatagaacaagcaaaccaataa

SEQ ID NO: 69044 - DNA, 678 bp, Glycine max
  Peptide Sequence Number=SeqID_160729
atggcgattccgttgccctctctcgatctcactcaccactccgatttcgaacccttagtctccccagacggttacatctccatttgcggctacggttccctcctctccgagacaagtgccagaaccactttccccgacctcgtcaacttccgaatcgcccggttaactggtttccgccgtctcttcaactccgtcggacgcatctttttcactcaccgtgttgccaatatcaaaactcaggaaattgctggcctttctgttgaaccatgtgatggtgaattcgttgttgtagctgtttttgagataaagaacacagaggttgtccctgaaacactagatgggaagccctttatcaatccagcagttctctgtgcttcttacactgatgaggaattctttaaatttagatgcagtgagggcagggaaaaatattttgaacaatacggagaatataagatccataagatttggcgggatgatgttttcccatgccgtgtttatcttcgtcactgtgtcctggctgcaaaaagccttggcgatgaagtccacaataactttttggatcatactttccttgctgaccgtaaaacgaccatacgtcagtactttgaaaaagtgggtacaagcatcttggaagaagagccacctgagtctttgaaaacccgttatggtggttga

SEQ ID NO: 69045 - DNA, 516 bp, Glycine max
  Peptide Sequence Number=SeqID_160730
atgaaggtcacagctctcaaacaaaccagccacgatatgattgcacacataggtaaagctcgggcagcagtggaagaattgaagaggttccttgtggctgaatcgttggaggaagtgaatagaaagctagataagttctatatggttctcatcttgagaagtttacattcagactttgatcacgttcgtgatcaagtcttagctggagatcaggttccgtcgatggattctctcatcactaggctgcttcgtgttccccatgcattgaaagaagaaaatccggctgatgtagtggagacgtcagccatggctgcacctcgtgggagagggggaggacgtaacagtagaggaggccgtggtgggagaggtggacgtcctcaatgcacatattgcaagaggatgggccacacacaagagacttgctactccttgcatggcttccctgacaaagtagctcaggtaactcagaccgaaaccgaaaaatcagagtctaagttctctgataaagaatattaa

SEQ ID NO: 69046 - DNA, 258 bp, Glycine max
  Peptide Sequence Number=SeqID_160731
atgaagaaacgagcagtggctacagaaaaacagagaaaaatgaagcaagcaaacaaaccaggcaattgtttaaccattcgtcaatataagaaagaggcgactattggcaaaatcaggtcatttgccaacattatagacttgaataaatcggattcatacaatgcagactcagaaagtcaaaatatagttccttacttaccttggtatgccgagaaaatcaggaattcaagtgtaaagatcacattgggtagaaattga

SEQ ID NO: 69047 - DNA, 213 bp, Glycine max
  Peptide Sequence Number=SeqID_160732
atgcattttggaatgccgacgacggtgctggtgcagggagagctcaccggaacaggcgctggtggagaactcactgaaattggcgttggcggcgagctcacatgtgtcatagcaggagtggccgcgggaggtgtggccactggaggagtgtttgttggagctggagcaacagctttagacggaggagatgctaccgtgggagatgaaacgtga

SEQ ID NO: 69048 - DNA, 1125 bp, Glycine max
  Peptide Sequence Number=SeqID_160733
atggaggcccaagcttccgtagcactaatagtcggtgtgactgggttgactgggctgagcctagccgaaacattgaagaaacccaattgtctcggaggcccatggaaagtttacggcgcagcccgcaggcccccgcctagttggttctctccttccatggtcgaccacttcatcacctttgacgctgaggactcttccgacacacgcgccaagctttcccccatcgcccacgaggtcacgcacctcttctgggtcacctttcagattcacgcagacgaagaatacaatgcaactgtcaacaaaaccatgctactcaaccttctaactgccctgaaatcttccacgacatcccggttggcccatgtaacggtccaaaccggaaccaaacactacatgggcccagttttcgacccggttcactccacgcaactcatcggccaccagccaccctttgacgagaacatgccacggctcccttatccaaacttctactacgcgctcgaggacctggttgcttcttacgcgccctcgctgacgtactcagtgcatcgctcatccatcataataggcgcgtcgtccaggagtgtatacaacgcgctgctgactctggcgacctacgccgtaatttgtcgccacgtaggattggcgtttcggtaccctggaacgaggtacacgtgggagcatttctgtgacatgaccgacgcgggagtgttggcgcagcagcacgtgtgggctgcggttacacccaatgctaagaatcaggcattcaactgcacaaacggcgacgtttttgcgtggaagaccgtgtggaagcttctggctgaattgttcgacgtggagtttgtggcgtttgatgaaagtcacaagtttgatttggctgagctgatgcatgataagggtagcgtctgggaggagattgtggagaaatacgagcttcacaacaccaaattggaggagataacgtgctatgaagccctccaaacagtgctacattttaagtttcaacatgtgtctgccatgaacaagagtagggagcatggattttttgggcatgttgatacgttaaagagtatcagattctgggtgaagaagctaagacagatgaaaatcatgccatcatattaa

SEQ ID NO: 69049 - DNA, 1230 bp, Glycine max
  Peptide Sequence Number=SeqID_160734
atgaccatcgacttggattcgatcgctcgcagagtcgaggttgataatcgcattccaatccgctattactatcggattgccgataacctcctcaagcagagatcgcgagctgtgttggatgagcttgaatctttgaagcctgaatttaaacgccgggtggaaaaaatgaatgactcacatgtaaaagctccattccctgaagaaaatggcttcaataaggctttgcagagttcagtgaattcatctttggaatggccggctgttagtaaacagcctactgctggattcagttcacactcttcatggaattatgataatatgttatctttagattccaggcctattgacaagcagtttcagaaactatctcttagtctaccccctccaaataaggagactttgtccagacactcatttttaggaccaaatggccttcggggccaatggcttggacctagtgctgaaataaagaggggggaaaatgagagaatcgatattgaatactctaaagttgatggacttgatatggttcaatatccaagcagtagtgatctcacacatgccaaggattcaagcctgaatcaggctgggctatatgatcttggggcaattaaagatggcgatcaaggacctgttacatccacaatggactcagttctctccttggatgatggaagttggttgcgtcctgctgttgagtcctgttctcctgttgtaactgaatcaagggaggaccccttacaattgctcaacatcaagcaacctttgccgcctcctgttcttgctcaggtgtacccagaacatgcccctattcctccttcaaaagttgcagatccaaggccaggaccagctaaatcatctcatgattctggacttggttcaactacatatcaacacctacatattcctgtcaaaatgatggaagattttttgagattagcttcggaaaacacacggaagaacttagagacatgtggtgttcttgcaggatccctgatcatgttaccagaggcaattgctattgtcatggcccctacagatactacaagtccacatggcatattccatctgtctgatccgggtggtgtgtctgtcattcgtaactgtcaacaacgtggatttcatccccatgaggagcctgaggatgggactccaatatatgagcactgttcccatgtctatatgaatgctaacttgaagttcgatgttgttgaccttcgagagcgatga

SEQ ID NO: 69050 - DNA, 585 bp, Glycine max
  Peptide Sequence Number=SeqID_160735
atggcagatcttcaagaaaaactggatgctctgaagggtcttgttggtgtgctaaataacatggatgagggtgaaactcacaacaacaatgcaacctcctcacccaataattcccatagtcctgctcctatgcctggaaggaatcgctctgttggaaaatataacaacagtggcactcagaagattaaagtttgtgactgtggcaaatttcaggaattgcgcatgtcttgttctcatgttgttactgcttgtaagcatgctcaccatgagtacaagaactacatgcatcctgccaagaattcaatggcaggtattgcatctggaatcagcacccttgccattggctcaggtgatgctcgacggcgtccagcacaagcccaatccactcccaacactaacactaacacaaacactaacagcaacacttcttcttctacgccatcatctgaagggttcacttatttaaattctgccaagcaagatataaagggtcttaccaaccagactggatacgttaaaggcaacgctaatggggtcatcaactttgggaccctcacagcctctgcttctgtccaaaggcaatga

SEQ ID NO: 69051 - DNA, 1713 bp, Glycine max
  Peptide Sequence Number=SeqID_160736
atgcattcctcgctctctctctcgttctccgcgacctcctcctccgccgccaccgtttccagatcacgacactcattccactctcccgccgtcgccacgcctctcaatctccgcttctgcggcttgaggcgcgaggcatttgcttcaggtctcgctgcttctcgcaaccgccaccactcccacctccctcgccgccctcgctccgccgcagtctctgccgcgctttctagcaatggcatccctcccaaatcgttcgactacgatttgcttattatcggcgccggcgttggcggccacggcgccgcgcttcatgccgtcgagaagggtttgaaaacagctattgtggaaggagatgtggtgggagggacatgtgtgaaccgaggctgtgttccttccaaagctcttttggccgtgagtggtcgtatgcgagaactaaagagcgatcatcacttgaagtcctttggcttacaggtttctgctgccggctatgacagacaaggagtcgctgatcatgctaataatcttgcttcgaaaatccgtaataacttgaccaactcaatgaaagcgcttggagtagacatacttactggttttggaactattctgggtcctcaaaaggtgaaagttggctcctcagacaaaatagtaactgcaaaagatatcatcattgctactggttctgttccatttgttcctaagggcattgaaattgatgggaagactgtgattaccagtgatcacgcactcaaactggaatctgttcctgattggatagcaattgtaggaagtggatatattggtcttgaattcagtgatgtatatacagcacttggaagtgaggttacttttatagaagctttagatcaacttatgcctggatttgatcctgaaattagcaagttggctcagagggtccttataaatccccggaatattgactatcatactggagtttttgcaaccaagatcacgcccgcaagggatgggaaacctgtcttgattgaacttattgatgcaaaaacaaaggagccaaaagacactctggaggtggatgctgcactaatagcaaccggaagggctccgttcacacaaggtcttggattggagaatattgatgtggtaacacagcgtggttttgttcctgtggatgagcgcatgcgagtaatcgatgcaaatggcaagctggtgcctcatttatactgtattggtgatgcaaatggcaagatgatgcttgctcatgctgccagtgcacaaggaatttcagtggttgaacaagtcactggaagagatctcgtgctcaatcatttaagcatcccagctgcttgtttcactcatcctgaaatcagcatggttggattgacagagcctcaagcaagggagaaaggtgaaaaagaggggtttgaagtaagtgttgccaaaacaagttttaaagctaacacaaaggctctagcagaaaacgaaggagagggactagccaagttgatatatagacctgacaatggagagatactaggagttcatatttttggtttgcatgcagcagatctcatccatgaagcatccaatgcaattgcattagggacacgtattcaggacataaaatttgcagttcatgcacatccaactttgtccgaggttcttgatgaactattcaaatcagcaaaggttaaagcacaagcttctagcccagtaagtgaaccagttgctgtctaa

SEQ ID NO: 69052 - DNA, 192 bp, Glycine max
  Peptide Sequence Number=SeqID_160737
atgaagccccctacgattattgtgccaatttcagtaaaggaggatgcagagaagctttttgagattcacaggaaaatggatcaatcagaacttaagcacaacctgattggcttggatgtaggtgtcattgatgatgctgctcactatttcaaggatgcttatgacagtatgattgatagccttttcctgtga

SEQ ID NO: 69053 - DNA, 581 bp, Glycine max
  Peptide Sequence Number=SeqID_160738
atgcttactacagtgtacacggtggtctttattgttggtgatgaagacgaggatgtggaggtcgtagccgggagggtggtacaagaacggagtggaaggaaagctacgaagaagatgagtaaaaaatctgatacagagggtgcacccgtgcaagatcgattcgggtcgaacatggatgggaaatcgccggagaaactaatactggtgaaccgcgagccaaacggcgtcgcactggtgacgattaaccgtcccggttcccttaactcgctgacccggcccatgatggtggacctggcccaggctttcaagaggctcgaccgggacgagttggtgcgggtcattatattaaccgggtcgggccggtcattctgttcgggcgtggatctcacggccgctgaggacgtgttcaagggcgatgtgaaggacccggagagcgatccggtggtgcaaatggagctctgccgcaagccaattatcggagccatcagaggattcgccgtcactgctggcttcgaaattgccctcgcctgtgacatcttggttgctgccaagggatctaagttcatggatactcatgctag

SEQ ID NO: 69054 - DNA, 402 bp, Glycine max
  Peptide Sequence Number=SeqID_160739
atggcgctaaccccgcgcttgattcgattactaatctcgttggtggaagaaagtttgaaggaaaccttgcttccatctgaaaagatcactgaggaagtaggaattggttctattaaatgtttggatgcctatgaattggacagttccatgttcaatgcaaaacctaaggtgttcaactcacaaactgcggcacctcaatataagaagcttatggatgaaataaccaaatatgtcatagaagatctttataagaatactgtgccagaggacttcgatcggtctcatcaagtgcagtctgcaaaaaaccaagtggtgcttctgtggttctgcatttggcttattggagtattggctatatttttcttcatttctgatattcattgcccttacttgaactactaa

SEQ ID NO: 69055 - DNA, 1176 bp, Glycine max
  Peptide Sequence Number=SeqID_160740
tataccccagctatagacatatggagcattggctgcattttcgcagaacttttaactggaaaacctcttttcccagggaagaatgttgtccatcaattggacctcatgactgattttcttggaacaccatctcctgaagccattgctagggtacggaatgagaaagctcggagatacttgtgttgcatgcgtaagaagaagccagttcctttctcccaaaagtttcctaatgtagacccccttgctcttcgtgtgttagaaagaatgctggcatttgaacctaaggatcgacctactgctgaagaggctctagcatatccatattttaaaggcttggccaaggttgagagagaaccttctgctcagccagttaccaagatggaatttgaattcgagagacgtaggataacaaaggaagatgtgcgagagcttatataccgagagattctggagtaccatccaaagatgttaaaagaacatctagagggagaagagccaacaggattcatgtatccaagtgctgtggaccacttcaagaaacaatttgcatatcttgaggagcattatggaaaagctggaactgttactccacccgagaggcaacacgcatcattacctaggccatgtgtgttgtattctgataactcaagacaaaatatggctgaggttgcagatgatatctccaagtgtatcatcaaagaagttgagaagccagccatggacaggactggtggtatcccaatgaccaggcttcctttacaagctcctcaaaatattcaaggtgtgatgactgatcgtattgcttcaggtgttgctgcgcggcccggaaaagttgtaggttcaatattgcattacaacaactgtggggcagcagttacagctgatgctgagcagcggaggatgggtagaaatccatctgtttcagcccagtatgctgctccaagcagttcatatccaagacgaaacccaagctgtaaaagtgagagggcagaagaagtgatcgaaggtgctaatggacttcagactaagcctcaacacataacacaaaaagttgctgctgctgctctagggggacctggtgcatatcaggtttcttggcctacacggaacgcagatcaatcatctgaattgaataaagatatgagaggccatagcatcgacaatatcgaaggatga

SEQ ID NO: 69056 - DNA, 750 bp, Glycine max
  Peptide Sequence Number=SeqID_160741
atggatcttaagagtgccaaggatgaggatactgaagttgatcttgaaagtgggttggttttgacagatgatgagtcaaaggatgtctctactgaagattgtataaaaggtgaagataggtatagtggattctgcaaggagtcaaaattaactgtagtttcaatggacatggtgaaagtgacaaacaagttgtactcagtagaatatgcagagaataataccccagaaaaggagaaacgtaaaaagtccagtaataagaagtctccgaagcctccaagacctccgcgagctccatcgttggatgctgctgaccaaaagctaatcagggagatcactgaacttgccatgttaaagcgtgcgaggatagagcgaatgaaagccttgaagaagatgaaagttgctaaggcatcatcatcttccagtagcagcatgcttgctacggttttcactgttgtcttctgtattgtgatattactccaaggcatgtcatctggaaaaagttcagtgacaagtttccagggatcacctgtacctgcaggactaatggagggtggtctgattgatgttcaacaccaactcaatccatcttcaagtgacccaaatgcacctagtttagagcctcacaaaattgtacagcaggtcactggtttagatttgcctgcaaaactgagaagaggtgcagttacctcctcagcaacttcttgttgcatacacgttgaaattcagagtcggaggagattttgcttttga

SEQ ID NO: 69057 - DNA, 763 bp, Glycine max
  Peptide Sequence Number=SeqID_160742
atggaatctagtgcggtgtggctgtcggagaaaaagataacaaactgcggaggagtgacggttgcgaaagcaagactgtatcggaggagcgacgacaacagagggagtggttgggaaaggtcgctgatctatggtggtgcgatggttttgtgggtggtggtatggcatggtgaagtcgcgcatggttatggattagatgcttttgctccagggttagcccagggaggaccccctcccattggaggccaaaaggccaatctggatcccctcacagaagacttaaccttgcagagtggtttagctctaattggacgtttgagggctataaagcgcgcagtaaaaggtttccctaggccattaataaatctaaacaaggaattatttgctcaaattgtcgatcaagcctttggacaacctttgaatccaccttttgatccctatgccaattccttgaactaccaacttgcggcttacataactactgtagttggccccaatatatatgttggaatcattccaaagcttcaaaataccgagtccaaagaactttttgctggccttctaggaacagcaagtggcggtcgaacaagtcgtcgagcatatctatacgaacgttgggactcgccggtgccaccatataaagtgactgtggcagagttcacaaatcgcatttcagaacgagcgaataagctaggaatggaaggaatcaaaagtgagggtattgtagtatctccatggaatggtgctgaaggcaaagtttcag

SEQ ID NO: 69058 - DNA, 1926 bp, Glycine max
  Peptide Sequence Number=SeqID_160743
atgacggtggtcggactcttcctcaccgccacgaagctcgccggagctcttttcactctcaccgtcgccgccaacgccttctcctactcccgctttcgcaagaagaaccttcgccgtttccgctcccccatcgacgaatcccaagacactctcgcacactttaacatcgccggggaagatgagtttttctttggtttggcgacagcgccagcacatgttgaggacaggcttgatgatgcttggatccagtttgctgagaaaaagagaggtggaggtggtggtgactcagaggggaagcagagagtggatgctgtgattggttctgcttctggtgatggtgggtcccagcaggccataacatctccgcggagcaggaagcctcttaaggtggcgatggaggccatgattaggggaattgagaagtacatggaagtggaagtgcaagaaggagaagaagaagcccgtcctaatgtaactgcttggcataatgttccacgcccggaggagaggttaaggttttggtctgatcctgaaacagaaataaaattggccaaggatactggtgttacagtttttcgcatgggaatagattggacaagaatcatgccaatggagccagtaaacagccttaatgaatctgttaactatgctgcattggaacggtataagtggattataaatagggttcgatcatatggaatgaaagtgatgctcactctttttcatcactcacttccaccctgggctggtgagtatggaggttggaagctggaaaagacagtggattatttcatggactttaccaggcttgttgtagacagtgtctcagatttggtagactattgggtaacatttaatgagccccatgtcttctgtatgcttacttattgtgctggagcttggcctggtggtcatcctgatatgcttgaggctgctacttctgcacttccaactggtgttttccagcaggccatgcattggatgtctattgcacactcaaaggcatatgactacatccatgggctaagtaacccattaaattcaatagtcggtgtagcacatcatgtgtcattcatgcgaccctatggtttgtttgatattgctgctgtttcactggctaattcgttgactctcttcccatacattgatgacatatctgagaagctggactatataggcataaactactatgggcaggaagtggtttcgggtgcaggcctgaagctggtggaaaatgatgagtatagcgaatcaggtcgtggggtataccctgatggcttataccgtatgttgcttcagtaccatgaaagatacaaacatctaaatattcctttcatcattactgaaaatggggtttcagatgagacagatttgatccgccggccatatctcttggagcatttgcttgctatttatgctgccatgatcatgggtgtgcgtgtacttggttacctgttctggactatttctgataactgggagtgggccgatgggtatggtcccaagtttggacttgtcgcagttgaccgggcaaataatcttgcacggatccctcgcccctcttaccatctattttctaaaattgtgaatacaggcaaagttacacgtgaagatcgtgaaagagcatgggatgaacttcaaagatctgcgaaagagaagaaaacaaggccattttatcgggctgtggataaacactgtttaatgtatgcagttgttgagcgagaggaatttagaagatttatgatgaagttaagcacgcttaagcgtgacatgctatgtgttaagcgagccaagtcagagaacaaaattggattcactgaaagtccttgcttaagcccaaaccttgaggtgcttaagcaaaacaatcaagtcaatggaagcacacaagaacctcgcttaagcgtgacattctgtgcttttaagtga

SEQ ID NO: 69059 - DNA, 703 bp, Glycine max
  Peptide Sequence Number=SeqID_160744
ctctacattgagtgcatacacagaagcagtgagggagctggcatgtgagatattggaactaatagcagagggcttgggggtcccggacactagggcattcagcaggttcataagggatgttgatagtgactcagttctcaggctcaatcactacccacctataattaacaaggacaaggacaaggacatgtcacaatatagcaaggttggttttggagagcattctgaccctcagatcataaccattctcagatccaacgacgtgggtggcctccaaatttcccttcaagatggggtgtggatcccagttacccctgacccctcagcattctatgtgaacgtgggtgatgtactagagcatgatgacaagtttggtacaagagttggaacaaaaatggaagtgattgatatggtgttgtgtggtgttaacaaggttatgacaaatggaagatttgtaagcgtgagacacagggctatgacgaactcatacaagtgtagaatgtcagtggcatattttggggctccacccctccatgctaccattgttgctccctcagttatggtcacaccccagaggccctctctctttcgaccattcacttgggccgactacaagaaagccacctactctctcaggcttggagacacacgcattcagcttttcacaaatagactaaccactaatcaccacccaaaagtctag

SEQ ID NO: 69060 - DNA, 792 bp, Glycine max
  Peptide Sequence Number=SeqID_160745
atgccttcttctgtgaaggttaatcacgggggtaatttcattcgtaaccccattttgaagtatgttggtggagaaaaagccttattgcttgacatagatgaggacaagtggtccttctttgaattgattggaattttgaaggacgacgtcaactacaaaggtgactttaatctatggtggacaggggttcatgatgttggtctaaaagagttggcccttgataatgatgctcttgagttggcaaatttttcattgagtaacaaccctgaaacacttgatgatggggatgaagttgttggggttgaagttgttgttagtgagtttgattctagtgatactgagtctaatgaaagtggttctgaaagtgggtttgacaatgataatgaaggtgttgtttttgaagatagtgaagaggagagagaaattagggttaatgatggttttgatagtgaggatgaatgtttagttaacctcgtttcaaagaaaaaatgtagaaaagcttcttgtgttggatctagtggtagtcatcggaatgttgaagaaggaaatggttttgaatttgatgaagacaaacataagtttgtcagatacaggaaaagcaaagtagagattttgagttcaagattggtgttgaaaattgctgcaaagaagttaaagtccaacgatgatgtcaaattgacacacataatggatgttgtgagattgaaatatggtattggtataactttggttgttgcttgggaagctaggatgattgctaaagcaagaatggatggggatgctgtcagatag

SEQ ID NO: 69061 - DNA, 269 bp, Glycine max
  Peptide Sequence Number=SeqID_160746
atggcattagaagagaggaaggtgaagatcgagaagttcgatggcagagatttcagcttttggaagatgcagatagaggattatctatatcagaagaagttgtatcagcccttatcaggggttaagccagaagacatgaagcaagaagaatggaacttgctagatcgacaggctcttggcgtgatcagattgacattagccaagaacgtcgcgttcaacatcgtgaacgagaagactactgtaggcttaatgaagtcattatcagatat

SEQ ID NO: 69062 - DNA, 1374 bp, Glycine max
  Peptide Sequence Number=SeqID_160747
atgcaaaaacaagatgtagcgtacttgaatgcacaaaagaagatttggttactaatggggagaaaggaagataaactagtttcgtgggaaaaatatatttatcccaatatattggagaaatcaaatattgctgctgagaaggccaccttgttttctcagttacaatccacaactgaaaagttggagaagctctcagaaaagagcaacctattggaaaattcactatttgatgtgaatgctgaacttgaagggttaagggtaaagtccaaggtattagaagacacatgccgatcacttgaccatgagaagtccagtatctgtcaagagaaagaaaccttagtttcacagttgaacataactcatcaaacactgaaagatcttgagaaactgcacagtgaattggaattgaagcatttggaactaaaaggagaaagggagtctgcacttcaaaaggtagaagagctactagtttccctatattctgagagggaagagaattccaaagttttgaaattgaatgaagatgaattggctgagaaggagttacaaattcttattctacaagaagatgcaaattgcaagaaaaaggaatatgaggaggaagtggacagagctatacatgctcaacttgaaattttcatcttgcagaaatgtattgatgatttcgagaaaaagaacctctcccttctagttgagtgtcagagacttttggaggcttccaaaatgtctgacaaaatgatatctaaattggagactgaaaatgttcaaaagcatgttgatgtgaattctctgtctgagaaaattaaaatactaaggattggcttgattcaggtgttgaagactcttgacaataacagtgggcatttcggtgaggatatgcttgaagaagaccaaatgctcctgaaccacatatatggaaaacttcaggagaggcagaaatcttttgacacaattttcaatggaagccaacaaatggccattgagaattcaattctgattgcattcctagagaagttgaaactaaaggtggaaaatcttgtaagaaaaatagcagaaaacataaaaatcagtacattgaataataaaaaagaagttcaatataataagactaccaagattgaggagctaagcgatcagttgataccagttcctgagccagcaaatctctttcttcatgaaacttcaacccaggaacttggagcgtcaagtcgacctcgtccagttcaatggaagaaggctacaatgtcgaagagaagaggttcaatgttgaatgtcaaagaaaggaccaagcagaaatgggaagaaacatgcgctagggttcaaagaaaggacaagcagaaacacaggctagggttcaaggaaaggagttcgtag

SEQ ID NO: 69063 - DNA, 1514 bp, Glycine max
  Peptide Sequence Number=SeqID_160748
atggttagaacaagaggtttacatcgttcattaggtaggggtataggcagagcctggggtggactggatgagcatcatccagatgatgttccccgacgaagtaggcctaccgcatccgtccgcaggcaacaggtacgtgtttctgttcctgaggaggttgctgatatgactaaggatgttcctcagatgactacgggcgtacctgcagctggtgtagagggcttagttgctgatgatgttgttgtaggatcagttgctgatgatgctgagggattcccaggtgggccacgtgacccatcagtgctgacttcgtttcctaatcatgttgcacacaacatatggactagagatgaacgtcctgacatgaagttggcctcccacggtaggaaggttgagaaaattgggagaccaacacctaagatcgaagggctagtcgctgccataggattaagccctttgatcgggcgcttagtagtaaccggcgatctgggacttatatctgcacttgtggagagcttccaccttctaatgggacagttgacgatcacattggatgatgtggcgtcactcctccatctgccgatcacgggcgccttgcatagcttcgagcctctagttgtggaggaggcggtcgtattgttgatgaagttgctcgaggtcttgggtcaagaggctagagttgagactgcacaggcgtgtagggcatatgtacgcctgtcatgggtacgggatatctatcagagtagatgcgaggcccgatggtggagtctaccagcttgtgcttatctcctccacttggttggttgcactcttttcggtaacaagagtgcaacacatgtccatgtagtgcatctggaggcttttcgagacatgggtgagagtggaagtgctggatatatgtgcactttcctagtgttcatgactgcgtcactgacgatgcgtacgatgagacatccccacgtgcctaccgcaccggcgtaccaaacacgtttagatgctttgacgatcactgacgtgccctggatgccctatggtgaccaccgaggagttaagggggttgagctcattttgtgcttccagggccaggttagatggggtcctattgtggtcatagttcgaccagatagggtgatacgacaattcgggtacattcagaccattcctccaccgcctgttagtgcctccttgtcatatgaggatatcaacgacaaatggatgcattatgaggaccatatagcagatgggggtgagatttttgttgtgcctgggcaggtatcagcagattacatggagtggttctttcggatatctcatccgttcgtcacacccacacaggcagcgatcgcagaaaggttggagcgtgtgctcagcctaaggatggtcactaaaggcacaaagttacatgagatcgtagaagattgcctcaggattgctagaggggtgacagctcaaatgaaaatgttagggcgcgacgaagacgatgcacagatcattgatagatcattttatgtctt

SEQ ID NO: 69064 - DNA, 711 bp, Glycine max
  Peptide Sequence Number=SeqID_160749
atggatgcatctgtcatagctgaatatgaccccaaaagtgatttattggatcaggagttcatgctgaaagggaaatggtatcaacggaaggatgtagagataaaaaacagtcgtggtgatgttcttcaatgcagccattacttgcctataggttgtgctgactgggtgaaatgcttgtatgacagtggatgtagggctgatgctagtgaagctgctataattttacttccctcaaacattacagtttttactctggatttttcgggttctggaatttctggaggggagcatgtcactctaggctggaatgaaaaggatgatctgaaggctgtggtaaactatttgcgggatgatggaaatgtctctttgattggcttgtggggtcgctcaatgggagctgtaactagccttatgtatggagctgaggatccttccattgcagggatggttttagacagtcccttttctgatttggttgatttgatgatggaacttgtagatacatataaagttcgtctgccaaagttcactgtgaagtttgcaatccagtacatgcgaagagcgatccaaaagaaggcaaaatttgacataatggacctcaataccattaaggtggcaaaatcttgttttgttccagctctactagggcatgccattgatgatgattttatacagccccatcattctgatcggatatttgaggcttacatg

SEQ ID NO: 69065 - DNA, 96 bp, Glycine max
  Peptide Sequence Number=SeqID_160750
atggagcctttgaaagttcggaagttcgggttttgggtggatggagtagctgttagcagtaagtcagtggaggcatattacaaggaggtattctag

SEQ ID NO: 69066 - DNA, 402 bp, Glycine max
  Peptide Sequence Number=SeqID_160751
atggcagtgaccaccgtaccagagggagacagagagcagcggggaggtaaggatgggggagcggagcagatcgttgcgaacataggcgaaggaacatatggtgttgtttacaagggtcgcgaccacatctccaacgagaccatcacattgaagaagattcgcaggggctattatcctaacacaaatgtttcagattttgagagtgttcgtattttggtgtggggagaagtggtttcatcattgtcgaaaaatccaacagcagtggaggcaagggccatgttcaagaaattcatccgcaaattcgaggaagcgtatcagaaacataactcatttgtcactgacacaacttctatcttattagaagctattgggtacattagattccttcagagtcaaattgag

SEQ ID NO: 69067 - DNA, 147 bp, Glycine max
  Peptide Sequence Number=SeqID_160752
atgtcagtgaaaaacctcgtcgggcgcctaggagtacatgacaagacaaaccacacactaggagacaagtcagggtcacgctgttttacgagaatgctccaaccatgtgcactattagaaaatacactttcaacatcggttatttag

SEQ ID NO: 69068 - DNA, 180 bp, Glycine max
  Peptide Sequence Number=SeqID_160753
atggggttggtggatagttcccttgttcccagctctgctctttctctctctccctgtttctccttgaagataatgaggccgcacatggaaaaaataaagcaagagatagaggataaggctatggatcctgtagctgttgctgaaggtcagaaaaggatgaagaagctatttaaggagtaa

SEQ ID NO: 69069 - DNA, 183 bp, Glycine max
  Peptide Sequence Number=SeqID_160754
atgggtaacggaattggtggtggtagtaagtggtggtggtgcggtggtggtataaaaagtgatgttggttgcgcagtattagtggtagttgcaatgactttggacaaaggtgatattggtggtggatgtggtggaaatggttgtggtagtcgcaatgataatgatggtagtagtggacaatga

SEQ ID NO: 69070 - DNA, 150 bp, Glycine max
  Peptide Sequence Number=SeqID_160755
atggccagccattctacatctcttattaatggcattcccatcaatgaggcatctaaccttgggtggcagcagcctcagatatggcacacatcagtggacaaactattgctagttgttcctgctgcagtggtttccattgctggaaactag

SEQ ID NO: 69071 - DNA, 261 bp, Glycine max
  Peptide Sequence Number=SeqID_160756
atggagaagagagtgcgagagggtacacggagaagaagaaagcgtgagagggtaaacggagaagaagagagcgcgagcaaaatagtctgtgacttgaatgttgttggactagatttgattaatgaaatgtcaataacaagctataaatgtatacgaagcataattaagtttacggttttgggtcccaaaaggagattatgcaatataaatttaggacacggaggactctctttcaagagggtcaagacaagccaagaataa

SEQ ID NO: 69072 - DNA, 228 bp, Glycine max
  Peptide Sequence Number=SeqID_160757
atgagaaatgctaatttgcatgataatgatttcgtgaaatttgcagaagaagcgatgatgaaaaagcggagaggggacagaagagcgtgcctttgtgatttccaggataaacagctttacgagactgcatgcgggatcgggtcacgatttcatatcgctatcggcgcgttggtgacgcactgcggggtggaactctacggtggaggctgtgagcgctggggtgcatga

SEQ ID NO: 69073 - DNA, 369 bp, Glycine max
  Peptide Sequence Number=SeqID_160758
atggcgaaaccagcttttttttttcttttccttcacgaatctcgccagaccaactggcggatccacgtggatcagcagcatcagcaattccaccactttgactggcgaaaactgcataatgatggatgcgctgatggatgcttggataaaaaaacatgtgggcatggggtatctcgccaatgggagtggcggaaccccatgcatgaagaatccgcttttgatgttggcggaatccgctattgcatacttgtattgtacgggaaagtaaactctcgcagacaaacaggacaaggaagaaacagagagaagggtacagggaaggcagtgagggtcacgcagcagaatgatgcttgggcacgagaggaatga

SEQ ID NO: 69074 - DNA, 7137 bp, Glycine max
  Peptide Sequence Number=SeqID_160759
atgggttgtgtccatggcaagtcttgctgtggcgacagttcttcatcagatgatggttctagggattaccgagaacttggcttcattcatggccacaggaagaacgtgctcgctcagagatcattgaagcatgttcctgttccttcccacaacttcattttggagtacactttcctcagtcagcgggggtactaccctgattcacctgataaagaaaaccaagatagtttctgcatcactacacaactccaaggtaaccccaatgtccatttctttggtgtctatgatgggcatggccaatttggtagccagtgttcgaattttgttaagcataggctggttgagaagttgtcaaatgaccctgcattgttggaggaccctgttcaggcttacaattctgcattcttggcaacaaatcaagaattgcgtagtactagtgagattgatgattctatgagtggcaccaccgcgattacggtgcttgttattggtgacactctttatgttgctaatgttggtgattcaagagcggtgctggctgttagggatgggaatcacattgttgccgaggacttgtcctctgatcagacgccatttcggagggatgaatatgagagagtgaaactttgtggggcaagggtgttgagtgttgatcaagtggaagggctaaaggatccagatatccagcattggggtgatgaagagagtcggggtggcgatcctccaagattgtgggttcctaatgggatgtatcctggaactgcatttacaaggagtataggggatagtttggcagagacaattggtgtcattgctattccggaggtgaaaacggttcagcttacacctaatcatcttttctttgttgtggcaagtgatggcatatttgaattcctgacaagccaaactgttgttgatatggcagcaagctatatggatcctcgtgatgcatgttcagctattgcagagaagtcgtataaactatggttggaacttgagaacagaacagatgatataacaatcatcattgttcagatcaaaggtctctctaattcaggtacatctggagttggatccgatgagatcaatggtgggggtactgtaatgaattccaggacaggaactcatgagatatctgctacccctggatctaatgtttatcgttctgtcagaaacagtttatccgatttgcactcctgtcagcatgtggcttcagtgacgagcgcagcgatagagagaggctttactgaagcttcatcaagtctctttgcagtttctcccaagtggtacatttccacgttccaacttcctgagcattgtgcattactgttgtacatttactggtcactacattttaggctgccaacttgccagcttaagaaaccaaacccctcagaggagaacacttgtgctcaccttcctgtgacgcaattgcacctccactctacagatttgatctttggaaggggaatcaataacgagcttgaaataaaaggaaggtggtatacaaggagctgtgactgtgactatcatttgcaatggatcgttgaagaaactcataggatggtcgatgctaaaatgatttcattggttgccagttgtagcagtcaaatgtctccttcagtttcttgtcaagaaaaaggaagtaggaacaaaagaaaattcagagttgatccacctctaggggagccaaataagttcattcctgcacctcaactcaagtgcttcagttatgaattctctgctgagaggtttgaaataaccccaggtcatggacaagctgctgcttgtgacctgtgtggtgttagccaagattattctgatggattgaaacttggccttggattgtataatcctggaacatctgaggtcgggcctagtcaatctaaggacgaacctgagacagatgaaattaatgatgcagattggagcgatctcacagaagcccagctggaagaacttgtcctgactaatttggacaccattctcaagagtgcaattaaaaaaattgtagcatgcggctacactgaagacgttgctactaaggccattttaagacctggcatctgttatggatgtaaagatactttgtctaatattgttgataattctttagcatttcttagaaatggtcaagagattgatacatcacgagagcactattttgaagatctagtgcagcttgagaagtataacttggctgaattggtttgtgttcttcgagaggttaggccattcttcagtgttggggatgcaatgtggtgtttgttaatttgtgacatgaatgtgtcacatgcttgtgcaatggattgtaaccctttaagtagtttaggtaatgataattctactggtggtccatctaaccaagctgaatcactatcaaaagcagaaaccaaatgtcctgaaccgagtcttataagtcctagtaaatcaattcctacatgttctcataattctcaatcaaagaaaccctttgtgacaagaattcctggtgtgaacaacttgaatcctcaaattattggtggagcctcagagaaggagggtgccagttgtggatctgagtgcattaataaagcattcagcgctgcaggaacatctcaatctggcctgatgaaagaaaagcgtggaacagttagaaaggtccattctggtagcaccaagagagactacattcttcaacacaagtcatttcacaaagaaaaaagttatcgtacttatggattaaaagggtcttcaagacgaggaaaagtgaatggcttgagtggtttggtcttggataaaaaacttaaatctgtgtcagaatcttctaccataaacttaaagagtgcatccttacagataagtaaggcagtgggcattgatactacgcaagacagtattagtgttaacttttcatgtaatgctgggacttctacatccactgcatttagcctggtgaattcttctgattctgtttgtagatcaaccaatacttcatttgcaataaatgcagcaaatactatacccgtattcagttgtccagcttcattatcagctaccaatacagatctttctctctcattgtcttcaaaaatcaagccttctacggaatctgtctgcagcaataatgaggcacctaatagtagttatatgggaatactgtataataataataataataataagtccccaaggcagtggataccccacgatggaaaggatgagatgattttaaaactgcttccaagggttcgggagctgcaaaaccagcttcaagaatggacagagtgggctaatcagaaggtcatgcaagctgctcgtcgtctgagtaaggaaaaggctgagcttcagacactaaggcaagagaaagaggaagttgaacgtctaaaaaaagagaagcaatctctagaggaaaataccttgaagaagctttctgagatggaaaatgccctgtgtaaagttagtgggcaggtagagcgagctaatgccactgtccggaagctcgaggtggagaaggctgcactgaggaaagaggtggaggctgctaagatacgtgccacagaaactgctgcaagctgtcaagaggtctcaaggagagaaaagaagacacaaatgaagtttcagtcatgggaaaagcagaaatccttgtttcaggaagagctaacgattgaaaaacggaaattggcacagctgctgcaggaattagaacaagctagaatgcagcaggagcaagttgagggtagatggcagcaggaagcaaaggcaaaggaagagtttatcctgcaggccagttctataaaaaaggaaagagaacaaattgaggaatcaggaaaatccaaggaggatgcgatcaaattaaaagcagagaggaatcggcaaatgtacagagatgacatccataaacttgaaaaggaaatttcccaactaagactgaagactgactcttcaaaaattgctgcactgaggatgggcattgatggatgctatgccagcaaatgcttggacatgaaaaatggcactgctcagaaggaaccccgggcttctttcatctcagagctagtcattgaccactcagcgacaggtggtgtgaaacgggaacaagaatgtgtgatgtgcctttcagaggagatgtctgttctgttcatgccatgtgctcatcaggttgtttgcaaaacatgtaatgagctccatgagaagcagggtatgcaagattgcccttcttgcaggagccctatccaacagcgtattgctaaggaagatagatcagagatgtcttccatagtgaaaggcatattcataaggagcacagcggatgtgtgcaacaatagcatccttttgaatgggaagaacaagcacagcgaaattgttgggggaagaagcacaagagtgcagtggcagttgcgtcttagatctaaatcaaacacatggaagagaggtagtaggagatcatatcagcctccaatacgtggccaagccatccttaccccagcaacaccatctaccaccaaaaaggtattcacttttggcaaaggtagaagtgaaggaaacaaggccatgaagtccttgttgggaggaaaaggagcaaacctggcagaaatggcaaccattggcttatctgttcctcctggactcactatatcaacagaagcatgccaagagtatcaacagaatggaaagaagctaccagatggcttgtgggaggaggtacttgaaggcttgcaatttgtagagaatgaaatgggagccactcttgggaatccttcgaaaccccttctcctctctgtgcgctctggtgctgcgatttccatgcctgggatgatggacacagttctcaacttaggattgaatgatgaagtggttgctgggttggcagcaaaaagcggagagcggtttgcttatgattcttatagacgtttcttagacatgtttggagatgttgtaatggacattccacactcgttatttgaggagaagttagaaaagctaaagcatacaaaaggaattaaacttgacactgatctagcagcctatgatctcaaagatctagttgagcagtacaagaatgtctaccttgaagccaggggagaaaagtttccctcagatccaaagaagcagttagaacttgctgtgaaagctgtttttaattcttgggatagcccaagggctattaagtatcggagcattaatcaaataactgggctaaagggaactgctgtaaacattcaatccatggtgtttggtaacatggggaacacttcaggaactggcgtccttttcactagaaatccaagcactggtgaaaacaaactttatggcgaatttctaattaatgctcagggagaggatgtagttgctggaatcaggacacctgaagatttggaggttatgaaaacttgcatgccagaagcttataaggaacttgaggagaactgtgaaattctagagaaacattacaaggatatgatggatattgaattcactgtccaagaaaataggttgtggatgttgcaatgtcgaagcggaaaacgtaccggtaaaggtgcattcaaaatagctgtagatatggttgatgaggggcttgttgatattcgttctgcaatcaagatggtagagccacagcatcttgatcaacttctccacccacaggatccatctacttacaaggataaagtgatcgccattggtttgcctgcatcccctggagccgcagtagggcaggttgtgttcactgctgatgatgctgaagaatggcatgcacaaggaaagagtgtcatcttggtgaggaatgagactagtccagaggatgttgggggtatgcatgcagctactggaatcttgactgctagaggtggcatgacatctcatgctgctgttgtagcccgtggatggggaaagtgttgtgtgtctggttgctctgatatccttgtaaatgatgctgagaaggtgtttgtagttggggataaggtgataacggaaggagaatgggtctcactgaatggatctacaggtgaggtgatactaggaaagcagccactttctcctccggctctaagtgatgatttagaaactttcatgtcttgggctgatgaaataaggcatctgaaggttatggcgaatgctgacacacctgaagatgcagtaacagctagacaaaatggtgcccaaggaattggactttgcaggacagaacatatggtacaaataaacattcaactccttgttatatcaatgagaagtgtggataacgagaggataaaggccgttagaatgatgataatggcagttacaccagagcagaggaaggctgcactggacctgttgctaccttatcaaagatcagattttgaggggatcttccgtgcaatggatggtctcccagtaacaattcgattgttagaccctccacttcatgaatttcttccagagggtgacctggaacacattgtcagtgaactaacttctgagacaggaatgaaagaagaagaaatcttctcgaggatagaaaaattatcagaagtgaatcccatgcttggttttcgtggctgcaggctgggaatttcatacccagaactgactgagatgcaggcccgtgcaatctttcaggctgctgtttcagtgagtaaccatggtattacagttcttccggagataatggttccacttatcggtacacctcaggagttaaggcatcaagtgaatttaataaggaatgttgctgataaagtgttgtctgagatgggttcttctttaagctataaggttggaactatgattgaagttccaagggctgcactagttgcagatgagattgcaaaggaagcagaattcttttcgtttggaaccaatgaccttactcaaatgacatttggatatagtagagatgatgttggcaaatttcttcctatatacctatccagtgggattctgcagcatgatccattcgaggtacttgaccaaaaaggtgtgggtcaactaatcaagatttgcacagagaagggtcgtgctgctagaccaaacttgaaggttggaatatgtggggagcatggtggggagccttcttcagttgcattctttgctgaaatcggacttgactatgtttcatgttctccttttagggttccaattgctaggcttgcagcagcacaagttgcagtttag

SEQ ID NO: 69075 - DNA, 1824 bp, Glycine max
  Peptide Sequence Number=SeqID_160760
atgctggaagaagaggaaaaaagtggaaagaaaacaaaggtaattgggaccaatacaacaactactactactactacctctaaccgtgccgtttgtcaggtgcaagattgtagggctgatcttagtaatgccaaggattaccaccgtcggcataaggtttgtgatgttcattctaaggccactatgggactagtgggaaatgttatgcaacgtttctgtcaacagtgtagcaggtttcatgttcttcaagagtttgatgaagggaagagaagttgtcgaaggcgtttggcaggccacaataggaggaggagaaaaactcatcctgatgtctctgttgttaatgaaggctctctgaacgatcaaagggacagtaactatctgctgatgagtctgttacggatactgaccaatttgcattccaatggctcagatcatacaaggaaccaagatattctctctcatctgctgaagaacctggcaagtctggctggtccaaataatggtggaaggttagcacccttactggaggaatctaaaggcttggtaaatgctgggacgcatggagctgatcatgataaacccaaccttaactcaaatgctcctgaagcttccaggccttcttcttccatcaagacagacaatggcatcatcgctcaggaccctccaatgtcggtggtgcagtatgaaacacctgctaatggcatgacacaaaaatgtatagcttcaggtgatggagtaggaaatttaaaacctccttcaggaccactgctctcaaatgtatgtgaaccaagggacagcgttccatcccaattaactacagcagagactaaagtaggaaggggaaacttgaataacattgaccttaataatgtttacaatgatatacagaatactgttgagaatcataagaagccttatcctcctgtggcttcagggatggggtttattgaccatgcctcatggttgcaatgtgattctctcaaatcaagtcctccacagacaagtagaaactcagattcaacctctacccaatcaccatctagttccagtggagaagctcagatatctttactgataaagatactattttgccaaggtcatcatttgaagtccccttttcagagtcgcacagatcgaattgtttttaaactctttggcaaggatccatctgattttccccttcttctccgatcacagattctcaactggttatcccgcagtcccacggagatagagagctatataaggccaggttgtatcatattaacaatatatctccgtcttgaaaaatctgcatgggaggagctctactgtaatctaggatcaagcttgagaaagcttcttgctgcatcaaatgattcattttggagaacaggatgggtatatgcaagggtgcagcacgctgtagctttcctgtataacggtcaggtagtcttagatgtgcccttgcgtctcaaaagcccacaacattgtatgatttcatgcattaatccacttgctgttcctgcaagtgctagtgctcagtttattgtgaaaggtttcaacctttcccaatctagcacaagcccagatgttgatctgttgctaatgatttccaggttgcactgtgcacttgaagggaagtatctggtacatgctagttgtcatgatttgataggtggagctgatgcacccattcagcatctaagcttctcttgtcaaataccaagtgtaactgggagggggtttattgaggtagtatcaattcatcatactccaaaaattgtatgctgtaaaattcctgaaactaacagaagaacacaaagctctggtgcttgcttctga

SEQ ID NO: 69076 - DNA, 150 bp, Glycine max
  Peptide Sequence Number=SeqID_160761
atgactgtgagggaaacacttgatttctcagcacgttgtcaaggcgtaggaagccactccgaacttctgatggaaatcagtagaaaggagaaagaggcaggaatagtcccagaccctgatttagatgcatatatggtcacgcaaacatga

SEQ ID NO: 69077 - DNA, 1326 bp, Glycine max
  Peptide Sequence Number=SeqID_160762
atggcggaggaccttactcatatcgctcagttgctcgaccaaaccctcagccccgacgctaccgccgtccgcactgccaccgccgcactcgatctcatctccctcactccgcacttccctttctacctcctttccatttccaccggtggaggaaatcaaggtcagaaaatcgctgctgctacctatctcaagaacctcactcgtcgcactgtcgatagtaccggcgtcaagccttccaatgtgagcaaggagttcaaggagcagctgatgcaagcgttgcttcaagtcgagttgtccgttctcaaaattttagtcgaagtgttccgtgccattgctgctgctgattttgttaagcagaatttgtggccggagcttgtgcctaatttgcagtctgctattcagaatagccatcttaccagtggttcgaataccaaatggagtactgtaaatgcacttcttgttctccatgctcttctcagacctttccagtattttttgaatcctaaagttgctaaggagccggtaccaccacaattggagcttatatccaaagaagttcttgtgcctttgcttgctgttttccatcaatttgttgaaaaggctttagcaacccatggcatagcagaaaaagaaactgagaaagtcctcctcactatatgcaaatgcctacattttgcagtgaagtcctacatgccatcaactttggctcctctactgccttcattctgtcgggacctaatgagcattttgagctctctgagctttgatagtattgtcaatcaagaagatgaatatttgacaagattgaagactggaaaaagaagtctgcttatcttctctgcccttaaacttcctttcctttcagagaggctattgtccctaggttttgatgtaatttcaaatatactggagactgggccgggatggcgattagtttctccacattttacgactctattggaatctgcaatctttccagcattagtcatgaatgacaaggacatgtcagagtgggaagaagacccagatgagtatatacaaaagaatcttccttcagatataggtgaaatttctggatggagagaggatttattcacagctagaaaaagtgcagtaaacttacttggtgttatttcactgtcaaagggtccaccaatggagactgccactgacagtttatcttcatccaagcgtaaaaaaggtcaaaagaacaaaaaaagcaatcaacgccgctctatgggggagttattggtgcttccatttttgtccaagtttcccattccttccgcttccaacttgtctcaaaagaaaatcttgaatgagtga

SEQ ID NO: 69078 - DNA, 732 bp, Glycine max
  Peptide Sequence Number=SeqID_160763
atggtaatctatgacccttcaatgtccacctgctccattctccaacctcaccacgacttcgaaatgacccaagttcaatccgccataatccccccatcacaggacacagttttcgtgctgctaaactgctccatagactctcccgttctaaaccactacaagtacctctgcttcaacttcgccggtcacacgtgtgacgagctttatggttcgtgcaacgccttcagggtctttcatttgctgacaaacagttctccaccgtgttgtttcaccagttatagcaccgtgaagttcatgagcatgaacatattggactgcacgcactataccagtgtgtttaacacggataatttgaagggtgttggccctttggactgggtttatgggatcaagctttctttcagtgtgcctgatactggatgtcaaagttgcaaagaatctggtgggacatgtggctttgatactgatacggaaggtttgctttgtctttgctcaagtttcgctaattcaacaagggaatgtgctgctggaagcataatatcaaaaggacagaacaatgctccttggacacacttcctactggttttgcttgttgtagctaattttctcacgaaagtgaggctctcgcaaggttgttcacaactctccaatgatgcaaaatggcttacagaaaacagaagagaaacgtcatcttcatttctgtatgttgttcacagtgggcattacaaatga

SEQ ID NO: 69079 - DNA, 1881 bp, Glycine max
  Peptide Sequence Number=SeqID_160764
atggctggtaggcaagtccttgatgtgccctcaacaaatgttggtggttccgcattttgtattgctgtaagcaccaggggaatggacattcaaaaggctctggaatcttctagcacatggatcttagcttttcgagaagaggagaaggctagctggtttaaaggacttgtacaagccacatatcaagcttctactcctccatcagttgatgtgctaggtgactcagagggcaatgctacttcctacaatgttcttagtaccccaaatacaaaaacagctgacattgttataaatggggcactggtggaattgaagttgtttatatatggaaaggttggggataccataaatggaaagcttgatgagtctctcattcttgaagttgttgcggatgggggaaaggtccatgtccttcttgcagatggcgacttgacagtgaagatgaaattgcattctttaaaaattaaggatgaacttcagggtcgtctatctgtagctccgcgttatcttgctgtttctgtcttgcagagtgaaacttcatcctctgacatgtatgattcccatgggaaggaagtgtctcatgatgatgatgacagctttacggatgcattatctgaattcatttctcaaactgatggaggatattgtttacataatatggatttggatcatcagggattggtggggattgcttctgatttcgagtctctagaaaacataatgcatgaaaagggcactcctcgtgaggtatattatgaggcacagggaagtgatacttcaaattttgtatctgtctcctttacaacaagaagttcttgttcacctgattatgatggcatagatacacagatgtgtgttcgtatgtccaaactggaatttttctgcaaccgaccgactattgttgctttgataagttttggtttggatataagctctggaaataaagtgacaagtcccacggacactttggcaacttcttcagagaaacttgtggtaaaggagagaactgatgaagaggggcccgttagtggattgttgggatttggtaaagaacgtgtagtattttatttgaacatgaatgtggacagtgtaactatttttcttaacaaggaggatggttctcagcttgctacattagttcaagaaagcttcttactggatcttaaggttcacccaagttctctttccattgatggaacattagggaattttagactttgtgatacatcccttggatcagatcagtgttgggattggctttgtgacattcgtaatcctggtgttgattcccttataaagttcaaatttaattcttatagtgctggagacgatgactatgaaggatatgattatagcttgcaaggccatctttcagctgttcgcattgttttcctttatagatttgtgcaagagataatgatgtacttcatggaacttgcctccccgcacactgaagaagcaataaaacttgtggataaagttggaggatttgaatggttgattcagaaatatgaaatagatggagctactgcactcaagctggatcttgcactcgacactccaattatcattgttccaaggaattcaatgagcaaagattttatacaacttgatctgggaaagctacagattaaaaatgaattcagttggtatggatctcaagaagaagatccttcagctgtgcatattgatcttcttcatgctcagattctgggtattaacatgtctgttggaattgatggtcgtcttggaaaaccaatgatacgtgagggtcagggacttgatatatttgttcgtcgaagtttgagggatgttttccggaaagtcccaactttttcacttgaagtgaaggtaactccaattccaaaccctaatgtttag

SEQ ID NO: 69080 - DNA, 6698 bp, Glycine max
  Peptide Sequence Number=SeqID_160765
atgtctgataaagaatataaggtgattttggattgtacatacatgaatttatctgaagaaccaaggctccctgctagctttcgtggtggaaaatctggttcaagggatactattaggcttcttgttgataaggttaacttgaacagtcaacttttgttgtcccgaacagttacaatcatagctgttacagtgaaccatgccttgctggagctttgtaatggcactgatggggagtctccattggctcatattgctatggaaggtctttgggtttcttatcgtatgacatctttatcagagacagacctttttgtgactattccaaaattctctgtactagatgtccgccctgatacaaaaccagaaatgcgtctgatgcttggatcatctgccgatgcttccaaacaaactgttactggaaatgttccctttttatttaacccgggtagttttagaaggacaaccagtgaagttgaaattgatgatatgcccatttcaacaatgttcttgatggactacaggtggcgggtgtcatcccaatcatatgtgattcgtgtgcagcaacctcgagtccttgttgtgccagattttcttcttgcagtggctgagttttttgtgccttctttgggagcactaactggaagagaagaaaaaatggatccaaagaacgatcctatcagcagaaacagtagcatagtgctgatggaatcaatttacaagcaggaagaagatgtggttcacctctccccatctaaacagctagttgctgattcggtaggcattgatgaatatacgtatgatggttgtggaaaggttatttgtttatctgttgaaacagatgcaaaggaagttcgaagcacaaggtttagaccaattattgtcattggacatggcaaaaaattgcgatttgttaatgtaaaaattgagaatggttctcttctaaggaagtatacataccttagtaatgatagcagctactcaatctctagtgaagatggtgttgatatggtggtttcaggcaatttgccatctagtgatgagaaaagccttgacaatgtgaatcaaacatcaggcacttctatagattctcaaagtggttcaaatgcaactcaaagtttttcctttgagacccaggttgtttcttctgaattcaccttctatgatggcactaagtcatttcttgatgattcattttatggcgagaagcttgttcgtgcaaagttggatctaagtttcatgtatgcctccaaggaaaaagacacttggattagagccttggtgaaggatttttctgttgaggctggttctggtcttatcattctagatccagtggatatatcagggggatatacttctgtgaaagacaaaacaaatatatctttgctatcaacggacatctgtatacatctttcacttagtgctctgtctcttatgctgaatctgcaaagtcaggcctctgctgcattaagttttggaaatgcaattcctcttgttcaatgtaccaactatgaccgaatttgggtgtctgagaaagaaactggtcacaacaacaacattactttttggagacctcgagctcctgcaaattatgttatattaggagattgtgtaacatcaaggccaattcctccttcacaggcagtaatggcagtaagtaacacatatggccgcgtaaggaagccagttgatttccatcttattgggtcattcctcaatattcaagggcacagtggaagtgaagaccattctattgatggaaatgattgttctctttggatgcccattgcacccccagggtacacagcgctaggctgtgttgcgcatgttgggaaccagccacccccaaatcatgtagttcattgcttacgttctgatctggtaacatcagcaaagtatacagactgcttatttaatatcccattaaataatcactttacctctggctttagcatatggcgccttgataatgctatcggctcattttttgcacattcttccactggttgtcctctcaaagaaagatgttatgacttaaatcatctgcttgtctggaattcaaatcgagctcccctgttaggtccagtatcggattatccttctgatcatgacaataacaatcagcagacaagcaaaagtgtgaatacatctggatgggatattctcaagtccatttccaaagcaactaattgctatatgtctacaccgaattttgaaaggatatggtgggacaaaggcagcgacctccgtcgtccagtctccatttggcgaccaatcgcacgtcatggttatgctgtcttgggtgattgcatcactgaaggcctagaacctcccgcactaggaataatcttcaagaatgacagtcctgatatctcttcaaaacctgttcaatttaccaatgtttcccatattgtagggaaagggtttgatgaagttttcttctggtatcctatagctcctcctggttatgtttctctaggatgtgttgtctccagaacagatgaagctccacgtgtggatctgttttgctgtccaaggatggatcttgttagccaagcaaacattcatgaagtgcctctttcgagatcatcaagttcaaagtctcctcaatgttggagcttatggaaagtagaaaaccaggcttgcacatttctggctcgttctgaccttaaaaagccatcaagccgattggcatacataatcggtgattcggtgaagcccaagactcgggaaaacataaatgctgagctaaagctgcgatacttttccctgacgattttggacagcttatgtggaatgatgagacccctgtttgacactacaattacaaatgtgaagcttgcaacccatgggggactagatgggatgaacgcagtactgattgcttcaattgttgcatcaaccttcaatgcacatttagaagcatgggaaccacttgtggaaccattcgatggaatattcaaccaagaccaaagtagaaacgttgcgtcttcaaatagtgaattcgcgttgaaagttgcattagagaacgctatattgtttctaagcttccaaatagaccaacaatggaaaaacaaatgggatgcgccctcctctgtaattctgcagaaaggacattgcatatctgtgagctgtcctgttgagaatatgccattaactagatctttactttctaacttgtttaggttcgaaacttttgacaccaacgcaccatcaggacttgggaagagagttcgaatttctgctaccagtatcttgaatgtaaatgtcagtgcagcaaatcttgaatcctttgtgggaagcattctttcgtggagacaacagttagatcttgaacagaaagcattgaagctaaatgcggaggctggtggtcaacaaggcaaaggagaaaatacaactttttctgcactagatgaggatgacttgcagactgtggtagttgaaaataaacttggctgtgatatttttgtcaaaaaagtagagcatgatgtagatacagttgacaagctacagaatggcgattgtgtttctgtctggattccacctccaaggttttcaaataggttaaatgttgcaaatgaatccagggaagcacgttattatgttgctgtgcagatactcgaagccaagggcttacctattattaatgatggtaacagccataacttcttctgtgctttgcgtcttgttgttgatagccaagcatcagaacagcaaaagctttttccccagagtgcaagaacaaagtgtgtgaagcctgttgtatcaagaaccaaagatcaggttgaaggcacagtaaagtggaatgaacttttcatatttgaagttccccgaaaggcccctgctaagttggaaatagaggttacaaatctcgccgcaaaagctggaaaaggggaagttgtggctgcactttctttttctgtcggacatggtgcaaacattctaaagaaggttgcttccgtgagaatgtttcatcaaccaaatgatgttccaaatattagatcatatccacttaatagattggttcagcaaaatgttgaagccatgcatgatggatgcctctttgcttcaacctcttattttgaaagaaacaaaattgctaaccttcagaatgatatagaaagtgagaacgttggtgatagagacatgggtttttgggtggggcttggcccagagagtgagtgggagagtattcgatcgttgcttccactatcagtggctccaatatcattacagaatgagtatatcggtatggaagttgtgatgaaaaatggaaagaagcatgtaattttcaggggtcttgttacagtagtgaatgattcagatgttattttgaatattttgacttgtcatgcatctcatggttgtgattccttgcttggagtaaacagttctaacactgtaacagcagaagtctttcaaaatcagtattatcagccatcatctggttggggtaacaattggccagctgtgcacaatgataatcctggacattggagcacaagggacttctcatactcatctaaggatttctttgagcctccacttcctcctgggtggaaatgggcttcgggttggtccatagataagtctcaatatgttgacaaggaaggctgggcatatggacctgacattaaaagcctaagatggcctcctatttcttcacatttttcaaccaaatcagcctctgatgttgtgcgtcgaaggcgatggattcgtacaagacaatctttgtctgagcaaggtacagaaagcttgcagggtggagcaagtactgtgcaacctggagcttctgctgttttatcatggagaagctcatcaaagaattctgaccaatgtttgcaagttcgacctaaatttgataattctcagccctcatactcatggggttgtgctattgctgttggttcaagttatatatatagcaaagaccaactattagatccaggttctactagactgacttctgtaacacccacttgctcattgaagcttaatgagcttgagaaaaaagatatacttgtgtgctgcaatcctagtagtggaagtaaacagttgtggtttagtgtgtgtacagatgcctcagttctcaatactgaactaaacgtacctgtatatgattggagaatatctattaactctcctttgaaattggagaaccgacttccttgtcctgctgaattttcaatctcagagaaaacaaaggaaggaaattgcattgagcggcatcatgggtggctgggttatggaaaagttgatgcacaatcatcttctttacttgattcatctgcacaggacccaactattgtactggatccttctttctcgaaccatgtctcatctttctggatgattcaccggcaaagtaaaaggaaattacgtgtgagcattgaacatgatatgggcgggacaagtgctgccccaaaaacattaagactctttgtcccttactggattgtcgacgatttttctttatctttggcataccgtgtggtggaagtggaacctttggaaaatgtagagatggattctgtcctactctctagggcagttaagtctgccaaaactgccttgaaaaaccccataggctcattggatagaaggcattctaattcaaggagaagcctgcaagtacttgaagtaattgaagacaacagtccatttccgagcatgctttctccacaagattatgctggtcgtagtggagtttcaatgtttcaatctcctaaagatactaggctgggcatttctgtttctatgcagtcttctgaagtttacagctctgggatttctctgcttgaactggaaaaaaaggaacgtattgatgtcaaggctttcaattctgatggatcttactacaagctttcggcattgttgaacatgacttcagacagaacaaagcaatgtgatactcagtcagctgtatggattcatcccacggattctccaaagccttttgcttggcagttatcagccaaagttgaacttctgaagttgcgcattgatggctacaaatggagtacaccatttagtgtaagctatgaaggtgtaatgcgcattagcttgaaaaaagatgttggagatgaacctatgcaaataagggtagcagtaagaagtggtgccaagaaatcacgctttgaagttgttttccgtccagattcactatcaagtccttacaggattgaaaatcgctccatgttcttgcccattcactttcgtcaagttgatggtatccctgattcctggcagctacttgttccaaattctgctgcttcatttctgtgggaagatcttggtagaagacgcttattggaactcttggtagatggaactgacccaatgaaatcactcaagtttgatattgatgaaatttttgatcaccaatccatccatgtaaatgatggaccaaccagagccttgcgtgttactattgtaaaggaagaaaaaaccaatgttgttaagatcagtgattggatgcctgaaaatgaacctactggagttccaagaagacatttatcatcaacgaatgattctcaaaagcaacaactgacgtcaattacagattgtgaattccacatcaactttgatcttgctgagcttgggatatctattattgatcatacacctgaggaaattttgtatctctctgttcagaatcttgttttggcatattcaactggtttgggctctggaattagtcg

SEQ ID NO: 69081 - DNA, 1641 bp, Glycine max
  Peptide Sequence Number=SeqID_160766
atgtgtgggctacaagtggacaaccaactgccactaactccaatgccagttctctttaggccacagagagctgtatcagaaactgactatatcctgaaatgctccattacaatgcaatcaaatggatcattggatctttgtgtctatccatatattggtctacatgggccagaaagttcttctgcctttctgataaacattcacgaacctattatttggcgccttcatgaaatgatccagcaggtgaagctcagtaggctgtatgattctaaaacaactgctgcatcagttgatccaataattcaaattgggtatggtttgcttgaaactgcttatgacattacattgaattacagtgtccttaatatttcggaagttcgattcagagtgtctatggctatgtcaccaagtcaaagacccaggggtgtgcttgggttctgggcatccttaatgactgcattgggtaacacagaaaatatgcctgtcaggataaaccagaggtttaatgagaatgtatgcatgaggaagagttctatgattaccatggctatctcaaatgtccgaaaggatctactaggccaaccacttcagcttctctcaggagtcgatatattgggcaatgcaagtagcgcacttggacacatgagtaaaggtgtagctgcattgtctatggataaaaaatttattcaaagtcgacagagacaggaaaacaaaggtgtggaggatttgggtgatgttataagagagggaggtggagcattagctaaaggtttattcagaggggtgactggcattttaacaaagcctcttgaaggagcaaaatcttctggtgttgagggttttgttcagggtgttgggaagggaattattggtgccgctgcacaaccagtgagtggagttttggatcttctgtcaaaaacaaccgaaggtgctaatgctatgagaatgaaaattgcatctgctataacatctgatgaacaacttctcaggaggagactgcctcgtgttataggtggtgataatctgctaaaactatacgatgagtacaaagctcaaggacaggtcatactgcagttggcagaatcaggttcattttttggtcaggttgatctgttcaaggttcgcggaaagtttgccttatcagatgcttatgaagatcacttcatgcttccaaaagggaaaatcctcgtggtcacacatacaagagtcatactattgcaacaaccatccaatattattgctcagagaaagttcagccctgcaagggatccatgttcaataatgtgggatattctgtgggatgatcttggtactatggaactgactcatggcaaaaaagacaagccaaaagctcccccatcacagctcattttatatttgcaatctaggtcaatggatatgaaagaaaatcatcgcattataaaatgcatccgtgaaacccatcaagctcttcaaatttactcttcaattcagcatgcattgaacacttatggtccaggagtatcaaagggagttctgaaaaataaagtggcaaagccatattcaccccatgttgatgcccgtagtgttgacctatccccccaacagatgcctggatcagtccctctctcctcaacttttggaagcagtgcccgtgactag

SEQ ID NO: 69082 - DNA, 312 bp, Glycine max
  Peptide Sequence Number=SeqID_160767
atgagcaacaaaaaaaagcctgttaagatgtccgtgcctcaatttggagggtgggaacacaagcccgcgggagtgcctactgactactctatggtgttcaaccaagctcgtgaaaaaaagaagactcaaatgaatgatttgactgaagtcaaacgtctaagtcttgggaatgaaagggatgccctaaaacccaatcatcgtcgtgggcatggtcaaggacatgggcatgggcatgggcatgggcatggacatggacatggacatgggcatgggcttgatcatgaagatcctcccgttatggtgagaccttaa

SEQ ID NO: 69083 - DNA, 1911 bp, Glycine max
  Peptide Sequence Number=SeqID_160768
atggcgatggcaaacttggctcgacggaagggttacgccgtcgttttgtcgtcgaggtcgtcgctttgtctgacaaggtggagggggttcgcgtccggatctgacgaaaacgacgtcgtggtcatcggcggcggtcccggcggctacgtggcggccattaaagcggcgcagctgggtctgaaaaccacttgcatcgaaaaacgtggcactctcggcggtacctgcctcaacgtcggatgcatcccttccaaggcacttttgcattcttcccacatgtatcatgaggctaaacatgcatttgccaaccatggggtcaagttttcatctgtcgaggttgatttgccagccatgatggcccaaaaagataaagcagtttctaatcttaccaagggtattgaaggtctattcaagaaaaacaaggtaaactatgtcaaaggttatggcaaattagtttcaccatctgaggtctctgtggacaccactgaaggtggaaatactgttgtgaaaggcaagcatattataattgccactggctcggatgtgaaatctctgcctgggatcactattgatgaaaagaaagttgtttcatcaacgggagctcttgctttgactgaaatccccaagagactcatagtcattggggcaggctacattgggctggaaatgggctcagtatggggccgacttggctccgagataacagttgttgagtttgcatcggagattgttccaaccatggatgcggaggtccggaagcagtttcagcgttctcttgagaagcaaggcatgaaattcaagctgaagactaaggtggttggagttgatacttctggggatggtgtgaagctaactcttgaaccagcagctggtggtgatcagactacacttgaagcagatgttgtcctggtatctgctggtaggaccccattcactgccgaacttgggttggacaagataggagttgaaactgacaagattggacggattttggtaaatgaaagatttgccacaaatgtctctggtgtttatgcaattggagatgtaattccaggcccaatgttggcacacaaggcggaagaagatggtgttgcttgtgttgagtacatagctggtaaggttggtcatgtggattatgacaaagtccctggcgttgtctatacaatgcccgaggttgcatctgttgggaagacagaggagcaggtgaaggaacttggagttgaataccgtgttggcaagttcccattcctggctaatagcagagctaaggcaattgacaatgctgaaggactggtgaagatattggctgaaaaggagacagacaagatattgggagtgcacattatggcgcccaatgcaggagagcttattcatgaagctgcaatagcactacagtatgatgcatcaagtgaggacattgcacgtgtgtgccatgcacatccaacaatgagcgaggctgttagtggtaatgaggaagaagtccctcaacgtcgaaggtcgacaacatcaacacgtagagaatggacacttgtagctgttgcagaggatgttgagaatgtggatgatgctgctgacgagattcacgattcagttacggatcatgaacatactgagtcgaagttggcttttcatggaaagaaagtagagaaatttagaagacctacacttgagattgaaggcataatggttgttacaggattaagttctctcattacatgttcgttggagacaggtgccttccctacctttgatgctattgatgtagaggaagttgttgacttgttagttgagttgcttgaagccagtacacaagaagcaaaagatgagactgagcaatgcaaaatgacatatgttcgcctagcctggctgggagacatttatcataacaaattgttttgtaagtactatctatga

SEQ ID NO: 69084 - DNA, 663 bp, Glycine max
  Peptide Sequence Number=SeqID_160769
atgacgtcactctgccggcgcatccccatcgccggaaccggccaactctgcctccgttgcgctccgaggaccgctgcgattggcgcggtccgctacggctacttgcctaagtggccgacaatcgcgctgcgactgcctccgccggctaaatgcggcggcgcgtgggagagatcaggcgagaagaaggtggtggcgcctcgcccgcgctcggtggggagattcgcggcggagagtggccgggaaagcgggaatcggttggcggaggtgatgctcgccgccgctgtgacggtggtgatgggcgccggaaacagagtactgtacaagctcgcgttggttccgctgaggaactatccgttcttccttgctcagcttgcgactttcggatacgtaattgtatacttctctattctgtatatacggtatcgtgcgggcattgtcactgatgagatgttatcagtgccaaaaactccatttctagttgttggtctcttggaggctctgggtgctgccacaggaatggctgcaggaggggttggactaggaggaagggaagcagtcgctggacaattcgtacaattaacaatattcttctttggctcaatggttgggccggttgcaatattaggggagttgggcccgaatggaactagaccaggagtttga

SEQ ID NO: 69085 - DNA, 582 bp, Glycine max
  Peptide Sequence Number=SeqID_160770
atgtttgctttgcaaaatggctataacgaagagctcagggctcaggtggaggaggcctttcacaatgaccctgcaaaagatgaaaattttgtaggatggcaattaaatactggatccggccactgtgaactgacgggtaaagaaccacataaacagagaagaacgattaccgttctcaacgactgtgacagtgctaccactgcgacacagggcccccggtttcagatggttgcgccggcggtgagggcggctgccgcggagcttttcttcttctccttcttccgcgaggcttttcttcttccttctttttccacgagccatttcttcttcttggtgattcttcttccgcgcgagctactgcatctcccttgcgaggtggttgttcttctttcgtgcgagttgatgcttctccctccttctagtgcctcttcttcttccattcttccacgaggtgctgctcttccgtgcttcatcggggctatgttgaacttgcggatcaggttgatccacaagcagaaaaggttgatccgcaagcttcatgcagatcaagttgatccacatgaagcttgtggatcaacctga

SEQ ID NO: 69086 - DNA, 1137 bp, Glycine max
  Peptide Sequence Number=SeqID_160771
atggtagatgctgacgcacaggataccgatgcagagactggcgtacaggataccggtgcagaggatgttgcagatgaggttgagggatttcctggtggacccagggacccatctgtgcttacggagtatgctgagcatgaacgccctgagttgaagttatcttcccatggaaggaaggtgtataaattaggcaggcctgttcctgcaattgaggagatggttgctgggacaggattaagtcctctgatcacgtgttcagtagacaccggtgatcagggacttatatcctcgtttgtcgagaggtggcaccgggagacaagtactttccatcttccaatgggggaggtatccatcacgctggacgatgtcgcgtctcttcttcatctatcgatcgttgatgacttccacgccttccaacctctgcagattgacgaggcggtgctgatgttggttgagttactgatggtttcaccagagacgtcctgcgtgacctcactcagactaggaggtatgcatggggagctgctggcctcgtccatgtgtacgattagcttaatgatgcaatgttggatatatgagcactttccgtcagttgtggagtgcaatgttgatctggagtacaacgaggtgtcaccacgtgcatgtcggtggattgccacaaagaagactgtcaagaagatatctacagcgacgtacaggcaatgcctggatcgtctcaggattccagatgtctactggatgccatatggggagcaccgactggtccaagactttcatctgatttcatgtttcttaggacaactccgttgggggcctgctgttgtcagatacaaaccagagagggttatgcgccagttcggatacatccagtgcattcttgcacaccctgtcgattcatgggagccaacaccagcatcaacacatgtgcattctgatgcggacgagcccagacatgtagtggagacttgccatgtcatcgcggagacattgaagcatcatctcagcctaaatgaagtcatgccagacacatcgacacatgaggtcatccaaaaatgcttcaggattgtcaggggtgtcacaaaagacgtcaatgtgtatttgaggtctcatcgtaggcggcacacagatcaaccatag

SEQ ID NO: 69087 - DNA, 801 bp, Glycine max
  Peptide Sequence Number=SeqID_160772
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggcaatccaggtgatttacaaacctttgatcctgaaatagatagaaaatttcatagattagttaggcatagtgtgcatcttgatcattctgtgcttttcgagcattgtgagcattttgagcattctgagtattctgttgctggtgattctgaatattctgattttgagcattcaactactaattttcatactgagaacatggctcaacctccacctcgtgagaggatttttagggagatggctgcacctgatttcacttatgaaagcttgtgcattcaatatcctgatgagggtgttccatatgttctcaagactagactaatacatttgttgcccaagtttcatggtcttgcagatgaaaatcctcataagcatcttaaggagttccatattgagttgatccagctcgcagcggtgattaaaggagataatatcctcactagtttccctgatacaatagggaaggacatgactgttaagcaagggaaagattacatggatgaggcagtgagaaggttctttgaagcaggtcgttacgcaaggaaaatgggagtgaatgaagaacatatagttcggatgaagccttctttgactactagatcatccgaatcttcaaacacaaacccatag

SEQ ID NO: 69088 - DNA, 225 bp, Glycine max
  Peptide Sequence Number=SeqID_160773
atggagaaaaatgaagaaacaacaatggaggagaaggtaaagttgaaaattgatggagatgtagcgaaagataaaggagaaaaagtgagaggaggcgtcatccactcgggaataagccatggaaaaaaagagcttcaccaccaagagaatgtcttggataagaagcttagagtggaagtttcaatgaaggaaaagaaagagagaaggaggggaacacgaaattga

SEQ ID NO: 69089 - DNA, 261 bp, Glycine max
  Peptide Sequence Number=SeqID_160774
atgaccttgatggctgcaatacaagccacatcttttgccctttatgttaagaaggattggagccaatggaagttgggttcgagtattaggattctaactgtggcttataagaaaactactactgtagtagtgatggctaagtttgggaggcctgctctagagatcgaaggccttgtggctgctagcggactaagtcttttgatcgcatgttccctaaatacgggcgatcaaggactaatgtctgcttttgtggaacgctaa

SEQ ID NO: 69090 - DNA, 561 bp, Glycine max
  Peptide Sequence Number=SeqID_160775
atggattttgatgattctatccaagcaattgttgacacaacatatccagatttattacaaaactacaacaacgcagatttcttgcaaaagagagctattctagcctctacaaaagatgttgttgacaaaataaatgactatgtcttgtctttgattctcgatgacgagaaagagtattatagtgctgatattgttgacaaatctgatgaactactcaatcctacttttggagtactaacacctgagtttctgaactccttgaaaacatcagggatacttaatcacaagctaagaatcaagattagtactcccatcatactactacgaaatttggaccaggcatatggtttatgcaatggaactcggcttattgtcatcaaacttggtaccaatgtagttgaagcagaggtaataactgaacccaatataggtcataggacatacataccaagaatgaatatgtctccttctgattctccatggccattcaaactaattagaagacagtttccattcatggtttcatttgcaatgaccataaacaagtctcacagtccttag

SEQ ID NO: 69091 - DNA, 777 bp, Glycine max
  Peptide Sequence Number=SeqID_160776
atgacaaccaattccatggcaatctccatctcccagaactccttctcctcggacttagactcgacatcctcatgggactacctcactggctcctcctcccaattccctcgctgtccaccatcacctattgcaaaccaacccctagagaatctccctattgcaaccccacccaccaagaagccgcgtggcaggcccccaggctccaagaacaagcctaagaccacttccttcccagtgggccaacccgctgaaccctcaatgaagctcgtcattgtcaacgtgacccctggcagcgacatcattgagtccattcttgatgttgctcgtcgaggccacgttagcctcaccatcctcagtgcctctggcacgatctctaaagtaacccttcacaactctatccatggtgttgctgccctcacactccgtgggcccttcaccttgctctcgctcaacggctcctacttacacaacaaccattacacccttcaccctggagccacccctccccctcccttatccttcgggatcagcttttccacctctcaaggccaagtatttggcggcgccattggcggtagagtcatcgccggtgatgatgtcagccttacaatctccaccttcaagaaccctgtgatgtacaagtacgttcctacagacaaagaaaggaacggggatgacaataataacaaccattataacaatatctctaaaaattttaatgggggtaacgagttgttggggttcaacatggttggttgcagagttcgtgggtggtga

SEQ ID NO: 69092 - DNA, 495 bp, Glycine max
  Peptide Sequence Number=SeqID_160777
atgaagacatacagacgcagaacaaaaaagacagtgcatctatcacaggaactgatcaatgaaatcttgttgaggttgccggtgaaatctcttgtccgcttcaaatgtgtgtccgaaggcacagagagacttgtgttctttgagccttcagctcctgaaatccgatccatagacttcaatgcatctctttacgatgattctgcttctgttgcattaaagctcaactttttgccacccaaaccttatgatgttcgaatccgaggttcctgtcggggccttgtgctcttggagtgctgtcaaagtctctggatgactacttggtggttaaagtgttctgccacgcttgctcagctgttagtgctaactgatacggaagcagaggcagcaaacacaacaacaggaacagcagtcacaaagccaaaaacgaaggtgcaagtagaagaaaagcccaagagaaagatcacaaagccatcttacctcaaccactacttttga

SEQ ID NO: 69093 - DNA, 1161 bp, Glycine max
  Peptide Sequence Number=SeqID_160778
atgggttcaccgacatcaaggattgtgttccgtattgtggtggtggcgcttctgcttcttcttctcttctacattggtcgccctctgtattggaaaatctccgccaccgtccacgacatccgcaacaacaagcaaactgtcagacaaggtctttcccaaatcgtcattgaggctcagaaatcggtcggttggtatcacgatgagtccgactcagggcactctcacatcacattcacagttggcggtggttcctccggtcctccccgttcaactatatatctgtttgtggtagtgttgattattataggaggttgtgcagagggtagtaggcctcatcggattcttgtggatacagatgttgacactgatgatttctttgctcttctctatctcttgaagttcaacgcttcacagtttcagttggagggcatcagcatcagtgcaaatgcttggacgagtgctggtcatgctgttaatcacatttacgatctactttacatgatggggcgagatgacgttgccgttggagttggaggcgagggtggaatactacaaaatggtaccatactccctaacgtcggtggatatcttccaattgtagaacagggaatgacaacagtaggaggttgcagatacagaggggcaattcctgtaggtcttggagggcgattagacatcgatgccaattatggtatcaggaaggctttcctaccgcagcaaccaactgcacagcaagtgttgattgaaaaaatatctgcaggtccaataactctgcttgtgattggagcgcatacaaacattgcaattttcctaatgaataacccacacctaaagaaaaatgtggaacatatttatataatgggtggcggtgtaaggtcaagcaacccaacaggttgttgccccaaaaatgcttcatctacctgcgtgcctatgcagtgtggtgaccgtggcaatatgttcacagattataataccaacccttatgcagagttcaatatatttggagacccttttgcagcataccaggtgattcattctggaattcctgtcacccttgttcctcttgatgcaacaaacacaatccccatcaacgaagaattctttgatgcatttgaaaagagtcaagacacatatgaggcacattacattttcaaatcctag

SEQ ID NO: 69094 - DNA, 957 bp, Glycine max
  Peptide Sequence Number=SeqID_160779
atggcgcctcaccacgacatcttcgtggtagcgcccgcttcctctttccaccaccaccacgaccacaacgacgccgtattgtccgatccaaataacggttctaacaattcgaacaacaatcctggaactgcactcggtgtgaatgttttccctctcctaaccgccacgccatgcctcgagagcgagggcataatgggaaacatcagccaccaccgtaacagaattcagttatgggaagatcacgagtcttctccaccgcagcagcaacagggtcacgtggagcgtgacacgtgtggggatgggggtttgggtgggagtgggactaacacgtgccaggactgtgggaaccaggcgaagaaggactgtagtcaccggaggtgcaggacgtgttgcaagagtaggggttttgattgcgccacgcacgtgaagagcacgtgggtgccggcgtcgcggcggagggagaggcagctcatgacggttgcggcggccaggtccagtggggacacttctggtgccaagaaacctaggcttgttgcttcccagactacttcgcatacttcaacgtctaataatactaataccactcctccgaggagttttgacactggttctagccaccaagatgtgggtttcaaggagtcactaccttgccaagtgcgtgcaccggcggtgttcaagtgtgttcgtgtaacagcagtggatgatggtggggaagatgagtatgcttatcaagcagttgtgaagattggtggccatgtgttcaaagggtttctctatgatcaaggggttgaggacaaagaagggtatcctaatttatcagaattgcatttgggtggtggaaatggggtttcctcttcatctccaatggtggatccttctcatgatgtctatgcagcttcaggtggtgggttacttcttggaggttcatcaaactatggtaatcatccaataaattaa

SEQ ID NO: 69095 - DNA, 465 bp, Glycine max
  Peptide Sequence Number=SeqID_160780
atggtgtcaccacaagggaggaacacatggacagttgatgatcttgtgccttacgtgaaaaagttagcgattatatccgaagagcaagagagaatcactgagccagtgtcacatggtccagcatcagagtgtgaattcccaacacaagagtttcacattcttcagtcaagtgttgaaactcggggcataggcagacgaagcgagcctgttgaagcggaagaatattcccaacaaatgatggagcgtggtcatggaatgtattacacaccaacaacattttcccaatatccttcacagatgtatcagtatcattttgaaggtcctcacactgatacttctatgagcgaacattcgtatggtggtgttgcagaaacacaggctcatttttcatggcccactatgactccttcacaacaacaggatgcctcaatggcaacacctaacgccccatttgctttgcaatag

SEQ ID NO: 69096 - DNA, 405 bp, Glycine max
  Peptide Sequence Number=SeqID_160781
atggttgaagaaagcacaaaaggaaacatgcaaaatggtgggtttcactctagaatatggaactcaatgacctattggttgaattccataaccaattgttcctacaaaaaggaacaactaaaggcaaaaatacataggttacaagctttatatcatgagttctctttactcttgcagcacgcaagtcgtccaaatgatgataatgctagttcaaatgatgacatgcgagaagtagagcacaacacaagtactagaaagcataaatctaagaaaaggtgtagaacagatgaaatgggagattcacttgcagcatgggctgaagcatcaaaggcaaaggctgagacgtataggaagattgtgaacaaggaagactactattcttatcaagtgtgtgaatatcgttga

SEQ ID NO: 69097 - DNA, 864 bp, Glycine max
  Peptide Sequence Number=SeqID_160782
atgcatggaagccatggagaaggcgatagaggagaatcgcgaagcaatggagatgcaattaagcttgataaaaaggatgatacaatgattagcggtggcataggagaaaaacctcctgaatcgaacgttcacgtggacgattcattaggagcgaataaagggaacgctacgcagagctgcaatttgtggagaattcttgaaatgccaatatttgagggagaagatctgatgggctggttaacaaagacagcaagtgatggttgccatggatggagaagctctagggtggttccaatggtgggaatcttggaacccaaaccattagtgttcaagatcgcaatctcccaaaggtttcaagtgtctaacctagggaatccttttcaagcattgtttgcactagaacaggaagaaacaatgcaagaactcataggccaatttgagaagcacattagaatggtgaaggggatggaggaaccatttatggtggaggtgtttcctaaggggctgaaagaagagatcaacactgaggtagttggtcctattaatgttgctaaaacaggatccagtagatggcaaggtagaagaaacttccataatttgtcacccatggaagtaaatgagaagatgagaaaaggagaatgtttcacctgtgaagagaagtataatcctgctcatgttgtttttcctcgacatgaccttgagaacaaggtccatcttgaaggagggggtgtattgatagatgaggaaatgggtatgttaggaaatattcttggaagagctaagagccttagtaactgtcaattaggtggtgagaacttgaaactcatctatattttgtcttgggtgttggaggcaccacaataa

SEQ ID NO: 69098 - DNA, 489 bp, Glycine max
  Peptide Sequence Number=SeqID_160783
atggccgctaggcattttctgcttcaccgccttcggttgcgtagcttccaagggttcaccgtcgcggcgcccaagggccaccgtctctggtgcagtgccacgtcagcaccggaggaagcagcttccaacgcggaggtggatgaccccgagtggaggaagaaagaagagaagatcgtgagggacgttgagccaatcgtttcgttaaccatgcaaattctctactcatcaaggtacatgaatggggagatactgactatggaggatgaaagagccgtggtagagaacattctcatttaccatccggattatgaagataagataggaagtgggctgaactccattatggaatacaggatgtctactaaatacaccaaaatgaaaggcaagactgcaactcaaaggaaattgatagggactaagggtttcccaagtgttcgggtgcttatcaccttcacactgggctcagactgcaaatatgcaaaatgctag

SEQ ID NO: 69099 - DNA, 1308 bp, Glycine max
  Peptide Sequence Number=SeqID_160784
atggcaacttctgagaacaacagcagcgcgcgtccccaacgcgaagcgaagaagagggccgcagctgcaatatcccaaattcatggcaacgccgccaagaagaaacgcgtcgttttaggcgacgtcactaacgtttcctcaagcgacgtcgccgtttccgtttccaaaaaacccgttcagacacataaaaatgttaaactcgagaaaccggccgcgccggttgccacgccggagaaggttgaggaaagacacgacccgcaactctgtgggccctacgtttctgatatatacgaataccttcgcggaatggaggtggatcctagtaagagaccattgatggattatgttcagaagattcagagggatgttaatgctaacatgcgcggtgttcttgtggattggttggtggaagttgcagaagaatacaaacttgtttcggacacgctttatttctctgttgcttatattgataggtttttgtcgttgaatattttgtcgagacagaggttgcaattgctgggggttgcttcaatgctcattgcttcgaaatacgaagagattaagccgcccgaggtggaggatttttgttacattacggataacacatactctaaggaagaggttgtgaacatggaggctgaaatattgaaggctttgaaatttgaattgggtggtcctacagtgaagacattcttgaggagattctccagagttggtcaagagggtgttgatacttctgatctccagtttgagttccttagctgctaccttgccgagctcagtttgttggattataattgtataaagtttttgccatctttggtggctgcatcagttgtattcctagcaagatttatgtttagcacaaagacacatccttggaattcggcactccatcaactcactagatataaacctgctgacttgaaggaatgtgttctaaacttacatgacttgtacctcagtaggagaggggcctctttgcaagctgtgagagagaaatacaaacagcataagttgcattgggtgttttggtacagttcaaatgtgtggcaacaacaccatctcctcccgagatacctctttctttttttgaatttgaggggcagattcttaggcaattgtaatttggctattcttggtatggctctggtttcaactattggcaggaaagtgtttcctaacactagagatgagagtttcagacattttgttgcacttgtttgtagagagagagaggtgcttgccagaaatgcagcgacaacatactatgctggcctcactgactttgtgattgagcttgtgtga

SEQ ID NO: 69100 - DNA, 2073 bp, Glycine max
  Peptide Sequence Number=SeqID_160785
atgcaaaatccttcgagtcttgatcatcccttgttcgcgaatcgtgttcagttcagtaggacaattattttcttggttccttttgctctctcttggttgggtagtagaactgtagaagtagaacatgtgagcaacagagataacgagtgcggtgaagttgctatggacccgtctatcatgaagcttctagaagatgacgaggatgaagcaatgcattcaggggtggatgtggaagccttccaggctgccctaaatagagatataggaggagatgtgtctacttcacaattttctggctcagatgcagtgttgtctcaaggaagcaataatacatcaagtcaatctttatcacagtggcctacttctaaccatgacagccaaactgactgtcaaaagcaagaatctaaaactgcacaacagcaagatcaaccttcatctggggtggagctgaagcaacgtggatctcttgcggaacaactacatcatgttgcttctcaggacataaataatcctcatttatcacagaaacaatctcaagatgaatgtcaccaagcaccagctttacaagtttccctccacaattctcaagctattggaattcagaattctggaaaagatccagtccttaataatgaggtagtaaagaatcataaccccagcagtgaatctcagtatgcaaagttgcagcagatgagtaatcaacaggctacagtctctgagcagccaagtagtcaaggaaatcgtagtactagtaagcaagtaccatttggcatgttgctacccatcttgcttcctcaacttgccaaagacagagccatgcaacttcaaactttatttgctaaattgaagaaagaggaaataccgaaagacagttttgtgcggctcatgaaaggtatcgtaggggatcagatgcttagattagcattagcaaaggtgcaagtgcaaccacagacaaggcccaatcaagcatctgctgggcagcagcaccctatgaggatgccaactgttggttcaggtgcaagccaattgaatgatccccatgctttagcagagatgcatcagagaagtatgaatgctgccgttgaccaatctcgcatgggttcttcagctggccaaactatggagagcaatgctagaaaatctcaggaactagatgttaaaatagaatctcaaggattgcaaccaagccaattgacatcttccagttccaacaaaattgctcaagaaacagaaagaacatcagttcacatacaagggcttaataagcagcagcaacaacatctacatttcccatcagcatatggaaatagtggtggtaactataaccctttttctgggacaaccagtagttccacttcatctatcaaatcacaatcgcatgattcacatatgagtcaaatttcgtatcaaagtattggttcaaatcatcacttaggtgggtcaacacatggtttgaatgtaattggtatgtcaaaacttgaacagcagaattctttcaatgatcccaagagactgccaggtggatctgtgtctcctgctgtaaacaatacagtgtctcaacaaactaaaaatgcttggcaaccatcaacaaacaaagaacaaaatctgggcttattgtcatctgtttcttatgtcaaaaaggaacctagtgacttgtctactgagcagcaaaataggcataatttgtctaaattgcatgggtattcttctgttaattctgctcagcttgaacagggtggtgctagtcaaggaactgtaaaggatgaattttcaagaggtcttccagcacccccaagcaagcctcctacatctactggcttgctgccacaaagttcttcttccccttctgtaatgacccaactaggcccaggtgtctcggtttatgttcttgccattttccttatttggaacacaggactaaaaattgatatttttggaagctccactgtctgctcatgcttggctcaagttagagtcatgagctacttgagtccacacaatgagctcaattgggttaagccaagtgtactctcaacatttaatgacccaaataaggagttccagattgcataa

SEQ ID NO: 69101 - DNA, 3783 bp, Glycine max
  Peptide Sequence Number=SeqID_160786
atgcgggtagtggacacaaattttttcgaaccagtgggtagcgaaaatcacactatccatgcccgacccgacccgacccgacccgttgtcatccctcattttcggagaagcgctccaaactcgtggactgcgtgccgactgccgagtacagtccattcgtcacttcccatggcttcagcggagcagcctctgaagaagcgaaagctctacgagcctttaccagaaccgccaccgttttcgccgccgcaaccgccgccgccggaatccgaagcaaccccttcctctccgcaaaccctacccacgccgtcgtccactcccccgctgtctcaggaggagattctcgcgaagcggcggaacaaggatgaaattcgaagcgtgtacgaaggttacaagcggattaagcgttgcttgcttcgaaaagacgctccctcctccatgtctgaactcgaacagagttatctcgctctcatcacttcttccagaggttgtatgagtgtacaaagaattgtggcggatcttattcctcggtacgcatgtcactgtccaactgctttggaagctgcagctaaagttgttattaatatgcacaacttgagtttggccttgatcagcagaggagaggattccagtggtattgcatttgaaactgctagagcctgtatttgtggcctagctgatgtttgctgcgatgcttcatcggtggcgcctacattagctgtaattagaggaatttgcgaagcagtttttcagaatgtgctcaccttttttatagccttattcgaagggaaggatgtcttacagatggttgacaagaatttcctgaatatgcaagatactcctgaggccttttctgagttgaaacaaaagattttagatgaagatgaatcttcattgactaaactgtccaagttgcgcgtgttatgtctacttcggatattcttctcttgtccaaaagatttgcttgcagcttgtttggatctctttggctctgccacaaaagaggcaactaatgccgaaggacagcgttttctgagcctggtgactagcacatttgatgatgataaggcagttcaccttttcgaaagagcaattggtggatctaaatcatgtacagattctactgggtcaggcatcagagacaatgaggctggtgaggcaattatgactgaagacaaccatgtttctggtggtgattcatctgttggcaaaagctgcttgcttatgcaggtccttgacaaggatcccttactgcggaaatggatgttgtgtagatgtaagaagttgcttgacttgctctctgatgtatcactggaaattacgtcagtactgcaaggaattcttggaatgtttcctcgacaaacagatttggaggactgtcaagcagatagtgatgaagataaatctgattcttcaatttacatgaataggaactacatggttcctaggatctctgaggaacatgaaagcattggtgaatcatctggaaaaggcagcagtttgagagttcatgttggttcttctgatggttttactgataaatatgtgatggatcatagctcagcagttcctcttgaccatgttcctgtgttaaaagtgggttcacattacgataatggagtctcaaagcccatgagcattggggtgggggaggaagggaatatgcccacacctagggactcggtaagccatcaaatgttctcacctgctgttagaacaccagtagactttaggagcaattcatttgaaggtagaaatgatttcctgaatgtagagaaaaatcatgtcttaaatatgaacttcaattcacctccgctgagatcctctagtggatctgttagtaattctttggcatctcctaatcatcattttatgtcaccaactgcttcaacaaaaggtcaaattgtctggtgctgtgatggggatcctgcagccatggatattgtctctgcttctaagcagttatggataggctatgtaggtcctgatgtgcctgaaaatcatattaggtttcacttagaaagatttggtactattgaacaatttattttcttcccagtaaaaggatttgccttggttgagtacagaaggatcattgacgcaataaaaactcgacactgtttacctggatgttttccttgccgtgtaaaattcatggatataggacttggaactaggggtgcaatgaatggtgttgcagttggctctagttctcatatttatgttggaaatattcctagtcaatgggccagggatgagatcatgcatgaaacaaggaaggtgatccacaagggtcctcttgcattcattgatcttagctgtgagtttgcattacttatggaatttgaaactcctgaagaagctgcaactgtcatgttgcatttgagacaactacgaagagaaagaagtaactacaaccagcattttggtccaggaacagttaatgttggaattgggcatgcttatatggatggtggaaggcctatacctgcccctccccctccccctccccctcccaatcttgaccttaaagttaacaaccctgctggatcacctcatgctcgaactctatcagggagccccgccgatagcagtcgaacaaggatgtctcacttgtctaccttacttgcttcattgcgcacaaagtataatattaatcaaaacctaggtctcagtgataattatacgattggaaataattgtcctcccatgcgtgaagaagatatggtgccatccagcactctgtgcataactattccacgtagtagctctttgttcctcacagatgatgagttaatggccatttgcaatcttgccattggaaactctggatcaattgtgcagttgacacaaacaaacttgcagatgggatgtagttggtttgtcgaatgtagtaatgttgatggtgcagtttctgttctaaagaatctccgtggttgtccaggattgttcttccagatagaattcagcaaacccggaaatcagattgctgtaccattttcagttaaaccagagaacaattcaatggagcttgtatcccccagaataaattcagaaaatcataatctgcctcagtcaaactggcactttcctggttctagggagatgtcagagcttggagcaagaaaacctgatggttatgataatttgtcacaggatcctcatcaaggaggtattgttccgcattcacactctggagcacatggaccttccattccaccaccacaacaaattcagtcttctccttttgttcgccctgtttatgttcctcctaatggtccatgggatcgtcggggaattaataatcatttacctgtcagccaattcaagacaggagtaatgccaaataattttcatggtaatgctgttgtcagtccttttattcctgcttcagtaactccacttgctcagatacaaggaactccaatgcatccttataaccagcaggtgcctccatcaattataccaccacctttatcatccttgccacctcctcagcctgaaatgccacctccacttcctccttctccaccacctttaccccaggttcagccacccttggtccctccactgcctagttctcctcctccccctcctcctccaccactgcctgttcaagaagcagtcgatatggaatgttcagggcagtccttgctgtatcaatggcaggggaatctctgtaaaagtggggttgatatgggatctcatcacctctcccctatgtccaaggttggacatctagagcctggagattgtaggactgacctaggaaagtcgtggagctag

SEQ ID NO: 69102 - DNA, 336 bp, Glycine max
  Peptide Sequence Number=SeqID_160787
atggcacaggacatgtggggcatgaagagatggttcttcaagaggcttagaaagcaagcattgagaacaatgaagcttttgaggtctgcattcaaagggaagaagctttattcgccactctccttcatggactatgtgatttttaagattatgtccgcgtttgacaccattgtgttgatggaatcaaacggcacacttccctctgcaccagaaatcaataccataaagtcagattcagggaatgaaagggcaatgcagacaaccttcaacaacaacaagccttatcctactaggattatgccttttcaattagatttcaagggcagagaagagtaa

SEQ ID NO: 69103 - DNA, 591 bp, Glycine max
  Peptide Sequence Number=SeqID_160788
atgggaaaggagcctttgttggtagaggtagaggccgaggtagatttggaaggggaaaaggccaacaaggctccaaactttgcactcattgtggatttcctcctaggtatcgctccaaaaactcaaaagaataatgatagtagcataaacttagttgcatcttcaatggacgtgtctaccgatcttggtcacaaaagtgcaagcgaattatttactcccgaccaatatcagagcttgttggcacttatccaacaaaatcataagccttcttcttcagatgttcatgcatccaacatgaccagcataggaatagccaaggtcgcgagtaacatggcgtcgaagatggagttcaagattgtgaaggcgatgagccacaacgacgaccctaccaacgacaagtacataagggagatcttgaacctcatgtctcactcgcgcggctacatccacgcgtgtgtcaccgccgtgtccaagcaattgggtaagacgcgtgactggattgtggcactcaaggcgttgatgttcgtgcacaggctcatgaacgagggtcctccgctcttccaagaggagatcctctatgccactcgctga

SEQ ID NO: 69104 - DNA, 486 bp, Glycine max
  Peptide Sequence Number=SeqID_160789
atggcttcaaagcttttactcataactgtcttcgttttttatttgattgcttttggacttgccgtggctgctgagcaaagaaaaagcatttctagtgttgtgaccgacaatgaattttggcaagtcgatgcttctgttgcgggaagcctcttaaccctggaggctcaagggcctggtgtttttcatcatagcagaggtgtgcttgttggctggatcagtggaaaattcctatcacaccaagtacatgacaatcttcggggaggttgggagaaagttaacatttctcctttcaaatccttcataacaatacaaggagaaggtgcagataagaccattgttcagtggggtgacactgctcaaagtcagccattaggaacctatggttctgcaacttttgctgtgaattcaccttatttcatagccaagaacatcacatttaaagctgagtttgttgagggatcaaggacgaggtttaaagagagttag

SEQ ID NO: 69105 - DNA, 1158 bp, Glycine max
  Peptide Sequence Number=SeqID_160790
atggaggagagaaagaagcacccttcttttccctccaactatctcactctcgctcaactccaagaacgatggctcaagcagcaaaaccaaatcaaccaaccacaaccacaaccacaaccacagccacaagaacaacacaaccaccaccaccgccaacaaccacaccaagagctggtactcgttcccagaaacggaaacgcttataggtctcgttctcagtttcagtatgttgcgaagaatcggaacgattccgaaactcgccgccgcgcaaccaaggttgcggtggcctccgatgacaactgcaaatcggaggccgtcgccggaatcggtgacgaaaccgccgatctgaatggaaaatccagtgaatcgaagaagaatcagaataataggaggaatgggaaaggaacatggaaaactaagacggagaagagaggagcgcgtggagatggctctggaacaggagcacaggggaaagaagaggcagagaagaaagccacaatcgagaagaagaatgagttggagaagaacggtggttcggcatcggtggatgaggttggacagcgagttagggttttatcgattaactcaggggatgaaaagaagaagaagaagaagaagaacggtggttcggttacggcagaggaggttgttgaacagagcgtgaggattttatcgattaactcggggaacggtaaacagaacaacgggagattagggaaaatgaacaacggttttggaacagcggcacatgggaaaaaagaggctgagaaaaccacaatcgaaaacgagttgaaggagaagaagaacggtggttccgtaacggtggaggaagtggaacagagagttagggtttcatcgaagaacgaggaggaggagaagaagaacggtggttccgtaacggtggaggaaatggaaaagagagttggggtttcttcatcgaataactcagggaatggtaaacagaacggaagattggggaaaatgagcaacagttttcgtcactctgaatctcagaggaagtattacggtggtgaagcaagttatggctatggctatggtaatcgtggtaacggtcactactctaaggttggggtgcagaaaacaacagagaagaagatggtttgggttaagaaggatgagatagttggtggaaattga

SEQ ID NO: 69106 - DNA, 321 bp, Glycine max
  Peptide Sequence Number=SeqID_160791
atggctaaaaggatgaatggaaagggtgggttgtcattatcgtccttagtctccggtatggtgaagtgcaaatgtgagaatcaagttcttgtagattttttcaatggattggtgatacagaggctagcaataatgtgtctgcaaaagggggtgagttggtgtgctaaaacaaaagcaaaagaaattatagatttaaggaaaataattgttgcacaaaaggaagaatgtcatgcatcttctgagcaagttgtgtacttcaagaatcttgttgttgaaaggaataaagtgaagttgttaggttttgtagttgtagttctttag

SEQ ID NO: 69107 - DNA, 480 bp, Glycine max
  Peptide Sequence Number=SeqID_160792
atggtggtcacaattcgatactcaaaggctgctccagatcaagtcaagaactggttccagagcaatcctgagttccttaaacctgctgatccagagacatctctgttcctgaatcagaagtcgcaactggcagcattcttagcaagctcaaaatctaaagagagtcttgctcagaatctcaaagaagttctccaactagttcaacaggaagtggaagaagaaccttccaaaaaggaagctgaatcatcagagactaatgatgaccaagaagacgatccattctaccagaatgaagatgattgtttcgatgaatggcagcgaaatggagaaaggaagagagagaggagatgccacttcaaggagaagatgagtctagaagaagctcaccaccataggaggccatggataagagcttggaggaagaaggagatgaatgaggagagagggagagaagagcacgaaattttgtgttctaaatga

SEQ ID NO: 69108 - DNA, 318 bp, Glycine max
  Peptide Sequence Number=SeqID_160793
atgagagacaacaacatcaaattcatccatactattaacattgtgactattgtttacaggtcatacactgctcaatggaatgcctcgaaactcccccatgataagcgcaagtcacaatggagttgtatcctctggcaaatggaggttgaagaatctttgctgggtttatggctaccattgcattatagagcagataaggaagggtggtgtttcgtcttggatgtgcaacaggtggattttgtggccgatttaggggtggcctttgtggatgattgggctttcttggttgctagggtggtgtgtaatggtaaggactga

SEQ ID NO: 69109 - DNA, 255 bp, Glycine max
  Peptide Sequence Number=SeqID_160794
atggagggtatacaacaagacgaagagattcgaaggattcaaagagaaaataaggccagggaaatcatggatgtttgtgtggtgcggtgcagtgcggttcagagagtgagtgaggcaatttacccatttggggttggacccacaccaatacagtcttttctaatctattgtgattatcaattggagtgggtgggggccactcagtcgtacatcccttccccacatattgtgatggacacagaattcatctcgtga

SEQ ID NO: 69110 - DNA, 276 bp, Glycine max
  Peptide Sequence Number=SeqID_160795
atgaggctcggagtttatgagcagttcgagcaaagagatccttgctggagttttattcaattgttcaactactttaaactcactttgttggatgagacgaaggaactcatgagcctcttccaaggtcaccgcctttccttggagaccttccttcttttcagctcccattcactaccgggggatccacttcttttgaggggatggccgcgcccgcggactcttgggtcatgggtgctttccccttggagggcaattctgccgagtgagggggagtga

SEQ ID NO: 69111 - DNA, 778 bp, Glycine max
  Peptide Sequence Number=SeqID_160796
atgagtgatacacaaatccgcattgcgattgcgggcgccggcggccggatgggccgtcagttgatccaggcggtgcagcaggcggaaggcgtggtattgggggcggcgctgtcgcgcccgggttccagcctgatcggcgtcgacgccggtgagctggcgggcattggcgcgctgggcgtcaaggtgagcgacagtctggagaaggtggcgaacgagttcgatattttgatcgacttcacccgcccggaaagcacccggggctacctggatttttgcgtggcgcaccacaaggcgatggtgattggcactaccggcttcgatgacgccggcaagcaggcgatccgcgatgcggcgcagcatatcggcatcgtgttcgccgccaacttcagcgtcggcgtcaacctggtgctgaaactgctggagaaggccgcgcaggtgatgggcgactataccgatatcgaaatcgttgaggcgcaccaccgccacaaagtggatgcgccgtcgggcacggcgttggccatgggcgaagcgatcgccggcgcgctggggcgcgatctgaaaagctgcgcggtctatgcgcgcgaaggccataccggcgaacgcgatccgaaaagcatcggctttgccaccattcgcgccggcgacatcgtcggcgagcacaccgcaatgttcgccgacatcggtgaacgggtggaaattacccataaggcctccagccggatgacttttgccagcggcgcggtgcgtgcggctgcctggttgcgtaaccgggataaag

SEQ ID NO: 69112 - DNA, 264 bp, Glycine max
  Peptide Sequence Number=SeqID_160797
atgtggcgtgttacggtgaaaacctggcctatttccctaaaggccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggagtaa

SEQ ID NO: 69113 - DNA, 279 bp, Glycine max
  Peptide Sequence Number=SeqID_160798
atggtgaaagttggaacctcttacgtgccgatcaacgtctcattttcgccaaaagttggccccagggcttcccgggtatcaacagggacaccaggattttatttatttctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 69114 - DNA, 563 bp, Glycine max
  Peptide Sequence Number=SeqID_160799
atggctccgaagaaactctccacgaagaggtctagaagagacgccacaggagaagggtccaatgccgcccccgaggagaggcgtgtccagctcagggaggatgagtatacggactttcaggaggagatagctcacagacgttggacaccgttggtgactcccatggccaagtttgaccctgagatagtcctagagttctatgctaatgcttggcccacggaggagggagtttgggacatgcgttcgtgggtgagggatcagtggattccctttgacgcagatgccctcagccagttcctgggtgacctgctagtgttggaggaaggccagcagtgtgagttcatccagaggaggaacagggccgacgggttcgatgaggaagccattgcccagttgttgtgcacaccggggcaggatttcacccagacccttgtagggaggcgggtgcagatcatgcgcaccagcatgaccactttgacccagacatggatgacactgctgcttagcaatgtcttgcctagcaatcacaactctgatcaccctctgcctaagtgccagttggt

SEQ ID NO: 69115 - DNA, 1380 bp, Glycine max
  Peptide Sequence Number=SeqID_160800
cgtgattcagcccaacttctggtggctgttactgctgacagtgatcttcggctggatgagcctgccgcatcatgctgcgccacatgttgcccaacgccatggttgccacgctcacctttctgccgtttatcctgtgcggttcgatcaccacgttgacctcactggattttctcggcttcggcctgccggtgggctcgccgtcgctgggcgaactgctgctgcagggaaaaaacaatttacaggcaccgtggcttggcctttccggcttcttcgccctcgccctgctgctgtcgctgctgatttttatcgcatctggcggtggcgttcgggccgcgccgcgtggtggaagatatctcgctgcgcatcgacgccggcgaacgctggcgctggtgggcgaatcgggatcgggcaagagcgtgactgcgctgtcgattatgcgtctgctgccgcagccgccggagccgatggtatcactcaatccgctgcacagcgtggaaaagcagctgccgcgacgcgcctgcaggattttccgcaccagctgtccggtggcgagcgccagcgcgtgatgatcgccatggccttgctgacgcagcccaaactgctgattgccgatgagcccaccacggcgctggatgtcacggtacaggcacagattttacagctgctgcgcgaactgcagcgcgaactgaacatgggcatgctgttcattacccataacctgaacattgtgcgtcagctggcccacagcgtgacggtgatgcgcaacgggcgcgaggtggaacacaaccgctgtgacgtactgtttcgccagccacagcagccttatacccgcgagctgctggccgccgagccggacggcgcaccggtgggtttcccgattcgccgtggactgctgaagcgcaccgtggcggaaaaaaccgcgctacacaatctcagttttaccctgcggcgcggcgaaagcctcgggttagtcggcgaatccgggtcaggcaaaagcaccaccggcctggcgctgctgcgcctgattgctgcgcgcggcgagatctggttcgacggccagccgctgcatcagctgagcgcgaagcagctactgccgctgcgccagcgcattcaggtggtgtttcaggatcccaactcttcactcaatccgcgcatgacggtacagcaggtgattgccgaagggctggcggtgcaccagccgcagctcagcgctgccgaacaggaagccagagtcattgcggtgatggaagaggttggcctggaggcagcgagccgcagccgctacccggcggaattctctggcggtcagcgccagcgtatcgccattgcccgcgcgctgatcctgcagccgcagctgatcgtgctggatgaacccacctc

SEQ ID NO: 69116 - DNA, 642 bp, Glycine max
  Peptide Sequence Number=SeqID_160801
atggcacacatcgagaaacaagctggcgacctgcaggaaaaactgatcgcggtaaaccgtgtctctaaaactgtgaaaggtggtcgtattttctccttcaccgctctgactgtagtgggtgatggtaacggccgcgttggttttggttacggtaaagcgcgtgaagttccagcagcgatccagaaagcgatggaaaaagctcgtcgcaatatggttaatgtcgcgctgactcacggcaccctgcagcacccggttaaaggtgcgcacacgggttctcgtgtgttcatgcagccggcttctgaaggtaccggtatcatcgccggcggtgcaatgcgcgccgttctggaagtcgctggagttcataacgttctggctaaagcctatggttccaccaacccgatcaacgtggttcgtgcaactatcgacggcctgggcaatatgaagtctccggatatggttgctgccaagcgtggtaaatccgttgaagaaattctgggctcaatcggccgcctgcctaagcacaaagccactctggttggtctgggtctgcgtcgtattggtcacaccgttgagcgtgaagacacgccagctgtacgcggtatgatcaacgcgatttcttacatgctgaaagtggaggagtaa

SEQ ID NO: 69117 - DNA, 705 bp, Glycine max
  Peptide Sequence Number=SeqID_160802
atgtataccggggcaagatttgcccggactgctgtcgggagacggttgcggatcatgcgcaccaacaggaccaccctgactcagatatggatgactttgctgctcagcaacatcctgcccagcgatcataattccgacctccccttgccgaagtgtatggcacctaccaagcaccctctggacccggataagtccaacagggccctgggatttcccgccttgatcacaggactctgccagtcgttctgcgtccccatcacacctagcaaggtgattcggccgcccatcacccgagcttttattgagaagtactgcacgcagagacaggtccagggtgatgcaccaccggccgcggacgcgccgccaccttatcaggctgatccagccggattgtttgatatggagcagtatttgcggcatttggttcgccagcaggcggccaaccaccgggcacatgtacagacccatgattgtctttatcagatgagtctcagcctgcagggccagggctttacttcttttccgtgccttactccgtaccagttcagggcagaggtcgcatggcctggagattggcctgaggcccgggcaggagagccaccagcggaggcaccagtagaggctcccgacgaggcagatgaggcccgcgaggacgaggagatgaccgatttactggatttcttaggagggagcggggccacatga

SEQ ID NO: 69118 - DNA, 762 bp, Glycine max
  Peptide Sequence Number=SeqID_160803
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcatcctccatcaccaaaccaaccaagtccaccatcccatccccctttagattcagaggttcccatagaaaaacaaaactgtcacaagcgaaggagatccgagtatggagggagttcaagcgctgttgggatcaacaatcaaggcaacgttctggaaaaggcaaacatgaagtga

SEQ ID NO: 69119 - DNA, 231 bp, Glycine max
  Peptide Sequence Number=SeqID_160804
atgtccgatagcacgcgaagacaaattatggtcatccgcacgcttttgctatctgtttttcactctcgtcgtccgaaaacattcaaatccagcgacgcgcggaattcttctttgctgggcagagacgatcgggtgcaatggggaagggaagtgtcgtggttgtccaactttgtcgttttcaaaacactgaagtttgttgatgcttctgatgcctttttcttttctttctga

SEQ ID NO: 69120 - DNA, 288 bp, Glycine max
  Peptide Sequence Number=SeqID_160805
acttatcaaggtaatccttgtggcgtctatcctgacttatcttccttcaccggaagtggcgtctacccagacttatcttccttcactggaagtggcgtctacccagacttatcttccttcattggaagtggcgtctaccctgacttatcttccttcactggaagtggcgtctaccctgacttatcttccttcactggaagtggcgtcatccaaatctctgtaacctgtatcaaacgatccgctcctactcaggttcacatcatctggtatcagagctttggctcttga

SEQ ID NO: 69121 - DNA, 273 bp, Glycine max
  Peptide Sequence Number=SeqID_160806
atgagaattcaagggactaaccgcctaagaattctttgtcctaacatattggagggtacatcctttgtagtacaagtagagggtatatctacttgggttgtgtcgcaacgtgcccttcgcgggcgagcgagggcgaggctcacgggtgcgctttccaaaggaggaaagatgcgcggagtcgccaccaacgtttatttgtggaaaacgtcggaaaaaccgatggaaaccgttcaagatgaaaattctaagttcgggagttgtatttacgcttga

SEQ ID NO: 69122 - DNA, 171 bp, Glycine max
  Peptide Sequence Number=SeqID_160807
atggctcaagataatgcatctaaaaaggtttctctgtcatatcacaagagcactgagtccgccatcaggaatctggaggtacaagtgggcaaattagctaagcaattgactgaaacgtccacaagtagttttgcggccaactcggagaacaatcccaaggaggagtacaag

SEQ ID NO: 69123 - DNA, 645 bp, Glycine max
  Peptide Sequence Number=SeqID_160808
atggcagcgcaggtagcccctccaatggtcgagagggagatggttaccatgatggtagataccttgcctgtgttttactatgagaaattagtaggctacatgccctccagcttcgcagacttggtattcgctagggaaaggatcaaggtgggcttgaagagacggaagttcaattatgtctactccacaagtgccaacggtaggaggattggagcaactggggcaaagaggaaggaaggagatacccatgccgtcacttcaacgcctgcatgggtcaagccgccgcagatctcccacgagggaggtcccccaagctctggtttcgaccatgactcgcccgaccaacaatgcccaccttggcgtcggttccaacgcagcaaggaactttcccccaaggccaactcaagaattcgccccgatcccgatgacgtacaaagacctcttgccatccctcatcgccaaccaaatggttgtgatatctcccggaaagatctattagcctcttttcccgaggtggtccaaacccttaagggacgtaatgacccccagaaggtttatctaggaggccctacaaaaggggggcgtgattccccacggtgggcacgagaaggattcttgtctgatgcatcccggcgtgccacatag

SEQ ID NO: 69124 - DNA, 243 bp, Glycine max
  Peptide Sequence Number=SeqID_160809
atgattagtgcttttgatcaacaaaatggcagggcaataatagaaatgaatgttgaagtagacactgtcagttattctaatatcccattaccaggtggtgcagttagttctcgcatgtcaaatgatgatgacaactatattatgtctaactcatttaccaaggaaacatctaaggaggaagatgaaattgatggtgatttttttgacacaaatgacaaagcaatgtctattgagacaagttag

SEQ ID NO: 69125 - DNA, 300 bp, Glycine max
  Peptide Sequence Number=SeqID_160810
atgacgggagtcatcgttttaaatagaggtcaacaacccaaattggggccacatcaatcgcatttttttgcagttgctcgcaatgtaaatgttttctggctgacagcaactgcaacagcaattttaaaccatgacaggagtctttggggattcggaaattcagatgttgtgaagaaagcctccctttggtggagagatttggcaaaggtaccctcccaaacaaacaatgttatttttagaggggccaatgtcgattgggaagctgtgttgtgtgcccgcaagggatccggcaaaacttag

SEQ ID NO: 69126 - DNA, 522 bp, Glycine max
  Peptide Sequence Number=SeqID_160811
atgtgtagtcctctggaggtgagggcgtgtagtcctctcaaggtgagggcgtacagccctctgttggcgaggacgtgtagtcctctcaaggtgagggcgtgcagccctctcaaggcgaggatgtgtagtcctctagaggtgagggcgtgtagtcctctcaaggtgagggcgtacagccctctgttggcgaggacgtgtagtcctctcaaggtgagggcatgcagccctctgttggcgaggacgtgtagccctctcaaggcgaggacgtgtagtcctctaaagattgactgtccttttgaaaaaggtgataattcatgcaacctcatcctatctttttgcaaatctctccgggaattccctcagagtgagggaacctattgggtgagaacttctaatctgcccctaggttcacttgaggctcatgcacgatgcccctcatttccccagtgtaaggctttgaggtaccaatcgttgtcttgttttcatagcctcgtagtaaggaagaatgaaagaagcagttga

SEQ ID NO: 69127 - DNA, 987 bp, Glycine max
  Peptide Sequence Number=SeqID_160812
atggggatagcgttaacgaaaccgtgcatgtcttccgggcggcgccgcgtgcgcgtgtatacgcgaaaatacgttccacgcccccgaaaagcggagaatgaaaaattgagaggtttgccccgcgaactgacgcagaattcacgcagcgacgccagcgcgcataacgtgaccggcgcaagcgcgacgcgctactttgactacgcctcggcgctggcgctgcgcaacctggctgcgcactacggcaccgccatgccccgctacctgctggcgcccgaggtggcgctgctgctagacgccgagcgggaccagcggaagcgactgctgatcgaaacgttctggaacaccggcggccggctgaatgaggtgctgccgctgacgccggaggatttcgttctggacggcccggacggtcgcgctcttgatgcgccctttgcggtgctgcacaccctgaagcagcgacgggacgaggaaaagcagaagcagcgcgggcgcggccggccgacgcgggaagaacaggcggcgcagcgcgaagcggaagccaacccgccccgcgccgtgccgctgaccgatccgggctacgtgcgccggcttcgcgaatatctcgccaccgtgcggctcaggaagggagagcgcatctggaagattgacagtcccgataccgttcgcacctggatccgtacagcagttcaggctgccgagcgtgacggcgtcaccttcactatcagacccatcaccacgaagacgttccgggattcgtttgcgatgcacctggtgcagcacggcgtaccaaagaaggtcatccagtcgatgatgggccacaaggatgagaagtcgacggagtggtacacgcaggtgatggcgctggacgtcacgcgccagctcggcgtgcggttctcaatgacgcctgaggatgcgcgggcgctggtcatgcccggcgagcggctcaccctggtcagacaaaactacgatcagggtgaggggggataa

SEQ ID NO: 69128 - DNA, 1281 bp, Glycine max
  Peptide Sequence Number=SeqID_160813
atgcccatgtttggtctggccgacgtcaactccttttacgccagctgtgaggcgctgttccgccctgacctgcgcggcagaccggtggtcgtgctgagtaacaatgacggctgcgtcatcgcacgcagcgcgggcgccaaaaaactcggcataaaaatgggcgccccgtggtttcagataagggggcaggattttgccgaacgcgtgcatgtgttcagctcaaactatgcgctttaccactcgttatcgaacagggtcatgatggcactggaggaaatgacgccgaaggttgagcagtactccattgacgagatgttcctcgatttaaccggcatcgatggctgcgaggactttgagcacttcggccggcgcctgcgcgcgcacgtgctggccacgaccggcctgaccgtcggcgtgggcatggggccgacaaaaaccctggcaaaatcggcgcagtgggccagcaaggagtggccgcagttccgcggggtgctggcactgacgccggataatccgaagcgtaccgcgacgctgctggaaaaccagcccgtagaggagatatggggcgttggccggcgcatcggcaaacggctcaacctgatgggcattgaaaacgccctgcagctctcacgcgcgcaccctgccctcatccggaaaaacttcagcgtggtgctcgagcgcaccgttcgcgaactcaacggggaatcgtgcattcccctcgaggagtttgcgccggcgaaacagcagatcgtctgcagccgctcttttggtgagcgcattacgacaaaagtggccatgcaggaagcgctgtgtcagtacgccacccgtgcggcggagaaactgaggaaagagcgccagttctgccggcgcatcagcgtttttatccggacctcgccgcacgcgcagggagaggtcttctacggcaacagcgccggcgagaatctcaccctacctacacaggatacgcgcgacgtgatcggggtggccatgcgatcgctcgaccgaatctggcttgacgggcggcgctatatgaaagccggcattatgctcgatgacttcacgcccaacggcgtcagtcagctgaacctgttcgatgaggataagccgcgggcgaacagcgcgcagctgatgaaggtgctggacggcattaatcagtccgggctggggcacatgtggtttgcccgtcagggtgtcagcaatgagtggcagatgaaacgcgagatgctttcgccggcatggaccacgcgctgggaggacattccagttgcccgcgtattataa

SEQ ID NO: 69129 - DNA, 939 bp, Glycine max
  Peptide Sequence Number=SeqID_160814
atgtcctataaccttgcagcacggtcgcgggaagaacgagacagagttaacgtggatttagccgcgtctggcgtggcctggaaagaacgcatgaacctgccggtgttccccggcgaagtggagcggcagcagcctgaagaactgcgtgaatacttccgggagcgtctggcgttttaccggattgaagcgctgaaattcccgcgcggcaccgatcccgtttatcagaaggagacaccgtgccttcactttagccgggcggcctcacaaacaagggaagctgtcgccggcctgctcacccgttccccgccgtgcgcgggacattcagtccgctccggcggcgcgtgcggcttgcgcgtccgcccctgtttgctcagctggtcgcccggcttttgtggcggcacggtgatcggcagcagcagcgatattgagcgggtcagaactttttttaatggcggcaaccgcccggagtatgtccgggcgacagctgagggcattcagctgtttctcgccggttgcgccggcctgctgcagcctgtcggagacgtccgttatccgccttatccggcgctcacggtacgtgacggctgcgacacgccggaaaacagggcgttcacgcagtggctcagctatctgaagagtggcgcagagctgacgaaagatacctgcggcgagctgcacacactgtggatcgcctgcggcatcagcagctggccgtgggatgcgctgaacgcagggcagcaggctgtcatcgcagcgctgtggaagcgcaaggcatatgactggcagtttgcgttcggcgagggtgaaccgggcgaaatgtggaaccggctgtgccgtcacacttttatgccggaggctgcgctgccctttgacatgctgcagctgatcgccccgcgcctcgatgtggaatcacggctatacggtcgtctgcttgagggc

SEQ ID NO: 69130 - DNA, 210 bp, Glycine max
  Peptide Sequence Number=SeqID_160815
atgcggtcatgggtgaggggtcagtggattccctttgacgcaaatgccctagtgttgaaggaagaccaggagtgcgagtttagtcagaggaggaacagggccgatgggttcgatgaggaggccattgcccaactattatgcgcaccgagtcaggatttctcccagaccgctatagggaggcgggtattccacccaccaggcaccctctag

SEQ ID NO: 69131 - DNA, 546 bp, Glycine max
  Peptide Sequence Number=SeqID_160816
atgagtaaaaagttattgtctgttgaatatgctctagcttctgttttcaattacgaggtctcgatatattatgggattcattcggacatccgagtaaaaatttattgccgtttgaatttgctacgagcttccggtttcaattacgagcgtctcgatatactacgggaaacaatcggacatacagtaaaaagttattgtcgtttgaatttgctcagagcttttgttttcaattacgagcgtctcgatatattacggtattcggacatccgagtaaaaagttattgtcgtttgaatttgctcaaagcttcttgttcaattacgatcgcctcgatatattatgggattcattcgggcatccgagtaaaaatttattgccgtttgagtttgctacgggcttctggtttcaattacgagggtctcgatatactacaggaaacaatcggacgtacgagtaaaaagttattatcttttgaatttgctcagagcttctgttttcagttacgagcgtctcgatatattacgggattcattcggacattcgagtaa

SEQ ID NO: 69132 - DNA, 243 bp, Glycine max
  Peptide Sequence Number=SeqID_160817
atggtggaagggcaattgatcatagtctcgggagaggaagacattcttgtaagttgtccttcttctacgccctatatggaggccgcggaggagtccttggagaaggcctttcaagcatttgaagtggtgagcaacgcttatgttgagtctcccccggtgcaaccgcgctcatccgatgctgcattaatggtggctcgtgtgatgttgggacatggatacgagctcggcatgggtttgggctga

SEQ ID NO: 69133 - DNA, 402 bp, Glycine max
  Peptide Sequence Number=SeqID_160818
atgaccggaaggcttcttgccggtcgtatcttacttccaaaatcttcaaaccttgcacaggtttctgaagaagatcttattgttatgtgggcttttcataaaggcctaaaaattgattgggcacacctaattcgatatcgcatgcataagtcattgcgattaaatgctccattgccatatccacacctagtcaccttcttccttcaacactttaacatccctcttgattctgaaccctatgttccaatcaagagatcctttctaataggcactgctgtcattgcatcctttggttatcaaaaagagcataatggctcctgggtgaaaaagggtgctcgacatgttgatgaagaaggacatggtgcaagaagattcctctcttcttcaaaagattttggatag

SEQ ID NO: 69134 - DNA, 546 bp, Glycine max
  Peptide Sequence Number=SeqID_160819
atgcacaccacaaacagcactaaagtccaatcacttctgaaaccattcagaaaaaaccgttcggttacttccacaactattcacgttgaggttcttcatatcatcactgcctttcacattcaagaagcaactattcacttacaccatttccaacataaacctatcgccacttatgccatcgaaaagataaatcaattaatcaagtgcactcaactattaacccatattactcgttcctctacaaacatcatcttaacatcacatcaccatacttttacttcagaaaaacccaagatgagtacctcatcctccaccgcttcaaccaaaatcagatatccaattgtgagaccacctgcaatcatgcaattcagagtagctttccacaatgaccagagatacccccattttaccatgaacaatgggcacccaattacctacacgaagtttggttcaaatacaatggagcaacctacccaatacgggtccaacaacaccgaggcagatatttttttacagatggactctgagacgtcagggcagatttaa

SEQ ID NO: 69135 - DNA, 483 bp, Glycine max
  Peptide Sequence Number=SeqID_160820
atgactgatcctcttttgactaatccacctgcctccacaccttctccttcggacgcatcggcttcgccgtctgccgtgaagcggacacgcaaagcctcacgtctacgatcgttgtccactagaccacctggtgttgagagactagtggtgcatgttgatcctgttaccgggaaggccgacggtccccacaggaagaaattaagaacatatttggggattgtggcgcgtgataaggtggacgtcacctacgagaactggaaagagacggaatttgatatcctagaggcttttgacagtaggacgaagaggaagttactgcagatagtgggggagagatggaggcagtttaaatcagacctcacgagggaatgggcccttgcagccgatcaggacggtgtcgaggacactgtctgtgagaaatacggcatcagcaaggaaaagtgggcccagttttgccagactcgcagagacccttcttgggag

SEQ ID NO: 69136 - DNA, 462 bp, Glycine max
  Peptide Sequence Number=SeqID_160821
atggagtttttatgtcctttttgtggcaaggtggaggaggaggcatctcatttattcattcactgcactaaaattcagtctatttggtgggaaactttgtcgtggatgaatattagcagtgttcttcctttaaaccctcgctgccacttccttcaacattcatttgtccaggtggctggcataagggttaagagatggcaatgctggtgggtggttgtggtatggtccatttggcaaatgcgcaatagaattgtattttcaaatgaaagcttcaatggaaacaagctgatggaggatgcaatcaacaagcatattctcatcttggtaagactcacaatgatgagaatcatgaaactggccaaatacaggctaaaggcccaagtggagaagaacgaaggcccaagtggagaaggacaaagcccccgagtggagaaggatgaaggcccaagtggagaaggatga

SEQ ID NO: 69137 - DNA, 492 bp, Glycine max
  Peptide Sequence Number=SeqID_160822
atggatcttggactttctatattggaagagaaacttgctactattattgattctagtagcaatgaagagaaatctcattataaagcttgggaaagatctaacagacttagcctaatattcattagaatgattgttgcagacaatattaagacaattatccctaaaatcaatagtgctaacaagtttatggggttagtgggagagcattctcaaacaaatgataagtctcttgctgggacattaatgagtacactgaccactacgaagtttgatggttcatttcaaaaagaaacgaggcttaagaatcaaggaagtcactctgtccattttgtaagccaccaagggaatcaagaagttggaaagaaatttgtgaagaagcatggtaaaggcaaagggccattaaagatcaatgattactctttgcaaatccataagaaggcatcaaagagcaataattgccatgtgtatgggaaatctggtgttcttatctaa

SEQ ID NO: 69138 - DNA, 1257 bp, Glycine max
  Peptide Sequence Number=SeqID_160823
atggatcgcctaaaatcttctccgcagctcatgattgtttcggatcttgatcacacaatggttgatcatcatgattctgagaattggtccctttttaggttcaatgccctttgggaagcccattatcgccaagattctctgctggtgttctcaactggaaggtcacctacactctacaaacaactgaggaaggaaaagcctctgataactcctgatatagccattatgtctgtggggactgagattacttatgggaaatcaatggtgcctgatgatggatgggttcggtgtttgaaccagaaatgggataaggacatagtcatcgaggaaacaagcaagtttcccgaacttaagcgtcaggctgaaacagaacaacggccgcacaaggttagcttttatgttgagaaagacaaggctaagcatgttacggagactctttctaaggttttggaagggcgtgggttagatgttaaaataatatatagtggaggagttgatttggatgtattaccaaaaggtgctggcaaaggccaagctcttgcctatctgctcaaaaagtttgagactgagggaaagccacctgttaatactcttgtttgtggtgactctggaaatgatgccgagctgttcagcattccgggagtttatggagtcatggtaagcaatgcccaagaggaactgttgcagtggcatgcagaaaatgcaaaagataaccccaagattcttcatgcctcagagcgttgcgcatctgggataatacaagccataggtcattttaagttaggcctaaacctgtcccctagagatgtttcagacattggacaaaacgttgaaaatggatctccaggccttgaaatggttaactttagtttgttactcgaatcatggaggcgtgcagaagttgagaaaacggagctgtttatttctggtttaaaggcaaccactctcccatctggtttctttatccatccttctggtgctgaccataatattaaggagtatgtaaatattcttagaaaggtgcatggtgacaaacagggaaaacagttcaggatttgggtggatgatttattggctacaccgttaggttcagatacatggctagtgaaatttgacaagtgggagttatctggtgaagagcggcagggttgtgttgttaccgccataataagcaaaaaggattcggattggttcacttgggtgcatgtgcatgaaacctggttggaaaactcagagcaaggtttatggatactttag

SEQ ID NO: 69139 - DNA, 516 bp, Glycine max
  Peptide Sequence Number=SeqID_160824
atggcagttggtcatgatcatggatctcatattgaggatcaagcaccacctcggaggaatgaacatcatcgtgtttcaagtacggtggcaataaaggaagtaaagaaagttgagcctcaaatttctaaagtggattcaaactctgcaaatgaagaggaaatcaactgtggcttctcgtgggatgcgaaagcactaatagcaatagttggtttctctttatatggggagttttggaggcttgatcgggttcaagctgtagatcaatttgggaactcactgagaaagctgaatcaagtccaaatcagcagaagggtccctgtagatatgattgatccggtcgcagttttcagagaaatgcttaattacatcaatctatgggcaaaatggttttccatggattacaacacagaggctgtgcattccttgcaagctggcatgcaagatatccctcttgttgtgtactggacaattgcttccactgttgcttctattggcaaccttgttgatatatcgtaa

SEQ ID NO: 69140 - DNA, 231 bp, Glycine max
  Peptide Sequence Number=SeqID_160825
atggcagcggaatggagaaggaagagagagaggagacgccacttcaaggagaagatgagtttagaaaaagctcaccaccataggaggccatggataagagcttggaggaagaaggagatgaatgaagggagagggagagaagagcacgaaattttgtgctcaaaaagagctctgaaatctgaacccactaatccaagatcaattccaagattctccactaagtgtgcttag

SEQ ID NO: 69141 - DNA, 417 bp, Glycine max
  Peptide Sequence Number=SeqID_160826
atggagaaagcaaatacatcactagtgagaacaaaatcagaccaactattagaatcaatggtggcaggcttaaagtcgccaccatcgagcgatcactccgcgaacggagtggtggactcgaggaagtcaagccgatggctgacgggggcctcgccggggcgcggcgggaagaacacccacataagaaagtcaaggagtgctcagataagtcaaatgaagctagagctcgatgatgtgagtagtggtgctgcacttagcagagcctcaagtgctagcttgggactctctttctccttcactggctttactatgcctcctgaagaaattgctgactccaagcccttcagtgatgatgatatccagtttcacagtcagagattcaccttgacatttaatcaagaccttcaacattattga

SEQ ID NO: 69142 - DNA, 631 bp, Glycine max
  Peptide Sequence Number=SeqID_160827
atggctactccacctgcctcgccttctcctactcctcctacagacgcatcaacgtctccatctacgttgaagcagacacgcaaggcgacgtggctacgatcattggccactagaccaccttgggcagaaaaacctgtggtcaacatcgatcctgctaccggcaaagccgacgatccctacaagaagaaattaagaacatatttggagattgtcgctccggaatttgaaatccctgaagcttttcacactaggacaaagaagaaaattcttcatattgtcagcgagcgctggaggcaatttaaatctgacttgactaggaaatgggcacttgcagccaacaaggacgaacaaaaactcatggttgagaagacaaagaaaagactaaaagaagctgccaagtctggaagcattgagggcatcattgaccttccatctcccatcagacgccacgtgaagtggaagatggctcgcacgaaaaaaactggacagatgacgtttgagactgcaaaggaaataactgacaggattgaaagcgtcacaaggattgttcgtcctccatggacatcaggatatcctgactgctgtcattgggcgaccagagcacctggttgtgttcgtgctgttggtgccg

SEQ ID NO: 69143 - DNA, 1245 bp, Glycine max
  Peptide Sequence Number=SeqID_160828
atgctgccaagacatgttcaaactattggtagtctccttgagagagttatgcaagttcatgttgcgcagctcagaggaataaatacacatttctgtctttggtactcttctgtgtcgacttgtaatgagctgccaagaaagctcaacaagtatgagaggaaaccaccggtgacaagttttaatgaacttaagcgtcaagccagactggagagaaaggagaggcaaaaggtgcatgagaataaattacaacctcccgaaaatggcttattggtggagcatttaattcctattgctcatgaagtttatgctgccagatgtcacaccataactctagtattcttcattgtggttgttcaagcttttagcatgttgcctgtagatattctattcaactatgatatctgcttatgtggagaagttcatgttggtcatccaccacatcaaattagaacatgcgatgttagaggaagcccatcaagcaaagaacatagttgggtcaaaggtggtgttgaacatgttctgccacttgtagagtcatttcatctgtatgatagaatagggagggctgtttcacataatgaaatgcttgaagtagaccgaattccagcaattgttgaattgtgtattcaggcaggttttgacatacctgagtaccctaccaggagaaggtccttccctgtttactgtgttgctggtaggattattgattttgagaaaagatttcctaaagaaatttctcttggtgaagatatagaagcacatgggttttggtttaagaaaaaaagagtggatgtaaacacaaattctatggcaatgcaatctgatgatatccaagctattgctgttcgaggcatgaaagcctgggaaaaaatgcatggaggagcttcaaaacttatggagaagtatgctgtccaaacttgtggatattgtccagaggtacaagtgggacccaaaggtcatagaggacgaaattgtcaagctttcaaacaccagatgagggatggacaacatgcatggcaggaggcaagaattgatgatttggcacctccagtatatgtctttcacattcgagatgatcaacctaggaaacctctggtaaatgagttgaaaaagtactatggtatgctacctgcagtggttgagctatttgcccaagctggggctccagttgataagagttatgcttgtatgatgagggaagatgttgtaatccctcaaatggatgaggaaaagtgggttgtttaa

SEQ ID NO: 69144 - DNA, 261 bp, Glycine max
  Peptide Sequence Number=SeqID_160829
atgtctgaagaagttgatatgaatgatgaaaatgaagacgaagttggtgtgaatgaagaatatgttgattgttcttatgcgtttaatacttctcagactaaacttatgtggattgcattagtggtcagtgtaggtctaggaagaaagattttgtcagaaaagatactggcagtaggaaatgtgggtgtccttttaagtttcgttggaaaccagtggttggaggccaatgatggatgtgaagttaatgtgtgggagtcataa

SEQ ID NO: 69145 - DNA, 324 bp, Glycine max
  Peptide Sequence Number=SeqID_160830
atggaacttctgaaattcaatttgaaaagtcatgacccttcaaaatataactgtgtaatcgattaccagaaacatagagaaattcctctaggatcttcaatttgtatcatccactctaaaggagggaaatctttatgttcatctcaaaaagtcagttgtaatcaagagactggttgtctcttggattgtgagagttgtaatcaagagacgggttgtctcttggagaatcttgaacacaagggtgagggattccaaggagtgttcaaagtctgtaaaggatttacagagatagtggaaatctcaagtgggttgcttgaggactag

SEQ ID NO: 69146 - DNA, 993 bp, Glycine max
  Peptide Sequence Number=SeqID_160831
atgtcttcttctactacagaagatgggtcttccattcgtgataggtttcttgtgggtagggaggaaaatgaggagaagaataagagggaattagagggaaactttaggaaagttaagagacaaaagagggacaatgctatagtaggtggtaaaaaatttaggaagaatagggaaggcaagttttcccttattactattcctaggtacgagtgggtttctactatggtcaactcgtaccctacacaatttcaaacacacgacttgatcgagaggttcaaaagggggatcgacatgacaatctttgatgatgtcgagttattgattgtagagcctaataacgttgaggagggcatttttatgagagtgtcaaatggtgaggctgacttcgtatatatgtatgaggatgtgtttaaggagatggatgaatcttccaaatccaaccttgggaaaggctctacaactcctgtggaagagcaagttgaaggcaaccataccaatgtggggatcctctacgtaagtcaaacaaagggggagaagaaaggtttggaagatgaggcgaagaagaggaagagtaatggagataaagaaccaactgagaagttggagaacgaaaagatagagagaaagaagcagagaaaaaaaaagagaaagaggtggaaatcactcagaagctggccaaaattgaaaaagagaagaggacagactcataagtcgactttgcttatgtccaaggataatccaagctctagaacagttcaaaccaatcgcgatatgatggattatgttgggccggtggagagtttggatgctatagagatcttccttagccgatcttttgttgttgtgcaccattggcaggagacagtgtcaaaagcttacgagaagagtaaagtgatgtttgtacaaatgaaagccataaaggttgagattgccagagagtcccaattttactttgagtccgacaaggaagaaaagatcgaaagaagaggttga

SEQ ID NO: 69147 - DNA, 897 bp, Glycine max
  Peptide Sequence Number=SeqID_160832
atggcttcaatctcgttgagtgtatttctgccaattaaggcaaaagagcttgccctaaccaaaggtggtcatcaagtccatgtagcttctgtacaagatatcagtgaaactgccctagtcgataaggaccctgtacaccatgaagttcgctatgatgatggagacaaccatagggtcatcttggttgacggggttgatgcccttgaagtgccatttttgggattgattggactatcctccataggaaaagccgccagtgatggtcttgattacacctctgatgtgctgggcagtttctgtgctgctcctcttgatgtcctctgggtcttggtcttacttggtggttgtctggggtgtgtaatgctcgtacctgggccctttggagagaagttgatgcttgtctggcctgtgcctcttgtccaacttgtgcaagtcgatcttggtgtttacttctcgctggtcgcacttctatccggcttggcggacttcattctggaatctgaacatttcttccatctggatgtagcccttggctcgttcgcacagttcgtgcgtgaacttgcccggggactcctcgtctacttgtcacagactggccaaggcggccaaggtcatgcggtgagacctactagtggcgtattgcgcactgaatcgtttgacaagggtgtcaaagttgtctatggatctaggtttgcctgtgtcaggaaggcatccagatgctcgtctggatctgttgtcccatcgtaccgctcgaggctaagtggttttcaccccaaaggtatgtctacctctataatgcggtcaacaaaaggatgccgatggacattcgatgctactagatggcaaggtgtgggtggatttctcatcgccctggggacatctgacataggcctctag

SEQ ID NO: 69148 - DNA, 1530 bp, Glycine max
  Peptide Sequence Number=SeqID_160833
atgagtgaggaaagtaaagcaagtatatgttgtaatgagactcgtatgagtgaaaaagagaggggcacatgcttgttgccgtgtgctgagtgtgagagcaagttgtgtagaggggatagtagtcttgaagagcagagggtgacgggtttgtcaagcccccaaagtgtggacgagagttgtcctgtgtcaagtgtgacaaccttgacgaggagtgcattgaagacaaacgttacttctatcttctacaacaggcatatgcggcacacgctctgtactcttccgtatgtgtccctcatagagttggcacgtattggaatggtggcgattcctcatctgaggatactcactgaagtgcttccaacagcgagtcctcctcgtgtgagaggggagcctgtctcggttactatgatcctccccctacaacgtaggaagcaagaccttgttgatgtagaggtcttgccaaatagtggggtagcagttcgccttgtggaacttggacccttaacgatggtcgtcgtagctgctgcatgtgagcgaaccaagaggaagtatgtaccaagggcggaccttgggttttgtcaaaatgtgtaccatgggcagaccttgggttttggagatgtgagtactaagggtggactttgggtttttgataagcctggatgggacttagtaatggaaagggcttcaccaagggtgaaccttgggtttgtcgagccttggaccagggacgtgtttgtcttgggttttgtcaagcctatggagatgtgtcaaggcttaccaaggatgggccttggattttgtagacgtataaggatcggcaagcgcagagcttggtgggactcaccaagggcggaccttgggttttgtgagccctttggaggattgaccaaggaattgtccaacttaggttttgggcaccgtgctcttgcatacatgccacttttcatggtggaacgcactagagacgtgctgtgggtgtcatacactagagacttggtaggatgttcgtgcgcacatgtcgtgggggcacgtactggagacttagtgtatgctcttgcatacatgtcactcgtcgtgggtgacatgtactggagtcacagtgatgatatgttctttcatggtgctcgtgtgtgcatgtcaatcgccatgggtggcacacactggaggcttattagggtgcttgttcatgatagtaatatgctcttgcatgtatgccattcatcgggggtggtttacactggaggcttagcttgtgcacaaatgtcatcggtggcacatactggaagcttagtagaatgctcggtgcttgtgcgcacatgtcactcatctagggtggcatgtactggagtcacagtgatatgctattgcatatatgcctcttacaaagtggcatgcactagatcttgtctccttgtcaatggttcctcggtttctacggggatcatggcatttgtgccatatgtgagtcgggccctgaggatgactccattaactgcctttgcctatccgttagtctgggatgttcgatag

SEQ ID NO: 69149 - DNA, 432 bp, Glycine max
  Peptide Sequence Number=SeqID_160834
atgccagagtcatgtgaccgccgcgtaaccattgtcgtgtctcatttatctacaaagacgctccggctctccgtacccttccaagaatcattgactttggccgttgaagagttcacgcttctcccgactcctagaaaataccacaatctattgtgcaacatgatagaggacgtgttttgttacgctttgtgcttccagcatggtaccctaggatccgattcttctgctcttttcttcgtcacagatagaaaaattgatgaactaaaaaattcggtgaaaagatttgatgaaattgggatcaaagttcttggagatgctgttttaaatcaccactgtgctcattatcggaatcaaaatggtatttggaacatatttggaggccctcttaactgggatgatcgtgcagttgtagctgatgatccacattttcag

SEQ ID NO: 69150 - DNA, 948 bp, Glycine max
  Peptide Sequence Number=SeqID_160835
atggctttccctccccacgtagtagaggactgcatgggcctcctcaaactcctgagtgacggcaccgttttgcgctccaatatcaacttccaagaacaacctcaacctacccaacacgacaacctcgtacaattcaaagactttgtcttcctcaaaaaattcaacctccacctccgtttctacaaacccaaatttgaggacaatgatgatgacgacaacgaaaacaacaacaagaagttgttgcccgtggtgatgtttctccacggcggcggcttctgctttggctcgcgcgcgtggccacacatgcattcgtgctgtgtgcgtcttgccacgagcctccgtgccgccgtggtggccccggactaccgtctcgccccagaacaccgccttcctgccgcggtggacgacggggtggaggccgtgcggtggctccagcggcagaagggtcaccacggcggggacgagtgggtgacccggggtgttgactttgaccgtgttttcatccttggtgactcctctggcgggaacattgctcaccacttggcggttcagctcggacccggttcgagggagatggacccggttcgcgtacgaggttacgttctgctgggcccctttttcggtggggtggttcggactaggtcggaggtgggtccaccggaacaaatgctgacccttgagttgctcgacaggctgtcaatacctattggagagacaagagatcacccattggcgaacccttttggacctaacagtccaaaccttggacatgtgaagcttgaccctatcttagtaatagttggtggcaatgaattgctgaaggacagagcagcggactatgcaacaaggttaagagaacaagggaagaacattgaatacgttgagtttgaggggaaggaacatggctttctcactcatgattcgcactcagaggctgcagaagagctc

SEQ ID NO: 69151 - DNA, 432 bp, Glycine max
  Peptide Sequence Number=SeqID_160836
atgaaggtagatggagaaatcaccaatgaatatgaaatcagtgaagaaaaagtggaaaaaaagcttgaggatgaagctacacagggcgatatgctaatggaagttgtaccaatgttgcaagttccagatgaagaggtaaaagtgactcagcaggttgaggtgtgtctcaccattggaagatataatgatagggtgctatgtgatgtgattccaatggagcaccatgagcagaagattattcttaaacctctatcccctagagaagtgtgtgatgaccaaatcagaatgagagaaaagagagaacaagagaaagataaaagtgaagaagcaaagaggaataggaaacaaaagagtgatacacgtaagggaaagagtgatacacatgagaaaaagagtgatacacatgagagaaaatttaattgtttagcagag

SEQ ID NO: 69152 - DNA, 804 bp, Glycine max
  Peptide Sequence Number=SeqID_160837
atggccttcatcatttccaaatcatgcatccatttcagtattcaaagattcatgcaaaaatcagtacttgatgctagtcgttctctcacagttaagtgtgggccatggatcccagggtgtcctcagcagcctcctcgtccttcggagtgccctcagcagcctgggcctcaggagcctcacctccccccaaaaagaaaggttggacttcaggtcaagccacttgcgccagatactcctgcatgcataggcacgatcgggtcactattgggcacggaggggctgactggagctggaatgggttctggaggtcagttctttcaaatgtatgccaaattaatggtcgggctcaaagactcaaaggtcagagaatcagacataactcctctagctaagcataaggcggtgatgagggctgggaagcccaaccgagaggagttggactggatcagaggtatgagaagtgagagcaaggttggagtaggaaaggacactccaggtctgtgcaagggtggtcaggtccttcctcaaaagctttcaggaagccccctcagcgagtatgccgagtatctctcccttggctcaagcaccactggggtctctagaaaggtgttcaatgtggcggcatcgaacttaatggttcttgtgctactagcagcgctccaattcccgaaggaattcatcataatgcgagtaggccagctccacattctgctcggggaggatgttcctgtgttgaacattggtctcatattgctcccaagtaaggctcctggggccaagaagatgatgcacgtctctttttag

SEQ ID NO: 69153 - DNA, 1326 bp, Glycine max
  Peptide Sequence Number=SeqID_160838
atgggattaagtcaaatgcctctgctcaagaaaaggttttaccaagtcaagatcaagggtctagaggtcaccagtttacaagaattaagggagttgatggggcagctccagtggcaagcctttcgcaaagcctatggtaagatttggaacttggctatgatagaagcctttgcaaaggcgatcgcttccctcacccagcactatgaccaacccctgagatggaggaagccttatctcttttctggattctacccctccatgtctagaatcgccagagtagttagaatttcagcacaagaattagaccgagtaaagcaaaatagaaatggagtggccggtataccaagaaaatgtctagaagaaagagcaagggccttggcaagtcaaaacgagtggcctcctttcattgatatcctagcgctgttaatcttcgaagtcgtcctctttccaaacgtggatgatttggtggacctagcagcaattgacgctttcctcgcctttcaccacaacaaggaaagtccagtcgtcgccatcttggccaacatatacgacacatttgaccggagaagatttccaaatgttcccttgatagggacaaggggttgtatcaactgtaatcccatcctcgcaataagacagcttggctaccccatgaggggagcgttgttggtggagagcctcacatctttcgtcacacgaggttttagtgaccccaatgcaagggtggttgagagcctacacacgaggtctagattggctcccgaagctgagagcactaaagaggaagaggctgaagcctcagaggaaagcaaagtggtgcaagccctcaaagcgaaactcgagaaagcccaagcagtcaaggaaagattcaaaacaacagccgtcagaatccgaagggagaatgacgaactgagggacatcaatacagccattgccaaagtcttggagcaagaaaccaagaggtccaaaaagagtttgtctcagcagctgagcgagatcgaagcaaacatgttagccatcatcggcaagtacaaagaagaactagatttggcaacatcccatgagcataaggtggcggatgagtatgcccaagtgtacatggaaaagaatgcaaggggaaggatgattgacgcattgcacccagaagcaacgatgtggatggatcgattcgcccttactttgaacgggagtcgagatcttccccgattactaacaaaggccaaggcgatggcagacttgtactcaacccccaaggaaatccatgggctcctcagctattgccagcatataatagacttgatggcccatataattagaaaccgttag

SEQ ID NO: 69154 - DNA, 150 bp, Glycine max
  Peptide Sequence Number=SeqID_160839
atgaccgagtggtggtgtctcgaactgggaggcgatgacaatggcatggccacgaacatggcgatgatgacaccaaacaaagttgagatagaggacggagaaccacctggtatgtttgcaaataagaagtcacatgtggatatttactaa

SEQ ID NO: 69155 - DNA, 652 bp, Glycine max
  Peptide Sequence Number=SeqID_160840
tggatggcgcctcctctcacctcttctactttgtgttccgctgcatctccatggtggaaaatcaccattaaaggacctcatcgaagctcaaagatccagcctccatagaagccccacaagcaagcttccatcatgtaccttcaccttcagaggactacacgtcctcgcctccagaggactacatgtcctcgccatcagaggactacacgtcctcgccttcagaggacttcacgtcctcaccttcagagggctacacgccttcgccttcgtaggactacgtgtccttacctttagagggctacacgccctcacctttagaggactacacgtcctcacctttagaggattagatgtcctcgccatcaggggtctgcccgccctcacctttagaggactgcacatcctcacctttagagggctacacgcattcgccttcgtaggacttcacgtcctcaccttcagagggctacacgccttcaccttcgtaggacttcacgtcctcaacgtcagaggactgcacatcctcgccttcagagggctgcacgccctcaccatcagaggactacacatcctcaccttcagaggactacacgtcctcaccttcagagggatgcacgccctcaccttcagaaggctacatgccttcgtctag

SEQ ID NO: 69156 - DNA, 2115 bp, Glycine max
  Peptide Sequence Number=SeqID_160841
atggttccgtcaaataccgtaacggcattcaccgcaaagccgtctccgttattaactttcgtaatgctcatcgtcctcggcgtggtgggattctattccctgcatttccctccccgtcccaccacctcccccgacccctcgcgcttccgccacgtgttcgtatcgtcttcgtcgaactccactgtcgcgagctacctccgcgccctcaccgtgcaccctcacctctctggaacaaaacccgcctcgttaaccgcacgctatgtggtgaaccatttcaccaccctcggctttcaaacaaaaacagtacaacactctgcgctgctatcctacccggtgcgctcctcgctcgccgcgcattttagcgacggcacgagtttcgagtttcagttaaccgaaccggacactgagaaggaagtggtggcgccgtaccacgcatactcgccgtcaggtgcggcggaggcggccgcggtgtttgtgaactacgggcgggaggaggactaccgtcagctggtggctgcgggggtggaggtggcggggtgcgtggtggtggcgagaggcggcgcactgccgcgcggggcggtggtggaggcggcggagaggcacggtgcggcggcggcggcggtgttcgtggagagggacacgtggcgcgaggggtttgagagagggcacgtgatgagaggggggataggggacccactgagtcctgggtggagtggggtggaaggtggtgagagtttgggtttggaagatagtgaggttttgaaaaggtttccgaaaattccatctttgcccttgtctgctgaggctgcggagaggatcttggagtcgcttggtggtgctcctctgcccttggattggaggggtaccctaaagtcatccaaggttaagaatgttggcccgggccccaccatcctcaactttacttatcagggtgaattgaaggtggctaccattgaaaacgtttttgccattatcaagggacgggaagaacctgatcgatatgttctgcttgggaaccatagagatgcatggacatatggtgctgttgaccccaacagtgggacagctgctctacttgacattgctggcagattttctattctattgcgtttggggtggactccacggaggaccatcattctatgcagttgggatgcagaggaatttggaatgataggatccactgagtgggttgaacaaaaccttgtcaatcttcgttccaaagctgtagcatacctcaatgtagactgtgctgttcaagggcctggtttctttgctggctcaactcctcagctagatgatcttcttgtcgaggtcataaaacaggtcaaggatcctgacactgaaggtactacaatatatgagaattgggcagctgctggtggaaactctaatgtaggacttttagtctactggccaatgattcaaaggctcagtggtgttgattctgatttcgctccatttgtgcaacatgcaggggttccatctgttgatgtatattatggaaaagattatcctgtctatcacactgctttcgattcctataactggatgacaaagtttggagatccattctttcagcgccatgaagctgttactggaatttgggggcttctagcccttcgccttgctgatgattccattatacctttcaattatctttcttatgcgaatcagttacaggtctacaataacatattgagcaacttgttagacaagcagattactctacatccactaaatacttcgattcaagaatttgcttctgctgccaaagaagctaatgatgaatcaaagaaattaaaatggcaagaagcttcagatcgttctatagatatgaaaatgcgagcattgaatgatagactaatgcttgcggaaagaggcttcttggacgttgatgggcttcaaggaaggcaatggttcaagcatcttgtttttgggcctcccagcgaccatgaaagcaagttggatttcttccctggaatcgctgactctctgtctgggatggataaaatgagtgaaaaagaaaggcttgctgcaattcagcatgagatctggagggttgccagggccattcaaagagctgcttcagcactaagaggggatttggcttaa

SEQ ID NO: 69157 - DNA, 384 bp, Glycine max
  Peptide Sequence Number=SeqID_160842
atggacaagctcttaaaggatgatgtaattatccacattgttgatcctctatcctataaaatgttcataacctcacatgatgatgagttagtggatttcaggggtttagggaaaatagaaaaagcttttgttccactgcaagaaaaatatgtgagccgtcaaaaattccacaatcaaggatgttacaatatggatgatgatgcttttattcagttgaaaaggaagtgggaggagaatgtgactgctttagagataaaaatgaagagattgctgacaaagatgacaaaaatagaggtagtacttaaaacaacaagagaagtcgacttggtgcaagtggtacaagactttgaagggtgcaactatttggatgttgaactaggatag

SEQ ID NO: 69158 - DNA, 300 bp, Glycine max
  Peptide Sequence Number=SeqID_160843
atggcctcatcaaactttccattccttgagggaaattctattgataggcctcttatgttcaatggcgagggttatcactattggaaaacccgaatgcagatccttattgaggccatagatttaaatatatgggaagccattgaagttggtccttttattcctacaaagggagaagggagacacaaaagaattcaggcggttagtccttcgttcttttggaaaagggagaagagagacacaaaaagaattcaggcagttagtccttggcgaattctttttggcaaagggagaaggaaatga

SEQ ID NO: 69159 - DNA, 968 bp, Glycine max
  Peptide Sequence Number=SeqID_160844
cgcctcgggtcggtagccgggctccgggacattactaccacggctactatcgacccgagcccaaagaaggaaaagaacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaacagccgggaataacggctggcatagaagtctctcgcacgcaaggagatgcatttctggtactggacaagctcttagggaataatctctttcttatttcttccttttttcccatgacgactaggaacgggcaaatcaaaaatttcacttcgaatttcggacctcaacatcctgctgctcatgtgcggcacgaagccgctgacgccgagtcggctcctatgccgctagctatgccctgcttggtcccccggcacggtggaggacagaagggagaaggttgtgaaggtggcctcgttatccacacctccgcgttggcgggtcctggagtgcctgtcaagggcgctagcgcataccccggggtgatcatcaccacctgcacctcacatctcggcacagcggaacgtgtaacccgcctgctgtctcattcaactacatttgttcctgtaatccatagcctaacagaacgcagcagcgagggacaacccgcccatacacagccagcggggaggatggcactactggcaaagaccgtccggcgaaaacgccgcagcgcgaagcgtggtaggccggtgccgggggagcatagcataggtaggaaagggagccaggacggtggaagagccaggggggccgggtcatttgacggaaatggaagcttttcccctattagagaagccctctga

SEQ ID NO: 69160 - DNA, 1500 bp, Glycine max
  Peptide Sequence Number=SeqID_160845
atggaacagaaagtctggtttgtgattggtacacagcatctctacggagcggaaaccctgcgccaggttgagcagcatgcgcgccaggtgatggacggcctgaaccaggccggtacgctgccggtgccacttgagctgaagccgctggtgaaatcaccggatgaagcgctggcgctgtgccgcgaggccaatcacgacagccagtgcgtcggtatcattacctggctgcataccttttcgccggcaaaaatgtggattggcggactgagtattttgcataagccgctgctgcagtttcatacccagttcaatgcggaaattccgtgggacagcatggacatggactttatgaacctgaaccagactgcgcacggcggccgtgagttcggcttcattggcgcgcgcatgggtctgcagcacagcgtggtgaccggtcactggcaggataaaaccagccagcagcgtatcgcgcgctggatcaatgccgccctggcgaagcaggccagccagcagctgaaagtggcgcgcttcggtgacaatatgcgcgaagtggcggtcaccgaaggcgataaagtggcagcgcagattcagtttggctatgcggttaacggctggggcgtcggcgatctggttgaggtggtgaacagcgtcagcgacggtgatgtcaacgcgctggtcgacgaatatgagagccagtatctgttcagcgcggcggcgtcagtaaacggcgacaagcggcagaatgtgctggatgccgctcgcatcgaactgggcctgaagcgcttcctcgatagcgaaggctgtaaagccttcaccaccaatttccagacgctgcacggtatgacccaactgcccggtctggcggttcagcgcctgatggctcagggctacggtttcgctggtgaaggcgactggaaaaccgccgcgctgctgcacatcctgaaagtgcaggccggcacgcgcgccggtggcacctcatttatggaggattacacctaccacttcgcaccgggcaacgagctggtactgggctcgcacatgctggaagtgtgcccgtcgatcgccaaagaggagaagccgctgattgatgtgcagttcctcggcattggcggtaaagccgatccggcacgtctgattttctcgacgccggcgggtcgcgcggtgaacgccagcgtcatcgacatgggcgaccgcttccgtctgctggtcaacgtggtcgataccattgaacagccgcaggcgctgccgaagctgccggtggcacgtgcgctgtggcgcgcgcagccgtcgctggccaccgcttctgaagcgtggatcctggcgggcggcgcacaccatacggtgttcagccaggcgctggatgtcgaggacatgtacctgtacggcgaactgcacggcatcgaagtgctggtgattgatgacgagacgcgcctgccggcctttcaaagatgcgctgcgctggaacgacgcgtactaccgcctgaaacgttaattgcctga

SEQ ID NO: 69161 - DNA, 240 bp, Glycine max
  Peptide Sequence Number=SeqID_160846
atgtcggcagccagacccgatgtgctgagtgcggcgctgaccatggtggtcaagagtaaacgtttccacataattttcattcctctgaagggagtgtgctgtaggggtacaaacgcgcttcaagcctggcgcaattgcgctaaaacaagcgcgacacacctcacaaaacagaatgaattaaaggggttacgcgtatcagcgtgtcagacagctgactcagcttatggacaaaacgcctga

SEQ ID NO: 69162 - DNA, 333 bp, Glycine max
  Peptide Sequence Number=SeqID_160847
atgaacaattgcttgtttgcaaagtctatgaatacattagaggtgtcaagcctactgaaatctctccaagtttgggctcacattcgtgatttggctcctttccataggcgtttcacttctttactgcgcattactgactctttaattaagggcagatccacatcaggtgttcaaggaaaattacgttgtctggctatagcaattacagtctactgcatctggttgtctaggaacaagctgatttttgaagattatcaattttctgtaatagaggttattagcaagattaagtttcttatgtatagacaagcgcacctgttgcattttttatag

SEQ ID NO: 69163 - DNA, 72 bp, Glycine max
  Peptide Sequence Number=SeqID_160848
atgatacaggaaaacacgatgaactcgctcagtgcacctgctgcgctaagcgagttcatcgatattcattga

SEQ ID NO: 69164 - DNA, 927 bp, Glycine max
  Peptide Sequence Number=SeqID_160849
atgcctgcttaccacgtggcctcgcctttagaggactacacgtcctcgcctttagaggactgcatgtccttgccttcagagggctacaagtcctcgccttcagagggctacaagtcctcgccatcagagggatacacaccctcgcaaacagagctgcacgtccttaccttcagagaactgcacatcctcgccttcagagggctgcacgccctcgccttcagaggacaacatgtcctcgccttcagaggcctacacgtcctcgacttcagactgctacacgtcctagcctttagaggacagcacgtcctcactttcagaggagtgcacatcctcgccttcagaggactgcatgtcctcgcctttagagggcttcaggtcctcgccttcagaggactgcaagtcctccccttcagagggctacacgccctcgccttcagaggactacacgtcctcgccttcagagcattacacgtcctcgccttcagaggactggacatcctcgcctttagagggctacacatcctcgcctttagaggactccacgtcctcaccttcagaggactccacgtcctcgccatcagaggattgaacgtcctcaccttcagagggctacacgccctcgtcttcagaggactacacgtcctcccctttagagggctacacatcctcgccttcagaggactacacgtcctcgccttcagagcactgcacgtcctcgccttcggaggactggacgtcctcgcctttagagggctacacatcctcgccttcagaggactgcatgttctcaccttcagaggactccaagtcctcgccatcagaggattgaacgtcctcaccttcagaggactccacgtcctcgccatcagaggattgaacgtccacaccttcagagggctacacgccctcgtcaacagaggactagac

SEQ ID NO: 69165 - DNA, 270 bp, Glycine max
  Peptide Sequence Number=SeqID_160850
atggaagtgaatgagcctgagatagacacaacaactcagataacgtttttggaaaaagaaagtggacagaggaagagaggtgtatttgctcaagacccaactagcattactacacgtgtagcaaagttgaaagatctatcaggacttgagcgtgagagtgaactattttacaaagccactagacttatgaaaaaaagggcaaacaagatcacctttgttgctttagaagagtctgagctacaacttggatggatcaagtctgacacttaa

SEQ ID NO: 69166 - DNA, 582 bp, Glycine max
  Peptide Sequence Number=SeqID_160851
gggctcatcgaaaagctgctcgacacccagtgctttgacggccaggcggcggcgtctctggcgcgcaacccgaaccacgtggagatctccaccaatgtttacgccaaccccggcagcaaggcggcaagctgcgaccagctcgacgtggtgatcctcagcgccctcgaaatcgacgttgatttcaacgtcaacgtcatcaccggctccgacggcgtgatgcgcggcgcgtccggcggacactgcgacgtggccgctgcggcgaacctcaccatcgtcgttgcgccgctgctgcgcagccgcattccgacggtcgtgaagcgcgtcaccacgcgcctcacgccgggtgagagcatcgacgtgctggtcaccgatcacggcattgcggttaacccggctcgcccggaggtgcgtgagcggctgatggctgccgggctgaagattgtggatatcaacgcgctctatgaacgggcgatatcgctgacgggcgtaccgaaaccgattgagtttaccgacaaaatcgtcggggtgatccgctaccgcgacggcagcgtgatcgacaccgtgcgacaggtgaaggagtga

SEQ ID NO: 69167 - DNA, 579 bp, Glycine max
  Peptide Sequence Number=SeqID_160852
atgttggtgcgcatgatccgcactcatttctttgcagcggcacgggatcaggggatggcccaggaactgataaaaggaaactactggccccttaaattatcttcaggtgcggatgtggagtccactcaaggcgagagtaaggtgaggacgtatagtcctctgacggtgaggacgtgtagtcctctgaaggcgagggcgtgcagccctcttaaggcgaggacgacaggtagtcctctgaaggtgagggcatgcagccctttgaaggcaaggacgtgttatcctctaaaggcgaggacgtgtagtcctctgaaggtgaggacatgtagtcctctgaaggtgagggcatatagtcctttaaaggcgaggacgtgcagtcctctgaatttgaggacgtctagtcctcagaaggtgaggacgtgtagtcctcagaaggtgaggcgtctagccctcttggcgaggacatgtagtcctctgaaggtgataggtactagtaccctaagggtccaaccttatgaggaagcaagagatggactcatcgagagggccagtcatcccaaattcacaagatttggacattag

SEQ ID NO: 69168 - DNA, 1053 bp, Glycine max
  Peptide Sequence Number=SeqID_160853
atgggaacaaatcaaactggaaaaaggttctatcaagtcaagattaagggcctagatgtcaccagccttaaggagttggggcggttgatgggacctctccaaatgcaagccttccgcaaggcgtacggaaagattttagatttgaccatagcagagatattcacggaagccgttgtatcactcacccaatactatgaccagcctttgagatgcttcacgtttggagacttccaattagtacagactgttgaagaatttgaggagattctaggatgtcctcttgggggaagaaaaccgtatcttttctccgggtttcttccctccttgagaaagattgcaattatggtcagggattcggcaagagagttggattgtgtaaagcaaactcaaaatggcgtagtgggcctaccacggaagtacttagaaggcaaggcaagggatatgccgaatcaagaggagtgggtcccgtttatggatcaaagagagcccggtgtagctatcttggcagacttatttgatacgtttgaccgaaggtgcgagaagagtagcgcacagatcatctgttgcttgcctgctctttctgtatggttggtttcacacctattccaacaagacataaggcatgcatgtccgctccgaagccatcgctcgtgtgtcgaaaaaagaagagtagattgggaccaacacttggctgggataggaggcagaacaaccaactggtttacacgatggaaggaaggaaatgagggagttctcttctcatgtggggactacccaaacatcccgttgataggaacgaggggttgctttaactacaatcctgcacttgctataagacagttagggtacctcatgaggggagcaccgacgaaagagagcctctttcctttccttgtgagagatttcgacgcgcaaagtttcaaggttatacaaagagtccataaggcatgggaaagcccgttagggaaagataaagaatttaggggcatccgtaatggcatcatcggtggttatcatgaatggctgaaagttcgtacgcgagggttagattga

SEQ ID NO: 69169 - DNA, 166 bp, Glycine max
  Peptide Sequence Number=SeqID_160854
atcgcatcttttccggtttttccgaagttttcctcaaataaacgttggtggcgactccgcgcgtattcctttcgtggaacacgcatcccgcgagtcacgcgtcgccctcccgccgaagggtaggttgcgacggttggcgactccactggggagggcgacgcttgag

SEQ ID NO: 69170 - DNA, 1023 bp, Glycine max
  Peptide Sequence Number=SeqID_160855
atggttgaggaaagtgaagaagacgaatttattgcgatcgtcaactattcgatcatcggacttattcagcttgaaaaaggtctttccaacgatttcaatgaaaataatgatgaaattttaagcctttatgacaaatatgcatctgaagctcaggctctgatggaaagaaaaaatcatgattatggcgaagcatggagagatatgagaatttcttccataacagatcttatttaccagaaggtcctgagaacaaaacagatcgaagataaccagggaaaaacgatcgtttccgaaggcctggatgccaactattttgatatgctgaactatgctgttttctttatttttatcctgtccgggtttgtaaaagctgtggatctgaaaagaattcgcccggaaagacgaatacagcagcacaacgaaaacacctacggccaaggaattatgcacgagcctcttatcgatttccgcgattataaaatcggtacggatattaaagcagaaaaagataaaatcagtaaaaacccatcggaatataaaaccttctactcccttaaaaatcaaaaaaccggggaggttttaaaggtaaatcaggatgattacatcaaagaaacaaaatattgggctgacggttctccatggaagattgaagaaggaaaaaacgaatctgtcatcgtaaaagaaggctacaagtctgagattgtaaaatttaaaattgaagatcctaccggccttgaggttactgatgagattattaaagctccaaaggctgttttggtattttcttatcaccctaaagagctttctcaggagttgatccagaaagttgaagctaaggtaaatgcccagaaaggtgcagttatctatggtgtctctacggatccgaacacatttaaaaccattaaaaatgcaatgatggatggaaccgccattaaaaccattgccagaagcaacccgtttgtactgatattacagaacggaaaaattgtagacaaacagcctgcaaaagattatattaaataa

SEQ ID NO: 69171 - DNA, 693 bp, Glycine max
  Peptide Sequence Number=SeqID_160856
atggtgaggacatgtaatcctctaaaggcgaggaagtctagtcctctgaagatgaggatgtttggtcctctgaaggcgagggcgtgcagccttctgaagatgaggacgtttagtcctctgaagatgagggcgtgtagccctctaaaggcgaggacgtgtagtcctctgatggtgagggcgtgtggccctctgaaggcgaaggcgaggacgtgttgtcatctgaaggtgaggatgtgtagtcctctgacggtgaggccatgtagtcctcggaaggtgaggacgtgtagtcctctgaaggcgaggacatgtagttctttagaggcgaggacatgtagtcctctggaggcgaggacgtgtagtcctctgaaggtgaaggtacatgaccctctgaaggtgagggcgtgtagccctctgaagattgactgtccttttgaaaaaggtgataattcatgcaaccttgtcctatcttttgtaaatctctccgggaactccctcagagttgacggtgtcgcaacctacccctcggcgggagggcgacgcgtgactcgcgggatgcgtgttccacgaaaggaatacgcgcggagtcgccaccaacgtttatttgaggaaaacgtcgaaaaaactggaaaagacgcgatctacgaacttgtattagcaccccacacgtccgtcccaagggacggcagcctttaa

SEQ ID NO: 69172 - DNA, 240 bp, Glycine max
  Peptide Sequence Number=SeqID_160857
atgaataagagcttgaagcgagcattcgctaagcgcgacactcagtggctaagcgcgaggaagaatccagaagaagatgagctgtcaggttcgctgagcgcaccgctccaagtcatcaagcgcaccgcttcagctcatccactaagcgagagaagcgcgctaagccaaaaatcactaatgtgcactaagcggtccatacgtgcgctaagcgcacgagcacgaacaaggccacctatttaa

SEQ ID NO: 69173 - DNA, 420 bp, Glycine max
  Peptide Sequence Number=SeqID_160858
atgcctggacttgtggaaatgggatatttgttttgcgcaatcgcccaatcgccacctagtaccacatatgacggagtggtacctggggatatgtcgcgggggttaggaggacgccagggtgtttgggagaccctcgaaggcaatgagaggtgccgattctgtggcacaattcgactcactgctacttcgctagtacatccagagcaacccgcgcgcacacttcagcagcttgatcttgaagaggacccagaggagttacctcctgaacctgctatggacgcccctgacttaccagaggatgatgaggacccactccctgatgttgattctccagaggatattatgtcagcatctgaggcagactctacagaggagagtggccctggagggacagcgattagtgacgactcttcatcgtag

SEQ ID NO: 69174 - DNA, 68 bp, Glycine max
  Peptide Sequence Number=SeqID_160859
gacaagaggataaagtctacaagttgaataaggcactatatggcctcaagcaggctcctagagcctag

SEQ ID NO: 69175 - DNA, 499 bp, Glycine max
  Peptide Sequence Number=SeqID_160860
gttggagggtgtgccatctgtggtggagctcacaattctggctgctgtctccttaatgaagaaccagatcatgaagtcaattatatggggaaccagccaagataaaatttcatgcaggccacaacaacaagggcctagtctctatgatcgaacaatgaatctggaagagactctagctcaatttatgaaggtatctatgtcaaaccagaagagcacagagtctgccattaagaatctggaagtccaagtgggccagcttgcaaagctattggcgaataggccgtcaagaagctttagtgcaaatactgagaagaatccaaaggaagaatgtaaagctgtaatgacaagaaacagaatggcaattcaggttgatgaaggcaaggaagtaccatatccattggtaccttccaagaaggataaagagcgacacttagccagatttgttgacattttcaagaagctggagatcactttgccttttggagaagctcttcaatag

SEQ ID NO: 69176 - DNA, 141 bp, Glycine max
  Peptide Sequence Number=SeqID_160861
atggaggttgaggaaccttggttggggttatggctacctttgaattatcaagtggatatgggagcaagtcatcataggacaccagaattaggacccactttgatcctttccgctggtgaagaccaaatccgtaaaacttga

SEQ ID NO: 69177 - DNA, 112 bp, Glycine max
  Peptide Sequence Number=SeqID_160862
atgaagaacgtcgaagaacggctgaaaatcttcgcgaaaatccccacggaagcgttatggaagcgcctcggctcggattttcttcacggaaccaatttttcactaatttcag

SEQ ID NO: 69178 - DNA, 285 bp, Glycine max
  Peptide Sequence Number=SeqID_160863
aaagagaaatggtctcttaatgagctcatttcatactttgtgcaagaagaggaaaggctgaagcgagagaaaggactgaaagtgctcatgctgttgtcttttaattcaaatattgttggaactggttcactcttggttaatgataatctatatttacttgatactgtagcttcctatggtgaatcctttaatgcagaattgtgtggtactaagcgtagaattgataatacaaactcaggagcattatggcacaagcacttaggtcacatttctaagaagaattga

SEQ ID NO: 69179 - DNA, 750 bp, Glycine max
  Peptide Sequence Number=SeqID_160864
atgatcggccctctcaatgagtcaatctcatgctttctcaaaagggtggacccttgggtactagaacctattgcctttaaaggactacacgtcctcatcatcagagggctgaacgccctcaccttcagagggctacacgccctcaccattagaggactacatgtcctcgccatcagaggacttcacgtcctcaccttcagaggactacacgtcctcgccttcagagggcaacacgtcctcgccttgggtactagtacccccaccttcaaagggctgcatgccctcgcctacaaaagactgcacgtcctcacctttagaggactacacgttctcgcctttagagggcaacacgcccttgctttcagaggactacacatccttgtctttaaaggactacacgtactcgcctttagagggctacacgccatcgccatcagaggactacgcgtcctcgccttcagagggctacgcgccctcgccttcgtagggctacacgccctcacattcagaggactacgcgtccccgcctttagagggctacacaccctcgacatcagaggactacacatcctcgcctttggaggacaacacttcctcgcctttagagggctgcatgccctcgccttcagagaactacacgtcctcgccatcagaggactacacgtcctcgccttcaaagggttgcacgccctccgcctacaaaagactgcacatcgtcaccttcagaggactacacgttctcgcctttag

SEQ ID NO: 69180 - DNA, 508 bp, Glycine max
  Peptide Sequence Number=SeqID_160865
gtagatgatcaaggagatgaaagggaagaaggaattggtgttgtgggtgctccagaaggttcgtggcggcggtggccagcagcagcggtggtggaggaagatcctttgcacttcttcgatgattctaaggttcgtggcgacgatggccagcaacagcggtggtggaggaagatcctttgcgtttcttcgatgattctgttatttgatgaagttttaatgaatttcaatctgtgggtgaactctggaggtggtggcggtgtttttgttgccagctactgtgatgcctcgccctgtgcctgcctggggaaccgacagaggcctgtaattagagctagaaccctagggccctattggacttcttcaggtccactggatgtcttgcgggcgcgatccctgcaaatagtagatggcatcagagaccagttgagccatgtgcatacttacttatgtcatgatggcataaaccagctgacacttcggcagggggagatcggagtggtggtcgctg

SEQ ID NO: 69181 - DNA, 315 bp, Glycine max
  Peptide Sequence Number=SeqID_160866
atggatatctatgaagatactgacattcctgtaatattgggaaggccattcatacaagcctgctccagaacaaaatgtttgcttataggtaatggaagtgggttaagaggttctggaggtgagaaccaaaacatgatgtcacccattaagccttgcgctaagcgcatctttgttcatgggctaagccttgattctcacgcgcttagcggtaaacccttgcatccgaggctgatttggtccactaagcttgccaaggcggagctaagtcaatttcgactcgatctgaattcagctaagcgatggcctaaccactaa

SEQ ID NO: 69182 - DNA, 618 bp, Glycine max
  Peptide Sequence Number=SeqID_160867
atggcgagttcactgtggactggacgcgtagcatgtaaacagccagcatggctggcgacttcccttaacgtggatctcgccactcctactggcgaatacatcatgaatttggttataacagtgttgtatttcaatggaagggtacatgaagagaatgatggtgtaatatttgaaggtagtaaaaaagcgattcagattaaacgtgaaattagtttcaatgctttgaagaaaaaaattggagataaggcgcaatcgccaagaaatgtgagcaatttacatggtgatgaagatgatgatgatgatgatgatgatcttgtgtctaactcatatgtggaagagtctttagacgaagatgatagtattgacggtatatctgatatagacgatgaagtcaccgacatgattcaaccagtaagaattgttcacccaacacaaggtgtacaaggaattcaaaatccattttggaatgatgctttgcattataataatatcaactgtagtcatcctgatgaggaggacatttgtggtttggagatgccatcgagttttaatgttggccaagaattatatggtgacatggattttgatagtaaagatgcagtcaagaatgcagtctaa

SEQ ID NO: 69183 - DNA, 513 bp, Glycine max
  Peptide Sequence Number=SeqID_160868
atgagggagggggtaagtaaaaagttgttctcgggtgttagcataggaaagaaccaagtggaagttgatttacttcaatttgtggacgatactctcttctttgcaaagtcttcaatggataatgtcatgactctaaagtccatccttaggggagggggaggggataggtactcgaacgcgtctttttggtggagtgatgtagagaagggttgcggaaatcgggaatatggggagtggtttgatgagaacattgtcactgtgagtatgttagatgtgagggaacaagttcgggatggttggagatggaagacaagtgattcaggactgtactctatcagtgaaggttacaaagttctacaacatcaaagctttgcaggggagatggacaactgctctgattcaatctggaagatggccactccatcaaatgtgaaggccttcacgtggaaagcattgctggatagaatccaatcaaaagcgaattatgcagaggaacttattaatgggtggtga

SEQ ID NO: 69184 - DNA, 636 bp, Glycine max
  Peptide Sequence Number=SeqID_160869
atgataaagtttgttctatttttgttctgctttgcctctgcactgaccctttcagtatcggagtccaaatcagcttcagtgcaacctcatgctgctgaatctttctctgttggatatattcagatgaagactgcagcgaactgttcttacctggtagttatatctacgagttgttcatcgcctaagttcacaacggataagatcggtatcacgtttggggatgctaatggcaaccagagatattcatcattcgtttcttgtgttaattggattcgtaaactatgggcaatatatagtctaaactgcaaggtatatgaaccaagactggatgatccaatttcaaggacatttgagcagtgttcttcagatacatttcagatagatggtgcttgtgcatctccaatttgctatgtgtacctatatagatctggggcagaggaaggttgggagcctgagagtgtgaaaatctatggctacaactcagagcctattacttttgatttcaacacctccatccccaatggcacatggtatgggtataatctgtgcgagactccttcttcttcataccaactatcccctcagaaatggttcatgagtttggttctaggctctgttcttagtttttggctgtaa

SEQ ID NO: 69185 - DNA, 618 bp, Glycine max
  Peptide Sequence Number=SeqID_160870
atggcgatgaagctgcaggttcttcttcttctcttgttatgtattgcatcggaactgacgacccattcagtctcaaattctctcgaacgttgcgatgctgaaactgagtacaactcctatggctacattgatgagaggaagaaggcattgaacgactcatcatgtacttaccaagtggtcataggtgcaagttgttcatcgcccaatttcacaatgggggacatcattattcgctttggggatcctcttcgcaaccaggtatatgaagaaaaactgattgttccacgttcaaggacaattgagcagtgttctcgagatatatttcagttaaatggtgcatgcgtatcttcgatttgttttgtggagctgtatagctatggtgcaatggatggttggaagcctgaaagagtgcaaatctatgacatgatgaacatattacctactacgaatttcaaactcatcccactcaggggaaggtggtggattgggtataattggtgcctcacaaaatttctttttaactaccttggtcattttaatgataataaaaagaaagtaataggctcaaaaatggtttcatttgttgttgagactttggttaacaaatcaggtagttaa

SEQ ID NO: 69186 - DNA, 484 bp, Glycine max
  Peptide Sequence Number=SeqID_160871
atggctgctctagctctagcactgcttcttctggctttcagtggcacttcaaattcatgtgtcctttgctcttcaaaccgtgtatacacctttattaatgcaaaagccataagcttctctcctagctacatgcccaacaccgttagggcccactgtaactacgccgtgaacagctacttccaaaggaagggtcaagggtcctgcgactttgcgggaacagccactgttactgcatctgaccccagctctggcggtacttgtgtttacccttctagcgtcaggtctaattcagattcatcatctgactcagaggctatgtcatcccaggttttctttggaaatgacccaagttgggttgatcacccagttttggaaggtgaaaaaaccctttttggggatggctctggtagagccaatttgaaacctttttcgcgacctcttccttctcgtatggaggcactagctaccttaggcggcatgacaa

SEQ ID NO: 69187 - DNA, 174 bp, Glycine max
  Peptide Sequence Number=SeqID_160872
atgaaggtagtcttatgcagtggaagacaaaggataagagatgagaggaggcgtcatctactagggaataagccatggaagaaggagcttcaccatcaagaatgtgccttggataagaagcttggagatgatgcttcaatggaggaaaagaaagagagagagaaagaaagatga

SEQ ID NO: 69188 - DNA, 297 bp, Glycine max
  Peptide Sequence Number=SeqID_160873
atggccacattcgtcaacacctccggccaccatcgtaacacctccagccatggtctcgcctccggccatggttgcgtctccggccatggtcgcatctcgcatctccattacggttgcatgtcgcgtctccgaccatggtcgcatctcgcgtctctagccatgctctcgtctccgtcatgcaatatcgaggaagctgacaagggtaaagtggaagagaagctagataatcttataggaagccatgaattgatatatattgttggatctgttaattctgccaatggatatatcagttag

SEQ ID NO: 69189 - DNA, 255 bp, Glycine max
  Peptide Sequence Number=SeqID_160874
atggacatagaatatgctataaggaaagacaaacctcttgcaatcactaatgaaagtaatctagttgttgttgcgctatatgagcggtgggagcgatccaaccagctcaatgtgatgttcatcaagatcaaaatctcagttgggatacgtggttttgtcgatcagcatgaaaaggatatgcaaaacctaaggagaccagtgggaagtgaacaaagcattttaacaggcaataagttgggatgtgaaggctattag

SEQ ID NO: 69190 - DNA, 231 bp, Glycine max
  Peptide Sequence Number=SeqID_160875
atggttcagcccactaatccaagatcaagtccaagattctccactaagtcccatgaacccgaaatctaccctaaggctcatgagaaccctaaggtcttctcttgcatctctgacccaatctacttagagtcttctatccaatgtccttgcgaggtaggattgcatcacattgtcacccaagtggcaccaatcaggaggttgcctcctggtgggctaagtaggggacattga

SEQ ID NO: 69191 - DNA, 666 bp, Glycine max
  Peptide Sequence Number=SeqID_160876
atgagtttcgcggcgtacaagatgatgcagtgccccaccggcatcgacaactgcgccgccggcttcctcacccactcccgctccgacttcgttcctctccagcccgacgacctcgacgctgccgagtggccctcccgcccccgccaccacgttggccccctccccaacctcgtcgtcaccgccgccaacgtcctcgaagtctacgcggtccgcctccaggaggaccagcagcccaaggatgcctccgacgactcccgccgcggtaccctcctcgacggcattgccggggcctccctcgagctcgagtgccactacaggttccgcctctgtccccttgctgaaatagtagaagtagcgattactttctcagaaatggtctcggttagacatttgagctgtggtaggtgtgtggatttgccggaatttagaatgtgtagtaccaacaagggttgggtcttgcagaaagggttactcctatcaatgtggcaaaccaagatttggttattttcagctttgttagtgcagaatttactgaaggagttgagtgtggagcatcttatgctgcaatgtaaatctaattgtgttgctactgctggagcatatagtgtaaaatttgcaaatatttatgtttctttaaatattgatttgcaattggatatagattag

SEQ ID NO: 69192 - DNA, 3453 bp, Glycine max
  Peptide Sequence Number=SeqID_160877
atgtggaacttgggtttttcccaatacaccgcctcacgcctagcacttcttgggcttgatgtgtggataacaatggttggttctggtttagttggggatgatgatgcctttggatcttcaggagcagttgctgctcgtattgagtcatcttatatgataaacctacgtgacttggatatgaggcataatcttccccatgatgcatacaagcttcttgcggtgccatcgccaataggtggcgttcttgtaattggtgctaacactattcattatcacagtcagtctgcttcttgtgcattggccttgaacaactatgctgttacacttgacagtagtcaagagataccaagatcaagtttcaatgttgagcttgatgctgccaatgcaacttggttgttgagtgatgtggccttgctgtcaacaaaaactggcgaactgctattgcttatgcttgtttatgatggaagtcggttaggggacagtatgctggtgcaattttcttgtggatcaggtgtttccatgatgtcatccaatctaaaagaagaggttggtgatattgaagtagatgctccatcaaagagattgcggaggtcaccttctgatgctttgcaagatatggttagtggtgaggagctctccttgtatgggtctgctacaaatagaacagaatcagcacagaaatccttctcgtttgcagtgagggattcattgattaacgttggtcctttgaaagatttctcatatggtttaagaataaatgctgatgcaaatgctacagggatagccaaacagagtaactatgaattggtgtgctgttctggtcatggaaagaatggttctctgtgtgttctgcggcaatcaattcgcccagaagtgattactgaggttgaacttcctggttgcaaaggaatttggactgtgtatcataagagcacacgttctcataatgctgattcttctaagatggctgatgacgacgatgagtatcatgcttaccttattattagcttggaggctcgaactatgatcagttttctggcaataggagaggcattcaattggtctgccagtgccaatgaaatttgtgttttgatatttatggtactagaaactgctgatcttcttagtgaggttactgaaagtgtggactattatgttcaaggaaaaacacttgctgcagggaatttatttggaaggcgtcgagttatccaagtctatgaacgtggtgctcgaattctagatggttcttttatgacccaagacgtaagctttggagcttctaactcagaatctggttctgcatctgagagtgctatagcactttctgtttctatagctgatccatttgtcttactcagaatgagtgatggaagtattcgacttctgattggagatcctagtacctgcactatttctgtcacttctccagcttcatttgagagctccaagggatcagtttcttcatgtacactgtaccatgataaaggacccgagccttggctgaggaaaacaagtactgatgcatggctttctactggtgttggtgaggctattgatggcactgatggtgctgctcaggaccatggggatatttattgtgttgtttgttttgataatggtaaccttgaaatatttgatatccccaatttcaattgtgtcttttctgtggaaaattttatgtctggaaagagccatcttgttgatgctctgatgaaagaggtactaaaagattctaaacaaggggatcgggatggagtggtcaaccaagggaggaaggataatataccgaatatgaaggttgtagagttggccatgcagagatggtctgggcagcatagccgtccatttctttttgggattttgagtgatggaactattctttgttaccatgcttacctttatgaaagtccagatggtacttctaaagttgaggattccgcatcagctggaggatccattggccttagtagtaccaatgtttccaggcttagaaatttgagatttgttcgtgtgcccttggatgcatatcccagggaggatacctcaaatggatcaccttgtcaacaaattactattttcaagaatattggtagttatcagggattcttcctatcagggtcaagaccagcatgggttatggtgttgagggaacgacttcgtgttcatccacagctatgtgatggatctattgttgcttttaccgtccttcacaacgtgaactgcaatcatggacttatatatgttacatcacagggtgttttgaagatatgtcagttgccttctggctcaaactatgacagctactggcctgtacaaaaagttcttaagccactaaatcaagttatttctctggttgaccaagatttcaaccatcaaaatgagagtcagaatatgaatcctgatgagcaaaaccgcttttatcctattgatgaatttgaggttcgtattatggagccagaaaagtctggtggcccttggcaaacaaaggcaacaatacctatgcaaagttctgaaaatgcccttactgtgaggatggttactttactgaatacaacctcaaaagaaaatgaaacacttttagccattggtactgcttatgtgcaaggagaggatgttgctgcaagaggacgtatcctcttgttctctttggggaaaattactgataatccacaaactctggtttcagaggtgtactctaaggaattaaaaggtgctatatctgccttggcctcacttcaaggccatctattaatagcatctggtccaaaaattattctgcacaagtggaatggcactgagttgaatggtattgcattttttgacgcaccgccattacatgttgtgagcttaaacattggtgctcaattgagcttattagccaaggattttggttctctcgattgttttgcgacggaatttttgattgatggaagtactcttagtctcatggtttcagatgataatagaaacatccagatgtctgagagttggaaaggacagaagcttctttcaagagctgaatttcatgttggtgcccatgtgactaaattcttaaggttgcaaatgctatccacttcggatagagctggttcagttccaggctcagataaaaccaatcgttttgccttattatttggtaccttggatggaagtattggttgcattgcacctcttgatgaaatcacatttcgcagactgcagtctttgcagagaaaacttgttgatgctgtaccccatgttgctggcctgaaccccagagctttcagattatttcggtcaaatggaaaggcccatcggccaggccctgacagtatagttgattgcgagctgctatgccattatgaaatgcttccattggaggaacagcttgaaattgctaaccagattggaacaactcgatcacaaattctgtcaaatctaagcgatctgtctcttggaacaagcttcttgtga

SEQ ID NO: 69193 - DNA, 282 bp, Glycine max
  Peptide Sequence Number=SeqID_160878
atgacttcgctggttcatttgacacggccaccgcatgatataatctttgttcatgtacaacgggtttatttgaaagaccattgtcccttaccgcctccagcgttgttgtggtcaagcaattgttattctcaggagaaactagcagtcggacgattgtcaactcaaggttggctttcatttttccaaatggatcaattattcacaatgatactggcgtttacttccaaacttcaactccggtgcccattcgagtaccaaacagctgtgattttgcaagcctaa

SEQ ID NO: 69194 - DNA, 381 bp, Glycine max
  Peptide Sequence Number=SeqID_160879
atgtgtagtgatgtgtggtggctgaggttgaagacgaaggttcttccgcgagaagaaccttctttcgcgcatgtggaaggggaagttggatattgtagcgaaagaaggagttcttccgcgggctcctgcggaagaaaggtgaaaaggttcttccgcgggttccggcagaagaaggcgaagaaggttcttccgctggatccagcggaagaaggttccgcaggcaacatgttttccgcggatcccgcggaagaacctgcaaaaccttcttccgcatgcaacttttcctggtcgcggaagaacctgcggaaccttcttccgcaggctacctatcattctcgcggaagaacatgcgaaacttcttccacggaccatgatgtctaa

SEQ ID NO: 69195 - DNA, 234 bp, Glycine max
  Peptide Sequence Number=SeqID_160880
atgaaggtgaaggtaccgacgttgagcgttgcggtggtcggtggcggcaaacgaggtacccagatggtgatggacggagatgagtggatgtatgaaataatgtctgaacgagcggatatggattgtgaaaatacagaatcatgtggtgcgaatgaaccacatgctgattgtttggatgcgttcaagacttctctggtgtttgagtgccaaggggatgttttgcggtgggcttga

SEQ ID NO: 69196 - DNA, 571 bp, Glycine max
  Peptide Sequence Number=SeqID_160881
gtatgctttaaaccagattgctgctgagtttgagcgtgtatattatgctggcaaaaacccttctcgttgtggatgtatcatgagaactactcacaatcttgcatgtgcataccaaaggttatctgagcccgaagtcaacataaccgaagagatgaaaaccatatccaagcggtttgaagagcttgatgtttgtagcattgttactataaagagtaaactttgggaaattgactactatgatctaaactctctgtgtcctcctctagaaaagtatgttgatgtatttcattatgtgcaaaatagtaattcttcagtcaaacgtagtgcatcattatctgagcaagtaattccaagaaggatcatgccgatgttggatcaatttcatccatgcattcatgattccattgaaaatattattgatgtcaaagctgatagtaactgtggatatcgtgcaattactaccttattaggtatatgtgaagattcatgggctttggtgcacaaccatttgcttaaagaacttgtaaaatggtctgatgagtatatcaacctgctcagtggcaaatactaa

SEQ ID NO: 69197 - DNA, 360 bp, Glycine max
  Peptide Sequence Number=SeqID_160882
atgagttatctgggtggagatctggtactcataacaagtctgaacaaggagaaagctaatgaattcgccaaatttgaagatgacaactttctctctattttcacatctatagagatattgagagataatatggttacgacaaatagactaatgtggctcaaatacatggctgaagagacaaaatcattgtccaaggtagatgcagcttgggtatgggtgttcattttgtgctcccaatcaatgaaaactaaagtcactgtcaagattaatgggcttctgtgtaatgtgagattgatggaggaaaacattcttctttacctcaaagtagatgcaatcgtggggtggaatttgaaggagtga

SEQ ID NO: 69198 - DNA, 612 bp, Glycine max
  Peptide Sequence Number=SeqID_160883
atgtctccttacactcctcgactttccttcctcaaatgcctcaacaatggccaacattcctcggtcccatccactacctcctcaaagtggcctgtgcttctattgattgagagcttctccaccacgatgcagttgacctacccctcgggtaccaccgcaacagtagagactcattcgatgaagcctccgcctccgcttccgcctcaacctccaccatcgtcactgcgacaggattgttctacaacagaaaaagcatgcacgaaggtgggatcggaggttgttttgggctcacgcgaaacgctactacgattcatcgacgtttttatggttgtttcgagcctttgcgggagggaggacgaaacgacgccgttgctggcgacctttacacgggatgtaatagcctgtgacgttataaatcttgatgacattgatgtggagttcaactctattgggggactagaaacaatcaagcaagctttgtttaagcttgggcaatttaaacaacattttgcagaagaggaggtggaaggtgttggagttgagcaaagagcaagaagtctcattcctcatgatgctatgaagtacttggacacctttccaagatgttcatga

SEQ ID NO: 69199 - DNA, 273 bp, Glycine max
  Peptide Sequence Number=SeqID_160884
atggaaaatgatggttgggaccttggttttggtttcgatgcggacgtcgagggaggagatcctggtggagaggataccggagaggcattcgccggcgagagggttgaaaaagtggaagcccggttgggcgaggcggtggaagcgaccccactgctcgaccacgccgacgctggattgagcaacgcaaccacagaagaagcagaacgtgttccccatccttgcaaaccaccgaacaacaatcaccttcttctttttcttctgctctgctgctaa

SEQ ID NO: 69200 - DNA, 495 bp, Glycine max
  Peptide Sequence Number=SeqID_160885
atggcagtgtatccctatgaaggcggaagacccgtaatgaaatcgagggataagtcttgccatggggcagttgggaccgggttttggcaaaacccaaatgtccgccaattggccatcatggtactcgatcccaggatgggaagtgggattggtgcaaatttgctgaagcttatcttgaaaagaagaactagtggtaaaatgtttgtgcatggcatcgatgaagatgaagatggtgaagggatggccgaggagttattgctgccatttgcggacggtggaggttatggcatggagctcgcggatctaggggtgaccatgctgagtctgaacaacacccatagccatgccggaagcatctgtctcaatggtaaatgggctggagaaatcgggccgaggaatctgcataaggattgggttgttaagggaatgggccaggacgccatggcttcaagctttgaaggattaggggccattcccttagcagacacaatatga

SEQ ID NO: 69201 - DNA, 1479 bp, Glycine max
  Peptide Sequence Number=SeqID_160886
atggcttcctacaagattctcttcctctttacccttgttagcttccttaattttgcaactattcaggcacaggaggaggaaagctccacccctgtctatctattccacaattgctccgggggcaacactactgcttacagtaccttccaattaaacctctggaccctcctctcttccctaacatcaaacgctgtcagcagcaccggattctacaacaccacagtcatcgaagcaaacccctcaaactctgtctttggactgttcatgtgcaggggtgatgtccctcctcagctttgtcaagcaagttgtgatttggaaagcttcatgcgtttattgtttgacgccatgaacgaaactgcagatgaagcagctcgtcccactaccggtaacaagtttgcaacaagacaaacaaacatttctggatttcagagactgtattgtctagctcagtgcactccagatctgtcacccaatgattgcagaacctgtctccgtacagtgataggagaccttccgtggtgctgtgaagggaagcaaggagggagagttctatatcccagctgtaatgttaggtatgaattgtaccctttctatcgttctgagggagagtgggttccttcagattcacaattttcagaagattcaaattatctttaccacaattgcaaaactaatgtaactggcagtgctttcaaaatgaatctcgagaccctcctctcttacatgtcttccaatgccatgaatcgcatggattactatgaaggtgtggaggacattgtgtatggcctcttcatgtttcgcagagaccttccctcgcggctctgtcaacagtgcatcctcaacgcaacccaaaaaatatcaacagagtgcaattcgtttcaagaggctgtaatttggtacaaccactgcatgcttcgctattctaatcgccatttcttctcccaagtggaaaaaaatccaacttttgaaatcttgaatcttatcactacttccgaccccgctagcgaccaagatttcttcacttatacattaacaaagacgttagttaatgtgacggaggcggcaagggatagaaatgagagatatgtgactaaatcaacaaagttgaatgatttacaaaccctttatactcttgctcaatgtacgcaggatttgtctaccgataattgtgtgggttgtctggatgatataaatggaaaaatcccatggtctcgcgtaggaatagggggacgagttctatatccgagttgcaatctcagtgtcgttgaataccaacatcggttgaaggaccgccttcgaatggggactgttctacatcggttgtgtaactacagccgatgtagaatgaatgggtgcgatttctacatcggtcttcagtcaaccgatgtagaatgggtaggaatggaagatttctacatcggttatcagtcaaccgatgtagaattgaaagggtttttacctcgtttatcagtcaattga

SEQ ID NO: 69202 - DNA, 162 bp, Glycine max
  Peptide Sequence Number=SeqID_160887
atgtataatactacaataacccatattggtctccactgcagtgcacactggcaaatggtcgtcattttgcctaaggaaaatcttattgtctgtgctttgaaagaacttgatgatactccacaacctaaatccaaggctggagctaggtggattgttgttaag

SEQ ID NO: 69203 - DNA, 457 bp, Glycine max
  Peptide Sequence Number=SeqID_160888
atgggatcgagtcaggcaccttcgcttaaaaagaggttctatcaagtcaaggtcaaaagcctaggagtcaccagtctgaaagagttagggcagttgataggtcagctccagcgacaagcctttcgcaaagcttacggtaaaatttgggacctagccatggcagaggtctccacagaggccattgcctccctcgcccaatattatgaccggccgttgaggtgcttcacctttggggacttccagttatcacccatggtggaagagtttgaagagatcctgggatgccctctagggggaaggaaaccctacctcttctcaggattctatccctctttagctagaatttctaagatagtccaaatctcgatgcaggaattagactatagaaagcaagtcgaaaatggggtggttggagtaccgaggaaatatttggaagcaaaagcaagaatcttggcag

SEQ ID NO: 69204 - DNA, 126 bp, Glycine max
  Peptide Sequence Number=SeqID_160889
atggcaattttgatcgccagtacttcgacaacatttcatagagatgaaagcctcgggaatataaatgggtttatgatcccaacatggttggctcatgaggaaaacgcaaggatcatgcatgagtaa

SEQ ID NO: 69205 - DNA, 294 bp, Glycine max
  Peptide Sequence Number=SeqID_160890
atgggcccgaaatctaccctaaggctcatgagaatcctagggccttctcttgcatctttggtccaatcttcttggagtcttctatccaatgccctggggcctactccaaacctcccgcggttttccttgaattctaccaagttggccattccatcgttgttccgtcctaaacctttggaagcaatgacttgcaagattattttgatgatgccaaagaatcaagagttaagaaagttccaaagaatcaggcttcaagaatcaagtctcaaagaatcaagattcaagaacagttaa

SEQ ID NO: 69206 - DNA, 195 bp, Glycine max
  Peptide Sequence Number=SeqID_160891
atggcacatcaaaaccccccatacttagccttttgcactcctgggcaaaatgaaacaaagagcaaaatccaaggatatcaaagagagacaaacaaaaacatttacatatttctcaatgaacatctaggaatgaaaggaatcggttgtaatgaggccaaggacaaggtagggaaaaagtatggaataagtagctaa

SEQ ID NO: 69207 - DNA, 256 bp, Glycine max
  Peptide Sequence Number=SeqID_160892
tagttgggctaagctcagcagttgggctaagcgcatatccatcgctaagtgcaactttagcatgcttagcgcaaaggagaatcaggcagagcatcagcatcaaagccgtgcgctaagcacgagatcagtgtgcttagcgcagcaggtgccttcagccagggtaagctcgagacttgcgctaagcccaatttcacttactcgcgctaagcgcgagggtggcgctaagcacaatgccacgaattcagagtctatttaa

SEQ ID NO: 69208 - DNA, 2179 bp, Glycine max
  Peptide Sequence Number=SeqID_160893
gcgcgccttacgacgtggacttcgatttgtactggcgcggcgcgccgtggcagccgcaggtcaatacgctgagcggtgcgctgcaggtcaaaatgggcaagggagaaatcgacagcatgggcggcggccgcgccggccagctgctgcgactggtcagcttcgacgccttgctgcgcaagctgcagttcgatttcagcgataccttcggtaaaggcttctactttgattccatccgcagcaccgcctggctgaaagatggcataatgcatactgataatctattgatcgacggcctggcggcggatatcgccatgagtggccagatcgatctggcgcgccgccgcatcgatatggaagcggtggtggcgccggcgatttcggcgacggtcggcgtggccacggcgtttgtcgttaacccgatcgtcggcgcggcggtgttcgccgcctcgcaggtgctggggccgctgtggagcaagatttcgctgattcgttaccatatcagcggcgatctcgaccagccgaagatcaatgaggtgcgcgataacctggcccagattgaacagcagatcaagcagctcaatgccgggcctatcgccaacaggcggaaaacagggcgatggcccgctgcagaacgcggtgcgcgaactggcgcgccgctatggcgtgtggttgctggtgggctcgatgcccttgatcagccgcgaaacccggagcttatcaccaccagcagcctgttgttcgacgatcagggcgagatccgcgcccgctacgacaagctgcacatgtttgatgtggacatcaacgacgcgcacgcccactaccgcgagtcggatacctaccagcacgggcagcatctgacggtggtggatacgccggtcgggcgtttgggcatgaccatatgctacgatctgcgcttccccgcgctgttccaggcgctgcgggcgcagggcgctgaactgatttcggtgccggcggcctttacccgggtcaccggtggggcgccacgggccgacccgccgcacctggggccacacgctggctgtcgacggctggggcaaggtgctggccgagaacccggacgccgtggcggcgctgaaggtgcgcgtggacaccacaagcctgcagcccctgcggcaacagatgccggtgctgcagcacaaccgattccagacgtcgctgacggcgccttactcgctaccaacaagctgagtcatcaagacctgtaccaggtactgggtcaactggcagaacgccgtatcgactacgccgatctctatttccagtccagctatcacgaagcctgggtgatcgaggacggcatcatcaaggatggctcttacaatatcgaccagggcgtcggcgtgcgcgccgtcagcggcgagaagaccggtttcgcctatgctgatcagatcaccctgaatgcgctgcagcagagcgcccaggcggcgcgcagcatcgtgcgcgagcagggcgacgggcgggcgcacaccctgggcgaaatcggttaccgggcgctgtacccgctgctcgatccgctgcaaagcctgccgcgcgaagagaaaatcgccctgttgcaccgcgtcgataaagtggcgcgcgccgccgatgcacgggtgcaggaagtgaacgccagcatcaccggcgtttacgaacaggtgctggtggcggctaccgacggcacgctggcggcggacgttcgcccgctggtgcgcctctccgtcagcgtgctggtggagcaggatggcaagcgtgagcgcggctccagcggcggcggcggccgtttcggctatgactacttcctggaaaccgtcgacggtgacgtgcgcgccgaggcttacgccaaagaagcggtgcgcatggcgctggtcaaccttggtgcagtggcggcgccggccggcaatatgccggtggtgctgggggccggctggccgggtgtcctgctgcacgaagcggtgggccacggcctggaaggcgacttcaatcggcgtggcacctcggtgttcagcggccatatgggcgagctggtagcttccgagctgtgcaccgtggtggatgacggcaccctgcaagggcgccgcggctcgctggcgatcgatgacgaaggcgtgccgggccagtacaacgtgctgatcgaaaacggcgtgctgaaaggctacatgcaggacaaactcaacgcgcg

SEQ ID NO: 69209 - DNA, 887 bp, Glycine max
  Peptide Sequence Number=SeqID_160894
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcccatggagatccacgccttcaacagccgggcatggaaccgcagcgagtgggtcttcaggttgggcacatcgccgggaaggacagacgcgtcgggaagatcgttgaccatcgtccgcatctccacggcggggcgtatcgcgtccggccacaacagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 69210 - DNA, 375 bp, Glycine max
  Peptide Sequence Number=SeqID_160895
atgtcgtctcttatgacagacgtgtgcggtgctaataccttccccatgcgtaaatacaactcccgcgcctttcacttaaaagttcatagattgcatcttgtccggtttttccgacgttttcctcaaataaacgttggtggcgactccgcgcgtattcctttcatggaacacgcatcccgcgagtcacgcgtcgccctcccgtcgaagggctggttgcgacaactgtgttttaagcatgtgcctgagcagatcagaaagaaactcgatgacaaagctgaaccaatgatactcattggatatcatccaaccagtgcctatggtcgacggtcggaaagtgcaccgaatcgctcaagtagtattaaacgggtggattga

SEQ ID NO: 69211 - DNA, 252 bp, Glycine max
  Peptide Sequence Number=SeqID_160896
atggagagatgccataacttcgacaatgggaagagatctcaagaaggttcctcaacacttaaatgctataagtgtaatcgacccggtcacataaaggcacacttccccatcaagcttatcgataccgtcgacctcgagggggggcccgtcgggaaacctgtcgtgccagctgcattaatgaatcgggccaacgcgcggggagaggcggtttgcggtatttgggcgctagcggagtgtatactggcttactat

SEQ ID NO: 69212 - DNA, 588 bp, Glycine max
  Peptide Sequence Number=SeqID_160897
atggcatcaaagaagagaaaggcacctgccacaccttcccatgtccgatatgaccgatccaggttcacttctcctgaggcttgggaaaggtacactgacattattgttcctaggaagctgctgccagagagaaatttggtaagggtcagaggtcatttgataaaatttgatgaagacaccctcaacacattcctgaagacccctgtgatcattgaggagggggagacattatcagcttattctaggtttgcactcttgaggcctaatcctcaagagttagctgctaagctctgcatcccaaggaggggatttgagcttaatgctgatggtcagcctctgaagatcctcaagaagaacatgaccacactcgctcagacatggagtgttctttcttactccaacttgatccccacctcccacacttctgacatcacactggatcgggctaagttgatttatggcattattatgaagatggacatgaatttgggctacctcatctcccaccagatttctatcattgcccagcatgactcctctaggcttggatttccagccataaccacagctttgtgtaaagctagaggg

SEQ ID NO: 69213 - DNA, 234 bp, Glycine max
  Peptide Sequence Number=SeqID_160898
atggtggaggatgcacgaacaacgcttggcaatcaattcgtggggctctggactcgatggatgcacgaacagcgcttagcaatcaattcgtggggctatggactcgatggtggaggatgcatgaatgataatcaattcatggggctccgaataagatttgatggtggaagatgcacgaacagtgctaggcaattatttcgtggcgctccggactcgattgtggaggatgcatga

SEQ ID NO: 69214 - DNA, 333 bp, Glycine max
  Peptide Sequence Number=SeqID_160899
atgggtacctcagagccctacactggggtaatgaaaggcaccatgcaaaaacttcaaggtggacccttgggtactagtaccctcaccttcagagggctacacgctctcaccttcagaggactacactccctcgccttcagagggctacacgtcctcgcctttagagggctgcacgccctcgccttcagaaggctacacgccctcgccttcagaggactacacgccctcgccatcagagggctacacgccctcaccttcaaagggctacacgccctcaccttcagaggactacacgtcctcgcctttagaggggctacacgccctcgcctttag

SEQ ID NO: 69215 - DNA, 1029 bp, Glycine max
  Peptide Sequence Number=SeqID_160900
gtgactatcaccctcgatgatgtggcatctttgcttcatcttcccatcataggcaccttccatagctttgagactcttcatgttgacgaagcggtgttgttgttagtcgaattacttgaggtaagtgcagatgaagcaagagttgagatagtacaatgtcatggggcatatgttcaactatcatggctacgagacacttatcgtagcaaatgtgatgtcgcacactggacggtagcagctcgagcttatttgttgcaattgcaaggttgcactctttttgctaacaagagtgcaatacacgtgcatgtgacgttcttggatgcctttcgagacttcacccagagtggaagctacacatggggagctgccgccttagcattaccagtgtcgacatatcggaaacgtctagatagattggcatctgatggtgtttgctggatgccctatggtgaccattgtgcagttagagactttgtgttgatttctttgtttttcggacatatccaatggggtccatctattgtcatacaccgaccagagagggttgtgcggaaatttgggtatgtttatagcattcctccacattctccggcatcaagattatgcttagaagatattgacgacagatggatgcatttttctaagtaccttgcactagtgggtcagatttgtgttgtgcttggacaatatgcaacagactacatcaactggttttacatgatgtatcatcccttcataagaccggcacaacccagggatccagctagacatccacctgtgtttcaagatgacacatatgttgaactagatattcctcagtacctaatggtgacaacaactatggaggaagcccctgcagatgcaccttctcatgtagagcagtctcgacatgcagtggatgcttgccaagcaatagctgaaagattaaaacgattgttgaacatgaggataatgacaaaaagtatagaagcatacagtgtgatggaagactgcctaaggattgctagaggtgtcactgtgaaacgcaat

SEQ ID NO: 69216 - DNA, 189 bp, Glycine max
  Peptide Sequence Number=SeqID_160901
atgtctcctccacctctagaacctcacaatcactcacaaactcatctcaagctctcaggacgacttcctcttcaatctccgttctctggaggtcttcgcacagcaaaatctctcaaaactctctggcactttgctccgggtatcagaatgactattattatatatgcagtttccatagttagactttga

SEQ ID NO: 69217 - DNA, 242 bp, Glycine max
  Peptide Sequence Number=SeqID_160902
atgcaattcaaggatacaattggatctattcaacgagcatttaaaagtgcaaaaattcaggttggtaagttggtagaagaagtgactcaagctatgaacagaagagaacaagagattgtcgaggttgacactcaggaggagagccctgtgaataagcatgatttagaagaagaagatgaggagaaagcgcaacaatgggaacaatgcttacaaacacacactcaacaagaagataattccaa

SEQ ID NO: 69218 - DNA, 438 bp, Glycine max
  Peptide Sequence Number=SeqID_160903
atgttgctggtccaagcaagccatacgttcctcctccaatgcaacaacaacaacaacaacagccaacaacaacaacagagacaacaatcaactgagaccccttctcaaccttccttagaggagttagtgaggcaaatgacaatacataatatgcagtttcagcaagagacaagagcctccattcagagtttgaccaatcagatggggcagatggccactgagttgaaccaagctcagtcccaaaactctgacaagctaccttctcaagctgtgcagaatccgagtaacgtgagtgccatcactttgaggtctggtaagcaaactaaagtgccaatcccagtagcagaacctacacctgaaagagagaatgagatagatgcacaattgtttcaccctccagaccatgtaggacctacttctagcaattctgatgtatga

SEQ ID NO: 69219 - DNA, 411 bp, Glycine max
  Peptide Sequence Number=SeqID_160904
atgagaacaagagagggtacatctcttgtggatcagttcaagtggagcgtacatccacttggttgttcaaagagaacaagagaggatgatgagctaaacatcaaaatccttaactgtcttacaagaacttgggaaccaaagatcacagtgatcaaggaatccaaggacttagcatcaatgtcgatggaagctctgttcagagaattgctagcatatgaacatgagttgattcaacaatctcatgtagaagaaacaaaaaagaaaagaaaaggaattgcactcaaagttagttcttcaaaggaagattgcaaagaaagctctagtgatggcaaagatgtagagaattttatcttgatggtgaagaagcttggaaaattttcccaatatatccaaagacagaaaattttctaa

SEQ ID NO: 69220 - DNA, 800 bp, Glycine max
  Peptide Sequence Number=SeqID_160905
atggcacgcagagacaaattatggtcattctgcacccttttgtcatccagaggcggcgggcccgatgacatgcggagacaaattatggtcattccgcacccctttgccattcagacacagtcgtgttcgatggcacgcagagacaaattatggtcattctgcacccttttgtcatccagaggcggcggacccgatgacatgcggagacaaattatggtcattccgcacccctttgccattcagacacagtcgtgtccgatggcacgcagagacaaattatggtcattctgcacccttttgtcatccagaggcggcgggcccgatgacatgcggagacaaattatggtcattccgcaccatcttttgccattcagacacagtcgtttccgatggcacgcagagacaaattatggtcattctgcacccttttgtcatccagaggcggcgggcccgatgacatgcgaagacaaattatggtcattccgcacccctttgccattcagacacagtcgtgtccgatggcacgcagagacaaattatggtcattctgcacccttttgtcatccagaggcggcgggcccgatgacatgcggagacaaattatggtcattccgcacaccttttgccattcagacacagtcgtgtccgatggcacgcagagacaaattatggtcattctgcacccttttgtcatccagaggcggcggacccgatgacatgcggagacaaattatggtcattccgcacccctttgccattcagacacagtcgtgtccgatggcacgcagagacaaattatg

SEQ ID NO: 69221 - DNA, 174 bp, Glycine max
  Peptide Sequence Number=SeqID_160906
atgggggtgcaaatagcacccaggcccatttgggccctccagaaggttcctccagaaggcgccgaggcgcttccgaaacgtttccgtaacgttttccgtgaggaatctcgcaaaggtttcgttcgttcttcgacgttctttattcgttcttcatcgttcttcgatcttcaacgg

SEQ ID NO: 69222 - DNA, 342 bp, Glycine max
  Peptide Sequence Number=SeqID_160907
atggtggcccgggtgatgttggggcatggctacgagcccggaatgggtttgggcaagaacaacggcggcaggaccagcctggtaagaaccagaggaaactgcgggaagtttgggttaggctataaacctacgtatgctgacataaggaaaaacatctcagaaaggaagaacaaaggccaaggcccgcggtcgggacaacgaaacaaagaggctccgccatgccacatcaataggagcttggtaagtgtgagttttcgacgcgaaggacaagtcgccgcgatatgcgatgatgactccccgaggagatcggatttggtacaaccatgccctcccagtttctaa

SEQ ID NO: 69223 - DNA, 225 bp, Glycine max
  Peptide Sequence Number=SeqID_160908
atgcctgggttgggtcgggattggtcaagcttggttttgggcaatagcaccccacctgatgtccccaaggtctctagcttgttggattatggggtacccgtcatatgtggtactaggtggcgatcgggagatggcgcaaatcaaatctcccacttccacaaatcaaacatgaacccatcatccccagttgcccaccttcaactgagctcacgtactcctatgtag

SEQ ID NO: 69224 - DNA, 348 bp, Glycine max
  Peptide Sequence Number=SeqID_160909
atggatattgactatgctataaagaaggatgagccaccggctattactgaaactagcgaacctgatgctgttgatctttatgaaaagtgggagagatctaatcgtctctctgttatgttcataaaaaccaacatatccgctagtatccggggttcagttgaccagcatgataatatgattgtggagacagagccctttggcagcgacgagaatgacgaagatgaggaggaggaagaggtggttgagatttgtgtccctgaccgtggcagcacacacaacagaaagggagaagtggatgtcagagggaaggatgccacgactagaagactgtgtgggaccgatgactag

SEQ ID NO: 69225 - DNA, 222 bp, Glycine max
  Peptide Sequence Number=SeqID_160910
atgggggccaccacggggggatccaagatccttagaacagcccccttcagcctatttataggaaaaagggggaggaggttgccgcccagctcgcccagggttatgggaattttacggaagcattacgggtgtcctggaagccccgaaatcccatttttaacaaaatgggggaggtggttgccacctagctcgcccaggcgagctagattgcttccaccttaa

SEQ ID NO: 69226 - DNA, 421 bp, Glycine max
  Peptide Sequence Number=SeqID_160911
agggtacatctacttgggtttgactgagaacaagagagggtacatctcttgtggatcagttctagtggagggtacatccattaggttcaaagagaacaagggagggccactcgatccaacagaaggagtgcgagacatgcgttcatgggtaaggggtcagtggattccctttgacaaagatgccctcagccagttcctgggtgacccgctagtgttgaaggaaggccaagagtgcgagttcagccagaggaggaacaaggccaaagggttcgacgaggaggccattgcccagctattatgcacaccggggcaggatttcgcccgaaccgctgcagggaggtgggtgcggatcatgcacaccagcatggaccaccttgacccaaacgtggatgacattgctgctcagcaatgtcttgcctag

SEQ ID NO: 69227 - DNA, 291 bp, Glycine max
  Peptide Sequence Number=SeqID_160912
atgtggggttaccgtatggttacccgcacctttcgtcaaccaggggcaaacgagcctattgatgcgcagagactaacatcgtcttctacgccttttgccattcagggacagcgagtcaggtggcaggcggagataccttatggtcatccgcacctttcatcaaccgaggggaacgaattcgacggttttactctcgtcgtccggaaacattcaagcccgacgatgcgcgagattcttctttgctgggcgggggcaatcaagtgcgatggcgttccgttggtagggatatga

SEQ ID NO: 69228 - DNA, 1041 bp, Glycine max
  Peptide Sequence Number=SeqID_160913
gttgcatgccctcaccgtcagaagggctacacaccgtcacctttagaggactacacatcctcaccatcagagggctgcacgccctcgccataagaggactacacgtccttgccatcagagggctgcacacccttgccttcagagggctatacgccctcgccttcaaagaactacatgtctttgccatcagagggctgcacgccctcaccttgagagggctacacgccctcacctttagaggactacacgtcctcgccatcagagggttgcacgccctcgccatcggaggactacacgtcctcaccatcagaggtctacatgtcctcgccatcggacggctgcatgccctcgccttcagaggactacacgtccttgcctttagaggactacacatcctcacctcaaaagggctacacgtcctcgccatgagagggctgcacccctcaccttcagaggactacagactatgcatcgacaccttcaaagggcttcacgccctcgtctttagaggactacttgtcctcaccttcagagggctgcacgccctcaccttcagagagctgcacgccttcgcctttagagggctccacatctgtgccttaagagaactcaaggggctagaagtttgcttttatcagttcctgggacacccccaatatttcagggcgaccaactgtgcgagcacaaccagagaaggaggctatcgtgcaactactatgcatatcggggcaagatttcacccagaccgccacagggagacgagtgcggatcatgcgcactaccacaactctgatctccccctaccgaaggatcacgttcgcaagacacccagtggacccgaagaagtccaacagggtcctggggtttcaagctctgattacgggcctctttcagttctacggagtgcccgttgcccccaacaaggcaggcgtagggcgagacaccactgccacctccggagccccttagctcatctacaaaggctggagcgttgcctacaacccgtggccgaccagcaggcgaccaagtccaaagccaaat

SEQ ID NO: 69229 - DNA, 2484 bp, Glycine max
  Peptide Sequence Number=SeqID_160914
atgggtttaagcagtgcaagtgacatatcacttcttctgcttgcactaacatgtattgctgcaattgctaaacttggtccgtcaagagtttcttgttcgcaattcttttcaatgatcacagagatatccggtagtttgatggacatgatggttggtttgattccttggggttcagaagaggttgttttctgggtaaatcttgctcagaagcagctacagcaagctattgataaggaaaaaatatggtcaagattgacaacatctgaaagtattgaggtcttggagaaggatttggctgtttttgggttctttattgctttaggcagaagtacaaggtcatttcttttgacaaatggttttgatactctagatgatccaattgaagatttcatcagcgttacaaaacaatctcatatgcatagaagtaaacatgaaggtcctcccaatgctgaagcagtgcgccaagcttttgatgtttgctctcattggatgcagagctttattaaatacagtacatggctggagagcccttcaaatgtgaaagcagctgagtttctgtcgacagggcacaagaagttgatggaatgcatggaagaacttgggatgattagggataaggcattggagaccgaaggcaagaaagcagctcatagacgtagatctacagttcagtcaactataaaagagtcaggttcttttgatgaggcattgaaaagtgttgaagagactgttgtaagacttgaaaagttgcttcaagagttgcacgtatcaagctctagttctggaaaagagcatttgaaagcagcctgttctgatttggagaaaatacgaaaactttggaaagaagctgaattcctggaggcatcttttagagcaaaagctgattctctgcaagagtggatccccatcggaacaaggcttggaacaggaatggacaacgacaaagttacatttgagctaactggagaggccagaatgacatacaatcattctacttcacccgattccctgaggatgcgacggagaaagaactgtggcttcatttcaaaaagtttggtgatggatggaagacgtgcacagcttagaaaagaagctagacaacatcatcttcagtgggctgaagatacacccattcccgagaacgactcaagggtcgtggccaggaacaacagacacccagctccaatgggaagaccaggtagtcaaaaccatagccgtgaaggatcatggtcttcggtgtatcttgacttaacgacaacagggattaaatggctcaaagagacgtgggtggaaagactaaaaaatctgtccatgttcaatagagttgaagacgacttactttggggcatcgaagctgacatatcgccaaagtacatgggagacgatattgtactcttactaggcctcacggacgatagagctcagcagatggtggaagaagaaatagaaggaggagtctcttcgttccactcactggaaaagtggaacccgaaattgcgtcctggatgccagctgacttgggtgaactgttggggcatcccattagtggcctgggacacggaacaaattaggaagatagtggttggtattggagaagtggtggacgtggacgacgatgtcgagatgcttcggaggctggacagggcacgagtcctcattaaaacaccatggaagccactcatacaacacaccgtcaatgtacacatccaaggtgaagtgtacggtgtgcatctagtggaggaaggtgggatttgttcagagatgcatcattgccggcgcgggagcgagtacgggtcatcggaagaaatagaaaccgatgtaagtgacgtcggaatgccgctcaaagaagacagaagaagatcggcgttggaagatggccttaccgtgaatccgacagaaaaccaggcccagacagttgcgcccgagtttgtgcaggtggcacacaagggagcgcagctcgcacacgccgcgcatggcgtcgcgaaggttgctgacgtcatgacggacgagacggggatgacgaagaccagcgcgtgcaagccaggcaaaaaggaagcacagtggattccatattgggcatggacgcagaacgagaggcacaccaaccaatgtggactgaggtcaaccattcagaggaaggtagctaagaagagggggaatttagatggaagaagaaagaggaacgtgaccaccacctggaagaggaaagtgtattctcgaaccaggaggttccaaaagaaatcgcaggtggaatgtgcaattgctgaagctcatgaaattgagtcacaattaaaagctgtagtggagattgcagaccaaggagaaaacatgaagcaagctgcaacagatatatggaatatagcaaaacaattgggggtaacaggagctgcagatcaggggaggtttgttgagaaaatcttgataatggaggaaagagataggaaagaggcagagagattggggaagaaaagtgataacccatga

SEQ ID NO: 69230 - DNA, 472 bp, Glycine max
  Peptide Sequence Number=SeqID_160915
atgaggatatcgataaggtttgacgttgataggcatgagatgactaaagctatttggggaggggtatgtaaggtaggtggtgggggtgaagtggctgaaggttgggctggtgctggggtgtcacagtcgagagtatggtcgttgcctaccataatgagaagggtcgtcgttggagtagaggcaagggatcaggtgcaaagagttgttgtgagtcaagaagaacagaatctaaggaaacctcaagcggtgaccatgggaccacttgtcctcgcagtggtagcacaacccttggtcgcagaggatttccatttcctcgacccggtgcatgtgggattgaaggggaatgctagctacgacgatgatccaataatttatcctcctgtagccgtgctagctcagccgcctgaggcagagacagagggtgaagagcttgaacttcccgatgaagctccgggattaaccctgagacgaa

SEQ ID NO: 69231 - DNA, 683 bp, Glycine max
  Peptide Sequence Number=SeqID_160916
aaaacctaacctctttctttctacctccctctcagatgaaccaaatcacggcaacgacaccaacatctgccaccaccttcgtagatctaaaggtactgcaatcaccaacatctacagccataaactcatctgtgaccagcacactccgtcattgctcctgctcaccgtcgttgccaccagggtgtgcatcttgcacgatggtggtggccaatcaacttgatctacttgaacaggccataaaggatggaattgtggtatcaagatctgagagagggagagttgttatcattttcgtcgctgctggggagggtttacgatgttggttgttagtgggttttctggttcttggtggtgaggatgcaatgtgcttgttgttggtgggtggaagagatgaagacaaaaggacaaatgtgagagccgtcgagaagttgaaaatcaaggatgttacaaatggtattagagcagacctctctcctaatatgatttggttcgaggacaaaccaggtgaaagctggtgggcatgtaacactccaattgaatcacatcagaatgagaaagattcgaagatgggtgatcttttggaagtttcccggaaagtgtctcaaaaatggctacctacgaaggattttgaccggtggagggttctaaccaacaaggatgttgagcgaagtgtcactacgtga

SEQ ID NO: 69232 - DNA, 372 bp, Glycine max
  Peptide Sequence Number=SeqID_160917
atggtgcaagcaaaccgccagtgggattggcgggttgctgctgctgactggactcgccactggcagcagcgatatgcacatgcacaggagcaaaacgccagtgaggctggcgatataggtggaaggtacacaatgaattcggttataacagtgttgtatttcaatggaagggtatatgaagataatgatggtataatatttgaaggcagtaaaaaagcgattcagattaaacgtggaattagtttcagtgctttgaagaaaaaaattggagacaagtgtcgagaaaatatattgtcttgcaaatctgcgatgatgaagacgttgaaacgatgctggaaagttttaaacaacaacaagaaatgtcagttctag

SEQ ID NO: 69233 - DNA, 513 bp, Glycine max
  Peptide Sequence Number=SeqID_160918
atggcatgcagtagtagcacaatgcagagtgtgtacccgagggtgagtggagcgaatttccacgttccgctatcttccccttctctcgttcctatttacaacaacaacctctccttttcaaagctacgcaattcaattcatctcgcggcggtgccattgccgccgttaaccaaagcctctgcggggaacggcggccccaccgacgagggagtgtctttagggacgatgaagcttcctttggacactgacctccagagattcgattccttgctctttcaggtggacaaaatacctggtggagctagactgggttttatcaccattggagatgggaaaactgaagttcttgtgcatattgattgcttggtttttccacctactgagaattctgctccaatttttcgtgccattagaaatggtcccttgaaggataaggcaccaccaggtgagcccagaatcatgagaagccttcttcaagctcttcagaagtccgttgaaatcgccagattgtga

SEQ ID NO: 69234 - DNA, 234 bp, Glycine max
  Peptide Sequence Number=SeqID_160919
atgggaagggtgttagaaacagaaacttatacaggaagtgatgaggacataaccaagagcaagggcaaggatccacttgaaggacttggaggacctatgacaagggctagagcaaggaaagccaaggaagctcttcaacaagggttgtccatactgtttgaatacaagcccaagtttcaaggagaaaagtccaaggttgtgagttgtatcatggcccaaatggaggaggactaa

SEQ ID NO: 69235 - DNA, 660 bp, Glycine max
  Peptide Sequence Number=SeqID_160920
atggatttttggctggtgagaacaattgaggaaacaggtattgaaatgatgctgagttgggtttccaatgcgtgtgcccatgtcaatacaaaagagagttgtgttgatccctcagggaacgatccagagacgggagactcagacaaatgcgggctggttggtgttgaggaggttaaagatgcagaggcttccgttcctgtacccactgacgaggttatgtgggatgctaccgtgttcggggtgtttaatcaaaacttctcgttgtacataaagcatgaagatctctctgaaattgcacacggtggtcaatgtctcagcatatctgttatacaattttacatcaagagttggatgcagagttcaaaacgcgatgtctaccttggagcctacctgaatggacacttgcaaatggtcatcattccgcctaaggaaaacctagttgtctggttttgttctttacataacatgccagacaactaccttaagggaataattaacagtgctttgaaaggacttgatgatactccacaacctaaatccaaggctactgcttggtggattgttgttaagtgtaatagacaaaaaggaagcactgagtgtgactattacgtcatgcactggatgtccacgataatcttaggaactttcaacaataattga

SEQ ID NO: 69236 - DNA, 216 bp, Glycine max
  Peptide Sequence Number=SeqID_160921
atggtgagcttcttcttgactcatcttcttcttgaagtggcatctccaatcatctttcttccttctccattccgctgccatgatcttcaagaagcaaaggactccattgataaagaagatccagggttgacaagctctccatggagctacatcatgtggtatcaagagcatcttcgtctaagtgatattcttttgcttcctctatctttttgttcg

SEQ ID NO: 69237 - DNA, 1449 bp, Glycine max
  Peptide Sequence Number=SeqID_160922
atggcccaaaatagtaacactgaggcccaaagcccaccaacccccgaggcccgaccagtcggcggcaccgaattcagctggtgcaaggccgttcccgccggcaccggcgtgacagtgctaagcctcctcctctcaaaaccgccgcaaattgctgttgtccaaaatgccctccacaaacttcaaaattcccaccctatcctccgctccaagatccacctcgatccctccaacaatacgttccacttcctcacccctcccactcccaccgtccaaattcaccccttcgatatcacatcaacggccaccatcatccaatcccagtccaacggccacgatcccttccacgcgctcctcgagcacgagatgaaccaggacacgtggcgcgactacacgatcccttcagccggcgccgacgtcctccacgccgccgtgtataatatcagccacgatcgcttcgccgtgttcctccgcctccacaccgctgcgtgcgaccgcgccgctgccgtggcgctgctcaaggagctcctccgcctggtcaccggcggagccggcgacgaggcgagccgggagaaggtgaattctccgatcgaggatatgattcccgaggggaagatgaacaagccgttctgggcgcgtgggttggacgtgctcgggtacacgctcaacgcgtttaggttctcgaatttgagtttcatcgatgttggctcgcctcgcagttcgaggataataaggttgcaactgaatgtggatgaaaccaagaacctattagccggatgcaaatcaagaggtattaaactttgtggggcacttgctgcagctggaatgattgctgcatggacctctaaatgccttcctaattatcaaagagagaagtatgctgtagtaacacttgttgattgccgctcgcttcttgatccagtccttcccagtaacaatgctggattttaccattctgccatcttgaacactcatgacgtgtgtggagaaacagaaaccttatgggagttggcaaagaaaagctacacagccatcgtaaatgctatgaactgcaacaagcattttacagacatgtctgacctgaactacctcatgtgcaaggcaatcgagaaccccggtttgacgccatcatcatcgcttagaacagccttgatctccgtgtttgaagatcccgtctttgatgactcggccgaaatgcttggagagtttggattggaagactatgtgggatgtgcttctgctcatggtgttggcccatccattgccgtattcgacaccatacgaaatggaaagttggattgtgcttgtatatatccatcaccccttcattcaagagagcagattcaaggactagttgatcatatgaagagaatacttgtggaaggttgtaacagtgaaaaccaacaaattgaaccatactccacttctgaggctgagcaaatggttatataa

SEQ ID NO: 69238 - DNA, 156 bp, Glycine max
  Peptide Sequence Number=SeqID_160923
atgagtaaagggagagggagagaaggggcacgcaattttgtgcctcaaatggggattgcatcaccatggagtggaatcagattcaagaaaaaagatagtggaactcaatccaaattccttgtgcgtggaagtatgaatagaagcagaagaagttaa

SEQ ID NO: 69239 - DNA, 411 bp, Glycine max
  Peptide Sequence Number=SeqID_160924
atggcagatcctttgacggctttgatgcatgtagtacaagtgatgaattttctcaagacccttgagatgaagacactaagagaaagagaggggtctacggtaaaatcaaatactgtttcagacttaaattcttttggtgatgataatcaccagagctcttcacagcttaaactcaaggatggcagtgaaaatggaagtgattttagtgaagaggataaggcacctgatgttactgttgagccttcggatgatgtgaagaatccgtcaagcaattggcagtttgtggttctggagttggctggttctcattacgctgccgtttgtatagaacaggatggtaccgatgcaggcaatgggagtattccaataaatctgaccctaaggaaaacaatcccatatgttgaggattaa

SEQ ID NO: 69240 - DNA, 405 bp, Glycine max
  Peptide Sequence Number=SeqID_160925
atggagttgaagagattgaatcaacatgaggagaatgataagaagaagaaaggaattgctcttaaagtttcatcttcaatccaagaagaaagtgataaggaggattcaattgaaatagacaaagatgatgatcttagtctttttgcaaagaaggcctgcattacatgggatgacaatgataaggactcatctgaagattcagaaaacgaaattgtaaacctgagtctaatgtccaagagttatgaaagcgatgaagaggtatccttgaagaagaattggtacatagatagcggatgctctaaacatatgacgggagatgcatcaaagttcactcatatctctcccaagaaaagaggacatgtgacttatggcgacaacatgcgccaaaatgttttttccaaatag

SEQ ID NO: 69241 - DNA, 165 bp, Glycine max
  Peptide Sequence Number=SeqID_160926
atgtgttttgcttgctattacagagggcagttatcttcggagagattcgaaggattcaaagagaaaataaggccagtttcctacttactatttccaaatgatgcttcaagtgttcctaatacacctttggatgcaagaggatcttctggtgctagcaacccttag

SEQ ID NO: 69242 - DNA, 927 bp, Glycine max
  Peptide Sequence Number=SeqID_160927
atgtgggtggtagcaggccctgccatattcacaaggttttcaacgtttggaatcatggtggttagtcaatccttcattgggcatattgggtcaactgaactagcagcttatgccattgttatgactgtcctagtcaggtttgcaaatggtgcattgagcaagaacaagatcattgcctaccttgcagcagtttcaatttcaattcatgttttgttgtcatggcttttaactgttcggtttaagtttgggctcaacggtgcaatgacatcaacacttttagcatatcggattccaaacattggccaacttttgtttataatgactaagtgccctgacataaactatggttccttttacagtcttgagatctggtacaacactgttttgattctgcttacaggcaacatgaaaaatgctgaagtgtcaattaatgctctggccatatgcctcaacattagtgggtgggaaatgatgatagcccttggtttctttgctgcaacaagtattgaagaattcataccactgctgagggagcgcatgaatgtgttgaatccatatgttcgtcagtttttggtaggatggattactgtattggatagtgtcccatatattgatatgctggggtttcttcctgattttcttgatgtgctactcttgaagtctgtagattatggtcgcatggctgaaatcctggtacagagggcaggttctctagatgaattcactaggctaacaactatcacatgggttgttcgtgaaaccaatgaagagctacgtgccctcaaggcagatccagctgaagcgtttgatgtaggagcaatcctgtccattgccaggagcatgcggaacaagtctgaatgtacacctcacgaatcaagggaaccttctggacatgatcaagagactaacgacaaagttgatactaag

SEQ ID NO: 69243 - DNA, 213 bp, Glycine max
  Peptide Sequence Number=SeqID_160928
atgaaacgggcgccagaaggagaggacgttggacttgacggcgcagccgggaggaccgtagtcgaaggggccggcgacgctccaggaagttcaccacggactgtcggagcacacgatgaagggcgcggacggcgattagaagaacgtgtcaaaacattcgcgtatttccttatattcctagaaacacattatgagctcttacccagagattag

SEQ ID NO: 69244 - DNA, 1653 bp, Glycine max
  Peptide Sequence Number=SeqID_160929
atgacatcaaaaagggaaagggaagcgggtgatagagtagaggatgaagggcttgataatgagtcgaaaaggcagaggctggatgaggattcttccccctctcctcctcctgtctccgttgcaaatcctctttctgggttggccaataattatgctgacattgatgaggaggaagatgatgttagaagggaaaggggttctgtaaatgagaggagcaatgatgggtcccatcataatgggcataataaatatggagaggctgatgatagtgatgaagaagatgacgattcacacgaacaatttactggaagaaatcgccaggttgaggttcggaaggactgtccttatcttgatactgttaatagacaggttttggatttcgactttgaaaaattctgttctgtctccctgtcaaatttaaatgtgtatgcatgtttggtttgcgggaagtattaccaagggagagggaagaagtctcatgcatatacacatagtctggaagcaggacaccacgtctatatcaatctccgcactgaaaaagtctactgtcttcctgatggttatgaaattaatgatccttcattagatgacattcgtcatgtcttaaatccaaggcttgagccttggcttggactctttgtggatagattcactgcaaaagaagttgaacaacttgacaaaaataagcagtggtctagggctcttgatggttctagttaccttcccggaatggtgggacttaataatatcaaggagactgattttgtgaatgtaacaattcaatccctaatgagagttacccccttgagaaatttttttcttatccctgaaaattatcaacactgcaaatctccacttgttcatcgatttggtgaactcactaggaaaatctggcatgcacggaactttaaaggacaggtcagtccacacgagtttctacaagctgtgatgaaagccagtaaaaaaaggtttcggataggtgcacaatctgacccgggcgaacttgaggttgtgaaagagattcctaacaaagtgatctctgataagaaagaaaacagtgaaaaccaaaacaatgctgagaaactttcagatggggtgaatgagcgatatgcatttgtcaaagaaacttcaaaaatgccatttctaatgttaggattggacttgccaccacctcctcttttcaaggatgtgatggaaaaaaatataataccacaggttccactctttaacatactaaagaagtttgatggtgaaactgtcacggaggtggtccgtcctcatatagcaaggatgcagtatcgtgttaccagattgcccaagtatatgattctacacatgcgtcggtttactaagaataatttttttgtcgaaaagaatcctacgttagtcaactttcctgtgaagaacctggagttgaaggattacattcccttgccaacaccaaaagaaaatgagaaattgcgaactaaatatgatttgattgctaatgttgttcatgacggcaaacctggtgaaggattctatagggtatttgtgcaacgcaaatcagaagaactatggtacgagatgcaggatttgcacgtctctgaaacacttcctcatttggttgcactttcagaaacttatatgcagatttatgaacagcagcagtaa

SEQ ID NO: 69245 - DNA, 723 bp, Glycine max
  Peptide Sequence Number=SeqID_160930
atgcgcaccagcatgaccaccttgacccagacgtggatgacactgctgctcagcaatgtcttgcctagcgatcataactccgatctccctctgcctaagtgccagttggtgtatgccatcctgacacggatgagcatccacgtggcccaggtgattgctgacgccatctatttgtttgcaggtatgccacccaccaggcaccctctagacccggataagtctaacagggccctggggtttccggcgttgatcacgggactctgccagtcattcggggttcccgtcacccccagtaaggtgatccgaccgccgatcacccgggccttcatcaagaagtactgcacgcctaggcaggcacagggtgatgcacatcaggccgcaaacgcaccgccaccacctcatcaggccgatctcgctggatcactaggcatggagcgttatctacagcacttggtttgccagctggcggccaaccaccacggacaggtgcagatacacgagtgtctctaccgtttcagccgcagtcagcaggggcagagttccaccccttttgtatgccctaccccggagcagtttgcggctgaggtcacatggccgggagactggcccgatgcccaggcaggggaggagcctgcagggtcccccggtaggatggatgaaccccgcatggacgaggatatgactgacctgttcgatttcttggaagggagcggagccgcatga

SEQ ID NO: 69246 - DNA, 1851 bp, Glycine max
  Peptide Sequence Number=SeqID_160931
atgaagatcttcattatctttagtatcaccttcacatgtggtatttttggaaatgttaattcaaatgtcaatcctctcccgtatgaagctattttcaattttggtgactctataagtgatacaggaaatgctgctgcctatcaccatgttcccaaggatggtaaaagcccttacggctcaacatacttcaaacatccatcgggacctgaggcatatgggttgccaatgttgcccgcctatctagatctcaccaaaggtcaagacattaggcatggagtaaattttgcatttgctggtgctggtgcacttgatatgaactatttcacaaacaatagactcaaggcaccagcaacaaataattcattaagtgttcaacttgattggtttaagaagctcaaaccttccctgtgcaaaaataaaaaagagtgcaataactacttcaaaaaatcattgtttatagtaggagaaattggtggaaatgatattaatgcgcctatctcgtataacaatatttctaaacttcgtgaaatagttcccccaatgattgaagaaattaccaaggccaccattgcattaatagaagaaggagctgtagaggtagtggtgccaggaaactttccaattgggtgtaattctggtgtcttgacagtggtgaatagtggcaacaaagatgactatgatcaatttgggtgcttagcagcttacaatgttttcattaaatattataattggcggcttaatcaagccatagaggcactaagacaacaaaaaaaccatgttaagataatatattttgattattatggtgatgccagacgtttatttcaagcaccacaaaaatatggcttttcatctagtaagaatgagactttcagagcatgttgtggaacaggcgagccttacaatgttgatgaacatgcaccttgcggaagtttgacttcaacaatttgctctgatccttcaaaacatataaattgggatggagctcactttactgaagaagcttataaactaatagcaaaggggctagttgaggcgttatcttcttccttcgttgttggttggtatgtgtcgcgttgccactgttcggtgcttccattgccagattttaggaccaccatgtcgtttccaccgtcgagttacttgaaatcagtggagatgaagctagagctgagacaatacattgtcatggggcatatgtacgcctatcatggctacgagagatttatcatagcaaatgtgagagacctcagtcaaagtagaaactacgcatggggagctgccgccctagtgtatatgtatggtaatttgaatgatgcttgtaagagcgatgtgttggattatgaatattttccatatattgttgaggcttttacggatcaagactatgatgaaaggtcaccacgtgcatgccactggacctctatgaaggcctctacaaaggcattaccagcatcgacatatcggaagcgtctaaatcaactgaagactgttgatgtcgttacaccttatggtaaccaccatgcagttagagagtttgacctcatttcatgctattttggacctatccgatggggtcctgttgtcatcatacaccgaccagagagggttgtgcgacagtatgggaatgttcagatgattcctccacactctttgggttcaagattatgcttggaagatatcgacgacagatggatgcatttctctgactaccttgcaccggtgagccagatttgtgttgttcttggacaatgtgcaccggactacatggactggttagacatgattttgaatccattcatgaggccaacacagctcagggatccagccatacatccacttatcatgtaa

SEQ ID NO: 69247 - DNA, 231 bp, Glycine max
  Peptide Sequence Number=SeqID_160932
atggcattagggctcaactcacccaagcgagctggttacttcacccctaagctatttgggggcccaggcgagccagggttcagaaaaaggcttaaaatgaccattttgccctccctttcgatatttttcgtattcttgatcaaaacattgaatgatcatctgtttcgcactgtaactggtgttcaacaccataagtcgactaacaaggatcaaaagatcaacaaacgatag

SEQ ID NO: 69248 - DNA, 942 bp, Glycine max
  Peptide Sequence Number=SeqID_160933
atgaggactaccaaaactattaagcgataccatcgtagctcttttactcctcaagaggaacacgttgaatgtgaaactcagagctggtaccaagaggtgtcaaagctaaaggcaaagtatgattctcttcaaaggacccagagggcaagtgactactccagacccagtgactattcaagatggggttcatctgatgatgacaatggccttggagactcgccaagcacagtctcaccactgtcttatggtggacctgcctctactgaagatggatatggaatgccagggcgttccaggtactgccttcttgcaagtaagcaaatggtaggaatatttctaaccatatgggtgagaagtgaattgaaagatcatgtgcgaaacatgaaagtatcctgtgttggcagaggattgatgggctatcttggaaataagggatccatctcaattagcatgtctctacatgaaacaagcttttgcttcatttgtagccacttaacctcaggacaaaaggagggtgatgaattaagaagaaattctgatgtgatggagattcttaagaagacaaggtttctacgtgtacatgatgctgacaatgagaagtctcccgagacaatcctcgagcatgagtatgaatttacttgcatacatcttagtataactaatactcttaacatgtttattcgaattatatggcttggagacttgaattatcggattgccctctcctaccgttttgctaaggcacttgttgagatgcaaaactggagagcattgttggagaatgaccatttgagaatagagcagaagagaggccgtgcatttgtgggatggaatgaagggaaggtttatttccctccaacatacaagtattcaactaattcagataggtatgcaggagatgatatgcacccaaaggagaaaaggcgaacacctgcttggtaa

SEQ ID NO: 69249 - DNA, 1014 bp, Glycine max
  Peptide Sequence Number=SeqID_160934
atgtccataaaccactactccatggaccttcccgaaccgacactctggtggccacacccacaccaccaacaacaacaactaaccttaatggatcctgaccctctccgtctcaacctcaatagcgacgatggcaatggcaatgacaacgacaacgacgaaaatcaaacaaccacaacaggaggagaacaagaaatattagacgataaagaaccgatgttcgagaagcccttaaccccgagcgacgtggggaagctgaaccgtctcgtaatcccgaagcagcacgcggagaagtacttcccactgagtggtgactcgggcgggagcgagtgcaaggggctgttactgagtttcgaggacgagtcggggaagtgttggcgcttccgctactcgtactggaacagcagccagagctacgtgctcaccaaagggtggagccgctacgtcaaggacaagcgccttgacgcgggcgacgtcgttttgttcgagcgtcaccgcgtcgacgcgcagcgcctcttcatcgggtggaggcgcaggcggcagagcgatgccgccttgccgcctgcgcacgttagcagtaggaagagtggtggtggtgatgggaatagtaataagaatgaggggtggaccagagggttctattctgcgcatcatccttatcctacgcatcatcttcatcatcatcagccctcgccataccaacaacaacatgactgtcttcatgcaggtagagggtcccaaggtcagaaccaaaggatgagaccagtgggaaacaacagttctagctctagttcgagttcaagggtacttaggctgttcggggtcgacatggaatgccaacccgaacatgatgattctggtccctccacaccccaatgctcctacaatagtaacaacatgttgccatcaacacagggcacagatcattcccatcacaatttctaccaacagcaaccttctaattccaatccttcccctcatcacatgatggtacatcaccaaccatactactactag

SEQ ID NO: 69250 - DNA, 132 bp, Glycine max
  Peptide Sequence Number=SeqID_160935
atgtccgaagaagttgatatggattttcaaaatgaagaagattgtggtgtgaatgaagaacatgttgattgttcagatgcttttaatacttctcagcagaggaagaactgcatttgtgttaattgggtgtga

SEQ ID NO: 69251 - DNA, 333 bp, Glycine max
  Peptide Sequence Number=SeqID_160936
atgagggtctatcagccaacaaactgcagatatatctgcaaagaatgggaaattgggattgaaattgataccaatgtgaaggcagatgaggtggagaagttggtcaatgacttcatggcaggagagaaaggaaacaaaataagaaaaaagatcgtggagttgaagaagaaggcaggggaagccactacaaataacacagtagagatagctcctgataaagtacagaagacaagaaccccacaaaagaaacaacaccaccccaaccatacacatcaaaaacttaagcaaaggctaaaggcattgctgatgaccattggtgataaggaacattga

SEQ ID NO: 69252 - DNA, 240 bp, Glycine max
  Peptide Sequence Number=SeqID_160937
atggagaagaagacagagagaaggagacgaaacatatctaggtatggtggcgaaggagaagaagtagagacttgtgacgatgctcgagtgcgacgaacacgatgctcagatgcagacagggacgtaatgttagatgaacatggcataatcattaggaataaggctagattagttgcaaaaggatataatcaagaagagggaatagattacgaagaaacatatgctccagttgcagattag

SEQ ID NO: 69253 - DNA, 717 bp, Glycine max
  Peptide Sequence Number=SeqID_160938
atgactaatgcaaactgtccgcaagagtcattgcattcagtctcaaacgggaatctaaggtttgacactgcacaaactcttgtgtcaaggttctttcagagccctgtcgagtctgatgaaacaaaagtccaaacttggagcagccaacactacaggaacgaacctgtggttgttgttgctgctccacggttgcaaaagtattctagttttgatgaccagagtggggagaagcctctgcttttgcccattcaaagcttcaaatctcgcttatctaaagaagttattgatgttcaatctcagaacatgtcaatgagttctaaaagattttcaagctattcgaatagaaaagcagaagttaaagctgttgatgttgatgttgatgttcaatatctaaataggtcaacaaccttcaaaaggtcaacaatttctcaaggattttcaagcaattccaatagaaaagctgaagttataatgttgtcttcaaacacttatgttataatgttgtcttcaaacgcagaggattcggtgaggaagaagggcttctacaagtcttgtcctccaccacctccgccaccgccaccaacaatgtttcagaaatcagtgttcatgaagccaaggttcgatggttcatccaacgaagcaccttccttcaataaggagttaaagagaagcttcacaagtgagagaaccacacctagtgggaaagaaaagtcatga

SEQ ID NO: 69254 - DNA, 777 bp, Glycine max
  Peptide Sequence Number=SeqID_160939
atggctacctcaccaaaagatacttcatcacctggttcacccgctgtaccatcatctccatcatccaccaaagcaccatcaatccaggaacaacctgatttccatatccaacccatacagatgattcctggtcaagcccctgttcctgaaaaactggttcccaaacgacaacagggtgtgaagatttctgaaaaccctagccttgcaacaagtcctagggaagtagacacagagatggataagaagatccgcagtattgtaagtaacattctgaaaaatgcctctgttcctgatgctgagaaagatgttccaacatcctccaccccgaatgtttctgtgcctgatgttgataaagatgttccaacatcttccgctccaaatgctgaagccctcccttcacccagtgaagaggaatcaacagaagaagaagatcaagccacagagaagaccccttcaccaagggcaccagaacctgctccaggtgacctcattgaccttgaagaggtagaatctgatgaagaacccattgccaacaggttggcacctggcattgcagaaaggttacaaagcagaaagggaaaaacccccattaagaggtctggacgaatcaagactatggcacagaagaagagcactccaatcactcctacctcatccagacgaagcaaagtggcaatcccttccaagaagaggaaagaaatttcctcatctaattctgatgatgatgtcgaactagatgtctcgacatcaaagagggccaagaaatcagggaaaaag

SEQ ID NO: 69255 - DNA, 264 bp, Glycine max
  Peptide Sequence Number=SeqID_160940
atggagcagtatttacggctttggttcgccagcaggcggccaaccaccgagcacatgtacagacccatgattagccagggcttcgcttctttttcatgccctactccagaccagttcagggcagaggtcgcatggcccggagattggcccgaggcccaagcagaagaggcacccccagaagctcccggcgggggagaagaggcccacgaggacgaggagatggccgatttgcttgacttcttgggagggagtggagatacgtga

SEQ ID NO: 69256 - DNA, 435 bp, Glycine max
  Peptide Sequence Number=SeqID_160941
atgaccactcttacacagatatgtatgacattgctacttagcaacattctgcccagcgaccgtaatgtcgatctccccttgcggaagtatcagttggtctgtgccgtcccgacatatgggtcgcgccaacaagacacccagtggacccagagaagtccagcaaggccctggggtttccagctctggttacgggcctctatcagtcctaaagggtgcccgtaccccccgacaagagatcgcgcccgcaagacactagtgaacccggagaagtccaacagggttctagggtttccagctctgattacgagcctctgtcagttctatggagtgtccgtcacccctagcaaggtcatcaagccccctattaaccgggctttcagcaagaagtactgcgccccccaggtaggcgcaaggcgagacaccataacagcctga

SEQ ID NO: 69257 - DNA, 457 bp, Glycine max
  Peptide Sequence Number=SeqID_160942
gaaaatcttgcatgagaggaatgttatgctttattatattgagtttgacgaattcactgaagaacttgagcgcaggaattggcacaaggagttgacaaacttcatggatggcagcattgatgtggccattgtgaaggagttctttgctaacctctatcatccagaggacaaatcaccaaagcaagtgagggtcataggtcacttggtgaaatttgatgcagacactttgaacacttttctgaagacccttgtgatcattgaggagggggagaaccggcctgcctattccaggttgatctatggcattattcagacgatggatatgaatgtgggacatatcatctcgagtcagatttctgtgatagctcagcatgactcctcagggatgggtttccctgccctcatcactgctttatgtaaagcccggggagtcacttctgattcacttagtttttaa

SEQ ID NO: 69258 - DNA, 612 bp, Glycine max
  Peptide Sequence Number=SeqID_160943
atgaacttggagattgaagctacattaagaaggaacagagctgagaggagaagaaaattactacaagataggacagtagcttccattctagaggaagaagctcattttttttattctacatcatctgactcaccatcatcaagggaatccatgacatatttaccagaagccgttattatggctaatgaacaccagcaaagggttacccttgaggactactcaagtagttcagtaccacaattctttaccagcatcacacgtccggaagtccaagctcacaacataaactaccctcattctttgattcatttaatacaggggaacctattccaaggattacctaatgaagacccttacgcacatttggcaacattcattgaaatatgcaacactgagaagccaagaggtggttccactcatttaaggaccacaaaccaagcaattgctagatgcttcagcagggggaaaataaagctgaagacccttgaagaggcaattgagctaattgagaatatgtcagccagcggtcatgccattctacgcgacaaagttcatcaacccacagagaaaagcttgttagagctatcatcacatgacgctttattggcatag

SEQ ID NO: 69259 - DNA, 495 bp, Glycine max
  Peptide Sequence Number=SeqID_160944
atggtgcctactaggcaccctctagacccagataagtccaatagggccctagggtttccggcactgatcacgggcctcttccagtccaacggagttcccgtcacccccagtaaggtaatccgaccgccgatcacccgagccttcatcgagaagtactgcacgcctaggcaggtgcagggtgatgcacatcaggccgcaggcgcaccgccaccacctcggcaggccgatccagctggcccactgggcgtggagcgttatctacagcatttggttcaccagcaggtggccaaccaccatgggcaggggcagggttccaccccttttatatgccttaccccgaagcagtttggggctgaggtcgcatggcctggagactggaccgatgcccaggcaggggaggagcctgcaggatcccccggtgaggcggatgaatcccgtatagacgaagatatgactgacctgctcgatttctcgggagggagcgaagccacgtga

SEQ ID NO: 69260 - DNA, 321 bp, Glycine max
  Peptide Sequence Number=SeqID_160945
atggggttgaatcaatttatatttttcaacatggtccatgacatcttgatcaaggtgaaactggaagtaacgaggacatcaacagtcctaaatgtgtttggcagtagacgaagcagtgataggaaaatgcaaggatcatgcatgagcgaacatgaaaacaaaaggtatgtagtttgtagaacaaaaactgagaagtccgtggatctcctcgggggcggagtaggtgtccaccattgctttggccttggccagcaactagggaagttcttcactgccgttcaaagtaagagcaaatcggtccatccacattgtgcctcttga

SEQ ID NO: 69261 - DNA, 330 bp, Glycine max
  Peptide Sequence Number=SeqID_160946
atgatgacaaggagtaaaaggtttatggaggcaaaagatgaggatagtgtagtgtacaagaagaaagctgctgaaaagaaaggtactgatgaaaagaaagatgatgtgataggtgaaagcaatcatgaaaaagagaaacaaataatgaatgaagagaaaaatagaagtgaacaagttagagagaagaaaacagaaaaagctgtgaacgaaggtgtggaagtaccatatcctatggtaccttccaagaaggagaaggacctccatttggcgagatttttagatattttctggaaactggaaatgaccatgccctttggagaagctttatag

SEQ ID NO: 69262 - DNA, 246 bp, Glycine max
  Peptide Sequence Number=SeqID_160947
atggttcgcgaagcggagctaacgctgaatctgaccgtaagttcgaagagctggttcagacccgtaaccagggcgaccatctgctgcacagcacccgcgctggcccaggcttcccagaagctgatggaaatcgctcagcagcagcacgctcagcagcaggctggcggcgctgacgctcaagaaagcagcgcgaaggatgacgatgttgtcgacgctgagttcgaagaagtgaaagacaaaaaataa

SEQ ID NO: 69263 - DNA, 312 bp, Glycine max
  Peptide Sequence Number=SeqID_160948
atggaaaaatccgacaagatgaatttcaaagagaagaaagaaaagaaaggatacatcacttgggaagataatgtcataaattattcaagtgattcagagaagaaaatcataagtctgggtatcatgatgaaagactatgcaaacggagaagagcaaagtcgatacattgatagcaatttctccaaacacatggcatgcatcaaagtggttgtcatcatcaaaaagggggagaatgtaaatcatgaagattttgatgatgtcaagaagaatttgcttgagaaagggggagaatgtaaatcatgcaagctttga

SEQ ID NO: 69264 - DNA, 765 bp, Glycine max
  Peptide Sequence Number=SeqID_160949
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaacttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatattttttatttggtaa

SEQ ID NO: 69265 - DNA, 243 bp, Glycine max
  Peptide Sequence Number=SeqID_160950
atggagtggttctacatgatttcacatccgtttatgactccagcacagccagaggatcctcctaaacaactagtggcgacagcgacacctaatgaagtagacgttgatgtgcatcgtcctcgacatgcggtggatggttatgtggcaattgctcataaattggagaggctactgaacctgaggatcttgatcgaaggaacagaagcctatactattgctgaagaatgtttgagcatcgcatga

SEQ ID NO: 69266 - DNA, 184 bp, Glycine max
  Peptide Sequence Number=SeqID_160951
tcctttcgctaagcgcaagcctcgcgctaagcgcatctttgttcatgcgctaagtcatgagtctcaagcgcttagcgatcaactcttgcatctgaggcttatttggtccgctaagctggccaaggctgagctaagccaacttcaattcgatctgaattcatttaagctacagcctgattgctaa

SEQ ID NO: 69267 - DNA, 294 bp, Glycine max
  Peptide Sequence Number=SeqID_160952
atggaaaaagattccaagaagattttccaattcttagatgctacaagtgcaaccaacttggtcacatcaaagcaaattgcccctcaaacgagcaatggcttgagaagaatgagaagaaaagtcatgaagaaagaagatccaagaaggtgtatattgcatgggatgacaatgactcatccgatggttcggagaaggagattaaccttctatcaaaagactatgagagtgaagaggacatcactcaaagggattaaaatcaagatggcaaatctaatttccatttcattccaatga

SEQ ID NO: 69268 - DNA, 123 bp, Glycine max
  Peptide Sequence Number=SeqID_160953
atgactaatgcaaactgtccgcaagagtcattgcattcagtctcaaatgggaatctaagaggcaggagacaagtggcgctgaccgacaccatgtgtccattctgctgcaaagaagaagagtga

SEQ ID NO: 69269 - DNA, 237 bp, Glycine max
  Peptide Sequence Number=SeqID_160954
atgagggacggcaagaggtcttcgtacgtcattgggatcggggtgaattctggtgttggccttgcggtaaagttcctcatcgtgttggaaccggtgccaaagtgggcattgtcggccgggcgaatcgtggttggagccggagcttggggggcctccctctggataggtgcgggcgctctaggttgtatgggtgctgaattggaagagtccccgacgcgagctgagaagttcaggtga

SEQ ID NO: 69270 - DNA, 441 bp, Glycine max
  Peptide Sequence Number=SeqID_160955
atgcaatcccagatgcaatctcaggggcttgcactgcctccagagcttatggttggtccctcaagtcctcatgtcatcacaaaggagagttatgttgatccctcagggaacgatcctgagacaggtgactcagacaagtgcgggttagtttatgagggatcaacagttcacaaaattcctttgttgcctggccaagtgaaggttggtgttgaggaggttaaagatgcacaggctcccgttcctatacccactgatgaggttaccttagtggggcaggcacttaacaccttccttgcttggccgacacatctcatgaagcatttatcagaacaggtagctgtttctccagcaaaacctccacaaaggccggatcttgaggtcaatgatccgctatatctgctgacattgaccatcccagagcttttcttgaagcctttctag

SEQ ID NO: 69271 - DNA, 669 bp, Glycine max
  Peptide Sequence Number=SeqID_160956
atgatcgtgggaaaagttgtaatttcttcgttccatcagtttcccaatgaatctttgagtggggcattagaaacatttcgtagcttgttgtggaaaactcccactcatggtttttcagagcctatacaactgaacatcttcattgatgggttacagccgcaatcaaagttacatgttgcacactttgtggtggagctcatgggtcaggcttgtgtattcccactgaagaaacatctcatcaagttaattacatgggaaaccagcctagacaaaattttaatgcaggtggattttctgaatttcagcatggccaaccttaccagtagcataatcaatggagaactcaccctgctagccaaacagcttgcagaaaaatcttctagtacttttggagctaacactgagcagaatgcaaaagaagaatgcaaggctgtgatgacccgaggaaggaaggtaaccatggaggaagagaacaagaaggagaaaatggtggaggatgacaaacaacagctgataattaaactagcacctaaaccagtgcaacccttttgtgaacttataaaggaagaagaagaagaggaggatgaacaaatgagagagacaccaataattttgagtgaaaaagaaataaatgaaaaagaaaagaaggaaaaagaaaaagaagaataa

SEQ ID NO: 69272 - DNA, 78 bp, Glycine max
  Peptide Sequence Number=SeqID_160957
gcgaggctcacgggtgcgctttccaaaggaggaaagatgcgcggagtcgctgatcgaggccgtacccgaatcaaataa

SEQ ID NO: 69273 - DNA, 241 bp, Glycine max
  Peptide Sequence Number=SeqID_160958
atgggggatgcaaatagcaattttgaaaatttgaaattgggtcttccaaagtattttcgaagctggattgcttctggaggaagtaacccagctcgcttgggcgagctgggcggcaacctcctccccttttttcctataaataggctgaagggggctgttctaagggtcccagatcccccggattttcagccgtttttcgtcattcattgttcgttcttcattgttcttcggtcttcaaccg

SEQ ID NO: 69274 - DNA, 537 bp, Glycine max
  Peptide Sequence Number=SeqID_160959
atggaggagaatcatactagtaatgcgtcaacgttaaccagaaacatcaggatcaccgtgttgctcaataatctacaagaggtgaatgacatttgccagaaaaagatgaccaaggaaatctactcagattttgaaaagaaatatgggcaaattaaggattttctttacgcaacttctcagcttatgacattattcattgaggagaatatcctcccttggatagatgtcaaccatattttaatctcaagatgttttgatccttgcacaaaatgtgggggacacatcacattgctagtacataagacctcctctattgagaagcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaggggagagggagagaagagcacgaaattttgtgctctaaatga

SEQ ID NO: 69275 - DNA, 1304 bp, Glycine max
  Peptide Sequence Number=SeqID_160960
atggccacggttcacaagtggctcactcatttctacgacaccaaaaaatgcagcaacatcctcgtacctcttggttccaagggacagcaatccataccccatcatagatgctacctttcaatgaacggttgcagagagggacaacaccaacatgcaagaacaaggaacaaccctgttgggaccatagaaaccagaaccttggcagcagttgcatcacctgcaatggctatgtacagcctcaacatggccatttcggagcttaaatcggatgctctgtttggtacctcttcgggcattgtaagggtgcaggttccaattgaagagcaagttgaagccattgattggctccattcgcagaaccatcttctgcttcctcgctgcttcttctttggaaggaaacagtgcagtagtccctgctgcattaatggtgaagaaaagttggtcagtgttgctggggttggttcagctgttttcttttcccagccacatccattttcctactgggattggatatctataagaagatgccctttaatccgtgcatatggagctatccgtttcaatgcaaaagctaaggtgtcatcagagtggctggcttttggttctttctacttcatgattcctcaggttgagttcattgagcttgaaggaggatcaatgcttaccataactattgcctgggataatgatctttcttggtcatgggaaaatgcgatcaatgcactccaagaaacactttgcaaagtttcttcttccattgtgaagtttccaaaacaaactcctccaaccttaatatcaagcagccagaacattcctagtaaagtagactgggatcttgctgttaatagagctttgcagatgatagggcaaaatgattccttactaaccaaggttgtgctcgctcgtagcactagggtggtgcctactgttgatattgatcctcttgcatggttatcttgcttaaaggttgaaggtgaaaatgcttaccagtttttacttcaaccaccaaatgcaccagcatttataggaaacacagctttggctggaacccgtgctagaggagcatcacaagcactagatcttcaaatcgaacttgacttacttaccagtccaaaggatgacattgagtttactatagtgagagaaaccataagaagaaaattagaggggaatcggaaaacggcggtgtacactaccacactcaatcacaacattcagtcaatagcgcaaggcatggcccaagcccttcacaccagcgagcacctccgtcgtgtgatggacagtgacggttgttcccctaactg

SEQ ID NO: 69276 - DNA, 651 bp, Glycine max
  Peptide Sequence Number=SeqID_160961
atgattgaccaagaagcatgtcggattgcacttgtcaaattgtttgtggcattggagctcttcttccatacggttgagcatgaagcctttcgagaattttttagcattgttgcacccttttcttgttgtcatctcatgcactactttggtttcaaagaggatattctagctatttgtagggttcatgctgccatcaaatgtgtaaaatcctccccttctagattgtctaaattcaacgaatgtgttgcgcatgtgacaagcactatgtatacgtttgaggcctttgggattggaatgaaaattagggaaatgtctacttccaggggtgtgaatatgagtgtgagaacggtgactgtgcacatgaaggaaaaatattattggggcaatattgatcgtataaacatgctattgatgatctctcttgtgttgcacccgagttacaaattaaaattcatgaattggcttattgctgaaattttttatggtgaatggggtgaattgacttgtaagttgagggataaagtggaatctagcttgagatcactttttgaggagtatagtagtgatggtgatgagtttgaagttagctcacatgaagctcgagctcaacctagtgaaaaggttgagaatgatccttatggctatagttga

SEQ ID NO: 69277 - DNA, 1190 bp, Glycine max
  Peptide Sequence Number=SeqID_160962
atgtcctttttcaactggtggagttgtggtttgtgcagtggattcattctagggtcgaccgtgattgtttatgtacaagatcatgtaaattggggagttgctgatatcattctctcagtggtcatggctgtatcattgctcatattcttgataggaaggaagggaccaatcactagaaccatgagcaagaggctccaagaagattgggctagagctgctgaagaatgccctagggttctcatgaaccttaggactcatcttctccttgaagtggcgtctcctctctctctccctttctccattccactgtcattcatcttccaagaagcaaaggaatcctttgatgaagaagatcctaggcctacaagctccaatggagcttgcatcattgttgctgctatttccaaaagaaagcttccatatccttccgatccaactcaattgtatgaagtttccaagtctaagggaaacagggaaagatttctgcctcagaccatgaaactcaaatttcttgagaaggcagcaattcttgaaaatgaagggaacttagcagagaaacagaatccctggaaacttacaactgtgactaaagttgaagaattgaagcttaccatcaacatgttccccatttgggtattcactttaccatttggaatatgtactgcccaaaccgccactttttttatcaaacaaagtgccatcatgaacagaaagataggcaataagaggctaacaggaaatgaaagaggaatcagtatcctccaaaggattggtattgggatgttcttctcaattatcacaatgatagtggcagctttggtggaaaaaaagaggcttgaggctgttgagattaatggcccattaaagggttctttgtctacgagtgtcttttgcccaccaaatctgtttcagaaaaatgacgatctcggactcattcaccgttggatcgtcgtgaaatttgagcaccacgtgcgcaacacagtttcgagcattctccccgttgggaatttctatatcatagagaaaaaggaatcgcatgaagatagtccaaatggaggcttcaatcccttttacgtttctctgacgtttgggaactctatcagagcaatcggaggagaaactggaggaatcttagggaaccgctcgagatgctgttatcgctgtcggaagacacgtaagtccgcttatag

SEQ ID NO: 69278 - DNA, 81 bp, Glycine max
  Peptide Sequence Number=SeqID_160963
atggataaaggtgtgtcataccctaatttcgtccggggacctttgcttgatgacatgcgacctttctttggtccttgtgag

SEQ ID NO: 69279 - DNA, 702 bp, Glycine max
  Peptide Sequence Number=SeqID_160964
atggacatgaacttgggacatatcatctcatgtgagatttccttgattgcacaacattactcctctaggctaggtttccctacacttatcactgatttgtgcaaggctagaggagtcacttctgactcattgacttttgagagcctcagtccagccattaatgtggcatatgtgaagaaaaattgctggaacctcgatgatcttgctgttactttcaaaggaccatgcaaagccaaagggaagatgtctgaggctccttcatcttctgatattcctcttattctagctctttccacctctacatctccattagttccagctcctcctacaggaccatcctctatcacatcagagacattatttgctatgctgcaaagccttcataaaggccaggtggcttggccaggagtccaaccttctccttctggagggggtgaggcctccgcaacccaagagccagagccagtagaggatgatgttcctcctgagtcgtttatcatcgagactgatccagtacctcaggaggaagtagcagctcaggagccttcttctccaattcctgtctctccagctccagttattgatgattctcatccatctgcactagcattggagccagagcagcctattgttcaggatccaccagctgctccggtgttggatcttaatgagcatgcagaggatcacccacaggaggattga

SEQ ID NO: 69280 - DNA, 897 bp, Glycine max
  Peptide Sequence Number=SeqID_160965
ggttctatcccctcattagctagaatttccaagatagtccaaatctcagcgcaggaattagaccacaggaagcaagtcgaaaatggggtggttggaataccgagaaaatattcggaggcaaaagcaagaatcttggtaggtaaaggtgaatgggccccgttcatagatattctcgcactgttgatcttcggaggagtcctctttccgaatgtggatgggttggtggacctagcagcgatcaacgcttttcttacctatcataaccacaaggaaagctcggttgttgctatgctagtcgacatatatgacaccttcgaccgaagatgtgaaaaaagcaatacaaggattgtttgctgtactccagctctttatgtatggttagtttcgcacctttttcgtcaagacgaaggaagaaccggagttcttatttcatgcggaggatttccaaatgttcccttgatggggacgaggggttgcattagttacaatctcgttcttgctataaggcaacttggctaccctatgagaggggcaccactagaggaagagctcgcgcctgtcatttcacgaggtttcaataagaccaacatggagacatttcagaagttaaaagcccacgtgcaaggtttggattggcttccaagtttgagaaccgctaaaaggaaggaagttgaggcaccagaggaagatgaagaggttcaggcccttaggacagaactcgagcaagctcaaacagtcaaagaaaggttcaaatcagcagctctaaagatccgaaaggagaatgtcgaactgagagatataaaatgtgtgtcataccctaatttcgtccgaggaccatccgttgttgggatgcgaccctcgtttgaccacttcgaggtatttggcacccatcgttag

SEQ ID NO: 69281 - DNA, 387 bp, Glycine max
  Peptide Sequence Number=SeqID_160966
atggaactcattgaaaatatggctgcaagtgacattactattttgagagatagagcccacattccaacaaaaagaagcctactagagctttcatcacaagatgcattgttggcacaaaacaagttgatgtccaagcaattggaagcattgaccaaaacactaagtaagtttccagctcaattacattctgcacaatctttaccatctactattttgcaggtggatttcccgaattccagcatggacagtaatacaaccaacaacagggacaatggaggaaccaccctgggaattaattcaatagagaccagggtggaccgtccacaaggccgtaacaacaagggcctagtctctatgagcgtacaacgaagttggaagagactctag

SEQ ID NO: 69282 - DNA, 225 bp, Glycine max
  Peptide Sequence Number=SeqID_160967
atggcggaatccacccattctaagtccaatatggactgcatagaggacaccattgccaaacttaccaccactcagcttcacctcactgctacccagaactccatgtccatgaagctcgacgatctactgcagaaaatggctagctcaaaactagtcggccttcaccaacatcatccatggcttctccccacacggtcataccaccttacaacccgcatcgaatga

SEQ ID NO: 69283 - DNA, 294 bp, Glycine max
  Peptide Sequence Number=SeqID_160968
atgttcctccagaaggcgattgcttctggaggaagcaacctagctcgcttgggcgagctgggtggcaagctcctcccctattttcctataaatagggggaggagtgaaggagaaaaaggttcaaccctcttgctgaggcgcttccgtaacgattccgtgggtgatttcgcgaagattttcaatcgttcttcgacgttcttcgttcattcttcgtcgttcttcggtcttcaaccgacgtgtgaggtgctaataccttccccgcgcgtaaatacaactcctgaacctttcacttaa

SEQ ID NO: 69284 - DNA, 408 bp, Glycine max
  Peptide Sequence Number=SeqID_160969
atggctacaccatcgaactcccctcctcttgcatcagcaccttcaccctctatgtcgaaaaggactagaaaagccacatggctcaaatcattgtctgccagacccgtgggggtggaaagaccactgccagatgtagtcctagatgcaatctcaaggaatcgtacccctgttgagcctaaggtagctccttctagtacccatgttagcacaaagggaagttgtgttgatccctcgggaatttatgaggggtcaacaatcgtgcaccatatccctttgggcaatgatctggtgaaggtaggtgttgaggaagttcaagatgttgatgctcgcagtcctatacccactgaagaggcggttagtcctttgaatctttgtaaaggggaaacaaaagatatcttaggcggttag

SEQ ID NO: 69285 - DNA, 165 bp, Glycine max
  Peptide Sequence Number=SeqID_160970
atgaagaagatcctaggcctacaagctccaatggagcttacatcatggctacattacatgcggtggtcgaggttgtcggcgagaagaacacgcaacgaagagtggtgtggtgggtggtggagtgccaaggaaggaggaagggtggtgaaagggaaggatgaatag

SEQ ID NO: 69286 - DNA, 615 bp, Glycine max
  Peptide Sequence Number=SeqID_160971
atgggtaaaggaatcaccacgagaggtgtgcctaggagcttgcttgaattaagccatgttcaaaccagaggctatgagtgtggctattatgtcatgcattggatgtggaacatagtcagcgagggtttgaagaatgaacgacgcatgtggtttggtgatggaacaacattagacatggagcacaaaaatggagtcatcaagcactttgtctactttagtaaaagcatcaaggcaggaatgattttttcagttgtagcaacttgctacaagtgcaaccttaaggagttacgccttcaccttcaggagaagttgaatgttttagggggtggggggaaaatcagtataccttgtcttggtcgactcttggaggaagatcttaaagttgaaaaatttactctagatcccaataagaagtttgtaagtcaacaacttcatgagactgataaggaagagagtgattgggaagatgaagttaaacctaggaaaaatatttttccaaaaggcaacgtgaagaattttgtccaacccaaaaaccataaaggaggggagactgatctatccaataagaaaagggtcaaatatgctaaagcagcttcagaagacaagagggattga

SEQ ID NO: 69287 - DNA, 159 bp, Glycine max
  Peptide Sequence Number=SeqID_160972
atgtcagtgaaaaacctcgtcggacgcctaggagtacatgacaagacaaaccacacaataataagtcaagtcactctcactaggcttaaaggagcactcaaaccgtgtgaaccccaaggcttacactccgaagagtccgtcagggcctctccctcctga

SEQ ID NO: 69288 - DNA, 231 bp, Glycine max
  Peptide Sequence Number=SeqID_160973
atgacagcggaatggagaaggaagagagagaggagatgccacttcaaggagaagatgagtctagaagaagttcaccactataggaggccatggataagagcttggaggaagaaggagatgaatgaagggagaggaagagaagagcgcgaaattttgtgctctaaaagaactctgaaatctgaacctactaatataagatcaagtccaagattctccactaagtctgcttag

SEQ ID NO: 69289 - DNA, 351 bp, Glycine max
  Peptide Sequence Number=SeqID_160974
atgggccaacagcaaaggccaccagtgaaagaggcccatccatgtcacatcaacaagagtttcgtgaatgcgggctggagatccaacgatgagtccggtgaaggtactaacaccgaggaccctgacatcgattttgaacgaatagcaagccaagttgaggatggagaagatgaagatatagggttttccctggagctagaaaggatggtctctcaggaaaaccgagagatgaagtcgcaccaagaagaaatggaaatcgtaaacttgggtgtttgcgaggaaaggaaagaggtaaaggttgatacgagcatgaccacatgggtccgagatgaattggtggttttgctatga

SEQ ID NO: 69290 - DNA, 387 bp, Glycine max
  Peptide Sequence Number=SeqID_160975
atgcagcaacagcagcagcaatcacaacaaagacaacaagcaactgaggctcctcctcaaccttccttagaagagttagtgaggcaaatgaccatccagaatatgcaatttcagcaagagataagagcctccattcagagtctgacaaatcagatggggcagatggctactccgatgaatcaagctcagtcccaaaattctgacaaattgccttcacaaactgtgcagaattcgaaaaatgtgagtaccatcaccttgaggtttggcaaccaaattcaagagcccccaacaatagtagcacctacacctgaaaacgaggatgagatagttgcacaaaagagaaagcttcataaccaaaaattttcatgcaggtggaccttcttctag

SEQ ID NO: 69291 - DNA, 321 bp, Glycine max
  Peptide Sequence Number=SeqID_160976
atgggccccgacgggtgcaaaaaaatgcgagggactggaaccagagaagtggcacgcaaaccgaggcagaattttagcattcaaaagaagctcttctcctcaccttctcacgttgcttttctcttcttcttcctctccattgaagcctccattaaagctccaaactttgctcaccatttctactccaaattgcaaaaggaagccattttcggagtcttgaagcgcacctctacattgtgggacttcgaatttcaggtttcggtagacttcttctcacatgaatttcgtggatattgggtttttgggagatatgatgggtag

SEQ ID NO: 69292 - DNA, 399 bp, Glycine max
  Peptide Sequence Number=SeqID_160977
atgtcttgcctagcgatcacaactccgacctccctctgcctaagtgccagttggtgtatggcgcctactaggcaccctttggacccaaataagtccaacagggccctggggtttccagcgctgatcacgggcctctgccagtcctacggagttcccgtcccccccagtaaagtaattcgaccgtcgatcacccgagccttcatggagaactactgcacgcctaggcaggtgcagggtgatgcacatcaggccgcagacgcaccgccaccacctcagcaggccgatccagctgggtcactgggcgtggagcgttatctacaacatttggttcgccagcaggcggctaaccattgtggacaggtgcagatacatgagtatctctaccggatgaagatatga

SEQ ID NO: 69293 - DNA, 189 bp, Glycine max
  Peptide Sequence Number=SeqID_160978
atgacagttgtcgcaacctacccttcggcgaaagggcgacacggggctcacgggtgcgtcttccaagggaggaaggcgcgtggagtcgccaccaacatttattcgaggaaaacgtcggaaaaaccggaaagggtgttttcctcgctcctacgtatcctcaattgcaatgaggaaatcagacctacgtag

SEQ ID NO: 69294 - DNA, 1085 bp, Glycine max
  Peptide Sequence Number=SeqID_160979
aaacgctggtgaaagtaaaagatgctgaagatcagttgggtgcacgagtgggttacatcgaactggatctcaacagcggtaagatccttgagagttggcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagtga

SEQ ID NO: 69295 - DNA, 261 bp, Glycine max
  Peptide Sequence Number=SeqID_160980
atggggaaatggctccgaagaaactctccccaaagaggtctagaagagacgccacaagagaagggtccagtgccgcccccgagtttgatagtcatcgtttcgtggttttggaggaaggccagcaatgtgagttcagctagaggaggaacagggccgacgggttcgatgaggaagccattgcccagctattgtgcacacaggggctggatttcgcccggaccgttgcagggaggcgagtgcggatcatgcgcaccagcatga

SEQ ID NO: 69296 - DNA, 155 bp, Glycine max
  Peptide Sequence Number=SeqID_160981
atgcatgtgcctctgaaccctaacctgaataacctaacctgttgctttcatatatgtctcatcatgaacagggagcatctcgccgttagcattggcgagattgccctagcctacgtggagcatctcgctcctgctcctagcgggactgctgctac

SEQ ID NO: 69297 - DNA, 258 bp, Glycine max
  Peptide Sequence Number=SeqID_160982
gcagccaactaccgggggcaggtgcagatacatgagtgtcactaccggttcagtctcagtcagcaggagcagggtttcgctccttttgcatgccatactccagagcagtttggggctgaggtcgcatggcccagagattggcacgaggctcaggcaggggaggagcccgcaggattccccggtgaggcagaggaggcccgtatggatgaagaaatgacggacttgcttggtttcttgggagaaagcggagccatgtga

SEQ ID NO: 69298 - DNA, 153 bp, Glycine max
  Peptide Sequence Number=SeqID_160983
atgactcagtgtgtgtgtctttgtgtgtgggtctctgtgtgtgtctgtggctcaggtagcaaaggatcattaaattgtaaacatcatcagccacatgatgagggaagcagtatcaaatcaatgctttacaagctttttggtggggagcaataa

SEQ ID NO: 69299 - DNA, 326 bp, Glycine max
  Peptide Sequence Number=SeqID_160984
atgaaggaacttctacctcaaatggaagcacaacctctatcccgtataccaaagagaatggggttgccccagttgaagtgtgtaccaagcctcaactgccccattaatcttgggcctataaggcgtagaattatggtgttggatcttgaaatcctcacacatttccttcatcattttattgttcagattggtggcattatcagtgataatcttcctggagggtacatctacttggatttgactgagaacaagagagggtgcatctcttgtggatcagttctagtggagggtacatccactaggttgttcaaagagaacaagggagg

SEQ ID NO: 69300 - DNA, 174 bp, Glycine max
  Peptide Sequence Number=SeqID_160985
atggacgaaagttcaagatcatcacaggcaccatcacacggtacaaaaattgcaaagaaatatcctaagtgtgtccacatgaaactctcacttaggaaaactaggcagcaagtgtcgaggtcaccttatcgtgcacaggcaactccccccccccccccgtggggatcaacctga

SEQ ID NO: 69301 - DNA, 459 bp, Glycine max
  Peptide Sequence Number=SeqID_160986
atgccctcccagtttccaactaggaaattggcgggtggaggaacacccagatattcgacgacgaggtctagaagggacgccactggagaaggctccagtaccgcctcagaatttgatagtcaccggttccagaatgccaagcaccagcagcgcttcgaggccatcaagggatggtcattccacagggagagacgtgtccagctcagggaagacgcgtaccctgacttccagggagagatagatcccaggcattgggcacggctagtgacccctatggctaagtttgacccggagatagtcatagaattttatgtcaatgcctggcccactgaggagggggttcaggacatgcgctcatgggtgaggggtcactggatcccctttgatgcagatgctatcagccagttcttgggtgacccgctgattttggaggaagaccagcagtgtgaattcagctag

SEQ ID NO: 69302 - DNA, 1105 bp, Glycine max
  Peptide Sequence Number=SeqID_160987
tcaagatcaagagcctaggagtcgccagtctgaaagagttaggacagttgatgggtcagctccagcgacaagccttttgcaaagcttatggtaagatctgggacctaaccatggtagtggtctccatggaggccattgcctccctcacccaatattatgaccagcctttgaggtgcttcacctttggggacttccagttaacacccacggtggaagagtttgaagagatcctgggatgccctttgggaggaaggaaaccatatctcttctcgggattctatctctccttagctagaatttctaaaatagttaaaatctcgacacatgaattggaccgtgggaagcaagtcaaaaatggggtggttggggtaccaaggaaatgtttggaagcaaaggcgagagtcttggcaagtcaagatgaatgggccccgttcatggacatcctagcacttttgatcttcgaggtggtcttctttccaaatgtggatgggttggtggaccgggcagcgattgatgcttttcttgccttttatgaccgcaaggaaagcccgattgtcgctatcttagccgatctatatgacacattcgaccgaagatgtgagaagaacaatgcaaggatcatttgttgtacaccggctctctacgaaggaagaaccgggattcttattttgtgcgggaaattcccaaatgttcccttgatggggatgaggggggcaccatcagaggaaggcctcacaccttttattacacgagatttcaatagcaccaacgcggggatgcttcagagggtccacaaggcatgggaaatgtcgcaaaggaaggacaaggaacttaggggaagtagcaacgggcccatcggcggttactataggtggttgaaagcctacgcacaagatctgaatgccgaactgagagacgtcaatatagccaccaccaaggccttggagcaagagaccaagagggcccgtagggaagaacatggccgaaacaaatttcgaggggctctgtggggcaataacagcgagcttaagctacaaagagaagaaagggaccagtcgcgagtagttggtttgattctgaatgatgaattgaagacttgcctaag

SEQ ID NO: 69303 - DNA, 273 bp, Glycine max
  Peptide Sequence Number=SeqID_160988
atgcaccaaagacccagggtcagcatcagaggctcctcttcctccccatcccccttctccgccttcttcccagggatcgcgtcctccacttgcatccacctcagcacccctggacttgcatggttagatgctgagatccattcatatgggacaacaactcattatggagaacatgcacaggctgtccctgcacctgcagatggatccaccgctcatcactctagaggcttatcgtcagcaggtcgcctggccaggagaccaaccctccattga

SEQ ID NO: 69304 - DNA, 159 bp, Glycine max
  Peptide Sequence Number=SeqID_160989
atgaccaaagtgaacaaagagccatttctaggagttttctgcctttgccctgttttcttggctgtgatagtgtcataccctaatttcgtccagggacctttgcttgatgacatgcgacctttctttggtccttgtgaggtgcttggcacccatcattag

SEQ ID NO: 69305 - DNA, 838 bp, Glycine max
  Peptide Sequence Number=SeqID_160990
taccctcaccttcagagggctacacgccctcaccttcagagggctacacgccctaacctttagaggactacacgtcctagtcatcagagggctgcacgccctctccatcagaggactacacgtcctcgtcatcagagggttgcacgccctcaccctcagaggactacacgtcctcgccttcagagggctacacaccctccccttcagaggactacacgtcctcgccttgaggactacacgtcctcaccttcaaagggctacacgccctcaccttcagaggactaatcgtccttgccttgaggactacaagtccttaccttcagaggactacacatccttaccttcagaggactacacgtccttaccttcagaggactacacgtcctcaccttcagagggctacacgccctcgccttctgaggactacacaaagctacacgctgtcaccttcggagcactacacgtcctcaccttcagagggctacacgccctcgccttcagaggactacacatccttgccttcagaggactacacgtcctcgccttcagagggctacacgtcctcgctttcataggactatacgtcctcgccttcagaggactacacatcctcgacataacagggctacacgccctcacctttagaaggctgcacgtcctcacctttagagggttgcacgccctcacctttagagggctctgcgccctcaccttcaaaggactacatgcactcgccatcagagggctgcaagccctcacctttagaggactacacgtcctcgccattagagggttgcacacccttgccttcagagggctacaagtcctcgccatttga

SEQ ID NO: 69306 - DNA, 399 bp, Glycine max
  Peptide Sequence Number=SeqID_160991
atggagtgcctagagggtgtttgggagaccctcgaaggcaatgagaggtgccgattccgtggcacaattcgactcactgctacttcgctggtacatccggagcaacccgcacgcacacttcaacagcctgtggagtgggtactacctacacctactccatatcgactagttgagtcggttaaagtgatagaggtgtcatcctctgaagaggatcttgaagaggacccagaggagttacctcttgcacctactatggatgcccctgacttaccagaggatgatgaggacccactccttgatgttgattctccagaggatattatgtcagcatctgaggcagactccatagaggagagcggccttggagggacagcgaatagtgacgactcttcatcatag

SEQ ID NO: 69307 - DNA, 796 bp, Glycine max
  Peptide Sequence Number=SeqID_160992
atgggccctgctttccagcaggtatacagtctgctgccgacattattgcactatcaccatccgctgatgcctgggtaccttgacggtaacgttcccagaggcatatgtcttttcacgcctgatgaaacccaacagcattatctgaacgagctggaactctaccgcggcatgccgccgcaggaatcaccgacaggtgaattgccgattaccggcgtttacacgatggggagtacctcatcggtagggcaaagctgttcttcagacctggatatctgggtctgccatcaatcctggctcgataacgaagagcggcagctgctgcagcgtaaatgcagcctgctggagagctgggccgcgtcgcttggcgtagaagtgagcttcttcctgattgatgaaaaccgtttccgccataacgaaagcggcagtctgggtggtgaagactgcggctcgactcagcacatcttattgctggatgaattttatcgtactgctgtgcgtctggccgggaagcgtattctgtggaatatggtgccgtgcgatgaagaagagaattatgacgactacgtcatgtcgctttattcgcagggcgttctgacgccaaacgagtggctggatctgggcggccttagctccctgtccgcagaagagtacttcggcgctagcctctggcagctctataagagcattgattcaccgtacaaagcggtgttgaaaacgctgttgcttgaagcttactcctgggaataccccacgccacgtctgctggcgaaagatatcaagcagcgcctgcacgatg

SEQ ID NO: 69308 - DNA, 318 bp, Glycine max
  Peptide Sequence Number=SeqID_160993
atggctgaagtaaatgaggtgcaagagcggatgaaggccgacatggaggccatgaaagaacaaatggtcacaatgctggaggccatgatgagcatgaagaagataatggaggtcaatgcggctgcacagggctacacgttttttccttcagagggttgcacaccctcgacttcagaggacttcacgcccttaccttcagaggactgcacatcctcaccttcagagggctacacgccttcgcctttagaggactacacgtcctcgccttcagaggactacacgtccttaccttcagagggctacacatcctcgccttga

SEQ ID NO: 69309 - DNA, 456 bp, Glycine max
  Peptide Sequence Number=SeqID_160994
atggtcattctgcaccttttgtcatccataggcggcgagcccgatgacatgcggagacaaattatggtaatccgcacaccttttcgccatccagatacgatcgagtccaatggcacgcagacacaaattatggttattctgcaccttttgtcatccagaggcggcgagcccgatgacatgcggagacaacttatggtaatccgcacaccgttttgccatccagagacgatcgagtccggtggcacgcagagacaaattatggtcattctgcaccttttgtcatcaagaggcggcgaggccgatgacatgcggagacaaattattgtcatccgcacaccttttgctatccagagacgatcgagtccggtggcacgcagagacaaattatggtcattctgcaccttttgtcatccagaggcggcgagcccgatgacatgcggagacaaattatggtaa

SEQ ID NO: 69310 - DNA, 518 bp, Glycine max
  Peptide Sequence Number=SeqID_160995
atggccccgaggaagcttgcctcaaagaggtccaggaaggataaagcggccaaaggaaccagttccgctcctgagtatgacagccaccgctttaggagcgctgaacaccagcagcgcttcgaggccatcaaggggtggtcatttctccgggagcgacgcgtccagctcagggacgatgagtatgccgatttccaggaggagatagttcgccggcggtgggcatcactggttacccccatggccaagttcgacccagacatagtcctcgaattttatgccaatacttggcctacggaggagggcgtgcgagatatgagatgctgggtgaggggtcagtggatcccgttcgatgcggatgctatcagccagttcctaggatatcctttagtgctggaagagggccaggagtgtaagtatggccagaggaggaaccggtccgatggttttgatgaggaggccatcgcccaattgctgtgtataccgggcaggattttgcccggactgctgcagggaggcga

SEQ ID NO: 69311 - DNA, 1249 bp, Glycine max
  Peptide Sequence Number=SeqID_160996
atgggatcgagtcaaataccttggcttaaaaaaaggttctatcaggtcaagatcaagagcctaggaatctctagtctgaaagagttaggacagttgatgggtcaactccaacgacaagccttccgcaaaacctatggtaagatctgggacctaaccatggcggaggtttccacggaggccattgcatccctcgctcaatattatgagatcctgggatgcccactgggaggaaggaaaccgtatcttttcttaggcttctatccttccttggctagaatttccaaaataatcaaaatctcgatacaggaattggaccggggaaagcaagtcgaaaatggggtggttggagtaccaaggaaatgtttggaagcaaaggcgagagtcttggcaagtcaagacgaatgggccccgttcatggacatcctggcactcttgatcttcgggttggtcctctttccaaatgtggatgggttggtggaccggacagcgattaatgcttttctcgccttttatgaccgcaggaaaagcccggttgtcgctatcttagccgatctatatggcacattcgaccgaagatgtgagaagaacaatgcaaggatcgccaccgctcatgcaccgagaaaaaaaaaggcaaattgggaccgactcttagcaagcaaagaaggagcgtctgtcaattggttcccccgatggaaggaaggaagagccgggattcttatttcgtgtggggaaattccaaatgttcccttgatggggacgaggggttgcatcaattacaatcccgtcctcgccataaaacaacttggttatcctatgagaggggcaccatcagaggaaggcctcacaccttttattgcacgaggtttcaatagcaccaacgcgggggtgattcacagggtccgcaaggcatgccactcagtgggagtcgtcccctccacactccaccaaaagctgaagttcgtagtggaaggacatttggtcataatatcaggtgaggaagatgtcctggcagccccgcctatccgatgcggcaataatggtggcccggatgatgttggggcacagctacgagcccagaatgggtttgggcaagaacaacaacagcaggaccggcctggctataaacctacgcaagctgacatatggcaaaacatctcggaaaggaagaacaaaggccaaggtccacgatcgggacaacaagccaaagaggctccgccatgccacatcagtaggagcttcgtaagtgcgg

SEQ ID NO: 69312 - DNA, 96 bp, Glycine max
  Peptide Sequence Number=SeqID_160997
atggaagacagttataaagattttcagagaaaagtttcagttgcaaaagtaggaatcttgattccaattccacttccttttattttaaagatctag

SEQ ID NO: 69313 - DNA, 96 bp, Glycine max
  Peptide Sequence Number=SeqID_160998
atgggttggtggcggattgtgctctcgggggaaggtggtggttttggagtgtgggtttctgaggaaagattcgagaatttcaagtcatggtggtag

SEQ ID NO: 69314 - DNA, 1563 bp, Glycine max
  Peptide Sequence Number=SeqID_160999
ccagcatcatcagcttgtagcctgagaaggcatgttgcagcatcacctgttcagcaccatagatcagtggaaggaaatggctgtgctctacagcctgtatcccctgcgtgttacagtagctcagaggaagtgacatcatataaatgtgcattaacccccacaagctccgtagacttcaaaggtagaactggagagtcaagttacaatcttaaaacgtccacagaattacttaaggtactcaaccgtatttggagccttgaagaacaacaggcatcaaatatatcagtagtgaaaaccttaaaaacggaactaaatagctctcaggcacagataaaggagttactacgagagaatcaaatgaataggcaggaagtggagaacttgataaaggaaattacaattgacaaacttattaggaagaacaaagaacatggtagaattaaagctgcagttcaatcaatcagggaagagctagaagatgagaggaggttacgtcagcattcagaaagcctgcatcggaagctggctagggagctttctgaagtgaagtcttccttctctggttgtttgagaaatcttgaaagagagagaaaagcacggatccttttggagaatttgtgtgatgagtttgccaaaggaataagagactacgaacaagaggtacattcacttaggcggagttctgagaatggtcagggtcatgttaaagggaacgatagccttgataggttaatacttcatatttcagaagcttggcttgatgagcgcatgcagatgaagctagctcaatctgacagtggtctcatagagagaaattcaattgttgacaagttaggttttgatattgaaacatttcttcatgccaaacgatcggtcgatttgaaaaaatatggttactcctccccaaaggagctcaaggaaattcaaccttgtcagcattcattagattccttcccactaaaagtggctggaagtgcccctcagaatatggctcaggaagattctgttgacactgacttttttgagccaaaaagggctaatggtgaaggacttcacaatctcagctccagactgcaagcaaacatgaacaggaacatatcatatgatggtaatgagaggttttttgcggataggaaatcgagtgaagtgggagaagacaacacagctatactaaatgaagaggctaaacatgatccacaagaaagtgatagacactggatcctgagaatgaatactagtcacaagccagatatcctggttggaaacagttccttgtcatcagtaggtgataaagtttatcctgagagtattttcaaggaagattcctgtgtccagtctgcagttacagctaatggtagtcctgcaagactgtggaaatcaaagttgtctgtttcagattttaacaagtctgagttttctaccaaattgcccaaaggagtaaaggaaaacacattgatggcaaaactccttgaagcaagattagaggcacagaaatctcgctctagagcctacaaaagcacttctggatcaactagagaagcttataatgagaatatggaatag

SEQ ID NO: 69315 - DNA, 2049 bp, Glycine max
  Peptide Sequence Number=SeqID_161000
atggcctttcaggatcatatttttaaattaaataaagaaaatagctcgctaaagcagaatttggaggctacaaatgctgctctgcgtgtctccagaattgaaggttctggagcatctacaaatggcacttatacagtcaagggaagtagtgatcagtcacccaatcgacagcataagctcaacactcaacggaaaaatcggtatgctataaacaatggaaccatgtctgctttggaatctgatgctattcaaagtgaaatggaaatcaaacattcaaatttacaaagaaatcatcaggagcttgcagatttggttgatggatataccacagtagctgtccaacatgccccagaaatgcaaaagttgaggttagaactagagcaagaacgtaatcaattggcaaacattcagctaaaattccaagaggaacagagattgaacaagtctttccaggaggagcttaacatattaaagttggaaagagacaaagcatcaaaggagatgaacaaaatacatactgaattgaatgagaaagtatcagaaataaagcatcttcaacttgagttgacaagacaggaaaatgaaggaggggaggctgttgatagcttgaaaagacttatcaaaaccttagagaaggaaaacaccacacttaagatggaaaggaatgaaattgaggctgaacttgaaaatagcaggaagtctttaactgataaaatgatgtctgatgcttcacatattcagaaaaaggattctagcattcttggtgatatgccagatcactccaaaagatttccaggaaaggaagaaatggaaagatccttacagaagctcagtaaagatttaaaggaaacacagcaggacagggacaaagtggtgcaggaattgaaacgcctcaaacagcatttactggaaaaggcatctgaagaatcagataaaatggatgaagacagcaaaatcattgaagagctacatgatagcaataattatttaagggctcaagtatcacatcttgagagaactctgaagcaagcacttgcaagtcaagaggagctgaagatggaaaactatagtgaaattctcaagtctaaagaagccattaatgacctgaacaagaagctagcaaactgtatgagcactatagatgctaaaaatattgaacttttaaatctacagacagctctaggacagtactatgctgaaattgaagccaaggagcatttagaaagggagttggctcatgcaagagaagaaatagctaagctttctcaacttttgaaagaagcagatcacagagcagatgtatcaaggaatgaaaaggaagaaattttagccaagctttcacaatctgagaaggtgcaaactgaatggagaagtagagtaagcaagcttgaggatgacaatgccaaattaaggaaggttcttgagcagagtatgacacggttgaatagaatgtcggtagattcagattatcttgttgacaggcgcattgtgataaaattacttgtaacttattttcagagaaatcacagcagagaggttttggatcttatggttcgcatgctaggattctctgatgaggataagcagaggatcggaggtgctcaacaaggttcgggtaaaggtgttgttcgtggagttcttgggctgcctggccgcctggttggaggcatcttgggaggaagttcgactgatgctgctgcaaatgcgggatctgataaccagtcttttgcagatttgtgggttgattttcttctcaaggaaacagaagaaagagagaagagagaatcatcagaaaatacaggtaaagccacagcaaattcttccaataaaagtccaaataccatccctgtcactccatcattttccaatcggaggtttgatgctggaacaccatccgctcttcaaattactccaacaaatcaaaacatcagtcctccccctcgtggttattttcagcattctgaacatttagattctgagttttcaacagttcctcttacatcatctgatggtaaaactacttgttcaaacctgcatccgagatactga

SEQ ID NO: 69316 - DNA, 1071 bp, Glycine max
  Peptide Sequence Number=SeqID_161001
atggtgtgtcaatctctgaatcctgaggtcccaaatgggaatcaaaatgaggtgctgatgaaaactgttgaaatgcgtctcatcaacaaaatgaaggcaataatcagcaaaatggtagtttcaacaaaaaagaagcaatctgatgagcctgctgactactttctgcgagaagagattcgcaagtatgttaggatcaaacctaacagattaggaaaacaaaattttatgggggaaaatgcaagcttcaccagcataggacacacgtgctttgccatgaaggaagagctagaagaatacatggattatgatgttggtgagatctgcaacgatgactggaaactggctcaaaagcttatggttcatggctgtgatcctttacctaggagaaggtgcttttcaagatcccctaagctatacaaacaaccatttcccgtcaatgaatccttgtggaaactccctgatgatagaaatgtcagatggagtcaataccagtgcaagaactttgcttgtcttgctggcaatgccactcgtaagggattcttcaagggtgttgattgcttcaacctcaccaatcatgagatgccaagatggaccgcacagcagattttccttataggattggacttaagtgttggaactgggatttttgctgctaggatgagggaattcaatgtgactatagtttcagccaatatcaattttggagcacccttcaatgaaatgattgctctaagaggacttgttcctctctacttgactataaaccaaaggcttccattttttgacaacaccctagatttgattcacacaacaaggtttcttgatgggtggattgatcttgtgctccttgagtttatattgtatgattgggatagagttctgaggccagggggattgctttggattgacagctttttctgcttgaaggtagatttgtatgattacttgcaggccttcaaaatgctgaggtataagaagcacaaatgggtggttgttccaaagcttgataaggatgagcaggaaatgttcttctctgctgttttagagaagcctcataggccattcaggtga

SEQ ID NO: 69317 - DNA, 204 bp, Glycine max
  Peptide Sequence Number=SeqID_161002
atgaatgcttccaaggtttctagatttctgagaaagggcacaatccaagaattctctgaaccattggaagccagctctccaagggactccaaaggtaatactttcagctctggaaagtggaaagtctccttgaaggaaccacgaaggatcacaagcttctctaaattgggtacccgttgcagaaatacattggactcaatatga

SEQ ID NO: 69318 - DNA, 1134 bp, Glycine max
  Peptide Sequence Number=SeqID_161003
atggcttcggagaatgtgaagaccggggattccgccgtcaccaccatcgtcaatctcgccgaggaggccaagctcgccagagaaggcgtcgtcaaagctcccagctacgccctcgccagcatctgcaagtcgctcgtcgccggtggcgtcgccggaggagttgtttgcggtttggatcgccagggaacagtggagattgaagcttttggctttttaatttcagagtggtcacgtactgcagttgctcctctggaacgattgaaaattttgctgcaggtccagaatcctcataacattaaatacaatggaacagtacaaggcctaaaatatatatggaggactgaaggatttcgtggacttttcaaagggaatggtactaattgtgctagaattgtccctaattctgctgttaagttcttcagttatgagcaagcttctaaaggtatactgcatctgtatcagcagcaaactggaaatgaggatgctcagctgactcctcttttacgtcttggagctggagcatgtgctggaataattgctatgtctgcaacttatccaatggatatggttcgaggcaggattactgtgcagactgaggcatccccatatcagtacagaggaatgttccatgctttgtctactgtgcttagggaagaaggtcctcgtgctttatataagggctggcttccttcagttattggagttattccttatgtaggtctcaactttgctgtctatgagtctctaaaagattatttaattaaatccaacccatttggtctagttgaaaattctgagttgagtgtgacaacacgcctggcttgtggtgctgctgctggaactgttggacaaactgttgcttaccctcttgacgttatccgtcgaagaatgcagatggtcggttggaaccatgctgcttctgttctaactggcgatggaagaggcaaagttccactggaatacactggaatggtcgatgcattcagaaaaactgttcagcatgagggatttggtgcattatacaagggtctggtgcccaactctgtaaaggtggtcccatcaatagcaattgcattcgtaacatatgaggtggtgaaggacattttaggagttgagatcagaatatcggactaa

SEQ ID NO: 69319 - DNA, 82 bp, Glycine max
  Peptide Sequence Number=SeqID_161004
atggcaattggatttctggtttttcaaagaggattggtagaggaacaacctttgtggctgaattatgggaagttttggaggg

SEQ ID NO: 69320 - DNA, 786 bp, Glycine max
  Peptide Sequence Number=SeqID_161005
atggaacaatttagacaaattggggaagcactagggggtttgaaatttgtgatgaacctgaaatttgaagagaagaatgggaagtggaaggttctagaacatccctttagagagatccataaaattttcggagaagaagaagcttacattaggcattgcatggaaacaaaggactggagaaacatcagggtgggatcaagaggagatgcaaaggaagagacttatcaactccaacaagtacaggaaggaatatggagacatgaatcttttccattggaaatttgggaagcagtacctcatcactcattatctgccaccgatatgatacggaatttggaaaggtcagaatcactggtagggaggctcttgccaagttcaacattggttggatctaaggactatcagagcaatttggtacacttgccaaacaccgcaacacacatcaaagagattcatggtccacggaagcgaataccgttcttgcttcatgtggcaattgatctcatgcttcagattgccaggggaatggagtatttgcattcaaagaaagtatatcatggagaactgaacccttcaagcattcttgtcaagcctagaggtacatccccagaaggttacttgcacgccaaggtaacagggtttggactaacttctgtcaaggacttgaaccagaaagggaacacaaatcagaatggaactcccccattcatctggtactctccagaagtacttgaagagcaagatcattcagggggtgcagcaaactccaagtacacagaaatctga

SEQ ID NO: 69321 - DNA, 791 bp, Glycine max
  Peptide Sequence Number=SeqID_161006
catcacctccaaacccaaagtacccattttcaaccacacccaataccaatgcttcttcttccacaccctttttcccaacatacccttctcctcctcctcctccttctccttctgcctttgcttccttccctgctaacatctcctctctcatcctcccccaaacccaaaagttcaaatcttcctccaaaaaactcctcgccgtcgccatcgccgccgtcgcctgcgccgccgcggtcgtcgccctttccgccttcgtctactgccgccgccgccgcaaaaactactccgccgacgataaaaccctcagatccgacagcagcatccgtctcttccctcgcgaagcctccaccacatccggcgccgcttcccggaaagccagaaacacgtcttctacaagctctgagtttctctaccttggcaccattgtgaactcccgcggcggcgttgatgagctctctgacccacgcgctgccgcgttgaaccctcggaaaatggactcgccagagctccagccgctgccgccgctggcgcggcagacttcgaggcttcgggaggaatcgacggcaacggtggaggacgatgaagaagagttctactcgccgagagggtcgctgaataatggaagagaaggctccgccggagctggatcgggttcccggcgagttttcgggaacgccattgccggggaaaacttggttggtcgtagcagcagtgagtcatccacttcttcttactcttcttcctcttctgcttccccggatcgctctcattccattagtctttctcctccg

SEQ ID NO: 69322 - DNA, 3087 bp, Glycine max
  Peptide Sequence Number=SeqID_161007
atgtcgatgacgacaacaacaatactgatcaatagtggcggtgtgacaacgacgacaacgataaaagtgaaactgatggtaatgatagcgatgaaaatagtagtaataatgttgacaatggtagtgaccacaatagttgtgatgaagttcacttcgttttcgcgccgccgcagcagcacactccgaggttgcagggttccaatggcggccttcgaccactttgggaacatgtacgacgttgcattcaaaccccgcttgcttcaaaccctcatcagagaccacctcccggacgagaaacgccctttttcgaacccttcagaactctccaaggtcgtttcgttgatcaaaacgcactctcttctctccgagtctttcgcagattccacgcgccccaaactcatcgaagcatggaaatccgcactcgcttcctggctcaacctcatttactccctcctttctaccaccatgccagataaatgctgggcgggtatctccctgttgggggttacttgtgaagagtgcagctctgagcgtttcctagaatcttactctgtgtggttccaaaagttgctgtcttttctacagtcaagcaaccagttagaggccagaggtagttgctaccttgttgataccaagcaagtgagcaaacaagcagttgcatatcacattcacagatcacaagtattacagccctcatgccatattgcaagggttgctgatttgcaggggttgcagtttgcggcttggaggtttgctggaggaacaatcggtgtcaatggagactggtccaaaggaatctttaagttacagaattatggtcatcatgaaagaggcaaattagagcttgcagctacctgtactaactctctgttgcaaaataggttaggtggatatcctaagatcaagaaagattcatcttcctgtgctgtgaaagttgttcagcctactttgaagatcttgaatgatgagaactcagaggcaatatggccttacccttgcatatgcaaagaggctgtttccggattcgaacccatgaccaacaggtcaccaaggcacaactttaccgctgcaccagggctcgccctcaaccacggaaaaaaagttgaatctgctattgctttaaaacttttgtctggaggatgcagtctagatatgtcaaagaaactcgcacattgcctcacactgcttccaaaatcaaaaggagatgaagaaagctggtctgtgatgatgcagaaaattttggtgttaataaatgatcaattaaatttagcctttcatggtctagaagaagaaaccctgcgtaatgaggttactaggctgttggttttgccaggaaaacatcctccaccaccattaggaggctatatattggcagaaaaagttcttaacaaggcatcaaaaacatctgagcaatcactgatgtctaatgcctctagacttatgtttggctgctgtctgttgcttaaaaattcatatcctgttaagagaattctgatggtaaatggctctttgccacaaatgtcattgccattcatgactgccaagcagcaagagaacatttgttcagaacttccagttttgcacttgagtagcttggaattgcttacggctatcataaaggccatgggcagtcaactattaccacatgctgcctatattgtacgtatcattacaaagtacttcaagacatgtaaactgccagaattaaggattaaggtctattcagtcacaaggaatttgctcataaccatgggtgttggaatggctttataccttgcacaggaagttataaacaatgcttttgctgatttaagtattattgagcataagaatagtggcatattaaatggttcaaattcaaatgcttctgctggagcactgctactgccaattcatagaaaacggaagcacagcagtacaactggttctcttcaagagcatggtgaaggtggtttgagtgtggaagttcccaagaatcgtccattgactccagtttctctgaggattgctgcacttgagacattggaatctcttattactgtggctggtgctttaaaatctgaaccatggagatcaaaagttgatagcctcttgttagtcacagcaatggactcttttaaggaaggatcagttagtgaagaaagaagtgtgtttcaacaaaaggaacctgctgcaactaccacagagttgcagcttgctgcattgcgtgctttattggtatctttactttcatttgctcgggtacgacctccatatttagcccagggtcttgaacttttccgtagagggaggcaacaaactggaactaaactagctgagttctgtgcccatgctctgttaaccttggaggtgcttatacatcctagggcacttccaatggtagattatgcctatgcaaataacagttcctttggtgaagctcatagtaatctccaacatggatattttggttggagccacaatacgccatatggcttaccgcaagttcctcctgactatgatgatgatctgtgtgcaagatggcttgaaaatgacaatgaagttggtgaatcattggataaaaatacaaaatacacccaggagccttctgaagcttgcagagctagtgatcctgaagtgcttttcgtgcatgtatcttccgacaccaatatacaggagaggattgagatggtgtctgagactgccacttgtgcagatgttgagatgaaaactgttgaggatgaaaccaatttcaagtcagatcaaccaggagaatctgtggtgcaatttcaagaaactgtttcttgcaccacaaacatccccgtggttgaaactcgcggtgatgtagctgatgataaagtgtctgagaagattgtttcagacaactccattcctcataatgaagccagtcatatggaatcaagacatggaagctcggttaataaagacttcaaattctcttctccgagtagtagtttatggcatagaacctcaggctctaatatttttgaggaatttgcttttcaattggaacatgataaggcactggcggatgaagatgattttcctgatattgtggatggagacccagattctgatactgaataa

SEQ ID NO: 69323 - DNA, 213 bp, Glycine max
  Peptide Sequence Number=SeqID_161008
atggcgccaagtcgattcttatggttcacgttcggattcgcatccacatactttgttgttttgaagaacctcaggcgtaagtgtcacgcgctcgcttatcacatggaacgcgattttcgcattctcgaagacagactctccaaattcgaagaatcctctttttctgttccgctcccgatcgatcagggtttgcaattcgtggttgatgcataa

SEQ ID NO: 69324 - DNA, 555 bp, Glycine max
  Peptide Sequence Number=SeqID_161009
atgcatatgcaaagggtggcccaatgcacgaggttcctacctggtggggtcttgggtaagatgtatgcagtcttaccccctcatgaagatggtcacaaggcattgtatgatgaagtgcttccagcatttgatgtactggggaagaagtctttctttctgggtgaggttggaaatggtgcaaaaatgaaacttgttgttaacatgataatgggcagtatgatgaatgctttctctgagggactcacactagctgaaagaagtggtttgaaccctggaactcttctcgatgtgctggatcttggtgccataagtaacggcatgtttaaattgaaaggacctacaatgctccaaaacagttattccccagcttttccgctgaaacaccagcagaaggacatgagattagctcttgcccttggagatgaaaatgctgtatcaatgccagtagcagctgctgcaaatgaggctttcaagaaagccagaagcatggggttgggagaccttgatttttcagcagttcatgagactttgaaagctcctgatcattcatcttga

SEQ ID NO: 69325 - DNA, 639 bp, Glycine max
  Peptide Sequence Number=SeqID_161010
atgaggctgaagtcagcatcaaggaagagattgagaccatatctaaaaggtttgaggaacttaatgtgtgtggcaaacaactcttcagtgaaacgtagtgcatcatgttctgaaccgcctcagccaacaaggatcatcccgatgttggatcaatttgcgccatttattcaaggtttcattcttgacactgtggatgtgaaagtagacagtaattgtggatatcggtcgattgccactttattaggtatgggggaagattcgtggccgttagtgcataacgaattgattaaagaatttggcagatggtcgcatgagtacatcaacctcttcggtggcacagagagatttgaacaattaaagttgtccctacttcggtggccgttagtgcataacgaattgattaaagaatttggcagatggtcgcatgagtacgtgaacctcttcggtggcacagagagatttgaacaattaaagttgtccctacttgttgatgggttttccaaggttagtgtggacaagtggatggatataacgaagatgggatatgtgattgcatcacgtttatttgaaagacattgtcctttaccgcctctagcattgttgtggtcaagcaatttttattctcaggcaaagcagtag

SEQ ID NO: 69326 - DNA, 228 bp, Glycine max
  Peptide Sequence Number=SeqID_161011
atggtggtcacagttcgaccggagagggatgattacgaaggctatgaggtgatcgcagaaaggttggagcgtgtgctcaaccttaggatggtcactgcaggaacaaagttacatgatattatgcaagattgcctcacgaccgctaggggggtgctagtgcaaatggaagtgttagggctcgacagagacgacgcacaaaccattgactattgtttttatgttttgtag

SEQ ID NO: 69327 - DNA, 414 bp, Glycine max
  Peptide Sequence Number=SeqID_161012
atgactcgacagctaatgttatccttcagccaaatgcagtcccagtttcagtcgcagatgcaatcacagggactcccactgcctcctgagcctaaggttgttccttcaactgcttgtgttagcacaaaggagagatgtgttgatccctcaaggaatgatccagccacgggtgacttagacaaatacgggttgtacatcgaagaaaatcctccctgcctggttgccctaggaagattttatgaaggatccacaactgttcacaacattcctttgctgcatgatcaagtcaaggttggtgttgaggaggttagagatgcagatgctctcattcttgtacccactgaagaggttaagttagtggggcagacacttaacaccttccttgcttggccgacacatcttgtcaaacgttaa

SEQ ID NO: 69328 - DNA, 426 bp, Glycine max
  Peptide Sequence Number=SeqID_161013
atgaagctaacagacctcaatgaaaaaggccccatcacagactgccatgcagacgcggaaaaaggaatagagggggaacacgaaaaagcattgcctcttgaggtatctatgcctcacaacaacattttgaatatcacgaatcccagcatggtctatgctgcctctggtcaacacgacttaaaagtggcatctgaggaaatgggccaacagacatgtggcccaactctttctgccacaaaggtttatgtgagaagaaaggaggtgttgaggagtaatagcaaggcccaacagtttgagaaatcaattgtggacttcaacccaacctctataactgaccctctgccttcattacacgaggactttatagagctgcaatgtgcccttttgaaggaaatgggcttgacttatggggaagatgataaccag

SEQ ID NO: 69329 - DNA, 151 bp, Glycine max
  Peptide Sequence Number=SeqID_161014
aggatccccggctcttgactttctagagggtgatgaggacccacttcctgaggtggatcctcccgaggaagtcatgtcggcatctgaggcagactctacggaggatagtggcccgggggagatggcgatcagcggaggctcttcatcctag

SEQ ID NO: 69330 - DNA, 216 bp, Glycine max
  Peptide Sequence Number=SeqID_161015
tggcgtctcctctctctcttccttctccattccgctgccattcatattccaagaagcaaaggaatccattgatgaagaagatcctaggcctacaagctccaatggagcttgtgtcaaagttggtgatgaaattgctgagaggttggagcgccatctgagtctaggggtggtcacgcctggctcatcgacacatgaggtgatcgaagaatgcctcag

SEQ ID NO: 69331 - DNA, 50 bp, Glycine max
  Peptide Sequence Number=SeqID_161016
gaatcttcttaaggaagcttctcaagaaggtgagcttagttatgagaggg

SEQ ID NO: 69332 - DNA, 145 bp, Glycine max
  Peptide Sequence Number=SeqID_161017
atgactagcaagtggattagtcctcacattcagactgtcctcttgaaacgccagccatcccgcatcaatcaagctttgtactttgtgcttgaaggccacacactactctatggaatgccccggaacaccaccgtgataggcgcag

SEQ ID NO: 69333 - DNA, 376 bp, Glycine max
  Peptide Sequence Number=SeqID_161018
atggaaaaatctgataggaaaaccttcaaagataagaaggaaaagaaagcttacatcacttgggaagataacgatatggattcatccaaagaatcagaaaatgaagttgtgaatctaagtctcatggctaaaaactatgaaagtaaagaagagataacatcttctaacaataacttatctatttcgtatgatgaacttaaagatgcattcaatgacttgcataaagaatctttcaaacttgccaaactagattatttgaagaaaaatcagtatattgatagcggatgctctaaacacatgacaggagatgcatcaaagtttactcatatttctcccaagaataatggacatgtgacttatgacgacaacaacaaag

SEQ ID NO: 69334 - DNA, 555 bp, Glycine max
  Peptide Sequence Number=SeqID_161019
atgcttcttgacccagctaggaacttgaggaattgcttaggagttggtggactaactgcagaagacaaaatgttggattacctcattacctacattctcactctgagatcaagcaatcatgctcagatgaactgggtactgctgattgaagacattatgttgaagagtgatcacttggtggattatgaatttctttatgttatacttgcctcaagattcattgactacttcattgttgatgtctctaataagattatggactttggcaaagcaactagtgagattaccaaaaggcatctcaagaagcttggaataaggtttgttgattatgaatggataatgactagagagccgacaactagaaactttaatcagctggaagaagatgctgaagctgaagctccacaagagcctgtacatcaatggagtccttttaagtcacctatgattcagaaaatggaggctatgcttcaccttcatcaagagcactcagttgaagttcatagttcgttggagaatataactacccgactggaaaacattaaactaggctga

SEQ ID NO: 69335 - DNA, 303 bp, Glycine max
  Peptide Sequence Number=SeqID_161020
atgaacaacaataaggaaaacaaactttctcaccaagcccctaggagagaagccaatcattgccaagcaagttgcaagggatgtttcatgctcaatttcactcccactgttgacaaaaatccatccatgctaatgtttatattgatgagaatcatgaaactggccaaatacaggctaaaggcccaagtggagaagaacgaaggcccaagtggagaaggacaaagccccgagtggagaagggtgaaggcccaagtggagaaggatgaaggcccagaggcagagacactatcaagactattaatt

SEQ ID NO: 69336 - DNA, 201 bp, Glycine max
  Peptide Sequence Number=SeqID_161021
atgtcgacgcggaagatgaccatttcgcttctaaatgagcatttagaggaaacactgggttcaacaaaaatagaagaaaaccactcaaagtgtatcaatctcacatggggcaaggttcatggtgagttgggaccttggctcaaggcttgtagaatggatggatatgatatatgtcagggtgttggtctggttcagggataa

SEQ ID NO: 69337 - DNA, 444 bp, Glycine max
  Peptide Sequence Number=SeqID_161022
atgccgatctccccctgcggaagtatcagttggtctgtgtcgtcccgacatagggatcgcgatcacaaggcacccagtggacccggaggagtccgacagggccttggggtttccagctctggttacgggcctctgtcagtcctacaggatgcccgtccccccagcaagggatcgcgcccacaagacatcctgtggactcggagaagtccaacagggccttggggtttccagctctggttacgggcctctgtcagtcctacagggtgcccatttcccccagcaaggtcatgccatcgtgacatagggatcgcgcccgcaagacatcccagtggacccggagaagtcaacagggtcttggggtttccagctctgattacgggcctttgtcagttctacagagtgcccgtcgcccccagcaaggtcatcaggccccctactaactaa

SEQ ID NO: 69338 - DNA, 528 bp, Glycine max
  Peptide Sequence Number=SeqID_161023
atggacgaaattgaaatccttgcccatttcctctgccctatttcccttcaactcatgagggaccttgtcacagtttgcacaggaatcacttatgatagagaaaacatagaaagatggttattttcatgcaagaacaacacatgccccgttactaagcagtgcctattagaccatggtctcactccaaaccacactctacgcaggctgatccaatcctggtgcaccctcaatgcctcacttggagttgaacgcattcctactccaaagtcaccaataggcaaaactgagattgtgaaactcctcacagaagcaaaagggttcccagagaagcaactcaagtgcctcacaaggcttcgatccgttgcctttgaaggccaaaggaacaaaacatgtttagagtctgttggagtaatagaattcttggccacaacaatgaatatatcagcaccaatattgtggggaaaagatttagtccacatgggcgtaattatttgcgagtatttcacccaccttttcactcttttctga

SEQ ID NO: 69339 - DNA, 229 bp, Glycine max
  Peptide Sequence Number=SeqID_161024
cgacaaagcaggtcgttacagaaggcacctattgatgcaatcctatcccgcaaaggcattgggtaaaagactccaagtagattgggctagagatccaagggaaggccctagggttctcatgaggcttagggaggtaagcttagctattagagagcttctcaatgaagttttctcaaagaagcttctcaaggaagttttctcaagaaagcttctcaaggaagctacctag

SEQ ID NO: 69340 - DNA, 243 bp, Glycine max
  Peptide Sequence Number=SeqID_161025
atgtttaacacccatcgtggtggaatccgtaatgttccgagatgtttcagggagaagccagccaaaaacacaaaaatgggactgtatttagcaaagtggcttaacactcatcgtggtggaatccgtaaagttttgggatgtttcagaaagaaaacaaccaaaaacacaaaagcggtggtgaacttatcaaacacggggggtgcactcaggaaacttcacccaaaacatctagaaggggggtga

SEQ ID NO: 69341 - DNA, 228 bp, Glycine max
  Peptide Sequence Number=SeqID_161026
atgtctcatgttctcctcattttcgtttttcccccttctcctctcaaaaccctatctttttcccgtataccaccaaacttgtctcagaaaaacgatgatctcaaactcattcaccgttggatcgtcgtgaaatttaagcaccaggttcgcaactcaattccgaggcttttaaccattgggaattacgagaaaatgtcgaatctaagagaaatacacttcgcatcatag

SEQ ID NO: 69342 - DNA, 318 bp, Glycine max
  Peptide Sequence Number=SeqID_161027
atgacgttaaatatatgtcataccctaatttcgtccggggacctttgcttgatgacatgcgacctttctttggtccttgtgaggtgcttggtacccatcattaggcaatttgtgaaattccaggacatgccggaaaaccaaaaaaatattgatgcacaatcccacccaggcccacttgggccctctagaatattcctccagaaggctgttgcttctggaggaagcaacctggctcgcttgggcgagctgagctcgcctgggcgagctgagctcgcctgggcgagctgggcggcaaccacctcccctattttgctataa

SEQ ID NO: 69343 - DNA, 358 bp, Glycine max
  Peptide Sequence Number=SeqID_161028
atgacgctgtacaagcgtgcatctgcttcgtataaacccccaggtaaccgggagaaacgcatgcgcattttattaattgaagacgatacgctgattggcgatggcctgaaggtcggcctgaccaaactgggtttcagcgtcgactggtttgtcagcggcgaagccggatttcaggcgctcaacgcggcgccatgggatgccgtggtgctggatctgtcgctgccgcaacgcgatgggctggacatcctgcgccagtggcgtgagcagggcgcggatgtcccggtgctgatcctcaccgcacgcgatgcgctggacgagcgcgtgcagggcctgcaactcggtgccgacgactatctgt

SEQ ID NO: 69344 - DNA, 986 bp, Glycine max
  Peptide Sequence Number=SeqID_161029
aaaagcatggcaacgcgccacctcgcggtggcgcaacttcctggataactccctatgagcaaaagcgcaaaactgggcggtactcggcagcatcaacgccgaccacatcctcaacctcgcccattttccccgtcccgggtgaaacggtgatcgggaaacagtatcaggttgcctttggcggtaaaggggccaaccaggccgtcgcggctggccgtgccggcgctgacattgcttttattgcctgcgtgggtgcagatgacatcggcgaacgtattcgccagcagctgcagcaggaccagattgataccgctccggtggaaaccgtggcgcaggaagccaccggcgtggcgatgatcttcgtgaatggcgaaggcgaaaataacattggcatctactcaggcgcgaacgcggcgctgacgccagcctgtgtggagcgccaccagcaggtaattcgttcggccgatgcgctgctgatgcagctggagtcgccgctggacagcgtgctggccgcggcccgcatcgcgcgcgccagccacacccaggtgatccttaatccggcgccggcgacccagctctctgatgagctgctggcgctgatcgacattattacgccgaatgaaaccgaagcggaaatcctcaccggcatcgccgtcaacgacgacgacgacgcggcgcgggcagcccaggcgctgcacgccaaaggcatcgataccgtattgattacgctgggccggcgcggcgtatggctcagcgagcagggccagggacaacgtattcccggcttcagcgtgcaggcggtggataccatcgctgccggtgataccttcaacggggccttcattaccgcgcggctggaaggcgtggcgatgcaggatgcggtccgttttgcccatgcggcggcagccattgccgtgacgcgcccgggcgcacagccctcagtgccatggcgcactgagattgacgcattcctgcagcaacagggttaa

SEQ ID NO: 69345 - DNA, 2458 bp, Glycine max
  Peptide Sequence Number=SeqID_161030
atgaagaaattttacttttttatattgctgttgatcaatttttttgtgttcggacaaatcaactataccattactcccggacagtttaacgaaacagatcagatcacactgacagttcctggtgatcagattgatgaatcgacctggaacgttagtaaccacgcgatttatatttgggcatggtcactggataccaactacatgaatagtcagaattgtcctacaaatgggaactggaacaattctgatgatcagaataaactgaattataattcaacgacagatacgtattcactgacttttacaccaacaactttttttggaagaacaggaatcggaagatttggttttctattaaaagacaaggcgggaacccatcaaacttctccggatatttttgtaaatgtaggagtattaaatctcaccctgacaaatccgctgccaaatagcttgacatctgtaccttcaggaggttctgtttctatatcagcaacaacaaacgtcgccgctaattttcaattaaaagctaatggagttgttgtaaattcaacatctactccttctgtttcgtactcttacacctatatggtatctgcagatgctgatatggaactcattgctacagataattccgggactaaaaatgcgaaattcataatacagattccaagaaatgtaatatctcaggctattccttcatggatacgtcaaggcattaattatcatcctaccgacaatacaaaggttggtttagcattgtatgctccccataaaaactttgtgcatgtcatcggaagttttaatagttggacagtaaatgataattacctgatgaaaagggatactacaaaccctgatttatattggattgagttagatgggattaccccgcagcagctgtatacttttcaatacagaacgaatgacctgaaaaaagtagcagatcctttttctccgcagattttgtcttcttacgacgaccaatggattccgtcatccacatatcccaatttgccaccctttcctgcgggacagaattttgaagtttctatgtttaaaacagggcagccaaattataattggcaggttaccaatttccagagaccagataaagaagatctgattgtatacgagttgctattaagagattttacacaggaaaaaaactggcaatctcttatcaataagattacctatttgaagaatttaaaaattaatgcgattgagcttcttcctattatggaatttgaaggaaatctttcatggggatacaatacctcttttcattatacattagataaggcctatgggacaccggagaaatttaaagaatttgtagatctgtgccatcaaaacgggatcgctgtgattttagatgtggcatttaaccatgctacgggaagatcaccactcgtaagattatggaatattgatcctgacggggatggatatggggatatagcaactaataatccttattttaatcaggttcccaaacattcttacaatgttttcaatgacttcaatcacacaagttcagccacgagatattatgttgaacggaccttgcagcaatggctgacggaatataaaattgatggtttccgttgggatctcaccaaaggatttacccaaaattgttccgaaaatgatgagaactgcacgaatgcttatcaacaggacagggtagatattttaaagtactatgcggataaacagtgggcaattgaccctaattcatatatgatttttgaacatttaggaacagatgcagaagaacagcaatgggccaactacagagttgctgaaggaaaaggagtgctgctttggaataaacaaacagagccttataaccagaatacaatgggatataaggaaaacagcaattttgaccggatgaatcatcagcttcacggattcaccaaaatgaatgctgtaggatatggagaaagccatgatgaagaaagacttatgtttaaaaatctagaatatggcgcgataaacggggcttatagtgtaaaaaatcttgatacggctcttgaaaggatgaaagcttttggagcgaccttctttaccataccgggaccgaaaatgatctggcaatttggagaacttggttatgaattcagtattaaccgatgtgccgacggaaccattaataatggttgcagaaccgacgaaaagccaattgcttttacattaggttacgataacaacccaaacagaaaagcggtgtatgatacatgggcgcaaattattaccattcgaaatacatatcccgtgtttaaatcaaaaacctatactgtagaatccaataacctttctaatgatccggatggattgataaccaggatatttgtttatgacaatcttcttaataacgggatgaaaaatgtagtagttctggcgaattataatacaacaacgaagaatgttattccttattttccatatacag

SEQ ID NO: 69346 - DNA, 462 bp, Glycine max
  Peptide Sequence Number=SeqID_161031
atgaaaaaaccagcacgactgttaagcgcattagccttgagcattgggatgagtctggcggcgacgccgggtgccatggccacgttgccggcacagattcagggacaagcactgccaagcctggcaccgatgctggaaaaagtgctgccggcggtggtcagcgtgcatgtcgagggcaccgacagcgggcagcagggccaggatattcccgagccgctgaagcgcttctttggccaggcgcccgggcagtctcagccacagccgtttgaaggactgggttccggcgtcatcatcgacgcagctaaaggctacattctgaccaacaatcacgtggtaaacggtgcggataaaatcagcgtgcagctgagtgatggcaacgaatatgacgcaaagctgattggtcatgacgagcaaaccgacatcgcgctgattcaggtagaaggcgcaaaaaacctcacgcag

SEQ ID NO: 69347 - DNA, 792 bp, Glycine max
  Peptide Sequence Number=SeqID_161032
atgccttttagaggcttgaaaagtgcaagaaaacgagctgcattttctggaaaacacaatgaactcgctaagcgagcatgctgcactaagcgagttcatcaatactcattgtatatgtcttccagaaaaagaaagagcattggtgcaaggcccacagctcaatatgactcaagaagattccactccttcgaggcctggaccagatacactgataatgttctgggaagaaacattttacctgagaagaaagtaaagctatatcacactgagctagatgactttaaggccgagctggagaggcgtaatttccataaacgcctaactaatttagcttatgggagcatagacctggctttggtgaaagagttctatgcaaatttatatagttctgaggaccgtccaccaaagcagtccagagtcagaggtcatttggtgaaaattgatgctgacagtctcaacaaattcctggagacacctgtgataaaacagcggaaactaaatattacgagcgtacctccagccattgcagatcgaatgcgaagcaatgcgtacacaaacccgaaggttgctgagataaaggttgaatgtggaaggaaaatagaccagattcagaaaacagaatttccaaaaaattgcaacgtgaaaaatagaaaaagggaacgtggaactctggatagcagagaaaaaccaatcacaaacaatgttagaaaaacacaaatagccaaatccagaaccaaacacggagaaagagcgtgtaaagagaaggggaaaaaagagacaggggtactttag

SEQ ID NO: 69348 - DNA, 408 bp, Glycine max
  Peptide Sequence Number=SeqID_161033
atgagcctctgtcagtcttactgggtgtctgtccccccaacaaggtcacgccatcgtgacttagggatcgcgcccgcaagacacccagtggacccggagaagtccaacatggtcctgaggtttctagctctgattacgagcctctgtcagttctacggagtgcctgtcgcccccagcaaggtcatcagacccatactaaccgagctttcatcaagatgtactgcgcccccaggcaggcgcagggcgaggcaccacagcagcctggggatggccggcagcgggcagcagacgcactgccgccacctccaaagcccctcagctcatctacaaaagctggagcgttgcctacaacccgtggtcgacctgcaggcgaccaagtccaaagccaaaggtaagcaaaagtactag

SEQ ID NO: 69349 - DNA, 330 bp, Glycine max
  Peptide Sequence Number=SeqID_161034
gccactcgatccaacaagtggtatcagagcaggtttcttgtagaaagtctaacaacttcaagattaatggcctctttagattctttgtctttcaaaagtattttcaggaacaggttattccaagatcatgatgaagaccaagtcaatttgtgtctcatgacaaaatctgatgagaataacaaagaagattctacaaggaagaaatggtacatagacagtggatgttccaagcacatggcgggtgatgtatccaaattcacaactatttctcccaagaaaagtggacatgttacatacggcgacaacaatattagtaaaatctcagaagag

SEQ ID NO: 69350 - DNA, 942 bp, Glycine max
  Peptide Sequence Number=SeqID_161035
atgataccagtctcacttgaaaagtcggatgagaatggagaactacgttcttatgcttcctggctaggaaaacatccttctgccttgggaaattttgaggaggtgatgagcattgctgaagggaaacaaattgttgtgtttttggactatgatggaacactctcaccgattgtagatgaccctgacaaggcttacatgagtgatgttatgcgtgcagctgtatgtgaagttgccaattgttttcccactgccattgttagtggaaggagcaaggataaggtatatgaatttgtgaagttagagaatgtttactatgctggaagtcatggtatggacatatcaacaccatcaggctcttcaaaatatgaagagcaggagcatcagataaaggctgttgatgaaaagggtaatcccgttgttcactgtcatccggcaatagaatttttgccaacaatccaagagatagttaaggttttgaaagaaaatacaagaagaataaagggctctatgattgaggataatacattctgtgtcactgtacactaccggtgtgtgaaaaatgaagaggaagttggtgttctcaaaaaaatggtgaagactattatgaaagcttaccccgatttttacatatcaggaggaagaaaggttatggagatacgtccaactgtaaactgggacaaaggtcgtgctcttacatatttgcttgacactcttggctttgacaacttcagcaatgttcttccaatgtaccttggggatgatagaacagatgaagatgcttttaaggttataagacacattggatgtggttttcccattgttgtttcttcaattgcaaaggagactgaggcttcatattccctgcgtgaccctgctgatgtgctgactttcttgattcgtttagcaaaacgtaagaagaacgaacttgttacagaaaattga

SEQ ID NO: 69351 - DNA, 474 bp, Glycine max
  Peptide Sequence Number=SeqID_161036
atgaactattgtttgatgtggtttggttatttcccttctcaggtgtggtcgctggttagaagatttgatcaacctcagaaatataaaccatttgttagcaggtgtatcatgcaaggggacctaggcattggaagcgttagagaagtgaatgttaaatctggccttccagccacaacaagtactgagaggttggaacaactggatgatgaggagcacattcttggaataaggatagttggaggtgaccacaggctgaggaactattcttccataatcaccgtccatccggaggtcattgatgggagacccagtacaatggtgattgaatcatttgtggtggatgtgcctgatgggaacaccagggatgaaacttgttactttgtggaggctttgatcaggtgtaacctaagctctttagctgatgtctcagagagaatggccgtgcaaggtcgaaccgatcctatcaaccattaa

SEQ ID NO: 69352 - DNA, 420 bp, Glycine max
  Peptide Sequence Number=SeqID_161037
atgtcatggtttttggagtcattgaaccgcatcacaactgaagttgcggtcgataccgcattaccgcagcatggaggttttgtagttactgcaattgttgatgtcagcacaactgcatcggaactgcaattgtggctgataccacagcgacagagttttttatgtcagtgcaactgcatcacaactgcaattgcggctgcatcaatcatatttctccacaattttccacaacagcaaggatgtcactgcaaccgcatcatgactgaaattgcggccaatactgtggcatcaagctttttggaatcactccaagactgcaattgctgcggtcactgcaactgtatcacaactgcaattgcagctgatggcagtatcgaggtttttagagtcactgcaaccgcatcccgaccgcaattgtga

SEQ ID NO: 69353 - DNA, 4188 bp, Glycine max
  Peptide Sequence Number=SeqID_161038
atgggagaacatgaggggtgggcacaggcaccaagtgggctattgccaaatggcttgttgcccaatgaagctgcctctgtgatacaggttctcgactcagagcggtggttgaaagctgagcaaaggactgcagagctgattgcctgcattcagcctaatcctccctctgaggagcgccgcaatgcggttgccgactatgtccaacggctgatcatgaaatgcttcccttgccagctgaaggtcgttgtaacttgtgaccaattacgacatcattattgtatgatgaaagtacttaataacactatcatgctgttgcaagtctttaaactgagtggtgctagatcagaaatcccagtttgtagtgagaaggtgttcacctttgggtcggtacccctcaaaacttatttgcctgatggagatattgacttaactgcattcagtaagaatcaaaatctgaaggattcatgggcacatcaagttcgtgacatgctagagaatgaggagaagaatgagaatgccgagtttcatgtcaaggaggttcagtacatccaggctgaagtgaaaattataaagtgtcttgttgagaatattgtagtagacatttcatttaaccagcttggagggttgtgcaccctttgttttcttgaggaggttgataatctgattaaccaaaatcatttattcaagcgtagcattatcctgataaaagcttggtgttactatgagagccgtatacttggtgcccaccatggacttatctcaacttatgccttagaaaccttggttctttacatttttcatgttttcaacaattcttttgccggaccgctagaggtattgtatcgatttttggagttttttagtaagtttgactgggaaaatttctgtgtaagtctttggggtccagtacctattagttcactcccagatgtgacaggtttgtcttgtgtattgattgcttttcttccttccctaacattatccacagctgaacctcctagaaaagatggtggagatttactgctcagcaagttatttctcgatgcctgtagctcagtttatgccgttttccccggtggccaagaaaatcaggggcaaccctttgtttccaagcatttcaatgttattgatcctttgcgtgtcaacaataaccttggccgtagtgtcagcaaaggtaatttctttaggatacgcagtgcctttgcgtttggggcaaaaaggctggctagattacttgattgctcagaggatgaattgttttctgaggtcaatcagttcttttttaacacttgggagagacacggaagtggggaaaggcctgatgttccaagcatcgacctacggcatttgagtttatccagtcatgaccaattacagaggtttgagaatctccggaacaataaccataaaattggtagtgcctccaatcatgaatctaatgaagaggaacatgtttcacaaagtggtctgtctcagtatagtaatttatcatcggaaaagacaactagaaatgttgtttctacagtttcgcattctcagaatcaaaagagttatggaagccaaaataattcaaggacctttgatcaagtccgtagggaaactaattctaatccaggtcctcatgtcgataaagttcagagaaatgttaaagccgataacctagtgagtgatgttcagggaaggtttctatttgccaggacatgttctagccctgagctgactgactcatatggtgacgtttcaacccaaggaaggcgtacaaaagcaacagaaagtagtaaaggccagacttcctttgcaaagttggagaatagtcgtaggaagcatgttgaacctgatgtagctgtaagaatggatgagtcatctgctaggctcatctcatctcatcaagttcttgaaaatgctgctgattcaaacagtaatcatgatgaatcaaggtcaggtgtcatgggtgaagagtttgcttctgttgtgggtgcagatggaatgcagatgatgcatcaggaggagcaggaccttttgaatatgatggcatctcccacagctcagggtttcagtggtcagactcatgttccaatgaatattgcgccaggtcacctaccatttcactttccaccttccattcttgcatcgatgggatatgctcagagaaatatgggtaacattccctttattgaggctccttggggtacaaatatgcaatttcctcaaggtttcgtcccaccattgactccatatttccctggcataggaatgacctcaagtcctcaagatttacttgaaactaacaatgaaaatttcagttctgttgagatgaacatagcagaagcagataataattactggcatgaacaggaaaggggttctgctagtgaggttgaagttgataatggaaattttgaaatgcttccagaggatagacaacagtctacttcagatagttataataactctgccccattgtctcgggtaggaagctccaacagtaacagttctgccagagttcagcagaagtttactaaagaaaaccgaggttctacaagagaagagcatgttgacaattttcattatcaagatggccgaagaaatgaggtttattttgatgatagaacagcaaattctgagttgtccagtgcacctcctttgagctcctttaagagtaggacctcttctgaaagctcatgggatggatcatcagccaaatcctcaaaatcaactagggagagaagggggaggaaaaatacttcctcaatagcatctcctgtttatgcgaagggtaagaatgtttcagaaacttcatctaatcgagtagatgatgaaaatagagagtggactcctttgtcgaccatggcatctaacatatcagaaagaagcatttggcccacatctagtacttctatgcatgttccaaggaatcaaatatctggttttgaaactgcccagacaagtggatcagattctccattacccatatctccggtgcttttaggtcctggttctcgccaaagagataattctggggttgttccatttacattttatcctactgggccacctgttccctttgttacaatgcttcctttatataattttccaactgagtcttctgacacttcaacaagcaacttcaatttggaagaaggggcagataacagtgattcaagtcagaattttgattcatctgagggatatgaacaccctggggtgtcaagtccttccaattctatgacaagggtggctattgagtcatcagagcacaagtctgacattcttaatagtgactttgttagccactggcaaaatttgcaatatggccgattttgtcaaaactcacgtcttccgccttcaatgacgtatccttcacctggtatggtgcctcctgtttatttgcagggtcgatatccttgggatggccctggaagacctatttctggtaacatgaatattttcagtcagcttatgaactacgggccacgcctggttcctgttgctcctctccaatcggtttctaatagacctgccaatatttaccaacgttatgtagatgatatgcctcgatatcgaagtgggactggaacctacttgccaaatccgaaggtttctgctcgggatcggcattccactaataccagaaggggaaattacaattatgatagaagcgaccatcatggtgatagagaaggaaattggaatacaaactcaaaattgcgaggaactgggcgtggccataatcgcaaccaaaatgagaagcccaactcaaagacagagcggctgtctagcagcgagagccgtgccgagagatcatggggttcacataggcatgacaatttcattcctcaccagaatggtccagttggttcaaattccttgcagagtaatccttccaatgtagcttatggaatgtaccctataccggccatgaacccaagcgggttctcgtcaaatggaccaacaatgccatctgttgtaatgttttatccttatgatcataatactggttatggttcaccagcagagcagcttgagtttgggactttgggaccaatggggttctcaggtgtcaatgagctgtcacaggcaaatgagggaactcaatctagtggagcacatgaagatcaaaggtttcgtggtggtcacagccaacgatcttccccagatcaaccctcctcacctcatgtctcaaggtag

SEQ ID NO: 69354 - DNA, 150 bp, Glycine max
  Peptide Sequence Number=SeqID_161039
atggagaaaattttggtggggaaaattgaggagaagaaacaagctgagcttctgacattccaagagaaattgaagagggtgaatggcttcttggcggcattattttttcttcttcctaaaattgcacttagtataacttacttctgttag

SEQ ID NO: 69355 - DNA, 324 bp, Glycine max
  Peptide Sequence Number=SeqID_161040
atgcagttacgttcaaaaggatcattttgggatgagttagactttgagttcctaggaaatctgaatggtgatcctgatacagttcatactaatctgtacacacacaagaaaaaggtaacagacccaactacagatttccgcacctattcctttctctggaatcctgcacttgttgtattctatgttgatggaagaccaataagggagttcaagaagttggagggtgtgggtgtggaatatccaaagaaccaatctatgaagctatatacaagtaaatggaacgttgatgattgggcaaaggagaggagggctagtgaagactga

SEQ ID NO: 69356 - DNA, 351 bp, Glycine max
  Peptide Sequence Number=SeqID_161041
atgtgttctgtacttcagcaggaaagtcacttctttcattatagcatgtttgcaacagcaaagcgtgcctttggtgcagcagaagggcaccttcttctggcaagctcatgtttcttggataagaggaatagtttatggtgccatgattgtgtatccaaagacaggagtaccatacccattaagtttccctatcaggagcacataattatactaggggaatattggctgcaggatctccaacaagttgagaatgccactatagcaagtggaggacctcctcctgtagcagatgcatataccattaccgatcatccaggacccaactacaactgctccactaatggtatttga

SEQ ID NO: 69357 - DNA, 675 bp, Glycine max
  Peptide Sequence Number=SeqID_161042
atgtcttgtcacattaccaaccttgcttgcctttttgaaggtggtgcacacaccgtgtctgtttttgataatcatgtgggaggtggttctgtatccccccttattgtgactggtggtaaaggtggtgatgttggacttcatgacttccgctatatagttactggaaaggctaaaaggcataagcgtgctgataacattgggcaaggctctgtctcatctttgacttgtgataaagatccgaatgtagatgggatgctttggtacattccaaaggctcactcagggagtgtaacaaaagtagttaccataccaaataccaacttgtttttaactggaagcacagatggagatgtcaaactctgggatgcccagagcacaaagttaatacatcactggtcaaagatacatgaaaagcacacctttctgcagccaagctctcgtggatttggtggtgttgttcggctgatgccgtgggctgttgtagctctgtcaaactcatggcctcttaaaaaaaaataccccagtgtcataaggctcttcactatgcgaaagtatgggagagggtcattgtatgtagccttgtccttgctgatgcaaggaggttgcttccgaattcaaacccatgaccaactggttaggcacaactttactgttattccaggactcgccctctag

SEQ ID NO: 69358 - DNA, 534 bp, Glycine max
  Peptide Sequence Number=SeqID_161043
atggttaaaaccagagaattgtgttggactttagtcaaagttttaggaagagcctctggaacagaagttagtggtgaagcggatgaagtccctcgacgacgaaggatgacatcatttgcacgtagacaacgggcagctacacctattactaaggatggtgagcatcttgatcatgcagctgatggggttcatgagcaacctcaggaacccattattgatgatgtgtgtgctgatgtccaggattttctaggcagtagtttccatcttccggtaggaaaggtcactatcaccctcgatgatgtgacatcattgctacatttacctattacaggcgccttccatacctttgatgctctccatgtagaccaagttgtggacttgttagtggagttgattgaagtcagttcacaagaagcaagagatgagacatttcaatgccatgggggcatatgttcgactatcctgattgttggatcaaggagcattttcctattgctgtttcttctattgccgtcgaagattatcatgagataa

SEQ ID NO: 69359 - DNA, 1284 bp, Glycine max
  Peptide Sequence Number=SeqID_161044
atggaagagaaactaaagatccgacccggacccgaccccttctccctttcggttcacctcaaccacatagacgcactctcccccaacaaaaccccttcccaactcttccacctaagactcctacgcgacggcgcaagagtcaaaacactaaactccttagccgcagccacaaatcaaacccgacccactaataccgggtcgggtttcagcagctccgtagtttcgggtctctcacagggaagcggcgagtacttcacgcgcctcggcgtgggaacccctccgaagtacctctacattgtcctcgacacgggaagcgacgtcgtttggctccaatgcaagccctgcaccaaatgctactcccaaaccgaccaaatctttgacccatcaaaatcgaaaaccttcgccggaatcccctgctcctcccctctctgccgccgcctcgactcaccgggatgcaatacaaaaaacaacctttgccagtaccaggtttcctacggagacggttctttcactgtcggagatttctcaatagaaactctcacgttccgacgcgccgaagtcccgcgcgtggccctcggatgcggtcacgacaacgagggacttttcgtgggcgccgcaggtttgttgggcctaggtcgcggcgggttgtcgtttcctacccagaccggaacccggttcaataacaaattctcttactgtttaacagaccgaaccgcttccgctaaaccgtcttccgttgtgttcggcgactcggctgtctctcgaaccgcccggttcactcctttggttaaaaaccctaagcttgatacgttttattatgttgagcttctcgggtttagtgttggcggcgcgccggttcgggggatttcggcttcactttttcggctcgactccaccgggaacgggggtgttataattgactcagggacttccgtcacgcgcctcacgcgccctggttatgtggcgttaagagacgcgtttcgggtcggggcttcacatttgaagcgcgcgtctgagttttcgctttttgacacgtgctatgatctttcggggctgtcggaggttaaggttccgaccgtggtactgcattttcggggtgctgacgtgtcactgccggcgtcgaattatctcattccggtggataatgacgggactttttgttttgcgttcgccggaacgatgagtgggttgtctattgttgggaacattcagcagcaagggtttcgggttgtgttcgatttggcgggttctcgggtcgggtttgccccgagagggtgcgcgtga

SEQ ID NO: 69360 - DNA, 1263 bp, Glycine max
  Peptide Sequence Number=SeqID_161045
atggcaaatagtagatcttggactcaaacatggccatgttttgtcaagctaggtgttctgaatcttgtcttggttttcaaaatcacagcattgggggatgtcagtggaagtgttacagcagaaaacacttgcaagaacacaaattatcaaagttttctccctccaccgtaccagaatatgtcccaaatgatatgcacacctgtatggcacacctatgaattgaggacagcttacaattaccctccctgtagcttcgctgagcgaagagcctctagcattaggtatttccagaatggtgatacaacaactatcatattatctgctccctacacaatagggtgggtaggaattggattttctagagatggaatgatggttggttccagtgcaatggtgggatggattaccaaacatggtcatgcaaacatgaagcaattttacctaaggggtaggaagtcatcagaagtcaaaatagacaaaggtgaactccccctcaataatatcccttcggctgtggcgactaatggagctgaaattcatatggcatttcagttgcagatgacaaccccatttcagaaacaaccaattttgttggcttttggtagcaaatatccacagaaccaccacctctccaagcatgaagacaaaacagctattgtgtttgacttctctgcaggttctacgggtcctgtatcccgtgaattgattcagatgaggacgaaccatggaattttggctataatagggtggggtctaatcctgcctgtaggggctattattgctagatatttcaggcacaaggatcccttatggttctatctccatgcaatcattcagtttgtaggattcacatttgggcttggtacagtaattcttggattacaactctattccaaaatgcaagtccatataccagctcacagaggcataggcatctttgctctggtactaagtattcttcaggtgttggcactcttcttgagaccaaacaaggattccaagattcgaaaattttggaattggtaccacagttggtttggaaggatggcacttgtatttgcagccattaacatagtgttggggatgcaagctgcgggggcaggaagtgattggaagataggctacggattcgtttttggcattatggttgttgcggctattgttcttgaaatattggcttatttgaaaagatcagagatgcgttctctacctcctaacttccaattggatcctgttggaggagctacatttccaagtaaatga

SEQ ID NO: 69361 - DNA, 405 bp, Glycine max
  Peptide Sequence Number=SeqID_161046
atggcttacatattgaacacaaatgaggaggagagggtaaagggaaagacagttgaagttggaaaagcacattttgagactgagacaacaaggttcactattttggatgcacctagtgggaaatgttatgtcttgcttaaaactgctagagcttgggacaagttgaatatgattggtggtttctttgcacaaaatgttgagcagttccaccacgaccctagcggtcctttcaggatgccaattattgacagagtcaaagacatgggagctgttgttatggggaaggttgaatctggtactgttcgtgtgggagattccttgttgctcatgccaaataaggatcaagtaaaagttgttgccatatttattgatgaggatcgtgttaaatgtgcgggagttagttaa

SEQ ID NO: 69362 - DNA, 822 bp, Glycine max
  Peptide Sequence Number=SeqID_161047
atggcagaaaacattccacttgatggaatacccgagcagttagatcaacagcagatgccaaatagcagtccaccaagaatgctatggggcaaagaaagttcaggattttacttcttgggcggtgctctaaagccaactgatgttgaaatgttgtgggttcatgtaacatgtgcttggtttcgacctcaagttgttttccaaaatcatgaggccatggaacctgccacgggaatccttaaaattcctcctaattcctttgtgaagggatgcttcaggggatcaaggctaatttcatcaaagaatatagagcttaatgaatcttcaaccactgaaaaggacatagtggagccgctgtctgcagccaggtgtcgtgtgtaccaaaggtctcctaataaggatgctgatgaatctaaagtattcacttctttcaaggaacgtcttcaccatttatgggagatggaaaaatttagagtttgctttggaaaatcgggcattcatggatggggtctctttgctcgtagagatatacaagaaggagaaatggttgttgagtatcgtggtgtgcatgtaaggcgtagtgttactgatctgagggaagaaaaataccgttcagaaggcaaagattgctattgcatgccaaactgctatgcaaggattatgagtatgggtgatcaggggagccggattgttcttattgccaagaccaatgtttctgctggtgaagaactaacgtatgattacttgtttgatccagatgagcgggatgaattgaaagttccttgcctttgcaaagcccctaattgtaggagatttatgaattag

SEQ ID NO: 69363 - DNA, 231 bp, Glycine max
  Peptide Sequence Number=SeqID_161048
atggcagtggaatggagaaggaagagagagaggagacgccacttcaaggagaagatgagtctagaagaagctcaccaccataggaggccatggataagagcttggaggaagaaggagatgaatgaagggagaggaagacaagaacatgaaattttgtgctctaaaagagctttgaaatctgaaaccactaatcctagatcaattccaagattctccactaagtgtgcttag

SEQ ID NO: 69364 - DNA, 49 bp, Glycine max
  Peptide Sequence Number=SeqID_161049
aaatggataagatatcccgacacagtgccgtgtgataccaccaagaacg

SEQ ID NO: 69365 - DNA, 120 bp, Glycine max
  Peptide Sequence Number=SeqID_161050
atggccactattcagcacctggcgattgccaacaagaagacaaggcctattatttgcatgatcaagttagaactcaatagaacttccaaggaaactaccaaggctacagaggtggctcag

SEQ ID NO: 69366 - DNA, 195 bp, Glycine max
  Peptide Sequence Number=SeqID_161051
atgccagtgtcggccgaaacacagtctcggtacagccgcacgaaaaaccctagccgacctacattgctaaaggcccaagtggagaaggacgaaggcccaagtggagaaggacaaagcccccaagtggagaaggatgaaggcccagaggcagagacactatcaagacaattaattgttgctgaaggcccaaactaa

SEQ ID NO: 69367 - DNA, 540 bp, Glycine max
  Peptide Sequence Number=SeqID_161052
atgagacccacatacagtgatatcgggtgcaaactagcccttgaagacaaagaaagagtcgcatttaggaggaggcagaggcatgaacatgttgatgcaacaaggcatgccaaaccttgcaattgttcaagtttggcctctcagcaacaaaaagcctgtgtctgttttttcatcaagctaccatgcagaatctgtcatcaagcactgaggtgtgcccggaaatgggcatgttatggatcaaagaataataggttgaaaaatccactgccatttaatttatccttttgcataacaggctgggtttgtgaattccttggcttttgcaaaatcaggagaattcttagttgctggagttggacatgtgaaaattttctcaaactgtgtcctgcttaccgttgtcctctaagttggtatgtcatggcaagggtgtgctcgagcagtaaacaggatttggggaaaatggaaggtatttgcattcctgcaagctatctctactatcagatcccaaatgaaaatgatctaggaattgtagcaatgtag

SEQ ID NO: 69368 - DNA, 240 bp, Glycine max
  Peptide Sequence Number=SeqID_161053
atggatggtcaatggattcataaacaagacattccaccaaatgcttctaatgaacgcacaccctctccaccaccacaaagggatccctcctcttcattgttgaatgatgttcttagtgagcttcaggatcttggtgccttcgccagtgaccgatttgatattatggattcacgtatcacacaacttgaggatgatatgaactttattcgtcagtgctttgatcctccggctaatccataa

SEQ ID NO: 69369 - DNA, 609 bp, Glycine max
  Peptide Sequence Number=SeqID_161054
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaaaatactttatgaaatggctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttaaatttcactaaaatagtttcattagcacccgaggtattataa

SEQ ID NO: 69370 - DNA, 765 bp, Glycine max
  Peptide Sequence Number=SeqID_161055
atggcagaatatgctgccgaaggaaaagcaccggaagttttattctgggtgggttgcgctggtagctttgacgaccgtgcaaagaaaattacgaaagctttttgcaaaatattaaataaaataggcgttgaatttggggttttgggccaggaagaaagctgtacaggagatcctgcaaaacgtgcaggaaacgagtttgttttccaaatgatggcattaacgaatattgaagtcctcaatgcctatgaagtgaagaaaattgtaacggcatgtcctcattgcttcaatacgcttaaaaatgaatatccaagcttaggtggacattttgaggtagtacatcatactcaatttcttaaaagtttaatggaggaaggcagattgaaaattgaaggtggtgccttcaaaggaaagaaaattaccttccatgatccatgttatttaggaagagcaaataatgaatacgaagcgccaagaatacttttggaaaaacttgatgctgagttggtagaaatgaaacgttgcaaaaccaacggactatgttgtggtgcaggaggagcacaaatgtttaaagaacctgaaaaaggaaataaggatattaatatagaaagaactgaagaggcattgtcttttgagcctaaagtaatagccacaggttgtcctttctgtaatacgatgatgacggatggggtgaaacatttcaataaaaatgatgaagtagccgtaaaagatattgtagagcttcttgccgaggcagaagatttataa

SEQ ID NO: 69371 - DNA, 216 bp, Glycine max
  Peptide Sequence Number=SeqID_161056
atgggggaggaggttgctgcccaacttgcccaggagagctcagctcgcccaggcgagctaggttgcttccaccagaaggcaccaccttctgttggaatcccctggaaggcccaaaccttcacggattacctaacaatgggtgttaagtacctcgaggaggtcaagcgaaggttgcatgccgccaaacaatggtccccagatgaaattacggtatga

SEQ ID NO: 69372 - DNA, 324 bp, Glycine max
  Peptide Sequence Number=SeqID_161057
atggaaagaaaagataaggagcttagggggagcaacaacggtgtcatcggcgactatcataagtggttgaaggctaggacgcaagggataacttggctcccaaagctaaaagatctaagtgggaaggaagctgaagtcctcaaagaaagcgaagaagtgcaagccttgaaaccagagcttgaaagaatgagagtggtcaaggaaaagctcaagacgacagtcactagggtcagaaaagagtttgacgaggcccagaaagaagaatggagcaggaacaagtttcgaggggctctatggggaagcaataacgagcttaagctttga

SEQ ID NO: 69373 - DNA, 336 bp, Glycine max
  Peptide Sequence Number=SeqID_161058
atgactaatctttctgaaggaagcatcgatgtggcaattgttaaagaattctatgcaaatctatatgtccctgaggacaaagaaccaaatcaagttagggttcgagggcacctaattaagttcaatgcggactccctcaacaccttcttgaagactccagtggtcttggagcaaggggagagcttaccttcttactctaggttctacaggttgaggccagaccctcaagagttggcagcccgactgtgtatccttggaaggggatttgttcttaacgccgagggattgccgtggaagctcttgaggaaggatcttacaactctagcgcagacctag

SEQ ID NO: 69374 - DNA, 757 bp, Glycine max
  Peptide Sequence Number=SeqID_161059
cctagaggtttccaatttgcaagaattggggctattaatggatcaactccaatgtcaagctttccgcaagacatatggaaagatctgggatctggctatgatagaagtctctgttgaaaccattgcgtccctcactcagtattatgatcaaccactaagatgcttcatgtttggggactttcagttagtaccaaccgtagaagagtttgaagagatcttgggatgcctgttaggaggaagaaagccatatcttttttttgggttctatccctccgtggcaagaatagccaaggtagtcaaaatctcggtgcaagaattggaccgagtaaaacaaaatagaaatggggtggtcggaataccgaggaagcacttggaggagaaagcaaagcctttggcagatcaagtgatcaatgccttccttgcttatcaccatagcaaagaatgcctggtcgttgctgttttggccgatgcctatgacacatttaaccgaagatgtgagaagagcggcacaaggattgggcatccgttaattggttcccccgatggaaggaaggaagagtcagggttttgtcctcatgataaggagcttaggggaagcagtaatcggatcgttggcggctatcacacgtggctaaaggttcggacgaaagagttagattggctctcgaagctaaaggtttcaggtgaggaagaggctgaaacccctgaggagagcaaagaggtgcaagccttgaaggccgaacaagaaagggcataa

SEQ ID NO: 69375 - DNA, 515 bp, Glycine max
  Peptide Sequence Number=SeqID_161060
atggcttgcaccaagaaaactaggcaaatgacgtctgatgtagcaaaggaaattgctgacaagattgcctcacaggattcctttgtcgcccatggacgtcaggatgtactgattgctgccattgggcgactagaacaccctggtcgtgtgcgtgctgctggagccggtgtcacaatcaagcaatactttcgaccaactccaaggacctcctgcacgtctttctccatggcccccgaagacttggagcagctgactcagatgcagtcccattttcagtcgcagatgcaatcacagggactcacactgcctcctaagcctaaggttggtcctttagatgctcatgtcagcacaaaggagagttgtgttgatccttcagggaacgatccagacacgggtgactcagacaaatgcgtgttgtacataaatgaaaatcctccccacctggttgccctaggaagagttatgagggatccacaatcgttcacaacattcctttgttgcatgatcaagtcaag

SEQ ID NO: 69376 - DNA, 189 bp, Glycine max
  Peptide Sequence Number=SeqID_161061
ctggaggaagcaacccagctcgcctgggcgagctgggcggcaacctcctcccccttttttcctataaataggctgaagggggctgttctaaggatcccggatgcccctggtgaggtttccgtaagcaaatcccatgaaggttttcctccgttattcaccattcttcatccgttcttcgttcttcaacgg

SEQ ID NO: 69377 - DNA, 357 bp, Glycine max
  Peptide Sequence Number=SeqID_161062
taccctcaccttcagagggctacacgccctcgccttcagaggactacatgtcctcaccttcagagggctacacgccctcaccttcagaggactacacgtcctcgccttcagagggctatcctccccttcagagggctacacatcctcgcctttagagggctatcctccccttcagagggctacacgtcctcatcttcagaggactacacgtcctcgccctcagagaactacacgtcctcaccttcagagggctacacgccctcgcctttagaggactacacatcctcgccttcagaggactacacctcctcgccttcaggggactacacctcctcccctttagaggactacacgtaa

SEQ ID NO: 69378 - DNA, 411 bp, Glycine max
  misc_feature (397)..(397): n is a, c, g, or t
  Peptide Sequence Number=SeqID_161063
atgactaggggcaatctaggtgatttagaaccctttgatcttgaaatagatagaacctttcatagattagttaggcatagtgtgcatcctaatcattatgtgcattttgagcattctgagtattctgttgctggtgattctgaatattctgattttgagcattcaactactaattttcataccgagaacatcgctcaacctccaccttgtgaaaggactcttagggagatggctgcacttaatttcacttatgaaagcttgtgcattcaatatcctgatgagggtgttccatatgttcccaagactggactaatacatttcctgcccaagtttcatggtcttgcaggtgaagatcctcataagcatcttaaggagttccatattgtttgttccaccnatgaagccccctga

SEQ ID NO: 69379 - DNA, 949 bp, Glycine max
  Peptide Sequence Number=SeqID_161064
ggataggtgtgacaatcagccaatactgtggcaggcctcacgtggctccgacacttcctctacatctataactcaacgacagttggctgaaatcatccataacttgaaggaagaatggaggaaagaagtagaagaagataataagaaccaacaggaagcgtggagaaggaaggtagaagaggaaaaccaacgcactttggagataattaaacaagagttgaaacaaacaatcaaattggagttatcccaaattgcatcataccactcacccccacttcaaccaccagatatacaagtattaggtgaaagggttagaatgaagggaagttgtgcagaagctgacacaaatccattaggtaaagatacttcttatgtgcacgctgataccataggcttatatgtagttgctgagcagtcaactaaactagtggcattgggaaaagtctatgacagttcttcgaccatacacaatgtcccttatgcagatgatgtggttagggtgagtgttgtcaaagtataccacggtgatgctcaggtccctttcccgacatcagaaattcaatttgtgaggcaggccgttggcactttcgtggggtggccgatacatcttgtgaaacccatatctgatgaggattcacaaaagcgtctgcccattccggttaaatctgctaaaattgacaatgtagtggctgcaattgatccattgggagaattggtaaagaaattgtttgatagttaccaaaacccaattcagttaccgtgggatgggaaaaaatttgggatacctaatgtcaaagatggctttttcatcacacacatagatgttagtgagattattttaggtgacaagtgtttgaacatatccatactacaactgtggctgatgtttatgaatgattggagtacaagcataggttatggatcattgtatggtttccttgaaccttag

SEQ ID NO: 69380 - DNA, 393 bp, Glycine max
  Peptide Sequence Number=SeqID_161065
atggatctagaccttgcattaaggattgagaaactcctttctcctacggattccaatgacataactagtgccaaagaattacttgctgaaattgaaaagcactttgcaaaatgcgataaggcggaaacaagtactctcatttcaaacttgatttccatgaagtatcaaggtaaaggaaataaatggtctcttaaagagatcatttcatactatgtgcaagaagaggaaaggttgaagcaagaaaggattgaaagtgctcatgttgtgagtaactccaaagacaagggcaaaagaaaaataactgaagagcctgagaatgaagctgctaagggtccagcacaaaagaaacaaaatcaaggtgacaactatttcttttgcagtaagcctggatag

SEQ ID NO: 69381 - DNA, 261 bp, Glycine max
  Peptide Sequence Number=SeqID_161066
atgtcttacaatacatattatattagcagcaccagtcgctcggcaaattcagtgtatgagcatggaactgattcagttataccatcagaaaatttgaaagaaattgaatcttctacagttgagctttgctggagaagacaatcagggctcactggaagtagaggaaatattcaaatcattcacatgatccttgatcacaatgaattacaacttgctatggtcatcttcaatttcaagatgattatatcagcacgttcatag

SEQ ID NO: 69382 - DNA, 414 bp, Glycine max
  Peptide Sequence Number=SeqID_161067
atggttgatacattggtgcaaatgatgctcaagtcgatcagatacattgtatttttccaaaaatacaatgcttctgtggtgctagctggtgatgggtttgacactgtgatcaaagccaatgctgcggttgacagtgtacctcgctgccagaataaggtttcaagtgctgacatattggccatggcaactagggatgtggcccttcagtacctttctaatgacacaccagtagttgcactttccactggatggttcaacaataggagcaggtgcctccacaacatcaccattagtgcaaatggcaaaacggggtggccatggtggtcgtatgtgacgaagaccatgattatcaacaacattgttgatgcctccaaggctgtctggaaaatcttaggtgtgcctcacgatcagtag

SEQ ID NO: 69383 - DNA, 291 bp, Glycine max
  Peptide Sequence Number=SeqID_161068
atgtattcgcaaatacccaaaatacttcccgcagcatcttccagattcgtctgtggttcaaagaaaactattaccctacagcgcgaccttccaaagcgcacccagtggcacatcaccatccacaatgacgtcccagcaattgcaaaaccatggttcaactttattcatgaaaataaaatgatacccggagatgaggtagtcttctactaccgttttgatgaacatgcatgggaagtgctcatcagaaaagatatcgaatgggacaacgaggagatcaacttcgacaactga

SEQ ID NO: 69384 - DNA, 1083 bp, Glycine max
  Peptide Sequence Number=SeqID_161069
atgccgatgccgatgccgatgccgaagccgaagccgatgccagaggagcagaagatggaatacttcatgcaagtcactgaagcaccgttgtccgtcgccgttcagaaattagagaaacatggaggcaatctaaataaagctcttgaagaattttatgaaaaggattcgctccaaaacccaagtcaaaatgagcaacatcgtagccaaaagggcttaacagtggcggaatttttggaagcatatcccaaaaaacatggaggcagcaatctaaataaagctcttgaagacttttatgaaaaggattcgctccaaaacccaggtcaaaatgagcaacatcgtagccaaaagggcttaacagtggcggaatttttggaagcatatcccaaaaaaaaaacactggcggaattgttggacgaaggcactgagggatctttttcgtggcagaaatgggcagcttccaaaattcctctaagtcattctcagaaaacagaggcggaattgttggacgaaggcactgagggatcttcttcgtggcagaaatgggcagttcccaaaattcttccaagtcattctcagaaaaaacaaaaagctaagtggggccagcttccaatgtcctcgtcctcaaagggccctgtcaaacaaaaagctatcgatccattaacacggccgcctaaacttccgtattctcgcataccagatgataaacgaagggagtacttagaccgactttggatggattattcgaatgcacctaatcctattcatattactcttcacataccgggtggtggttgcgttggacgtatctttgtcaaatctgacactcttgaggatgtctatgggtacttacgcttacttggattaggagaatacgcgtctgaatcctgtagacttgtgagtgcctctttccctatccacttgatttctggattgaaccttcatgttattttactatggcatgatttctgtcaacggtgcaacgaaatcccacgtcgttgttacagtattgaagatggcagctcaaccttggatgaattaggccttggcaacggtggagacttgtatctggaggagaagaaatag

SEQ ID NO: 69385 - DNA, 315 bp, Glycine max
  Peptide Sequence Number=SeqID_161070
atgccgaagccgatgcggatggaggagaagatcaaatacttcatgcaagtcactgacgcaccgtggtccgtcgccgttcggaaattacagaaacatggaggcaatctaagtaaagctcttgaagacttacataatcatattcatattactattcacatgccgggtggtggttgccttcgatgtatctttgtcaaatctgacaatcttcaggatgtctatgggtacttatggcaacttggattaggagaatacgcgtctgaatcctatagacttgtgagtgcctctttccctatccacatgatttctgtcaacggt

SEQ ID NO: 69386 - DNA, 1032 bp, Glycine max
  Peptide Sequence Number=SeqID_161071
atgttgaccctgggtaaaatcaaggatgctacagaaaagtatcctctaagcgtgcaaaatgtcaaatttggatctagattgtatgtgaacactgacattgcagagatacaacaattttgtccaagtttgtgtgtcccattttactgtggtggaataacccatgataaaggtggttctcattcccaatctagccagagtaatctggtggagaagtttttgcataatgctcgagtggttagtacagctgaaatttacaacctcagacaggattgttattgctcgactgttgagacaattgacgaaatcatcattgatgctccatggagttatgacagttgtcctaattgtaccaccacatttgatccatcgaaaggtgggtcagcttttcgttcttgccaaaacagtgtgaccgatacagtttcacggttagccatgattgttttttgcactaattatttacttacacgtttaactgtattaccaaattttgctgacactgctatggatgccaaggttggggacgatattaaggtgtttccaacctgtgttgatgaaattctgtccaaaacttgggctgtaagatttaagttccgttcacaattacgccaatcatctgtgttggatgtcagtgcagaaccccatcatattcaaacattgacagccacccttgggttgaaggaagaatcaagtaagggaaaagcaatagttgttgaacttgaaagttcgccgccaattttccatcctacgatgcttattactttacgagggatgcagcttccagaaatctatatagcaatttttggggttctgcctttgttagtgaccacaatagctatagcttacaatcatttgtctgttgcagcacatggcgtgcatatcattgatggcaaatctcaatatcttgttgttgacctgagacacaataacctgatgcctcaacatgaggttgtcttttattaccacccaaacagaggtctatggctgatcatcctgagcgaagacatcggatgggatgaaaaggagtctacctaa

SEQ ID NO: 69387 - DNA, 345 bp, Glycine max
  Peptide Sequence Number=SeqID_161072
atgccgaagccgatgccgatggaggagaagatcgaatacttcatgcaagaaagatcgaatattcatattactattcacatgccgggtggtggttgcgttcgacgtatctttgtcaaatctgacaatcttcaggttgtctatgggtacttacgcgtacttggattaggagaatacgcgtctgaatcatatagacttgtgagtgcctctttccctatccacatgatttctgtcaacggtgcaacggaatcccgacgtcgttgttacagtattgaagatcgctggtcaaccttggatgaattaggccttggcaacggtggagatttgtatctggagaagaagaaatag

SEQ ID NO: 69388 - DNA, 426 bp, Glycine max
  Peptide Sequence Number=SeqID_161073
atgacagaaactgatttagacataactatcattgatggtctgggttttgctggatgggcagttggtggactagaagtagaagctacaatgcttggccaagtacaaaatcaggttttcatttttgattccaatagcaaaagttgcaatgcttggccagatcctttcagattctcaaaagagagcccattatggcatggttcaaaattgaaaatttacacatcacaggctactgtgttcaaggagatggaagttgctgaatggttaaaatggtgcagattaactataaataatattttggcggaaaagaagatggtagttggatctggctattctgatgtattttggagagatttttattcagctattcatgcagcatactatggtcctaaaattcaatccatggagcttcttcctgatgtagtttga

SEQ ID NO: 69389 - DNA, 213 bp, Glycine max
  Peptide Sequence Number=SeqID_161074
atggcaaagctcagagattcgagcaagagtctggtcaggacctgctcgaatcgaaaagagaggagaatctttaagaaggaattcccaggttcaaagaagtatttacgaagtacaaagctaagacaagaaagaggacttcgagctattgggcaattcgaactggtgtatggacgagtcgaagtcgaggcagcaagagttctggacttagcgtaa

SEQ ID NO: 69390 - DNA, 1305 bp, Glycine max
  Peptide Sequence Number=SeqID_161075
atggctgtgattgcactgttgagtggaggcttgaatggtggatgcggttatagtgtattgcctagtgttcttaattctcaagattggaaggcaagactaaagattccaccagctgatactcgctataaaacagaggatgtaacggcaactaaaggaaatgagtttgaggattactttttgaagcgtgagctgctcatgggaatatatgagaagggttttgaaaggccttctcccatccaagaagaaagcattccgattgctcttactggtagtgacattcttgctagggctaagaacggaactggcaaaacagctgcattttgcattcctgcattggaaaaaattgaccaggataataatgttattcaaggtttgatgtcctcctctagtcctcttggcttaagcttttcacatgattctcatagcctagttgaaaggactgcatttgttatactggtcccaacccgagaattggcattgcaaacttctcaagtgtgcaaagagcttgcaaagcacttgaagattcaagttatggttacaacaggtggtaccagcctgaaagatgatataatgcgcttatatcaaccagttcatttactagttggaactccaggaagaatattagatcttgccaagaaaggtgtttgtattctgaaagattgtgctatgcttgttatggatgaggccgataagcttctgtccccagagtttcaaccttctatagagcagctgattcattgtcttcctacaacccgtcaaatcttgatgttttcagcaacatttcctgttactgtaaaggatttcaaagataggtatcttcgaaaaccttatgtcatcaaccttatggatgagctaactctgaagggtattactcaattttatgcattcgtggaagagagacagaaagtccactgcctaaatactctattttctaagctgcaaataaaccagtctatcatcttctgcaattcagtgaatcgggttgaacttcttgccaagaaaatcacggaacttggttattcatgtttctacattcatgcaaagatgttgcaggaccatcgtaacagagtgtttcatgacttccgcaatggtgcatgtcgaaatcttgtttgtactgatctttttactagaggaatagatattcaagcagttaacgttgttattaattttgattttcccaagaacgcagagacttatttgcacaggttacgtatagatgttctaaaggatgctctgctgatgacaggttggtcgttcagggaggtttgggcacctgggtttagcagtgaacttgattacctatga

SEQ ID NO: 69391 - DNA, 2472 bp, Glycine max
  Peptide Sequence Number=SeqID_161076
atggctagtggtagtttgaagaacatgttgagtgtagcaatgaatcaaggagtggtggaagcacgagccaggatcttcggccaccaattgaaccccactggcatgaaaactccacacaagcttctccgcatgaagctcttcggtgaaaaagtcgctcagtggtaccctcacgacatcaagaaagacgaccctcttgtcatggcccgtcaagaacaagatcgaagcctcgtgaagaagagcatcgcacctgcgcgtgggaaccctgacgacgaaggagaacgaggcgtgcgcgctgctaagactctcacaggtggaggagagcaaggcgccgatcgggcggtccagtgcgattccactgctggtgagcctcctggagagtggggggttccgcgcgaagaaggacgcatcgacaacgctgtacttgctgtgcatggtgaaggagaacaagatcagggcggtgaaggcggggatcatgaaggtactgggggagctgatggcggacttcgagtcgaacatggtggacaagtcggcgtacgtggtgagtgtgctggtggcggtatcggaggcgagggtggtgctggtggaggaaggaggcgtgccggtgctggtggagatcgtcgagaagagtatcaccgtgaagatgtcgccgactccggcgccgacggccacgttgaagtagtttgcgatggtggtgttttggtcgctggatttcttcctcaatgcggcttccaggtaggcgaggacttttccgacgagaatcccgcgcatgtcgtcgctgtcgatggcgagaatgcaaatcttgctgcgttggttcttgactacaaagatgcaatccatggcggcgaacccgagcctgaaccagaacccgaacctgaaccagaatcatcacgcgttccaggctcggccgccgtaccaccaccagcaacaacagccgcagtatgtgcagaggcatttgttgcagccgccgccgccgcagcagcagcagcagtggctgagaagggatgccaatgccgtcgacgaggtcgagaagaccgtgcagtccgaacccatggattcgaggtttctgattgtgtaggcaatgatgaaatggtgaaatcagtgtttgaaaattttaatggtttgtactcttgcattgtggaattcctggggatcaggactgtttcggccatgggtgttgtggttgcagcttgcatcctgcaaccttatgtcatctccagcaagtctctttcccaagattggaaagcaagactaaagattccaccagctgatactcgctataggacagaggatgtaacggcaactaaaggaaatgagtttgaggattactttttgaagcgtgagctgctcatgggaatatatgagaagggttttgaaaggccttctcccatccaagaagaaagcattccgattgctcttactggtagtgacattcttgctagggctaagaacggaactggcaaaacagctgcattttgcattcctgcattggaaaaaattgaccaggacaataatgttattcaaggttcagctggagttgcagtaacaagccgaactttcaagtttgaagggcacatcaattatttcatggttgtggactttttgaataagcatgatgattggctttacccttgctttgaattgaatgttttcaatgtatttttctgtaatgcagttgttatactggtcccaacccgagaattggcattgcagacttctcaagtgtgcaaagagcttggaaagcacttgaaaattcaagttatggttacaacaggtggtaccagcctgaaagatgatataatgcgcttatatcaaccagttcatttactagttggaactccaggaagaatattagatcttgccaagaaaggtgtttgtattctgaaagattgtgctatgcttgttatggatgaggccgataagcttctgtccccagagtttcaaccttctatagagcagctgattcattttcttcctacaactcgtcaaatcttgatgttttcagcaacatttcctgttactgtaaaggatttcaaggataggtatcttcgaaaaccttatgtcatcaaccttatggatgagctaactctgaaagtaaatcgggttgaactccttgccaagaaaatcacagaacttgggtattcatgtttctacattcatgcaaagatgttgcaagaccatcgtaacagagtgtttcatgacttccgcaatggcgcatgtcgaaatcttgtttgtactgatctttttactagaggaatagacattcaagcagtaaatgttgttattaattttgattttcccaagaatgcggagacttatttgcacagggttggtcgttcagggaggtttgggcaccttggtttagctgtgaacttgattacctatgaggatcgctttaatctgattgaacaagaacttggaactgaaataaagcagattcccccacaaattgatcaggcaatttattgccggtga

SEQ ID NO: 69392 - DNA, 1104 bp, Glycine max
  Peptide Sequence Number=SeqID_161077
atgatgagggaaagatttgcaaagcttctactgggggaagacatgtctggtggtgggaaaggtgtctgcactgcagttacagtatcaaattcaattaccaatctctatgcaactgcttttggacaaaatttaaagttggagcctctcaagcctgagaagaaggctatgtggaaaagagaaatgaattgtcttctatctgtgtgtgattacatagtagaatttgccccaactgcacaatatttagaagatggcacaattgtggagatgatgtcaagcagaccaagatcagatgtttacatcaacctcccagctttgcagaagcttgacacaatgctcatagaaatattggatagtttcaaggatactgaattttggtacgcggagcaagggagcatatcggggaattcaactcggtcacgtggaggctcatttcgaaggattgttcagaggaaagatgaaaagtggtggctgccagttccttgtgttcaccctggaggcctctctgataagtcaaggaagcacttgaatgagaaaagagactgtgctaatcaaattcataaagcagcaatggcaataaatagcagtgttcttgcagagatggatatcccagaaacatatatgtctaatcttcccaagagtggaagaacaagtcttggggacacaatttaccgctatatgtattctacagacaagttctcaccagatcaccttcttgattgtctcaaaataagttctgaacacgaagcacttgagctggcagataaggttgagtcttcgatgttcacttggaggcgaaaagcttgtctgagccattcaaaaacatcatggaacaaagttaaggatctcatggtggacacagaccgaagtgacaaaaactacatcttagctgagagagctgagactttgttgttttgcttgaagcaaagatatcctgaactttcacaaacatcattggacacatgcaagattcaatacaatcgggatgtaggaaaagcgatattagaaagctactcaagagtattagaaggcttagcattcaacattgtagcttggattgaagatgttcttcatgcagataaatcaatgaggaaccaaaatgtatag

SEQ ID NO: 69393 - DNA, 114 bp, Glycine max
  Peptide Sequence Number=SeqID_161078
atgacgagggtgaagaatgaagatgaagggaagcagacagagcatgatgaatgttctggcgctaaggttgcgcgtggtggtaaaggcaaattcagtactagtgttgtcttgtga

SEQ ID NO: 69394 - DNA, 72 bp, Glycine max
  Peptide Sequence Number=SeqID_161079
atgaagattcactggattcctccaaatgtagtcaacttagttgcactcaagtcttcaaaaccaaaatgctga

SEQ ID NO: 69395 - DNA, 300 bp, Glycine max
  Peptide Sequence Number=SeqID_161080
atgaactacgtaggtctgagtttctcatcgcattcgtggatacgtaggagcaagggtagttcctcattgcatattgaagtaaacaatgcccttgtaacggacgcgtggggtgctatcgcaacctacccttttgcaggagggcgacgcgagggctcacaggtcgacaaaaacggggctcttgctcttacgtaccctccatcgaagaggaaatcagacctatgtagttctttcaaaagggcgaatcaagcgattctttttacttggaaggtggtccttttaaggcgttggaccttaaaatga

SEQ ID NO: 69396 - DNA, 474 bp, Glycine max
  Peptide Sequence Number=SeqID_161081
atggcgggaatagccaatcatcctctttccaaatgtggatgggctggtggatctagcggcaatcgacgccttccttgcttatcacatagcaaagaaagtccggtctttgctgttttggccgatgcctatgacacatttgaccaaaggtgcgagaagaaaggtgcacgaattgtctgttgcacacccgctcttttagtattgctggtctcacacctcttttggcatgaaagtagacccgtttgtcccctgcaaggtcatcgcatgtgcgccgagaaagggaaggcaaattcggagcagctctttgcttgtatggtaggggcatccgttaattggttcacccgatggaaggaaggaagagtcagggttttgtcctcatgtgaggggttttccaacgtccccttgatgggaatgaggggttatattaattataatctcattcttgatgcaatcctaccccccaagggcattggatag

SEQ ID NO: 69397 - DNA, 694 bp, Glycine max
  Peptide Sequence Number=SeqID_161082
atgggattgagtcaagctccttcgcttaaaaagaggttttatcaagtcaagcgacaagcgtttcgcaaaggcagtaataacgagcccatcggcggctactgtaggtggttgaaagcccacatgcaagatttggattggctcccaagtttgagaaccactaaaggggtggaagttgaggctccggaggaagacgaagaggtgcaggcccttagggaagaactcgagcaagcccaatcagtcaaagaaaggttcaaatcagcagctcttaagatccgaaaggagaatgctgaactgagagacgtcaataaagctaccaccaaggccttggaacgagagaccaaaagggctcgtagggatgagctaaaggtttgcctaaggtccaagaaaagcttgtctcagcgtttatgcgagacagagaccaacatgttagccatcatcagcaggtaccaagaagaattaaatctagccacggcccacaagcacaaagtggcggaggaatatgctcgagtgtacgcgaaaaaagaggctatagggagggtgatcggctcgttacatcaagaggcaacaatatggatggaccgatttgctcttactttgaacgggagtcaagaacttccccgattgctagccagggccaaagaaatggcagacacctactccacccccgaggagatccacggactccttagctatt

SEQ ID NO: 69398 - DNA, 441 bp, Glycine max
  Peptide Sequence Number=SeqID_161083
atggtgggttacacaccttcaagttttacagatttggtcttcgccagcgaaaggatcaaagtgggtttgaaaagaggcaaatttaatcatcctgctttgaggaatgagaaaactggggcaaatgaagaggatgagaaggagggagaaacccatgctgtgattgccattcctatacgaccaagtttccctccaacccaacaatgtcattacttagccaataacaacccttctccttccccaccacccagttatccacaaaggccatccctacatcaaccacaaaacctgtctaccgcacttccaatgacgaacaccacctttagcacgaaccaaaacaccaaccaaaaaggaattttgcagcaaaaagcatgtaggattcaccccaaattccggcgtcctatgctgacttgctcctatatccactcgataatgcaatggtag

SEQ ID NO: 69399 - DNA, 363 bp, Glycine max
  Peptide Sequence Number=SeqID_161084
atgcatgtgcgtcaagatttgccgattatggttagaactagagggttaggtcatgccttaggtaggattataggcaaagccctggggagagaggatcatcatgatttagatgatgttccccaggggcaaaggcctacagcattcgtacgtaggcaacgggaagttgcccctattgctgaggatgatcctgtgttgcatgaagacgtatatgcacatgctgcagaagctattcatgatgttgagggatttccaagtgggccgcgtgacccatcagtgctaactaactatggtgaccatgttgcagtcatcgtatggaatggagaggaacgtcttgaattgaagttatcctcccatggaaggaag

SEQ ID NO: 69400 - DNA, 273 bp, Glycine max
  Peptide Sequence Number=SeqID_161085
atgggacaccttagtgatcaaggggttttcacgaaccctaagagaataaaggtcattcctgagtgtcccactccaccaagtgttgagggaagaagcctagaatttcaagaacctctagatttgaggtcaatccttttcaagaaggagggaatgatacaatcctaccccccaagggcatcggatagaagactccaagaagattgggccagagatgcaagagaaggccctagggttctcatgaaccttagggtagattttgggcccatgggctaa

SEQ ID NO: 69401 - DNA, 453 bp, Glycine max
  Peptide Sequence Number=SeqID_161086
atgccctcacctttagaggactacacgtcctcgccaacagagggctacacgccctcacctttggaggactacacgtcctcaccatcagaggactacacgtcctcaccatcagaggactacgcgccctcacatcagaggactacacgtcctcaccttcagaggactacgcgtcctcaccttagaggactgcacgtcctcaccttagaggactgcatgtcctcaccttcagaggattacataggactgcatgtcctcaccttcatagggctacacgccctcacctttagaggactacacgtccttgccaacagagggctacacgccctcacctttagaggactacacgtcctcaccatcagaggactacacgtcctcacctttagaggactgcgcgccctcacatcagaggactacacgtcctcacctttagaggactacgcgtcgtcaccttag

SEQ ID NO: 69402 - DNA, 382 bp, Glycine max
  Peptide Sequence Number=SeqID_161087
cccgggggatccactagttctagagcggccgccaccgcggtggagctccaattcgccctatagtgagtcgtattacaattcactggccgtcgttttacaacgtcgtgactgggaaaaccctggcgttacccaacttaatccccttgcagcacatccccctttcgccagctggcgtaatagcgaaaaggcccgcaccgatcgcccttcccaacagttgcgcagcctgaatggagaatgggacgcgccctgtagcggcgcattaagcgcggcgggtgtggtggttacgcggaccgtgaccgctacacttgccagcgctgatgtccggcggtgcttttgccgttactcaccaccccgtcagggtctgaacaagagggacagctga

SEQ ID NO: 69403 - DNA, 1206 bp, Glycine max
  Peptide Sequence Number=SeqID_161088
atgcgcgaaggatctgcaggccgcacgcattcgttcggcggtgctggccaccggattcgtcgccgaatggccctggctcgacgtgcagggcgcgctggatgcacacggctatccgcttggcgacttcggcgtttccccgcagccggggctgttcttcatcggcatgcacaacctgcagcggatgagttcatcgttcctgtgcaacggcggccgcgacgcacgcgacctgctgccggccatcctgcggcacctgggccgaagcgggagtaccggttccggcgcagggcaagggagccgccgggcatgacccggcggcgccagaccggcttaacggccggtcttcacctcggtccacaaccgggtgtagagcttgtcggtctccggcgtgttgatcgagtacgtgaacatcttctcggccacatcggccggcgggtagatggtcgggtcggtacggatcgcctcatccaccagcggggtcgcagtcggcaccgggttggcgtagtggatgaagttggtgttggccgcggcaaccttcggctgcagcagatagttgatgaacgcgtacgcggcgtccgggtgcttggcatccttcgggatcgccagcatgtcgaaccactgcggggcgccttccttcgggatcgaataggccacgtgcacgccgttgctggcttcctcggcgcggtcgcgggcctggatgatgtcacccgaccaaccgaccaccaggcaggttccaccgttggccagcgaacccacgtactgcgaggagtggaaattctgcacgtacgggcggatcgacttcagcaggtcggccgccttctgcagctcggccgggtcaccgctgtgcgggtccaggcccaggtaatgcagcgcgatcggaatcatgtccgccggcgtgtccaggatggtcacgccgcagtccttcatcttgctgatgttctccggcttgaacaccacgtcccagctgttggcgatgtcggtgctgccgccgaagcgctgcttcagcatgtccacgttgtagccgatgccggtggtgccgatcatgtacggcacgccgtactggttgcccgggtctgggtggcgatgcgcttcatcaccgccgggtcgaggttggccaggttcgggatcttgctcttgtccagcggcaggaacacgccggcctggatctggcggccgaagaagttcagcgtcggcaccaccacgtcgtag

SEQ ID NO: 69404 - DNA, 477 bp, Glycine max
  Peptide Sequence Number=SeqID_161089
atgactagaggcaatccatctgacttacaaccctttaatcctgagatagataggacatttcatagattcgttaggcatcattttataccttttgatcatcctgagcattccattactggtgaatctgtgcattctgttattggtgattttgaacatcctgattttgagcattacaattttgagcattctgattttgaacattctgagaacatggcacaacctccaccacgtgagaggactctaagggaaatggctgcacctgatttcacctacgaaagcttgtgcatccaataccctgatgaggatgtcccatatgttcttaaaactggattgatccatttgcttccaaagtttcatggccttgcaggtgaagacccgcacaaacatcggaaagaatttcatattgtctgctccaccatgaaacccccagatgtccaagaggatcacatatttctgaaggcttttcttcattcttag

SEQ ID NO: 69405 - DNA, 333 bp, Glycine max
  Peptide Sequence Number=SeqID_161090
ggatcgcgcccgcaagacacccagtggacccggagaagtccaatagggtcctggggttttccagatctgattatgagcctctgtcagtttacggagtgcctgtcacccccagcaaggtcatcaagccccacattaaccaagctttcatcaagaagtactgcgccccccaggcaggcgcagggcgagacaccacaacagcctagggatggccgacaacgagcaatagacgcaccgccgccacctccagagcccctcagctcatctacaaaggttggagcattgcctacgacccgtggccgaccagcaggcgaccaagtccaaagggaaaggtaa

SEQ ID NO: 69406 - DNA, 477 bp, Glycine max
  Peptide Sequence Number=SeqID_161091
atggaaggaagggagaaattggacctcattgaggagaggctaagggccatcaaagggattaatgattacccattcaccgacatggcaaagttgtgtttagtgcctgacgttgtcatccccccaaagttcaagagacgagaagctcttaatgcattttttccaagaaagcttggccggggtggcggtcacctgtatcagtacaacactgacatggctcctgacagaacccaattgcaaaatatgagcaagagggagcatgagtcctttaaggagtatcctagagatgaagggacctggcagcataagactgaggtaggcttgagaagggggaagtttgattatgcctctcccgccagcacaagcaataggagatttagagcaagtagggccaagaagaaggaaggagacacccgcgctgtaactttagctcctgcctggcctaaaccccagcaaacccctcataaccccacttactaa

SEQ ID NO: 69407 - DNA, 457 bp, Glycine max
  Peptide Sequence Number=SeqID_161092
atgataaaagcctcgagggtccgtcccatccctgaaaatgctatgaggtgttgggaaatggttgaagtagttgaattggaggatcgctatgactatagctcttggttggtccggtctattactcttcccttgcgcctatttcgccttggggggttggttcacagttcttatttggaaggctgcaacttcttaaccgctgcagtctccactcctgctaatagtttagcacactctttgttgttactgtggggtcctgaagcacagggagattttacccgttggtgtcaattaggtggtctgtggacttttgttgctctccacggcgctttcgcattaataggtttcatgttacgtcaatttgaacttgctcgatctgttcaattgcggccttataatgcaatcgcattctctggtccaattgctgtttttgtttctgtattccttatgtatccactgg

SEQ ID NO: 69408 - DNA, 213 bp, Glycine max
  Peptide Sequence Number=SeqID_161093
atggcacgcaacgtgcttgctctgtgcccctattttagggacctatatgggagagagctaaaagggattttaacgataattcccaacgttgtcatatctctcttgatggtctctagaggtatcatcccctttgaagaacgtattgcagcaatagggactactagcaacaatatgttgtcaaagagaaaaactctagatgagggttcattgtaa

SEQ ID NO: 69409 - DNA, 676 bp, Glycine max
  Peptide Sequence Number=SeqID_161094
atggacttggaaattgaagccacgttaagaaggaacagagccgaaaggagaaggaaactattgcaagagcattacaaggacaatcattatctttattccacgaataattcagggtggagacaggagttaaatccttacaatcaatatgaagaagaaagaacccctgatcttgaaagtgtattttcagaattcatggcatatcatgctagctctaaagctaattataattcactacaaaatcaggagattcattttggcaagagctattctttagaagattatcaaggggaactagagttacaactctactatcaaaatgaagcaggaagaagttccaatctggatactttgttaatgcaattcaaggatacaattggatctattgaacaagaagtgactcaagttatgagcagaagagaagaagaatttgtagaggttgaagctcaagagggaagccctgtaaatgagcatgatttagaagaagaagaggaggagaaagtgcaacaacgggagcagtgctcacaagtacacactcaacaagaaaataatctccaagttaacacatttcctcgtcaactgattgtcaaagaagaaaggcatgaagaccatgaggttccaatcattctgggacaaccctgtttgtcaattgctagttgtgtattaggcatgggtaagg

SEQ ID NO: 69410 - DNA, 276 bp, Glycine max
  Peptide Sequence Number=SeqID_161095
atgcgtagaagatgcaaaaagaaagcaagaatgcaggttgcacagatttggagcggcatgcgcttagcggttgatggatcgcttagcactactgtcgcaacgtgcccttttgcgggcgagcgaaggcgaggctcacgggtcgacaaaagcgggactcttgctcctatgtaccctccatcaaagaggaaatcagacctacgtagttcttccttatgcgtgaatcaagcgattctttttactttgaaaggtgatcacttaaaggtgttgggcctttaa

SEQ ID NO: 69411 - DNA, 580 bp, Glycine max
  Peptide Sequence Number=SeqID_161096
atgtcttccacatcaccatttccatataacctatacctcacaactagaaatggcaagaaaacccgtacccgtgggtacccgtttgaatctgttctgactttgacaggtaatacccgagttgatcgggtatgggtttgggttcaggttttccctgataaccaaaatcgggtatcgggtacgggtatggggagatgttggggagtcggagtcggggattggggagacaatacccgttcctgccctacctcattgccatgtctactcacagccacacttacccttgaagataaccaatcagttcatgtggttatggagctgtgtgctggtggtgaactttttgacaggattattgccaagggccactacagtgaaagggctactgcttcaatatgtagccaggatgataagggacttctcaaggccatagattttggcttgtcagtcttcattgaagaagttggcagtgcttactatgttgctccagaagttctacatcgtagccatgggaaggaagcaaatatatggagtgcgggagttatattgtatatcttacttagtggtgtacctccattttgggcag

SEQ ID NO: 69412 - DNA, 237 bp, Glycine max
  Peptide Sequence Number=SeqID_161097
atgaattcattgccttgcgctgttcatgtgtcctccaccaacgagtctggagccccgcgaattcattgcctagcgctgttcgacaattctccattctccacttttatccggagcgccatgaatttattgcctagcgctgttcatctatcctccaccaacgagtctggagccccgcgaatttgttgcctagcgctattcgccaattctctattctccactttttccggagccccataa

SEQ ID NO: 69413 - DNA, 435 bp, Glycine max
  Peptide Sequence Number=SeqID_161098
atgaatgtaggagctctcatctctggccagatcacatctatggcccagtctaactcctctagacttgggttccctgctcttatcacagctctatttactattagaggggctaggagagcgagggcaaggccagctgaggctccttccacatctgcagctcctcctccagcacgtaccttagcagctccttctacccatcttctgcagactttcaacctggtagcacctccaaactctatcccttctattgaacagtttaatgaatgggtagcctggcccgggactcagcctccccttcacagggaagatgaaggtctcaccgctcaggtagcagacccatccactcctaaggatcggactacaccagtcctgtctccgaacacctctcctccagctacccttgtgcttcgcttaacagatgaggaggatgtttag

SEQ ID NO: 69414 - DNA, 343 bp, Glycine max
  Peptide Sequence Number=SeqID_161099
gttgtacatcgaagaaaatcctccccgcctggttgccctaggaaaagtttatgagggatcgataaccgttcacaacatccctttgttgcatgatcaagtgaaggtcgatgttgaggaggttagagatgcagatgcacccattcctgtacccattgaagaggttaggttagtggggcagacacttaacaccttctttgcttggccgacacatctcatcaagcatttatcagaacagggagctatgggaccatcaaaacctacagataggccggatcatgaggtcgatgatcccctatatctgatgacattgaccatcccacaactttttttgaacccgttgtag

SEQ ID NO: 69415 - DNA, 1394 bp, Glycine max
  Peptide Sequence Number=SeqID_161100
atgagagggctacacgccttcgccttcagaggactacacgtccttaccttcagagggctacacgtcctcgccttcagaggactacatgtcctcgccttcgtagggctacacgccctcacctttagaggactacacgtccttgccatcagagggctacacgtccttaccttcagatggctacacgtcctcgcctttagaggactgcacgtcctcacctttagagggctacatgccctcaccttcagaggactacacgtcctcacctttagagggttgcatgtcctcgccttcagagggctgcacaccctctcctttagagggttgcacgccctcactttcagaggactacgcgtcctcaccttcagagggctacatgccctcgccttcagagggctacacgttctcaccgtcagagggctacacgcccttgcctttgtagggctatacgccctcaccttcagaggactacacgtcctcatcgtcagaggacgaaacatcctcttcttcagaggaccaaacatcgtcatctttagaggactacacgtcctcaccgttagagggctacacgccctcgcctccgagggctacataggactacatgtcctcgccttcaaaggacaacacgtcgtcgcatttgccttcgtagggctagacgccctcacctttagaggactacacgtcttcgcctttagaggactacacatcctcaccttcagagggctacgtgtcgtcatcttcaaaggactacacgtcttcaccttcggaggagtatacatccttaccttcagtggactgcacgccttcaccttcaaagggcgacacgtcctcaactttagagggctacgcgtccttactttcagtgggctccatatccacgccttaaatagtttccctttatcagttctttttcctgggccaccccttgatattggaggagggccaactatgcaagtacaaccaaaggaggaggctatcgcgcaactactgtgcatatcggggcaagatttcacccgtgccactgcaaagagacgagtgcggatcatgcacaccaacatgatcactcttacacaaatatggatgacgttgctacttagcaacatttcgtctagtgaccgcaataccgatctccccttgcggaagtatcagggtcgcgcccataagacacccagtggacccagagaagtccaacagggccctggggttttcagctctggttacgggcctctgggtcgcgtccacaagacacccagtggacccaaagaagtccaacagggtcttggggcttccggctctgattacgggcctctgtcagttctacggagtgcccgtcacccccaacaaggtcatcaggcccctattaacaggggtttcatcgagaagtactgcgcccccag

SEQ ID NO: 69416 - DNA, 319 bp, Glycine max
  Peptide Sequence Number=SeqID_161101
aggctcttcacatgaaattaatgtaaatttcacttcaatttcagaagctactgtctcactaagtcgagaccgtgtgcttagcgagtatcatttgcttagtgaggcagcagctcgcttaacgagtaagaagaatcttgaagggaatctgtcatgcaagcacgcgctcagcgcgtcatcaactcgcccaacgagtcatctgtctcttttggcgcttagcgcgcctggttcgctcagccaaatatcacttactcgcgctaagtgcgaaaatggcgctaagcatgcctttgaggtcaaaaagccctttttaagcctaaaatga

SEQ ID NO: 69417 - DNA, 471 bp, Glycine max
  Peptide Sequence Number=SeqID_161102
atgaagataatggagggagggggaaaatcttatattggaaatgaacaaccatcctcatcgtccaaaaggaaagtggtgggccctagtttgaatttaattgcccagatggtgaaggataatttgaaaatcaatcaagtagtgaagcaggtcaagactcaaaatgctaaaggcgataagaatccacaaggaggtagaggtaatgaagtttcaaagggaggcaaggcaaactttaagaaatgcaatcttctactcctgggactatggagtgaatttcctattactcaagtgtacatagaccaggaggcagtgacttatgttgctaataagtgtgagctgagggagacctcaataccccacgtggatgcgaatgtagaccatgccattgttattatggatacaaatgaggaggttaaagctacccaagatgatattagtagtaagataccaaatcctacaactcactcctcatga

SEQ ID NO: 69418 - DNA, 669 bp, Glycine max
  Peptide Sequence Number=SeqID_161103
atggtggccctagacctgaaagtggaacaacaacaactatcagcaaaggaggctggagtcggtccttgcttagaagatgaaggttatatggttgcgagaaggggactcaaacacccaggtatatgtagatccatgaagcaagtgttttctgaagaagagtcagacattatgtggatgatgactaaattctacttttttaggaagcttcctagagggacaaacgcctcatttcttgctcttataccgaagaaggaatttccagaagtcaatcagctttttggggtgggatgcaatttcttgatagtgtttatggttgcgaacaaggtcatacatgaagcaaagagtaaaaagaaggcaactcttgtttataaagcagattttgaaaaggcatataaagtgttaactaacaattcctttttgtatgatgtccagaacaaggacaacatggtgtctcgatatgcaaggttgatgaactgtactaccttgaaacttcctttgaagtacctaggcttacttatagggggcaatgctcgtaaagaggagttttggagtgaggacaaatcgagtgtagcttggttgaggtgggatttggtgtgttgcaaaaataagcatggtgagccaggaatgagatatgttgggaactttaacaaagctttaattagcaaatga

SEQ ID NO: 69419 - DNA, 369 bp, Glycine max
  Peptide Sequence Number=SeqID_161104
atggatgagaagagagagaaaaaattgaaggaagttgctcaatccaggagcactgacactatcattgatcctccatctcccatcaaacgacacgtgaagtggaagctagctcgcaccaagaaaactggccacatgtcatctgaggtagcaaaggaaattgttgacaggattgattcgttggaggagaaagcctcacagggttcctttgtcatccatggacgtcatgatgtactgactgttgccattgggcaaccaaaacaccctggtagtgtgcgtgctgcaggagccagtgtaaccatcaaacaatactttggatcggcttcaaggacctcctgcacttcttcctccatggctcccgaagacctataa

SEQ ID NO: 69420 - DNA, 459 bp, Glycine max
  Peptide Sequence Number=SeqID_161105
atgaggggcaccgtgcatgagcctcaagcgaacctaggggcagatcaaaagttctcaccccgtcaatgtactagtaccctcgccttgagagagctgcacgccctcgccttcagagggctacacgccctttccttcagaggactacacgtcctcgcctccagaggactacacgcccttgcctttagaggactacacgtcctcgcctccagaggactacacgcccttgcctttagaggactacacaccctcgccttcagagggttacacgccctcgcctttagaggactacacaccctctccttcagagggctacacgccctcgccttcagaggattacacatcctcacctttagaggactgcacgccctcgccttcagagggctacacgccctcgccttcagaggactacacgtcctcacctttagaggactacacatcctcgccttcagaggactacac

SEQ ID NO: 69421 - DNA, 552 bp, Glycine max
  Peptide Sequence Number=SeqID_161106
atgcggagataccttatggttatccgcaccttttgtcaaccagaggcaagcgagcccattgacacccagagactaacgtcgttatctgcacctttgtcatcaagagacggtgagtccaatgacatgcacagataccttatggttatacgcaccttttgtcagctagaggcaagcgagcccgttgacacgcagagacaaatgtcgtcatctgcacctttgtcatccagagacggcgagtccaatgacatgcgaagataccttatagttatccgcaccttttgtcagctacaggcaagcgagcccgttgacacgcagagactaacgtcgtcatctgctcctttttcatccagagacggcgagtccgatgacatacagagataccttatggttatccacaccttttgtcagccagaggcaagcgagcccgttaacatgcaaagactaatgtcatcatctacacctttttcatccagagacggcgagtccgatgacatgcgaagatacccgagtggttatccatacaaacacacttctgttaatcctgacccatga

SEQ ID NO: 69422 - DNA, 726 bp, Glycine max
  Peptide Sequence Number=SeqID_161107
atggaattgcagctgggacaccaaaaaccagcatggttggaagctctttacgcacaaaagttctttgtggggtgctctcaccatgagaatgctaaaaaaaacgagaagaacatatgctgcttagattgttgcaccagtatttgccctcactgtttgccatcacatcgctgccataggcttcttcaggttcgccgttacgtttatcatgatgttgtcagattggaagatcttcagaaactcatagattgctctaacgtgcagccttacaccatcaatagtgccaaggtggtgttcatcaagaagagaccacaaaacaggcaactcaaggggtcagcaaactactgcacttcatgtgatagaagtcttcaagaaccttttatccattgctctctaggatgcaaggtggattttgtgctgaaacactacaaggacctctctccctatttgagaacatgcaagtccttgcatctaggtcccgatttcctaatcccacaagagatgggtgatgatgaaacaactcgttcaaccattgtggattttgatgaaccaatgagctcgtcttcagggtcagagaacatgagcatggcttgcaccgaaattgttaggaagaggcgtagtgggtggaatgtgtgtgcaacatcaatgagcaacaaggtttcgcatgaagacatggttacaagcattagtagaaggaaaggcatccctcatagatctcctttgtgttag

SEQ ID NO: 69423 - DNA, 324 bp, Glycine max
  Peptide Sequence Number=SeqID_161108
atggactgtggtggcaacctagatgattttgtagtcttggttcaagaccatgtttctactaatgtatcattgcgcaaccaagtagagatggactctaaggtcaagttactcaatattgttcaagttgaagagatttcccctcataaggaggagttaacaattgtgtttaagtcacttatgcaacaaggatatactctagtagttgcaattggcatcatatcaagtttcatggactatgacttatatgtagtattggtgggagcttactttcttaaacctcattttggtcctccacctgctcaagttgataatctccccctttag

SEQ ID NO: 69424 - DNA, 798 bp, Glycine max
  Peptide Sequence Number=SeqID_161109
atggaagacgagtgcaaaaatgtgctggagttaggtacacagcaggatcatgcaattgaagcagacatctttgcttgccctgtatgttatgaaccattgataagaaaaggtccttctggccttaacttacctgcaatctacaggtctggtttcatgtgtaagagatgtaagaagacatattctagcaaagataggtatctggatctgactgtaactgctggattgagagactacactgaaattcaacctgctcggactgagcttttcagtcccctggtttcattcttgtatgaaagaggttggcgtcagaatttcaggcaaagtggctttcctggtcctgatgaagagttcaaaatggctcaagagtactttgaatctgctgaaggtggacttcttgttgatgttagctgtggtagtggtttattttcccgaaaattcgccaaatctggaacatattcgggagtcatagcactagatttttctgagaatatgcttcgtcaatgttatgatttcattgagaaagatgacacactttcaacaaataatattgctcttgtaagggcagatgtttctagacttcccttctcatcaggttcggttgatgctgttcatgctggtgcagctttgcattgctggccatctccctccaatgctgtaagtgctgtgtcagtgactccacaaggctatggctatctaacagaggaagagatcaaagacctttgcacctcatgtggtcttaccaattactcaagcaaaattcagcaggcttttattatgttcacagctcagaagccataa

SEQ ID NO: 69425 - DNA, 279 bp, Glycine max
  Peptide Sequence Number=SeqID_161110
atggatccagcttctcaaactgttagtttttctgatattcaatgtgatgttcccgaacacaaaggagataactataagatatggaaggagagaattcttctgcaactagggtggatggacatagactgtgctataaggaaagatgaatcacatgcaatcactgataaaagtagcccagatgttgttgcactatatgagcagtgggagcgatccaaccaactcaacgtgatgttcattaagatcgaaatctcggttgggatatgtggttctatcaactag

SEQ ID NO: 69426 - DNA, 180 bp, Glycine max
  Peptide Sequence Number=SeqID_161111
atgaaggactccttcaagcaaagttggtacattgatagcggttcctccaaacacatgatgggagatgcatcaaagcttatccatttttctcccaaaaataatggacatgtgacctatggagacaacaacaaaggttttgatgatgccaaaagtatttacttgatgaaagcacacaaatag

SEQ ID NO: 69427 - DNA, 351 bp, Glycine max
  Peptide Sequence Number=SeqID_161112
atgatgagatgttgcacactgattgattggcctaactctctaaaaacagtccctagtggagtcgccaactgtcgcgacctacccttcagcaggagggcgacgcgaaagctcatgggtgcgtcttccaagggaggaaggcgcgtggagtcgccaccaatgtttattcgaggaaaacgtcagaaaaaccaagatgcgtgtggtcaacgaactttaggtgtgaaaggttcgggagttgtttttacgtatggggaagggttacgagaattttacggaagcattacagaatccctagaagttgttttcaacaaaacaggggaggaggttgccgcccagctcacccaggcgagctag

SEQ ID NO: 69428 - DNA, 570 bp, Glycine max
  Peptide Sequence Number=SeqID_161113
atgttgacatctccagaaagggcgcagacgaccacattggtctccgcttgtcaatcaaacttggggtctccaaatgacgaggtgcagataaccgtaaggcgtctccacatgctaccagactcacggtctcggcctgaagatgctgacatctccggaaagggtgcagatgaccacattgatgcggataaccataaggtgtcttcgcatgctaccagactctcgggtcactggatagcaaagggtgtatgcgggttaccatatagggcatctccacgtgccaccgatctcacaggtgtggataaccgtaaggtgtctccgcatgctatcggactctcgggtcgctggatagcaaagggtgtgtgtgggttaccgtatagggcgtctccgcgtgccactggactcacagggagaggaccacttccagtcgcggttttgtttcttttcttacttgctcgtgacaactctcgtgttagcaactcaacagtgagtgactcttctttcttgggagaccccactgttccttcctccaagggcaaggatggaaagtctcatcctgggtcaagttttatg

SEQ ID NO: 69429 - DNA, 119 bp, Glycine max
  Peptide Sequence Number=SeqID_161114
atgtgtttccgtgaagaaaatccaacacaaggtgcttccgtaatgcttccgagacgtttccatgagcaatttcgtgaagattttccaccgttcttcacgcgttcttcggtcttcaaccg

SEQ ID NO: 69430 - DNA, 699 bp, Glycine max
  Peptide Sequence Number=SeqID_161115
atggttctttcgtggccttgcattaactcgctattcataatttgctttttaaattttggcttacagacagagaaggcttttctgaagcaaccaaaagtgtttctatgctctaagaaaggtgggaagggaaagaggcctgggaaaggtgggaatcgcttttggaagtcaattgggcttggattcaagactcccagagatgccattgaaggaacctatattgacaagaagtgccccttcactggcaatgtttccattcggggtcgtatcctagccggtacttgtcacagtgctaagatgacaaggaccattattgtgaggaggaattatcttcattttattaagaaataccagagatatgaaaagcggcattcaaatattccttcacacatatcaccttgtttccgtgttaaggaaggagatcatgttattattggccaatgcaggccaatctcaaagacagtgaggttcaatgtgttgaaagtgatccccgctggatcctctagcggtgcaaagaaggcttttactggaattacacttaactcttcggttgaggaggattttgtgataagtttctccataacaaacctcccttatgttgtgaatgggaaggtttctgtgaaaggttcctgggtcggggatgaagtggcaattgtggagacaaagggatgtgaaacagaagcaatcatagaaattgtttga

SEQ ID NO: 69431 - DNA, 681 bp, Glycine max
  Peptide Sequence Number=SeqID_161116
atgtggaaactgttaaagaattctatgcaaacctatatgtccttgaggacaaagaaccaaagcaagttagggttgaggccagaccctcaagagctggcagcccggctgtgtatccctagaaggggatttgttcttaacgccaagggcttgtcgtggaagctcttgaggaaggatcttataactctggcacagacctggagtgttttatcttattctaacctagccccaacttcacatacctctgatcttaatcttgacagggctaggttagtttatgggctagtaatgaagatggacatgaacataggagcacttatatctagacagatctcgctcattgctcagtccaactcctcaaggcttggatttccagccctcatcactgccttgtgcaaggcccgaggaaacctggatgacccttcgatcacttttccagggacccaaaaatccagggctagaagatctgaggcctcatctccttcagctacccctactccccctacttctgctctcccttcagctccagcagccccagttcttccagagcctgcaccagggccagctcctgattatgcagagcttgcaagatgtggtccaacagtgaccagttatgagcgtggaggagtttttgcagaaggttgcctggccaggagtccagccttctcctttgggagggggtga

SEQ ID NO: 69432 - DNA, 1062 bp, Glycine max
  Peptide Sequence Number=SeqID_161117
atggataaccaaaatgccatcgagttctttgaaggccaaaaccttttgtacatgcagatatttggtaacctaagacctgtgtgtcttatgtgggcttgcgaactaggtattccagacataatatccaaccatgggaaacccattactcttcttgagttggtctcagccctgcaaattccaccatctaaggtgggttttgtgaagcgattcatgcgctttttggcacacaatagaatctttgatatccatgagagccaggaagatcatcatgaattagcgtatgctctaactcctgcatcaaagcttctagtcaatgacagtatccattgtttatctccaatgcttcagttcatgactgatccgtttttaacgaatgcataccatcacttgggggaatggatgcgcggcgatgaccccacattatgtgagacagcctttgggacaaccctttggggacttcttgagaaaaaaccttcatacaatagtcttttcaatcaggttatggcaagtgattcccggatggtagacttggtactaaaaaattgcacttcgatttttgaggagctagattccatcgtggatgtaggtggtggaactggaaccacagccagaattatttgtgagacatttcctaagttgaaatgtgttgtgcttgaccttcctcatgttgtagcaaacttgacgggaagcaatcgtttaagttttgtcggaggcgatatgttcaaatctatccctcaagccgatgcagtcctactaaagtgggttttacatgattggaatgaagaaaattgcataaagatcctgaaaaggtgtaaagattctatttcaagcaaaggcaacagagggaaaataataatcatagatgcagtaataaatgaaaagctagatgaccaggataagactcaaacaaagctctgtatggatatagctatgatgatcgcttttaatggaaaagagcgaactgaagaagaatggaaacaactcttcattggagcaggattccaacactacaaaatatatcatacttttggttttagatctcttattgaggtctatccttaa

SEQ ID NO: 69433 - DNA, 192 bp, Glycine max
  Peptide Sequence Number=SeqID_161118
atggagacgcgcttcacgactccgaaaatgccctcctttcgcgatttggagcagaaatgggcaccaaaggttgaagctttgttggagtttcaatggtggaggaagaagaaggagaaaagcaacgtgagggagagggagagagcttctgaaaatgtggggttgagtgaggagagagagagagttgctttttag

SEQ ID NO: 69434 - DNA, 408 bp, Glycine max
  Peptide Sequence Number=SeqID_161119
atggctacgagccctacaactattcatagaaaaaatagccttgcacatttcttcaatagagggaaggtttgtaagaatcaaattgtcctcctgagtgacaaggctggggatgatagagccaataagattgttcacaacaatggagttttcagactcagaaagaaaagtaaagtagttgagaatcaaattttcaatgtccaccacatcatggagagtgccttctttaaatcattgccaaaaatagctttgttccacaccttgagtttggacttcaggatttttagcttttgggagggaatgtacatagaacagccaatgacattgtttttctatacatcctctatcaaacttctgcaaccttcatgggctgatcacatcttcagaaatttgaaagatgaaggaaactga

SEQ ID NO: 69435 - DNA, 519 bp, Glycine max
  Peptide Sequence Number=SeqID_161120
atgactaggggcaatccaggtgatttacaaccctttgatcctgaaatagatagaacctttcatagattagttaggcatagtgtgcatcctagtcattctgtgcattttgaacattctgagcattcttatgagggtgattctgaatattctgattttgaacattccactactaatttttatactgagaacatggctcaacctccacctcgtgagaggactctaagggagatggcagtacctgatttcacttatgaaagcttgtgcattcaatatcctgatgggggtgttccatatgttctcaagactggactaatacatttgctgcccaagtttcatggtcttgcagagggagtgacaaaagattggctatactaccttgctccaaggtccatttttagctgggatgaccttaagagggtgttcttggagaaattcttccctgcatctaggaccactgccatcagaaaagacatttcaggcatcaggcaacttagtggagaaagcttgtatgagtactga

SEQ ID NO: 69436 - DNA, 360 bp, Glycine max
  Peptide Sequence Number=SeqID_161121
atgccgtcaccacgcagcggagaacgacttcacggcaaagtacatccccttcaacgttggcttcgactcaccggaaacctactcgctcgactcgacaaaatcgtgtaccgcagccgttccggcggactcctcgacgtgctgcatgacatggattcacccgagtccgctggaacgactgcggtacacgattttgtcgagcgagtaggtttccagagagttgaagccggtgttaaaggggatgtacttcaccgtgaagtcgttctctgccatgtggtggtggcgggcctcgtcgttgatgttcggcggcgaagaaacatgggatggttgttggtggtgatgtgtgaggaggtgcacatgtag

SEQ ID NO: 69437 - DNA, 528 bp, Glycine max
  Peptide Sequence Number=SeqID_161122
atgtccattcattctagtatctctaacccatggatgcttgtggaggactataacaagatagtgaagccatctgaagttcgaagggagaaattcaaagcatcgagagtagatcttatgttggatatgatggataagtgtgagctcttggatatggaagctatgggtatgagggatacccctggggagtgcccttttcgatttcatgcggcttgggtcacccataatcaatatgatttggtagttcattttgcatgggcaaaagggtctccaagtgttactggagggctaaagcaaggcatcaccctccttcatattcttgatgaggcaagggaagcacttattaggccaatcttaaaagaggaggtttgtcatgcagtgatgcgtatgaaatcttttaaggcccctgaccctaatggatttaagcctttcttcttcaaatgctattgggatgtggttggggaggacctttggttaatggtgagggaggtgataagaatcccaaagctacctaaatataggaacctatga

SEQ ID NO: 69438 - DNA, 228 bp, Glycine max
  Peptide Sequence Number=SeqID_161123
atggccccacccaaatgtgcacatagtggaccattggccaaggttaaggcagaacatcatagacacatcaatagtgaaggggatgttggaccaaggttggtaaggagtagtggaatgagaagagagtggagtttagaggatttggctgggcaacaacaagacaagggaattagaacgtcatcatgcatcacactacgtgaaggagaaactcttgtgcttattggttag

SEQ ID NO: 69439 - DNA, 258 bp, Glycine max
  Peptide Sequence Number=SeqID_161124
atggataagtctcacccggtgttgctttcaatcatcaaacttgcagacttacatgtgaaagaagcgataggggacatcattgttgatcctaagtgggtggtggttatggtagaatatcagagtgactatgtggtggtggaagtgtttaagggaatggggttggaaaattggatggaacaattattggtggttgaggttggatgggtgaaagtgttgttttcacaggagtttgtcatgttgagcagagaaaaagattag

SEQ ID NO: 69440 - DNA, 435 bp, Glycine max
  Peptide Sequence Number=SeqID_161125
atggataggttgctaaagttggcgactccattggggacttttagagagttaggccattcagtcagtgtgtgtcataccctaatttcatccggggaccatccattgttgggatacgaccctcgtttgaccacttcgagaaaattcctccagaaggtggttgcttctggaggaagcaacctagctcgcctgggcaagctgggtggcaagcttctcccctattttcctataaatagggggagaagtgaagggaaaaaaatggtcagccctcctggtaattcgagatcacttgaaattagtgaaaaaaattgtttccatgaagaaaatccaagccgaggcgcttccgtaacgtttccgtgggtgatttcgcgaagattttcaaccgttcttcgacgttcttcgttcattcttcgtcgtgcttcggtcttctaccggtaa

SEQ ID NO: 69441 - DNA, 453 bp, Glycine max
  Peptide Sequence Number=SeqID_161126
atgactagaggcaatccatatgacttacaaccctttgatcctgagatagataggacatttcatagattagttagacatcatttagaaccttttgagcatcctgagcattctgttattggtgattttgaacatcctaactttgagcattatagttttgaacattctaattttgaacattctgagaacatgacacaacctccaccccgtgagaggactctaagggaaatggttgcacctgatttcacctatgaaagcttgtgcatccaataccctgatgaggatgtcccatatgttctcaaaactggactgatccatttgcttccaaagtttcatggccttgcaggtgaagacccgcacaaacatctgacagaattccatattgtctgctccaccatgaaacccccagacgtccaggaggatcacatatttctgaaggcttttcctcattcttag

SEQ ID NO: 69442 - DNA, 1038 bp, Glycine max
  Peptide Sequence Number=SeqID_161127
atggctcccgaagaactcgagcagctgactcaacaaatcagggaccagctggaggagtccatcacagaaaaagtgactcggcagctgatgttatccttcagccagatgcagtcccaactgcaatcacagatccaatcacaaggacttgcactacctctggagcctgaggttggtccctcagctgcttgtgtcagcacaaaagggagttgtgttgatcgctcaccgaccgatctagacatgggtgactcagacaaattcgggttgtatattgaagaaaatccttcttgcctggttgctctaggaagagtttatgagggatccacagtggttcacaacatccctttgttgcatggccaagtaaaggttggtgctgaggaggttaaagatgcagaggctctcgttcctgtacccactgacaaggttattttagtggggcagacaattaacaccttccttgcttggccaacacatctcgtgaagcgtttatcagaacaggcagctgtgtctctagcaaaacctccagataggccagatcatgaggttatgtgggatgctaccgtgttcggggtgtttaatgaacacttcccgttgtacataaagcatgaagatttctctgaaattgcacacagtggtcaatgtctcagcatatctgttatacaattgtggattttgcatctgactgagacaagtatgcgagcggtgaatcccgatgtgtatggattcctcgagccacagtccattcagagatttaggcaatcacaatttgaattagaaagttacatgaagagttggatgcagagttcaaaacgcgatgtctaccttggagcctacctgaatgagccagacaactaccttaaaggaataattaacagtgccttgaaaggacttgatgaaactccacaacctaaatccaaggttggtgctaagtggattgttgttaagtattttaatgatgttagaccattggaagcagagagattaaaggcgcttcgcatccagttggcacaatattatctcaaagttagaaatcaaacttag

SEQ ID NO: 69443 - DNA, 465 bp, Glycine max
  Peptide Sequence Number=SeqID_161128
atggaaaagcatagaaagttgaatatcattcaaaatgatggtcaatcacaaacaaaagagcaatcaattgaaaggtttactaaagcgaaccaaaataacaaccctatacttgatgaaaatgcacaatttgaaagagaacagcacatacaagaagaaagccatgtcgagtctcatacttctcttggaagtgcaagtgaaagttcaactaaaggtaaaaagaggactaaaggttatacacatatacgagatgtgtgggactttccacatggagaattcatacttgttggactagatcattggggaaatcctatggattggggagggaaaactctactcaatgcagttgggagcttggtaaggagacacctgtcgcaacctacccttcgacgggagggcgacgcgagactcacgggtgcgtcttccaaggaaggaaaatgcacggagtcgccaccaacatttatttga

SEQ ID NO: 69444 - DNA, 246 bp, Glycine max
  Peptide Sequence Number=SeqID_161129
atgactgaaaatgttagtcaatttgtcatattgattgtgaaggaatgcattgaccgtatcccggagagcatcatccacaggaagcttggttcaaagcaaatttgtcccaaatttgggggagtaattatcaaggtcaaaagaggcaaaaatcttgaggtgctaaagggagcatttgcgctcagctcaccatttgggctcagcgtgcatccaacgctaagcgcagcttcagcgtgcttagcacaatag

SEQ ID NO: 69445 - DNA, 107 bp, Glycine max
  Peptide Sequence Number=SeqID_161130
tgcaaggagtgccatttaggataaacttttggttcagagcaacttttgaagatgccagtagtgatggaagcttgcttgtggggcttctatggaggatggatctttga

SEQ ID NO: 69446 - DNA, 1122 bp, Glycine max
  Peptide Sequence Number=SeqID_161131
atggtgccggtcaaccttgccgcagtggcggcgaccctggtgatgttgcatctgttctttcgcaaggatattccgcggcgctacgcgttgacgcgtttaccgataccccaagaagcgattcgcgatcgtgcgactttccgagccggctgggcggtattggcgctgttgctgattggcttcttcgctctggagccgctcggcgtgccggtgagtttggtcgctgcctgcggcgcgctggttctgctggcggtggcgaaacgtgggcgcgcgatcgacaccggcaaagtgctgcgcggggcaccctggcagatcgtgattttctcgctgggcatgtatctggtggtctacgggctgcgcaatgccggcttgaccgagctgctttccggcgtgttggacgcgctggcgcggcaggggctgtgggcggcgacgctcggcaccggcttcctgagcgcgtttctctcttccgtcatgaataatatgccgacggtgctggtgggggcgttgtcaatcgacggcagcggcgcggaaggcgtcatcaagcaggcgatgatttacgccaacgaagaacatcgtcattacctggggctattattttcgcgtggggctggtgatgacgctgccgatcctgttcgtcaccctggccgcgctggcgctgcggctgtccgtttgatcctgataggagaaaccgtcatgagcagtatcaagatttatcacaacccggcttgcggcacgtcgcgcaatacgttggcgctgatccgcaacagcggcgttgagccggaggtgattttgtatctggaaacaccgcccagccgtgaacggttgattgcgctgctggccgaaatggggatgacgccgcgcgcgctgctgcgtaaaaacgtcgagccttacgccgagctgaaactggatgagaccggctggaacgatgagcaactgattgacttcatgctgcaacagccgattttgatcaatcggcccattgtggtgacaccgctcggcacgcgcctgtgccggccgtcggaggcggtgttggatattctgccggatccgcagcgcggggctttcagcaaagaggatggggagccggtgatcgatgcgcagggctgcaggataaccaaaggttga

SEQ ID NO: 69447 - DNA, 156 bp, Glycine max
  Peptide Sequence Number=SeqID_161132
atggctaatttcaaggcagcagataatctccttcgaagatgtgtgacaagtgaggaggccaagggcatattgtggcattgtcacagttcaccatgtggtgggcattatggcagagacaaaacagcagctaaggttttacagtcaggatttttctag

SEQ ID NO: 69448 - DNA, 996 bp, Glycine max
  Peptide Sequence Number=SeqID_161133
catccgctgcagctctattcgctggggacgccaaacggccagaaagtgaccattctgctggaagagctgctggcgctcggcgtgcaggaagcggagtatgacgcctggctgatccgcatcggcgacggcgatcagttctccagcggcttcgttgaggttaaccccaactcaaaaattccggcgctgcgcgaccactcgatcacgccgccactgcgcgtgtttgaatccggcaatatcctgctctatctggcagataaattcggccactttattccctctgacgtggcgggccgcactgaaaccctgaactggctgttctggctgcagggatccgcgccctaccttggcggcggtttcggccacttctatcactacgcgccagaaaaaattgaatacgccattaaccgtttcacgctggaggccaaacgtcagcttgatgtgctggatcgccagctggcggaccaccgtttcctcgccggcgacgaatataccattgccgatatcgcgacctggccgtggtacggcaatctggtgctgaacaaccagtacggcggcggggaattcctcgatgtgcagtcgtacaaaaatgtggtgcgctgggcaaaagagattgccgaccgtccggcggtgatccgcgggcgtaaagtgaaccgggcatttggcgccgagccgcaggatcagctgctggaacggcacgatgcgagcgattttgataccaatactgaagacaagcacgaaacgctggataaagatgagctgaccacctattcgcagaaagccggcgcggcgcgtggcgatcaccacatcacgccactggctttctacggcgatctggaggtactggaagggcgcgatgctgaaggcgtggtggtgctgcagtttgaagatgctgaagccgccaaagcctggtacttcagcccggcctaccaggaagccaaagcgcatcgcctgaaaggcgccaactaccgcgtactgctggtgaacggcgtggcgtaa

SEQ ID NO: 69449 - DNA, 355 bp, Glycine max
  Peptide Sequence Number=SeqID_161134
gccactaggtgactatgcttatcaacaaggcccaaaaaattacgacaacatagttattcctcctttcaacaataaggtcgtggaattgaagccagcactgcttagtctaattggctcacatccctttgttggaatggatcatgaggatccatacacacatttgtctaccttcttggaatgggagcttctgatgaagatgttgaagctgtctaccttagagcttgatgtaagctccattggagcttgtaggcctaggatcttcttcatcaatggattcctttgcttcttggaagatgaatggcaacgaaagggagaaggaagagagagaggagatgccacttcaaggagaagatga

SEQ ID NO: 69450 - DNA, 208 bp, Glycine max
  Peptide Sequence Number=SeqID_161135
atgggaggtttgggtattaaagatatcaaggccctcaacaatgctcttttaattaaatggaaatggttgatgttccagcaaagtgatcagctatggaaccgtattttgaattctaaatacagaggctggagaggcttggaaggggggccaccaaagcctaatttctctcattggtggtctgacttgagatccattaatcagcatgggt

SEQ ID NO: 69451 - DNA, 1728 bp, Glycine max
  Peptide Sequence Number=SeqID_161136
atggatggtaaggcatccagacggctaaatcaatcaaagtcattcaatctgccattctcacggagtttctacgtggcgaacccagtcccggctatttttctcgatcgtgatggcaccctgaatgtcgatcacggctatgttcatgagatcgataattttcagtttattgatggcaccattgaagcgctgcaggcgttaaagaagatgggctacgcgctggtgctggtgaccaaccagtctggcatcgcgcgcggcatgtttaccgaagatcagtttatgcaactcaccgagtggatggactggtcactggccgatcgcgatgtcgatctcgacggcatctatttctgtccgcatctgcctgatgcaacggtcgtggagtaccgccagacttgcgattgccgcaagccgcaaccgggcatgctgctttcggcgcagaaacacctgaacatcgatatggcagcttcttatatggtgggcgataagctggaagatatgctggcagcaaaggcggcaggcgtgggaaccaaagtgctggtgcgcagcggtaagccggtcaccgccgaaggcgaagcggccgcagactgggcggctcagcagggcgtgaagcgattcacgccgccggagaaaaacgctgaaaaaagtacaatctgtgtgggcactcgcaggattgatatcagcgtctccggacgtaaaaaatatcaagtctttgctgaattgaacgctggcggcaggcctaacacatgcaagtcgaacggcagcacagaagagcttgctctttgggtggcgagtggcggacgggtgagtaatgtctgggaaactgcccgatggagggggataactactggaaacgccacactggaactgagacacggtccagactcctacgggaggcagcagtggggaatattgcacaatgggcgcaagcctgatgcagccatgccgcaagaagcaccggctaactccgtgccagcagccgcggtaatacggagggtgcaagcgttaatcggaattactgggcgtaaagcgcacgcaggcggtgtagcggtgaaatgcgtagagatctggaggaataccggcgtggcttccggagctaacgcgttaagtcgaccgcctggggagtacggccgcaagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtaaccgtaggggaacctgcggttggatcacctccttacctgaagataccttcccgcgaacgcacccctgataagggtgaggtcggtggttcaagtccactcaggcctaccaaatcatttctcatgctgcgttacagcgccgctcgcatagaagactatgcgtcgcgacactgcgccttgcctgaaaaatga

SEQ ID NO: 69452 - DNA, 132 bp, Glycine max
  Peptide Sequence Number=SeqID_161137
atggtcactaaaggttggagctttgttggacaacaatggtggaggaagaagaaggagaaaagcaacgtgagggagagggagagagagctgtctgaaaatgtggggctgactatgccacatgtctccatttga

SEQ ID NO: 69453 - DNA, 198 bp, Glycine max
  Peptide Sequence Number=SeqID_161138
atgtgtgcagttaagaaggtgatatggaccttgcggcttcccgtgacaaaagacaagaccaacatacaacgcgtgcgtgatgacatgatgcagatgcgcaaaagtgcaacagggggatggactaccagcgataatatatcatcgaagagaaaaactctagatgaggttttactgtcatcaagcaagtgggagacttag

SEQ ID NO: 69454 - DNA, 810 bp, Glycine max
  Peptide Sequence Number=SeqID_161139
atgaccataaggattacagctatgggttttctttccggtaagcgcattctgattactggcgttgccagtaaactttccatcgcctacggtattgcgcaggcgatgcacaaacagggcgcagaactggctttcacctaccagaacgacaaactgaaaggtcgcgtggaagagttcgctaaagaactgggttcagacattgttctgccgtgcgatgtggcagaagacgagagcatcactgccctgttcactgaactggcaaaaacctggccgaaatttgacggctttgttcactccatcggcttcgccccgggcgaccagctggatggcgactacgtgaacgccgttacccgtgaaggcttcaaaatcgcgcacgacatcagcgcctacagctttgtggcgatggccaaagagtgccgcgcgatgctgaacccgaacgcagcactgctgaccctctcttacctgggtgcagagcgcgctatcccgaactacaacgtgatgggtctggcgaaagcgtcgctggaagccaacgtgcgttacatggcgaacgcgatgggtccggaaggcgtgcgtgttaacgccgtgtctgccggtccaatccgtaccctggccgcatcaggcatcaaagatttccgtaagatgctggcacactgcgaagcggtaaccccgattcgtcgtaccgttaccatcgaggacgtgggtaattcggcggccttcctgtgctcagacctggcgggtggtatcaccggtgaagtggtgcacgtggatggcggcttcagcattgccgcgatgaacgagctggaactgaaataa

SEQ ID NO: 69455 - DNA, 210 bp, Glycine max
  Peptide Sequence Number=SeqID_161140
atggaggctttggaggaagactatggagatggaaatgggaaaaatgaatcaaggcaatatattgagggcccaccaaacctgtctccgaaaaatgacgatctcggacttattcaccgctggatcgtcgtgaaatttgagcaccaagttcgcaacccaattctgagcattttaaccgttgggaatttcgatatcatgtctgaactgagataa

SEQ ID NO: 69456 - DNA, 567 bp, Glycine max
  Peptide Sequence Number=SeqID_161141
atgggtgagatagaggaggtacaagagcggatgaaggctgacatggaggccatgaaagagcaaatggccacaatgatggaggccatgatgagcatgtataagataatggaggtcaatgcaactgcagttgccgttaccagcaccgttgctgaggtggacccgaatcccccatctggcctcaatcaaaacaagcatgccttcccgccatatggcttgcctcccaactataaaccactcaatgttgcgcacactcccgatgagaatgtcaataactccactcccatactcattgagagccaacaacctcaatctgatcatgcacatgtctctcaacccatgggggagacacatgaggtaccccaccacaatctagccgaatttgagcctcgccttggaaatactgttgaagggaaaggctcagagccattgaaggggggtggagattatactttcgctgacatggtagagttgtgcctagtgcctgacattatcatccctccgaaattcaagccgtcacctggtacactaatccagaaccttcctgagtccattcttggaaggacctaa

SEQ ID NO: 69457 - DNA, 195 bp, Glycine max
  Peptide Sequence Number=SeqID_161142
atggaaaggatccaaaagtctacttctagtgataattcccaagggtggtttcaaggactattagtgacaatgcatcaccaaaagaggaaaactctagatgaggcttcactgttatcaagcgagtcagagacccaacatgaccacagatcgacctccactccttatggctcacataggcccgggtatagggcctaa

SEQ ID NO: 69458 - DNA, 417 bp, Glycine max
  Peptide Sequence Number=SeqID_161143
atgacgggactcaatcagacatccgactcagagcttcaacattcaatttcgagcgtctcgttatattacgggactcaatcagacatccgagtaaaaagttattgtcgtttgaattggctgagagcttcaacattcaatttcgagcgtctcgatatattacgggactcaatcagacatccgagtaaaaagatattgtcgtttgaattggctcgagagcttcaacattcaatttcgagcgtctcgatatattacgggactcaatcagacatccgagtaaaaagttattgtcgtttgaattggctcagagcttcaacattcaattacgagcgtctcgatatattacgggcctcaatcagacatccgagtaaaaagttattgtcgtttgaattggctcagagcttcaacattcaattttga

SEQ ID NO: 69459 - DNA, 387 bp, Glycine max
  Peptide Sequence Number=SeqID_161144
atggatttcattgaaaatatggctgcaagtaacattgctattctaagagatagagcccacattcctactaaaaatagcttattggagctaacctcacacgatgttgcaggatgtacaatttgtggtggagctcatgaatctggatgttgtatccctaatgaagaacaagtcacacatgaagtcaactacatgaggaaccagcccaaaaacaattttaatgcaggggttgtgagcttgtgtgaagagatagacaggaaaagactccgaattttttttgcaattgtctatccgtcaaacgtagaccttgcgctaagcgctcagtcttcacgcactaagccgagcttgctcgtgctaagtgcacagacccctgattggttggctgaatag

SEQ ID NO: 69460 - DNA, 765 bp, Glycine max
  Peptide Sequence Number=SeqID_161145
atgggtgaagtagaggaggtgcaagagcaaataaagaccgacatggaggccatgaaagagcaaatggccacaatgatggaggccatgatgagcataaagaagatactggaggtcaatgcggctgcaatagccgctaccagtaccattgttgaggtggacctgacccctccatatggcctcaaccaaataaatcatccaaccccatatatggtaggtctggaaggcaaagagttgggaggtacgggcgaccctcatttagtgcgaaaaacaagcatgccttcccgccatatggcttgcctcccaattatacaccacccaatgtggcgtacactcccgatgagaatgtcaataaccccactccgatactcattgagagccaataacctcaatctaatcatgcacatgtctctcaacccatgggggagacacatgaaattccccgccacaatctatccaacttcgagccttgcctcggatatgccattgaagggcaagcagttggtgatatacccttgcaaaacactttggaggggcctcaattttgcccccaaccacaacccttctatggaaaaatggtgggttacacaccttcaaggtttgcggatttggtcttcaccggtgaaaggatcaaagtgcgaaagtgggtctggaaatagccaatatcagctcctatcattacccaccatccagtcatccataaaggccatccctaaatcaaccacaatgtctgtctaccgcacttccaatgacgaacaccacctttag

SEQ ID NO: 69461 - DNA, 204 bp, Glycine max
  Peptide Sequence Number=SeqID_161146
atgatgacaaaggtgatgacaaaaagctcaaaggtcaatcaatgaatgagttcaagatattcaagatagaatcaagaacacttcaagattcaagagaaaagttgatttcaagaatcaagaatcaagattcaagagatcaagactcaagattcaagagatcaagatttaagactcaagattcaagagaaggcttaatcaagataa

SEQ ID NO: 69462 - DNA, 736 bp, Glycine max
  Peptide Sequence Number=SeqID_161147
agggctgcacaccctcccctttagaggacttcacgtcctcgccatcagagggttgcacgccctcaccttcaaaagacaacacgtcctcaccatcagagggctacacgccctcagcttcagaggactacgcgtcttcgccatcagagggctgcacaccctcaccttgacaggactacacgtcctcgccatgagagggctgcacgccctcacctttagaggactgcacgtcctcaccatcaaaagtctgcatgccctattcttcagaggattacacgtcctcgccatcagagggttgcacgccctcaccattagaggactacacgtcctcgccatcagagggctgcacgtcctcgcctgtagaggactacacgtccttgccatcagagggctacacgccatcaccttcagaggactacacgtccacgccatcagaggcctgcacgccttcgccttaagaggactacacgtcctcgccagcagaaggctgcacgccttcacctttagaggattgcacgtccttaccatcagagggcaccacgccctcagctacagaggactacacgtcctcgccatcggagggctgcaaacactaaccttcagaggactacacgtcctcgtcagtagacggctgcacaccctcatcattagaggactacacgtcctcgccatcagagggctgcacatcctcgcctttagaggacttcacgtcctcgccctcaccttcataggacaacac

SEQ ID NO: 69463 - DNA, 1373 bp, Glycine max
  Peptide Sequence Number=SeqID_161148
aggactacatgtcctcgctttcagaggactacacgtcctcgcctttagagggctacacgtcctcgccttcagaggactacacatcctcactttcagaggactacacatcctcgccttcagagtgctacacatcctcgccttcagaggactacacgtcctcgcctttagaggactacacgccctcgccttcagaggaatacacgtcgtcaccttcagaggactacacgtcttcaccttcagaggactacacatcctcactttcagaggactacacatcctcaccttcagagggctacacatcctcgccttcagaggactacacgtcctcgcctttagaggactacaagccctcgccttcagaggactacacgtcatcacttcagaggactacacgactacatgtgctcgccttcatagggctacacgtcctcgccttcaaagggctacacgtcctcgccttctgaggactgcacgactgcacatcctcgccttcagaggactacatgtcctcgtctttaaagagctgcatgccctcgccttcagaggactacatgtccttgccttcagagggttgcacgtcctcacttttagagggctccacatctgtgcctttagaggacttaaggagggccaactgtgtgagcacaaccagagggaggctattgtgcagccacgatgcatactggggcaagatttcacccgcgccgctgcaaagagacgagtgtggatcatgcacaccaacatgaccactcttacacagatatggatgacgttgctacttagcaacattctgcccagcgaccacaactccaatctccccctgcaaagtgtcaggatcacgcccacaagacacccagtggaccccgaggagtccaatagggccctaggatttccagctttggttacgagcctctatcagtcctacagggtgcccgtccccccagcaaggaatcgcgcccgtaagacacccagtggaccaggagaagtccaacagggccctagggtttccagctctacttacgggcctctgtcagttctacagagtgctcgtcgcccccagcaagttcatcaggcccctactaaccaagctttgatcaagaagtattgtgcccccaggcaggcgcaaggcgagacaccacaacaggctttcatcaagaagttctgggtacatctacttgggttgttgactgagaacaagagagggtacatctcttgtggatcagttctagtggagggtacatccactaggttgttcaaagagaacaagggagggcacatcccttgtggatctttgcttgtaaaaggatttttacaaaggttgaaaagaaatctcaaggaccgcaaagtcgcttggggactggatgtaggcacgg

SEQ ID NO: 69464 - DNA, 660 bp, Glycine max
  Peptide Sequence Number=SeqID_161149
atgatgcatatttctgtttttccagaactgagtcttgattctctctgcataatacgatatctttacattatggatacagcgtcttcttcttcatcacgacatatcacgttttctcacagtgcaagccaactacgggaggcagatcttaaattcaaggtcagtccaaatgaaaatgaatgcttacttgacttgacctattccaatgagggtgtgttgacaatgccaatcttgaatatagctgacgatacagaaatcttcttcaggaatatagtggcatttgagcattgtcacctttcagatcatacaaacatcattactcaataccaaaagattctagattttcttatcaacactgaaaaagatgtgaacatattagttgaaaagaaaattattgtcaattcgatggatgatgctaacaaagtgcctacaatggttaacaatctggactcaaatcttatagtgccacgtttcaattcacactacgactctctctgcaatagcttaaatgatttctatgaaaatcctcgcaacaagtacaaggctatattcatacacgagtacttcaacactccttggaaaatagcatctacagttgccgcaattgtgcttcttttgctcacattgattcagactatatgttcaataatctcactgttttaa

SEQ ID NO: 69465 - DNA, 625 bp, Glycine max
  Peptide Sequence Number=SeqID_161150
agggctgcacgccctcaccttcagagggctacacgccctcgccattaaaggactgcatgtcctcaccttcgtagggctacacgccctcacctttagaggactacacgtcctcgccaacagagggctgcacgccctcacctttagaggactacacgtcctcgccaacagagggctgcacgccctcacctttagaggactacacgtcctcgccaacagagggctgcatgtcctcaccttcagagggctacacgccctcgccatcagaggactgcatgtcctcaccttcgtagggctacacgccctcacctttagaggaccacacgtcctcaccttaagagggctacacgccctcgccatcagaggaccacacgtcgtcaccttcgtagggctacacgccctcaccttcagaggactacatgtcctcaccttcagagggctacgcgcccttgccttcgtagggctacacgccctcaccttccgaggactacatgtcctcaccttcagagggctacgcaccctcgccttcgtagggctacaagccctcaccttccgaggactacatgtcctcaccttcagagggctacgcgccctcgccttcgtagggctacacgccctcaccttctga

SEQ ID NO: 69466 - DNA, 510 bp, Glycine max
  Peptide Sequence Number=SeqID_161151
atgggggttcaaatagcaaccaggcccccttgggccttccaggatgttcctccagaaggcggttgcttctggaggaagcaacctaactcgcttgggcgagctggaaaatccaagccgaggcgcttccgtaacgtttccgtggatgatttcgcgaagactttcaaccgttcttcgtcgttcgtcgttcgttcttcgttgttcttcggtcttcaaccgcagcaagcttttcgcaaagcttacggtaaaatctgggacctagccatggtagaagtctctacagaggccattgcctccctcgcccagtattatgatcagccgttgaggtgcttcacctttggggacttccagctatcacctatggtagaagaatttgaagagatcctaggatgccctctagagggaaggaaaccatacctcttctcagggttctattcctcatcagctagaatttccaagatagtccaaatctcggcgcaggaattagaccataggaagcaagtcgaaaatggg

SEQ ID NO: 69467 - DNA, 192 bp, Glycine max
  Peptide Sequence Number=SeqID_161152
atggcaactattggaaatacaatgccactcaaagcttgctatactagacactttcagaagcccaagaaaggtttaaaacttgatggctctgatgataatggtgatgtgccttccatggatatgcgattgaatttactgagtcctaagattatcaaactcaagaatttacgcagactcgtgagaatttcatag

SEQ ID NO: 69468 - DNA, 384 bp, Glycine max
  Peptide Sequence Number=SeqID_161153
atgcacacacaaggacatttgaatcactatcgaccacggtggaattggaatccgtggcgatgcacgagatgggggcacttgctagggttaggtcagtcattaatggaagaagcgattatgtttctgaagatttcttcgcagaagaaggtggtgttggcaagggaagatatcgaagggattcaattcctctatggttccaaccctaatttcaatggctccaccgccacattagcattagagagagacgccagtgatggtgccaacgacgagggaagaggtggaggaatgggatgtggcggtagtggaagcaacagaggagaaggatgggagtttgaggccaaggaactgactgaggggcgtttggcttctccctcgaggaactag

SEQ ID NO: 69469 - DNA, 330 bp, Glycine max
  Peptide Sequence Number=SeqID_161154
atggagttagagcaaatcgatgtcaaaaatatcattctccatggacgactagaggaagacatcctgatgcaacaacctgttggcaatttagatgctgaaatcaacagggatcaagcccaagagaagttcttcctatgtcagaaggaatacgttcagaaagtactgaatcgttttgggatgacatctgcaaagcaagaagtaattgatattggactcgtctaccatggagacacatcttgtgctctcactggttacttagattttgactatgttgcaaacttggatggaaggagatctataactgggtacacattcacgattccttgttag

SEQ ID NO: 69470 - DNA, 546 bp, Glycine max
  Peptide Sequence Number=SeqID_161155
atggcaccgcaacacaaagacattactggagtaaaatgcacttacctgtctgatggcggccggaggagacactcgggactcacaggaacgagacgccaaattggggcaccagctgtaggaccgaggacacaaacaacgccaattgcaacgtcgggcaagagctctcaacacaggaatataccaaatggatggcctaaagaagtactaagtgatgttgaaaaccttagagaagaaaagatagatggtgttttgaataaatttctagaagattcaaaagagttcattagaaaccaaaggttattggcccttagttgtgcctacatgtactatatcaaaagttgttgggcctacacaaggattttggccaagaagtacccttcattttgcatcaatgttgttcctcctggccatgtgaaaacagatataaacgacaattctggtatgctagcacctaatgaaggtgctgaagctattgtgaggttggcattgctacttgatggcggtccttctggcctcttagaactgaagaaaaatcattttgattaa

SEQ ID NO: 69471 - DNA, 354 bp, Glycine max
  Peptide Sequence Number=SeqID_161156
atgacaaggactaagggcaaggaacctttagaaggacttggagggcctatgccaaaggctaaaataaagaaggctaaggaagctcttcaacaagcttgtggctgcctctttgatgcaagctccattggagcttgtaggcctaggatcttcttcatcaatggattcctttgcttcttggaagatgaatggcagcggaatgaagaaaggaagagagagaggacacgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 69472 - DNA, 705 bp, Glycine max
  Peptide Sequence Number=SeqID_161157
atggagaacttccctatgatcaacttggagaatatcaatggtgaggagagaaagactatgttggaccaaattcaacatgcttgtcagaactggggattttttgagtccaacagtttacaaccaagtttcattttgatttctcttaaacaacttgggaagctagattacttcttgggtattgaagtcaattctatggttgatggttctattcttgtaactaaaagatgtttgagagaggacttatgctcaaagaaaaggagtggaagctattctggagagaccataaaaaggcaaaggggttttgacctagaaaggcctgctgagagagacattttttatggcggctatgatgaacatgaggcaggacttacctcctacactacactagagagatgcaaaatatgcagcaacaatgatgatggttatgatgaagacatggaagtggatttgactctaagcataggaggaggaagccaagttaataataacaagaatagtagtagtaagaaaccttatctgcttccattagggtgctcagactcacccaataggaaaactaaggacctaaattcttctgtctctttccaatcctacagggtgggagatttcagtgaccccaccacccctatgagcagctcaagtgtgacatttgatcaagagagaaaggggccacattggctttctcaaggtttaaagcttaaatag

SEQ ID NO: 69473 - DNA, 225 bp, Glycine max
  Peptide Sequence Number=SeqID_161158
atggctttgttactaccctcttgggcctttctactttttgcatctgtgttgcatgttctgctactcttgtttctgcttcagctagttcttcttccttattactctgctgtagaagcaaagcttcatgatgatgacaaaggtgatgacataaagctcaacgatcaatcaaagaacaactcaagtaaatcaaagagcaatcaagaacaattcaagagttcaagataa

SEQ ID NO: 69474 - DNA, 1602 bp, Glycine max
  Peptide Sequence Number=SeqID_161159
atgccttattttggagtgattcaagaaatatgggagcttgattatgatccgagtgactctagatggtcagttgttctacaagggaaaataagtggtatccctaacaatattgatgcttcaacacttgatgttaacgagatgcctatgttttccccacaaatgccttccacaaatgttgaaaatgacgaggaagatgtacatgcaaattttaatgatcatgatgaaggagccatggcaacacccccgagttcccctccacctttagatgctccaagcgcaactacaaaaaagaagactagacaaactacccggctcagaagattgactagcaaaagcttggatcagccacgacctactgtcaatttcaaccctattattggtaaaggatctagccaccataaagaaaaattccatagttacctaggggtagtagcacaagaaaaaatccctattgtacatcccagttggaaagttgtccctgaatctctaaaaaatctaatatgggatgacattttgggtaaatttgacatccctgaaggatccactgccaaaaagaaggtcatgtcgacggttgccacgagaaggaggcaatttaagtcctcccttaccactaaatatgaatatgttgacaaagacggtgaagataaccatgatccatctactaagtatggtctaaatctgaaaacttgggaacaatttgcaaagagccaacaaacccctaattggcaggacagttttgtgccaaatggtcgtcaggacatactaaatattgcgcttggccgaccagatcatcctggtcgtgttcgtgtagctggacatggtgtcaccatcagtcattactttggagaggcatcgtgtggctccaacacttcttcggcaacaatcaccccagatcaattggttgaaatgataggaaatctaaaggaagagtggaagagagaggtagaagaggaaaatatacggatagatgcgcctgaccctggcgtattggctacacgtgtaagcaccaaaggaaactgtgttgaagctgctggaaatgttgtagctgaggagccttctgctattgatgtcattactatgggcttgtacatagctggtgaggagtgtacacaactagtggccttgggaaaggtgtttgatagtgccgccacgatacacaatgtccctcacacagatgatgtgatgagggtcccatttcccacgtcagagattttatatgttaaggaggccattaacacattcattggatggccgacacatcttgtgaaacctatctctaatgattcagaccataatatgccgaaaccggtgggacgtgttgatgggtgcaatgcaggtgctgtagaggatccattgggaaatttgatgaagatattgtatgacgtgtaccagaagccagtggaactcccattggatgggacaaaatttgggcttccaaatgaaaaagcaagatttttcatcacacatgctgatgtagctgaaataatagcaggtttatggatgactgcagtagaagtagaggtcatggttcagtgtatggtttccttgagccttagtctatacacaatgctaaggatagactgtgaatgtatgaatacatga

SEQ ID NO: 69475 - DNA, 195 bp, Glycine max
  Peptide Sequence Number=SeqID_161160
atggaaaaggcacagtctagggaaaagctccatcaaaaggtgtggggattatctcgtccatctcgttatgtccctgaaatcctggcagctttcttctggacagtcccagctctcttcaatcattttttgccttacttctatgtgatatttcttaccatcattctctttgatcgagcaaaacaagatgatgattga

SEQ ID NO: 69476 - DNA, 942 bp, Glycine max
  Peptide Sequence Number=SeqID_161161
gaatgcgctacactagatgttgtgtatcaaccttggagtattcaatatcttgagactgagattagttatgagctaaattctagactaactcctttgttgccaaggtttcatggtcttgcaggtgaagatcgagaccaacatctgaatgagtttcatgtagtgtgtttcaccatacaagttggacagccattcagacctcaacaacaacaatataatccttactccaacacctacaatcctggttggagagatcatacaaacttgagttctagaccttccttggaggagttgataaagcaaatgaacatcaacaacattcagtttcagcaagaggtaatggccaccagcaaagacttgcatactcagattggacagttagttacaacagtcaatcagttgcaacgacaaggttccgacaatattcccacattgccaattatcaatccaaaggggaatgtgagtgttgatgtcttgaagagtgacaaagagcttccaaagccagcaaatgttggtgccaaaattgatgatagtgccaaaatagattctgccagtgtagatatttgtacagatttactttctgatgtttttgatttttatgaatttgatcttggttcttttgattgtaattgtgataattctgatgagtctgctaatccaccttccttggagttgaaactgctacctgagcaccttaagtatgcaaagttcttgaaggatttttccaaaaagaggaagctgaagggaaataagcaagtgaagaggtttcatgaccataaaccctatattgtccaaaaagtgttattgtttaactctcgcctcaagcttattttcggtaaacttcgatctagatgggatgcttttgttattactaatgtggagaaggaatttgtggccaacctctctttggtcttgccaccaattttatattatgatgtgccgtga

SEQ ID NO: 69477 - DNA, 1815 bp, Glycine max
  Peptide Sequence Number=SeqID_161162
atggacaattatttcttcctcttcatcatcatcatcttcctctccctctccctcttccaccaccccatttccgcatcaaatctccacaaaatcaaacaactaactccaaatttcccccttgaacctttatcctccaatgaccctccaccactccccaccgaatacttcgaggtaacaacacccattgaacaccccaaaacaaaaccttgctcccaccacattctccaccacgacttcgcctacacctatggccacccccctgttctcgccacctacacccctccctcccattgccacttcaacaccttctccaaaatcgtgctccagtggaacgccacgtgcaaaggaagacaatttgaccgcatttttggtgtgtggcttggtggggttgagcttctcagaagctgcactgcagagccaagagccactggcattgtttggagtgttgaaaaggacatcacaaggtaccgttctttgttgttaagtccacaaaatcaaagctttgctgtttttcttgggaacgttgtggataaaacctacactggggtttaccatgttgatgtcactatgcacttttaccctttgggatattttgatggggagagctcaaagattggagttttagcatttgggggtggtgttcatgctgatttggtcctacccatttctagaaaccttccattgaatgatgggttgtggtttgctattcagaattccagtgatgagggtttgaaggagtttagggtgcctcagaatacctatagggctgttttggaggtttatgtttcatttcatgagagggatgagttttggtatgctaaccctcctgatgagtatctgattgctaataatctcagtgatgtgcctgggggtggttcttttagggaggttgtggtttctcttgatgggaatgtcgttggtgcagtttggccctttagtgtgatctacactggaggggttaatcccctcttgtggaggcctattaccgggattggctcgttcgatcttccctcgtatgatattgaggtcacaccacttttggggaccttgttggatgggaagagccattcggtggggttcagcgtgacgaatgcagtgaatgtttggtttgtggatgcaaatttacatctttggttggatgggaagagcagtaggacagaaggaggagttgtggatcttgttgccaagcctttggttgagtctctggtgagtgactttgaaggtttgaatggaaagttctggactagtgcaaggaggtccgttttgtctgctggttgggtcagatcctcatatgggaatgttactaccagttttgtccaagattttgttttcaacaattcaatggtgatggggaagaatgggaatcagcaaattgtgaatcaagtgattcttttcaatgacagtgttcatgctaaccttccatcaccctttgttaaggacacatacagaaaattttccctatacttggacactgacgaaatggatcagggcgatgatacttatttatccgtttcaaatgttacattgggatttgatgtggacaagtctacgagctcggcttttggattttcaaagagctctctcaaaaatgtgcaggatgctcagggtactatggttatcaaagggaatttggttgttaggggattgggtgaaacacagcaagattacagttacacaagtgatggatactgctattctaggaaagttggcagctcaaattacacaattctttacgacaaagtcagacattcgtgtaacaaaagaagtcactctcatcttggtcctcattctatcaaaaagttgttcattctctag

SEQ ID NO: 69478 - DNA, 1026 bp, Glycine max
  Peptide Sequence Number=SeqID_161163
atgatttatcctgaacgagttttaaagttaagagttcgtggaacaaagaaagatttgattcaagatacctcctcagaagagttttgtctcattatgtcaggtgtaattgcccgttttgatggctctgatattcagaatatgctgcaaaaatggtttgaagaagcaaactctcgattttcagatcaaaacccaaagagccaagattcagaggattttgaaaatactgatgtaaaaataccttaccagttatggaatattggcaagtatggtacttgtgctgatgcagcaattactggcataatgccccctccacttatggaacaacaacagtcaaatcaacgatattattgtgcagtggctgttggagaggatgccgtgatttcagcatacagactttctgagaacaaaggcaggtctttagtgggagctatcttgtctaaagttgtacctgcaacattttccactataagttctttttctaagttgatatggcggaatgaacggtcgtctccaaagaagtcagatctgaagcctcggccatttgctcgagcttcacctctgacatgtttaaaggatcaccctaggaaaggtgagaagcttaccttatcaccaagtggtacattggcagctataacagattcacttggtcgcatattgctgcttgatactcaagcacttgtggtggtgcgcttatggaagggatatagggatgccagctgtctattcatggagatgttggtgaacaaagatatagcatcatcaagctcttcttattctgaaccattgaagagtgattattgcttgtgtttggctattcatgcacctaggaaaggaattattgagatctggcaaatgagaaccggacaacgtcttagaacgatttcgtgcacaaaaggtagtaaaatgttacaacccagctacaggtttggagcatcagtgtcctctccttatgtccctctggaagttttcttgttaaatggggactcaggtcagatatcagtcttaaatagaaccttggattcttga

SEQ ID NO: 69479 - DNA, 387 bp, Glycine max
  Peptide Sequence Number=SeqID_161164
atggttgtgaagaagaatgtggttgagaggtataagaaagcagtgtggtggtttgagaaaacattagccttggtaccaaccactttatctgaaatttgggaatcgactgtagtcaatcttgcacatgcatacagaaagctgaagatgtaccgagaagcaatttcatattatgagaaagcacttgcattatcaacaagaagtgtgagcacttatgccggtcttgcatatacttaccacctacaggatgatttcaccacagcaattgcatattatcacaaagtgagtaactgtgcttgtatccatgataatgaacctatgatgcactccattcaactattgagacccatgaacattgttcaagagataagtgcaattttaagatgttga

SEQ ID NO: 69480 - DNA, 192 bp, Glycine max
  Peptide Sequence Number=SeqID_161165
atgcagaagcttcaggaaaaggcccaaactccacttcaaaatctgatttcaagcttaaatatgtggctttcggaaggactgaagcggtgcacttatgacccttcgcttagtgcaaatgcacaactcatccttctttcaaattcttcctcacgctcagccaaggggtgttgcgctcagcggatggctcgctaa

SEQ ID NO: 69481 - DNA, 327 bp, Glycine max
  Peptide Sequence Number=SeqID_161166
atggctctaaagaagctttctgctaaaagggctaggaaggccaccgcagaggagggatccagtgtagccccacaagcggaaattgagtttgatagacaccatttccgaagtgaggagcatcagtgttgtttagaagtgattaaggattggtctttcctcaaagaaagacggcccatggctaagtatgaccctgaaatagtcatggagttttacgcaaatgcctggcccactaaagaaggagttatggataagtgctcctggaggggcaatgttgtgaatgcgctgaaaaaagaagccaagtctcaggttttgatgaagaggccatag

SEQ ID NO: 69482 - DNA, 1312 bp, Glycine max
  Peptide Sequence Number=SeqID_161167
cattgttcttcatgatgacacccctgatacttatatttgggatccagcaaccgacgatgtttataacactcgatccacctacaagtgtggcgctttggaggaggatattcttcatgtgttgcgagattgcaatgaagctaaaatcacctggagaatgcttgaccttgaaaacaaccaagactttttcactctcaatttcttctttcctcaggccttttgtttgcttgtgcttgctgatagctttggagggctaggaatgacacgattttttaagacaagatccaacctcagtgcatggggacgcctgctaggtggcgtcccctgtttctggtactacacgggatgggtacagtcagaggacgtcgttgacttattgggtaggacaaaccaagacaaggacgacggccttgaggtggtaggaatgatgcctgaggaggaggatgaagaggaggcaaaggagattgaagagattgatgccttgtggaagtgttgcaaaacgtttcggaggttgtgtgaggtttcgttctcggggagtgtgaagaggatgtcgtgggaatggttgtggaggttgttgttcgaagtggcaatgataacgaggaaatggaaggagtggagacgttgtgtgcagcggcacgtgatcgggaacgccaaggaagcattccgtggcggagagttttcggttcgagaaacagttcaaaccgaatggacgcaaatctcgtggtctccccctcatccattcaaggtgaaactcaaaattgatagcagctccttggataacccgggaccattgggatttggaggaattattcgtgattattttggcgcttggcttgcgggatttttcagaataatagattgtgaatcagattcacttgttggtctcaaccacattgctgaagataacgaaggaattatgtgcgctaacgccctggctcgtcgtggttcttcctcgatggattctttgattacttgggactcttgtcccccttttgttagctctcgtcttttagctgatgctttaggggggttctttcggcatagacactgtggtgtgaccgccagcctcaagacagagttgtttgcccttatgcatggtctccgcaaagcttggaacctgggataccgtaatatcatgtgccacacagattcgaagttggcactggatctattagagacttcctcacgcttgactggaatgtcacccttcatcatacgttgcgggaagctaactcctgcgccgactgcctcgccaaatatggtgccatgcatcacaatgcaatgctcacttgggatcattgtcctccacctctag

SEQ ID NO: 69483 - DNA, 828 bp, Glycine max
  Peptide Sequence Number=SeqID_161168
gttgatgtggcttgtcaagcccctaatcctggacaagtgttgtcgggctgcttctgtcaagttgtttatgatggacatgtctttggcgtgtcagatgttacattcgtctgctattgtaagcatgtgtggcacacgcgtaatactcttgcatacgtgtcacccacggagtgggcatatactggagtcgtggttcgtgcgcgagtgggggagtgtcgtggtgccttcgacagcgagtccttctcttcggagagggtgagagccttgggtcgtattggtggaggcatttctcatccttgtgggagggcgtggccttcagctgctatcgaggagcttgtcccgatcactgtgatcctccctttttttgtttctggtggtgtgaggataggtagtggcggtggagatgtcagggcatctccccgcgtggacgatgttctgaagtacaagtcctctctgacctcggcagcaagtttcgctacgcttcaacgccaggtgaagttggcaaagctagtaaagcctgaggactcttgtaagttggtcgttcaaggttgtaggagtgatgacttccctttcttgagggcggtgcctggtatcattctcctgttgaacgttttccaatgtgctctacttaagcacttgaatatgtccccttctcaattccacccaaatagtggtgcaatagtgagggcctttgaaattctatgctctttcttcaacatccaacctagtttgtcggaccgtttctttaaggtcttggctactggtgtcgtggttgatgctatgccactgatgttcaacagggacaaggagcctcgcttcccgttctactaa

SEQ ID NO: 69484 - DNA, 106 bp, Glycine max
  Peptide Sequence Number=SeqID_161169
agcttccttggctttccttgctctagcccttgtcataggtcctccaagtccttcaagtggatccttgggccttgctcttggtcatgtcctcatcaattggacctag

SEQ ID NO: 69485 - DNA, 372 bp, Glycine max
  Peptide Sequence Number=SeqID_161170
atgaagtggttctacatgatatctcacctgttgatgagtcagacacaacctggggatcctccaagacatccatccatggtgcacaatgatacatttattgaaccaggtcctcctcaacaacctgttgccgcaacagctatgccagaaccacttgcacatgcacttgctgatgtagacatgtctcgacatgcagtggaggcttgccaatggatagcagaaaggttggaacacttgatcaacatgaggatagttactgctggaactgaagcatacactgtgaccgagcagtgccagggaatcactaggggtgtcactgagcaacagaatatttatgttcggttgagacgaaggcggcacacgccggacgcatga

SEQ ID NO: 69486 - DNA, 306 bp, Glycine max
  Peptide Sequence Number=SeqID_161171
atgaccactttcaaagacgttgctgaactttctaagacggtgttaaccccaacaacgtctttaaaagtaggctttcaaagacggtgcttacatcagcaacatcttagaatgcccactttcaaagatgttgctaaggtgatgacaaaaagctcaaaggtcaatcaaagaatgagttcaagaaagatagaatcaagaaagaatgagttcaagatagaatcaagaacacttcaagattcaaggatcaagcttccaagaatcaagatcaagattcaagactcaagattcaagaatcaagagaagacttaa

SEQ ID NO: 69487 - DNA, 216 bp, Glycine max
  Peptide Sequence Number=SeqID_161172
atggacaaggcgagaaagaactgttggaacccgaatgatcacatggtcactttttcgaggacccgcaaggcatgggctcaaggatctgaggctccttcttcttccgctcctccagctccagctcctccaccagcaccaccagctccagctcctgccactccagtgccttctggcagctccgctcaaactgcagagatcctagtgttgatgctttag

SEQ ID NO: 69488 - DNA, 1015 bp, Glycine max
  Peptide Sequence Number=SeqID_161173
atggcacgtattccaaataagataaagaacattaatggatcaaaagaaacacttaaactagctgttaggatcactgatctttggtttgttgggacctccaacaagtctgaacaagctgaaatggttatagttgattccgatggtgatgaaatccatgttgtttgtaagcaagatcagctaaagtcctggaagctagatttgaaggaaaattttactgttgttaggcaatctaatttggatggtcttccttataaaaaattcaaatttgctgaattttccaatgtcattgttggccacttccaacctggcctattggttgatattattggcgtcgttgatgaggtgatctttcgccatgtttcatcaagaagtacaaggattgtttttaaactcaatgacttgagtgaccaattactatcttccactctctgggatgcttattgcttgcagttcctacaatacttagttgagattgaaaatgatggccccataagtgttctattgaccaatgccagaattaaagaaggattctatccaccctcgatcagtaattctttgaaggcctcaaaattacttattaatcaaccggtggttgaaattcaagaattcaatcagaggtattttagccatacacctcgtggtcaagggagttcacagctttcaggttctactcaattatcatcaaaggatgtatttctttcaaaggctgaggcaaagagcctttcagaaattaacaacatttcggaggttcaaccaaagttcaagaatgttgttgtgcttaaatactcaaatgacttaagtttgattaacactatgatggacatgttgcctgatgctgatcaatccctatctgtaacagtagatcatgatccacttctcggactctgtcgcaatgtgcccttttgcgggcgagcgaaggcgaggctcacgggtgcgctttccaaaggaggaaagatgcgcggagtcgccaccaacgtttatttgtggaaaatgtcggaaaaaccgaaggaaaccg

SEQ ID NO: 69489 - DNA, 255 bp, Glycine max
  Peptide Sequence Number=SeqID_161174
atggtatcagagcaggttctgcccggtggtgtggtaagtgtcgctagccctcgctttatggtgacgagccctgactcgagggggcgtgttgcgagtcccacatcgggtggggatctttcgggtgcctggccaaactttaacatggtatcagagaaggttatgcatggtggtgtggatagtgccgctagccctcgctttgtggtgacgagccctggctcgagggggcgtgttgcgaatcccacatcgggtgattaa

SEQ ID NO: 69490 - DNA, 138 bp, Glycine max
  Peptide Sequence Number=SeqID_161175
atgagcttcagggaaaggattgctcccatcgtgaaaccggaggcatctatctctaggaaaaacgaaatggtgaagtcagggagatggaatgacccttgggataacatagagaagacaacttccaagtgttggagatga

SEQ ID NO: 69491 - DNA, 1318 bp, Glycine max
  Peptide Sequence Number=SeqID_161176
gccgttcgacatgactgctgtggcggcacggacggcagatttcggatccgccgcgattgagcatcgaccgtacgtccacgcctcttcgcagcacagcacatcgaaagaaggacgtggtcgcggactggtcttcgggccggcgtcggacattccccatcgatgcacgcgaacctcaggaaaggcgaccgccggcgctgaggatgctgcgcgtcacggtgaacttcggcgtgcgctcgagctgctcggtcggaccgatcagtcgcgtcagttcggcgcgatacccgagagcggagttgtacaccgtgaagagctctccgccggggcgcaggacacgcgcggtggcctggaacagacgggtggccgcgccggtgtggacactcgccccgaggtggaacggcggattcaacagcacggtgtccacactcgcgtccggaagctcggacgcggcgtcgtcgtgcatgaccgtgacccgctccgcgactccgttcgccgccgcggtcgcccgcgcagacgccgcgggcgccgccgaccggtcggtcgcgatgaccacggcgtcggggtgggtgagcgcgtaggacaccgcgagcgcaccggttccgcaaccgagatcgagcacccgggtgggtgcgaggccgtcggcgccgtcggacgaggatccgtgctccggcccgcgggaccgtgtgcctggccgatcgggggtgttcgccgcgcgatgtgccccgtcgaggccgagaacctccagcagcactcgggtgccgatgtcgagccgtgcacccgcgaacgcgccgccgtgggcgaccagggtcagcccgtcgtgctgcgccgtcaccgggtacggcggatcgaccggcacgtcgcgcggctccgtggcgacgatcagccgggacttccgctcggcgcgctgggcctgcacctgcgcgaagctgcggcccagcacgtcgttctgagcgagggtcatgtgcttcacgcggccgcccgcgatgagcaccgcgtcaggggccgcccaccgtgcgacggcgtccgcgatctcctcgagctccgcgagcgccttcggcagctgcagcagcacgagccgggcaccggccagcagctcggcgtcgaggtcgtgcgcgctgaagccggcgagcccgagctcctcggcgttacgtcggagtgcccggcggccggtcacgaggtcctgatgcacacggatgccggaccctcccgccgcgacgagcgccagcgtgatcgccccgtactcgtctccgatcacgacggtctccgcccccggtgttccgagcgcgagtgcacgttggaccagcagcacgtcggtcgcgtc

SEQ ID NO: 69492 - DNA, 603 bp, Glycine max
  Peptide Sequence Number=SeqID_161177
atgaccaccctgacgtggatgacgttgctatttagcaacattctgcctggcaaccacaatgccaatctccccctgcagatgtatcgggatcgcacccacaagtcgcccagtgggcccgaagaagtccaacagggccctgggatttccagctctggttatgggcctctgtcagtcctacagggtgcccgttcccccagcgagggatcgtgcccacaagacgcccagtggacccgaagaagtccaacggggccctggggtttccagctctggtttcgggcctctatagtcctacagggtgctcgtttcccccctgcagatggatcgggatcgtgcccgcaagacacccagtggacccaaagaagtccaacggggtcttggagttgtcaagctctaattacgggtctatgtcagttctacggagtacctatcacctccagcaagggcatcagaccccctactaatcaagcttttatcaagaagtactgcgtccccaggcaggcgcagggcgaaacaccacagcagcctggggatggccggcagcgggcaacagacgcatcgccatcacctctagagttcacctcagctcatccacaaaaaggttag

SEQ ID NO: 69493 - DNA, 636 bp, Glycine max
  misc_feature (592)..(592): n is a, c, g, or t
  Peptide Sequence Number=SeqID_161178
atggccctgaggaagcttgcctcgaagagatccaagaaggataaggcggccgaaggaactagttccgctcctgagtatgacagtcaccgctttaggagcgctgtacaccagcagcgcttcgaggccatcaagggatggtcatttctccgagagcgacgcgtccagctcagggacgacgagtatactgatttccaggaggaaataggtcgccggcggtggacatcactagttacccccatggccaagttcgatccagaaatagtcctcgaattttatgccaatgcttggccaacagaggagggcgtgcgtgacatgaggtcctgggtaaggggtcagtggatcccgtttgatgcggatgctatcagccaactcctgggataccctttagtgctggaagagggtcaggagtgcgagtatggccagagggggaaccggtctgatgggttcgacgaggaggccatcgcccagatactatgtataccggggcaagattttgctcggactgctgctgggaggcgggtgcggatcatgcgcaccaacatgaccaccctgactcagatatggatgactttgctgctcagcaacatcctgnccaccaatcataattccgagctccccctgccgaagtgtcagctg

SEQ ID NO: 69494 - DNA, 297 bp, Glycine max
  Peptide Sequence Number=SeqID_161179
atggccaagtttgatccggatatagttctcgagttttatgccaatgcttggcctacaaaggagggagtacgggacctctggtcatcggtgaggggccagtggatacctttcgatgcagacgccctcaatcagttcctgggatatccgctagtattggaggagggccaggagtgcgaatacggtatgccacctaccaggcaccctctagacccagataagtctaacagggccctgggttttccggcattgatcacgggtctctgccagtcgttcggggttcctgtcacagctagtaag

SEQ ID NO: 69495 - DNA, 240 bp, Glycine max
  Peptide Sequence Number=SeqID_161180
atgagggttcactgttatcaagcaagtcggagacctagcatgatcacagattcacctccactctatatgttcccatggacccggtggagtctccaactgtcgcaacctacccttcggcgggagggcgacgcgaggctcacgggtgcgtcttctaagaaaggaaaatgcgcagagtcgccaccaacgtttattcgaggaaaacgtcgaaaaaaccggaagggtgtggtctacgaactttaa

SEQ ID NO: 69496 - DNA, 303 bp, Glycine max
  Peptide Sequence Number=SeqID_161181
atggagtcaggtgacatgcgggggtactgtatggttacccgcaccttttgtcaaccaggggcaaatgagttcgttgacgcgcagagactaacatcgtcttctgcacattttgccatccagggacaacgcgtcaggtggcaagcggagataccttatggtcatctgcatctctcgtcaaccaaggggaacgaattcgatagtatcaggatgatgtttttaccctcgtcgtccggagacattcaagcccaacaacgcgtgagattattctctgctgggcggggacgatcgagtgcgatggcgtag

SEQ ID NO: 69497 - DNA, 192 bp, Glycine max
  Peptide Sequence Number=SeqID_161182
atggcggctcgacgacaagctccggttaaaacgttcctcttggtgtggtgggtttgggtgggcatttgtgatgcaatcctacccccccaagggtattggatagaagactccaagaagattggagccagagatgcaagagaaggccctaaggttctcatgagccttggggtagatttcgggcccatgggctaa

SEQ ID NO: 69498 - DNA, 341 bp, Glycine max
  Peptide Sequence Number=SeqID_161183
atggctctggaatggtggtcccagaggaagcatcatgtacctgtcagggttcctggccaggctaccctttccagaaattgctcaatggaaggaatggatcctggaggcgccaccacctctgctgaagtggatgttggagtaggagttgcagatgtggaaggaagatcagctggcctcgccctcgccctcgccctcctagcccctcggatagaaactgtcagatcatcaggattccaacagttcttcctgattgataagagcagaaacccaagtctagaagagttagactgggctatagaagtcatctggcaagaaatgagcgctcctatgttcatgtccat

SEQ ID NO: 69499 - DNA, 300 bp, Glycine max
  Peptide Sequence Number=SeqID_161184
ttgcttgtcatctttgttgtgactattgctgttgctgctgctatattggaggaggaacatatggcttgcttggaccagcaacattctggaaaggagggacaggctgttgttgttgttgaggacttgtccatttcagatttggatgattcctccaacctggattgtatctattgcttgaaaggtcataattactctgttgttgttggttttactgctgaggagattgctgcaaagaaggatagagatctgtatggtgatctacagaagaacatagaccacagactcttgcaacaggtgtag

SEQ ID NO: 69500 - DNA, 432 bp, Glycine max
  Peptide Sequence Number=SeqID_161185
atgaataaggcattgcgattaaatgctccactaccatatccacagcttgttactctatttcttcgtcattttgaaattcctcttgattctgaatcttatattccaatcaagagatcctttttaattggtgctactgcaattgtttcttttggttaccacaaagagcgtgatggctcttgggtcaaaaagggcactcaacccgctgatgaagaaggcaacctcccagatgaagataattccactcttcttcgcaggcttatggacaagtttgatggacttcagacttttgttggtgacaagtttgatgccatggaattacaagttgacatgaggttcgatgctatggaatcaaggatcaccagagttgaagaagatgtctctttcatccgaacttgttttgatccaccacctccgtctccttcatcctcttag

SEQ ID NO: 69501 - DNA, 537 bp, Glycine max
  Peptide Sequence Number=SeqID_161186
atgatggttgtgcggcaatggctccaaagaagcttctctctaagaaggcaaggaaggaggccattggagaaggatccagtgcggccccacaagcggatatggaatttgacggacaccggtttcggagtgaggaacaccaacactgctttgaagcaatcaagagttggtctttcctcaaggagagacgaggtccaattgagagagggagagtatgttgagttccaggaggaaattgccaagaggcagtggactcaacttgcggggtccatggctaagtatgatccaaaaatagtcatggagttctacgataatgcatggcccatagaggaaggagtgagggataagcgctccgggtgcggggccaatgggtcccctttgatgaagatgccattaatcagtttttggggcatccattggtcctggaagaggggcaacattgcgagttcagtcagaagaggagccaagcctcaggatttgataaggaggccatgggctagctgttatgcattccaggataggactttgcacagagtgtga

SEQ ID NO: 69502 - DNA, 231 bp, Glycine max
  Peptide Sequence Number=SeqID_161187
atgtgtctatcggggaaggagaaggaagcactgggttcaacaaaaatagaagaaaatcactcaaagtgtatcaatctcacacagggtaaggattatggtgagttgggattttggctcaaggcttgtagaacggctggtcatgatacatgtcaggatttggccaacggttcggggataaaggggatgtccccacattattcccatgatacacatgcaacaaatgatgattag

SEQ ID NO: 69503 - DNA, 234 bp, Glycine max
  Peptide Sequence Number=SeqID_161188
gtcacaggttgtaccatttgtggtgaagctcatgagacaggccaatgcaatcccactgacaataacactcaagaaattcatttcatggggaatcaacaaaggcaagggaccactcaagaagggtttttaggcttcctgcaaggtccttataatcagcaagggcagtggaggacacaccccggcaaccagttcaataaagaccaaggtggatcctcaaacaggccaattcaataa

SEQ ID NO: 69504 - DNA, 415 bp, Glycine max
  Peptide Sequence Number=SeqID_161189
ggaaagggaagaatcaaaagaattctcagattgtgtcgttttgaattctttgacatgggagaaaggagacacaaaagaattcaggcggttactcctttgttcttttggaaaagggagaagagagacacaaaaagaattcaggcggttagtccttggcaaattctttttggcaaagggagaagagatgaaaagaatgaatagcacaagttttcaaggtttagaaaaccagaaaactttggaaagcttttggcacaaagaagaagaagaagttcaaagagattcaaagattgaaaaggattgtattgtaaaggttgttcaagatactagaaatgcaaaacaaagccttgcttttatagactcttcatgtctggtcaagacaaccattagaagagttatgacttttagaaaaacttaa

SEQ ID NO: 69505 - DNA, 575 bp, Glycine max
  Peptide Sequence Number=SeqID_161190
atggaaccaaaatattgggacaaaaatcccttcaaagcaaccgccaaagtctttccccaaggattccattataggccaatagccctcaataaaactagaaagttctatgaatttattctagtagatacaaattcagtatccatcaagcatttcaaagactcaaaagatccaagcttaaatacccattccacaatccaaattctgaaagtaatgcagccacgacattacgggactaatcttaaccagcccaaaaggttttctgcaccttttgacccagcaggatacacttattgggactatattgatgcttggaccaatgtgttttggcatcagaacaataaattcaagcattcgtggttgatttatttcaaaaataatactgtatacaattttccaaactggtttctccaatggtggacttattttggtccaatcccacaactctttccagaagaagtccaacaaggatttcaacagttcaatagattgttcaacaaccaagaatcaagaattccagccgatctaatgtatttttctagctttgctttgtcatggatcttttcatggccatacag

SEQ ID NO: 69506 - DNA, 807 bp, Glycine max
  Peptide Sequence Number=SeqID_161191
ttggaactcttacgtgccgatcaacgtctcattttcgccaaaagttggcccagggcttcccggtatcaacagggacaccaggatttatttattctgcgaagtgatcttccgtcacaggtatttattcggcgcaaaagtgcgtcggtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 69507 - DNA, 306 bp, Glycine max
  Peptide Sequence Number=SeqID_161192
atgaccaccctgactcagatatggatgactttgctgctcagcaacatcctgcccagcgaccataattccgacctccccctgccgaagtgtcagttggtgtacgccatcctgacgcggatgagcattcatgtggctcagttaatcgctgatgccatctatatatttgtaggtatggcgcctaccaggcaccctctggacgcggataagtccaacggggccctgggatttcccgctttgatcacaggactctgccagtcgttcggcgtccccgtcgcacctagcaagttgatcacagggcaatcatga

SEQ ID NO: 69508 - DNA, 1116 bp, Glycine max
  Peptide Sequence Number=SeqID_161193
gcgcagctgaacaagaaaatctcggccatgccgcagacccagcaggagattctgcgtctgacgcgtgacgtgcaggccggtcaggaaatctacatgcagctgctgaaccgtcagcaggaactgggcatcagcaaggccagcaccgtgggtgatgtgcgcatcatcgaccgtgccgaaaccagcaccagcccggtggcaccgaagaaactgctgattattgttgcgggcctgattgtgggtctgatgctgtcggttggtctggtgctgctgaaagcgctgttccaccacggtatcgacaacccggagcagctggaagagctgggcatgaacgtctacgccagcgtaccgctctccgaatggcagcgtaagaaagataccgaagcactggcgcgacgcggcagcaaagagaagtcggatccgcacaacacgctgctggcgctgggtaacccgactgacctctccatcgaagcgattcgtagcctgcgtaccagcctgcacttcgccatgatggaagcgaaaaacaatatcctgatgatcaccggtgccagcccgggtattggtaaaacctttatctgtgccaacctggcgacgctggtatccaaagcaggtcagcgcgtactgttcatcgatggtgatatgcgtcgcggctatacccacgagctgctgggtgcggataacaagaccggcctgtctaacgtgctgtcgggcaagagcgagttctcgccggcgatgattcagaagggcgtgtacggttttgacttcctgccgcgcggtcaggtgccaccgaacccgtctgagctgctgatgcatcgtcgcatgcaggagctgctggactgggcgagcaagaactatgacctggtgctgatcgatacgccgccgattctggctgtgaccgacgcttccatcatcggtaagctggccggtacctcgctgatggtggcgcgtttcgaaaccaacaccaccaaagagctggatgtcagctacaagcgcttcgcccagaacggtatcgagattaaaggcgtcatcctcaacgccgtggtccgtaaagcgtcgaatgcctatggttatggttacgactattacaactacgaatacggtaaagagagcaaaagctaa

SEQ ID NO: 69509 - DNA, 464 bp, Glycine max
  Peptide Sequence Number=SeqID_161194
ggccacagcagcagcaccggaccgaagggccagcacgccaatcacttcagagatcacccaggtggagaaaaacggcagcgaggcgtggccgtcaacgtgcagcatccatagcgccacgacgccgcccagcagcggcgcgatcaggcccgcagccagcgcaaagcgtatccagtcggccacgcgcgcaacatcagcccgccgaggatggcctgcaccatattaaggatggcgaatttgacattgctcagagccgggccgatcaccagcagattggccagcgccgtgccgagcacgcagctggccagcagcagcggtacctgtcgcgaggggggggcggaacaccacgacggtcatttaacgcgggggagtaccagagcggggaaatgcgggccgctgacgacaatcagtttccagacagaacagcgtcagtaaaaatgccagcgcgcaaagcagcagggcgctga

SEQ ID NO: 69510 - DNA, 504 bp, Glycine max
  Peptide Sequence Number=SeqID_161195
atggtgaaagttggaacctcttacgtgccgatcaacgtttcattttcgccaaaagttggcccagggcttcccggtatcaacagggacaccaggatttatttattctgcgaagtgctccagtggcttctgtttctatcagctgtccatcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgttgcaaggcgattaagttgggtaacgccagggccgttctaaaactagtggatcacccgggaagcaggatttccattcactacgcatggctccaaactcgtgggtggaggatgcctgaacgaaaacgcaattcatggggctccgaaaaaggggtagagaatggagaattgcactaa

SEQ ID NO: 69511 - DNA, 987 bp, Glycine max
  Peptide Sequence Number=SeqID_161196
atgttggtggcgactccgcgcgtattcctttcgtggaacacgcatcccgcgagtctcgcgtcgccctcccgccgaaggaaatttccaggatgtcacatttctcaattttcttctaggatcattctagaccctaagtacctagacatagatttcttcaatgatgagacatttgactgttatcaagtgtttcaaaactctggattgattgatttcatgtctttaaaattgccttactatcttgaacttgttaaagtcttctacagcaatttaaaaattcgggatggtattatttcttctgaggtgcatagtatttctatgatcattgatcaatctttgttcttttcattgacaaaattacctagtcaaggtgcaccttttgagggcatcattgttgatgactggaaatttgattattctagtcatgatgctcgccgtatggtttgtaatgaccaggctgaaatgaccggtagattgctggccggatcattgacatttgataattgcatcatgcactatattattgttagaattttgcttccccggtcttcaaatttggctcaagcctctgaggaggacttgatcttgatgtgggctttccttaccggtcatcagatcgattgggctcacttggttcggtaccaaatgcataaggaattacgggctaatgcacctctcccttaccctcaaattggtgctggtgcaatcacttcatttggttaccataaggatcgtaatggtcaatggctgaagaaagatgcacttcctccacaagatgagtgtactcctcctcctcctcctcctcagcgagatgattcagctcttatgactgaagttctttctgagttacgggctcttcgcacttatgttggtgaacgttttgattctttggataatcgctttgcaagaatggatatccgtctcacacagcttgaagaagatgtgggatatattcgtcagagcttcgatcttccatcaccaccttcttag

SEQ ID NO: 69512 - DNA, 195 bp, Glycine max
  Peptide Sequence Number=SeqID_161197
atgcctcaaaatgtctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtga

SEQ ID NO: 69513 - DNA, 438 bp, Glycine max
  Peptide Sequence Number=SeqID_161198
atgaccgttggaggaaacaagctcgccacaataaacagtttggattacctcaccagtgtctggaaatttgtgaatcaggtggtggctggttacctgccaagtgtgatattggttttatttttgtgcgcagttccacctgtgattattctattttcttctgtggagggttctatttcccgtagtgaaaggaagaagagtgcatgttttaaagtcttgctactttctttacaacttacgttttatcatctagttgggcaagtttggcagttgaagttatgcaaattttccctctactatgcaatcttttccagagattcatactcaggcttaaggaagatgcacgggatggaagcttatcttttccgtaccatacagaagttccaagaatcttactgtttggattccttgggttcacttgtgttattctggcacccttaa

SEQ ID NO: 69514 - DNA, 607 bp, Glycine max
  Peptide Sequence Number=SeqID_161199
atggctatgatatctcccgggaagatctaccagcctcctttcccaaagtggtctaaccctgacgcgacctacgccggatggctgacatttcaagaggattggcccaacatgaaaacaaacccgctcgccaatcatggagggggagcagttaatgcagtcgagtcgggtaggccgcgcaggtctaagcctttgaaggacgtgacgacccctaggagtggaggacctgttgcaacagatgatagatcgaggccggctggaagtcggcgattaggggaagacatagctccccaaacgccccgatacccctcagaagttaaacctgttccgtttccacaccgaaacagccacgcagttccgtggaggtatgcgcctccaagcgaaaggaaggaagaagccaccgacattagcacgttgtcggccaaggtaaccaatatcacggggcttagtggcgtgacccgcagcggtcgtgtgtttgcaccccctgacctgtcgacacaacccgcaaacgttaaagggaaagcaaagatagcggaagaacaaaatgacaaaacaatccccactctgaacgaggatattccagtgaaaggtcttccggagaaaagggatg

SEQ ID NO: 69515 - DNA, 582 bp, Glycine max
  Peptide Sequence Number=SeqID_161200
atgtccaaatatccgaatattagtggacactttgaagagttcttgaatgtcaaggttgttagcgtgcaagtattcagcatgactaaatacccaaacattggtgaaagctttgaagagttcttgaatgacaaggttgtcagtgtgcggatattcgacatggctaaatatttgaacactgatggaagttttgaagagttcttgaatgtcaaggttattaatgtcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 69516 - DNA, 1254 bp, Glycine max
  Peptide Sequence Number=SeqID_161201
atggaagaaaacgtgaaattgaaggagtctccgttcactggacaacaagaaaagccatctgcactaatcacttatttgtacattggccacttcttagcaagatggggtgccagaatgtgggaattctctgttggcttatacatgatcaatatttggccagaatcgttgctgtacgcagcaatatatggtgcagttgaatctgccgctattgctgtgtttggtcccataattggaagatgggttgataagttgtcttgtgtgagggttttgaaattgtggttggtgacacaaaatctctcttttgttattgctgggggctccgtagttgccttacttgtccactcttctttgaagtctacaaatttctccattttcatcttgctggtgatcataatcaatgtctgtggcggcattggtgtgctttcaactcttgctggtacaatattgattgaaagagaatggttgttagttatatctgaagatcaacccccagaattgcttacaaaaatgaattcggttacgagacgcattgatctaagctgcaagctgcttgttcctgtcatttctggtttcataataagctttgtatcactgaaagcatctgctataaccttagcactgtggactactgtctctgtttgggtggagtattggcttttcacatctgtatatcatggaattccagctttggtgcaaagtagccaaaggagaatggaaaggcttatacaatgtgatatggaaatgaacaatcaaactatggagaaagatagcttgcttcctgttactgatgatggctcagaattggcagatagaaaagccagaaaaaaaatttctgagaggattttagagattccctatattgctgcatggagagtttatttacaacaagaagttgtccttcctggactggctctggctttgctattttttactgtactcagagtcattgatgaaattccaattacttgcctcagctttggaactttaatgacagctaccttagaatgggaaggaatacctgaatatattattggaatatcaagaggaataagtgctgtgattggaatagctgcaacagttgtataccctgtgctacagtctcgtatatcgaccattagaactggactttggtctatatggtctcagtttcctccttccatgtgtggctgcaatatggatccaaaatggctttctatcatcatatattttgatgggaagtgtagccatatcgcggcttggattgtggatgtttga

SEQ ID NO: 69517 - DNA, 429 bp, Glycine max
  Peptide Sequence Number=SeqID_161202
atgatgcacagggtagcagaagctcttgatgctaatgttaaaaggtggtcaaggcaagtattgaagcatataaatcttggggactatttaagtcctagagttccaagcttgaaggggtgctttggacagaaaccaaacggcgaagtgaaagcttcctcattaaaattacttgcccacattatgcaattcctacaaaggcatgaattcagacttaagcatgatgattggatgaacacggcaaaacctgatcttcatcctggtgtttcagcacaattgcatgaaaaatttgaggtatctgatgcagagattgaaaactctaaatctgttagaagtgagatgtgtgccgctgtaaattcgcttttgaaggatattcgcgtgattcaaatttgtcaccatgagcaggtcagagcaaccacacgattcaaagaa

SEQ ID NO: 69518 - DNA, 1020 bp, Glycine max
  Peptide Sequence Number=SeqID_161203
atgagaagaggggtagataatcatcaagggatgacaaaggggagattgacttcttacttctcacatttcccagataatttcaaggagatggatttttggcctatcttgaagcagtatggaaagaatgttcttgctattaagagtatgactaggagctttgaacttgtatccaggttgagagttatttttcataagaactacttcgggatcatcgataagaaatggcttgggttagttggaggagggtttgtcatcctagaagtcatgaaggattgggtattaaggacattggaaattttaatgaagctttgcttgggaaatggagatggtgtttatgttaggagggagtggatctttgggaagatggtggttggggatggtcgtaatattagtttttggaaggatgtgtgggtagggaaggatactttgaaagccaaattctctaggctttttctactatctgagcaacaagaggcaaaggtaatagatatggggttttgggaggagggggagtggtcttggaactttaggaggtatggaaaagtatctggtgtgcagtcacgtggaacctatggaattgtagacacaactctattccgcttcggtccaatgggttgccaacctgaccttatgtctacgagatcttctataaggcttgcaacgcctaatgaagctcatatcatcttcgagtcgagtgatccttgtatccatggcatcgaaacgctcacccataaaagctcagaggtcgtggagctctgtgagtacttcagtcagaaaaaagtggaatcatccctttatggtggaggagatggggaaaataatgtggatgatcgaggagatgaaagagatggaggaactagtgcaggtgtttcagctaactttgaccggtggctttggaagagaattgaaaaagatgaagattgggctttgtttgaagcgatttggttaacaaaattagagagatacgcagatttaaagattggggaaggttttgcgccgtcacacgaaaggggagaatga

SEQ ID NO: 69519 - DNA, 215 bp, Glycine max
  Peptide Sequence Number=SeqID_161204
ggaagttgaagtcaaagtggttagagccatttgtgatcaaagaagtaagaccccatggagttgtggaattggtggaccctacagtagacacccttgagaaaggaaggatcatcaacggacaacgcttaacaatttacaatggaggccagtaccaactcgctaagcctcgctttaggcttagcgagaacgagcaatctagatgggacaatggatga

SEQ ID NO: 69520 - DNA, 663 bp, Glycine max
  Peptide Sequence Number=SeqID_161205
atgtgtacccacgccttgtttgcgtacttcgacagagacaacatagctctcaaaggacttgcaaaggttttcgatttcgtgtggtgttttgtggagaacaggttcttcaaggaatcaagtgaagaagaaagagagcatgccgagcagcttataaagtatcagaacattcgtggtggacgagtggtgctgcacccaatcacaagtcctccctcggaatttgagcattcggaaaaaggggatgccttgtatgccatggaactagctttgtctttggagaagttgacgaatgagaaacttctgcacgttcacagtgtggcagaacgtaacaatgatcctcaattggcagacttcattgagagcgagttcttgtatgagcaggttaaatcgattaaaaagattgcagagtatgtggctcaactgagattagttggaaagggtcatggtgtgtggcactttgatcaaaagcttcttcacgatgaagatcatgaaaatgtcctaaaaggatgtgttggaacaatagtttatggtaaatcgaaaaaattactggttgagttgcggacaatgtcgctttctttaagacgtttcatgacactgcctaatattgtgcaaacagattatcaaccacgaagttttcaggataaaacaatccagatcactatataa

SEQ ID NO: 69521 - DNA, 1890 bp, Glycine max
  Peptide Sequence Number=SeqID_161206
atgtggcacattaacaagcacgatggtaaacaagcaatagaaatggtgttcatggaccaaacgattggtgccactctttggcaagatctgtttcctgaatttgaggcaaagttgcattgtggttctacatatgtgattcaaaacattaaggttgttgagaatcattctgaatacaaagtgagtaggattccatttttggtttacttggtgaaaattacttctatcaaggaggccaaatgtcctgagattcctcctaatgtcaatgttattactcgatttgctaatattattgctgaggtagcaccgcgtgacactttagttgatgttgttggtgttgtggtcgaagtcattgagcatatctgccatttaagtgatggtgagatgatcatgaccatctgggaggaatatgctcttcagcttaatgatgctatagagaaaaatcattttgataggaagctattggtggttatgttaacacttgctaagatcaaagatcctaaagtaatgattgatacaccatggagctatgatagttgtccctactgtactaccacatttgatccattgaaatatggttccacttgttgtttgtgccagaaccaagttactgacggttccaagagtggtgatgagatcaaggttttccttccctgtgttgatgaattattgggaaagacttgggttgccatgttcaagtaccatgtacgaatgcgtcaatcatctatgttggatgttactgaagacgaagatcttattcagacaatgacatcaacaattggtctactggatgaaccaagtatagggaagggtaaagttgttgctgctgaaacttcatcacaagactaccatcctacgccttcattgtcacagccaactgattatgatcctggactttctgcgtttgtcactcctgccaaaagaatgtcgatcagcaagccagtaatgaattccaaatattcatttgacaacataacaccaacagatgatgatgttgatagtcgtaatgatagcaatgatcatcatacaacgtatgattatgaaaataccggtgcaacttacaatgatattggagatccagtttggaaatgcaagcactataatgctatgatgtggtatgatgagaggattaacaaagacaagcagtccaaaaacccaagggcatcatcttattggaagcctcttacttatgatactgagaacgaagttaaaaacaggcttgcccaaaactcgaacaaaaatattcttgatgaagatattatcattggaatcaagaatatgctagataagcacaatctctatgcacagaagcaatcagatggaagattgtataacttgccaaatactgctgaagttgccgctttgattattggtgacaagcatacaggtgaagatgactatagaccaaatattcttcataaggataatccgaatagccatgttgcaaagaggaaaaaagttaccatgcgtgaatatttttgtttcagaatgcaatcaagggacaatgaagctcaaacaatactgcattcaaagagattgtttcaacaatggatagttgatggctacactacgattgagtctcaaaagctaaactatgttacagaacatcaacaggaacttagagttgacaagtacatgaatttgaatgcatgtaataatgagcctgaaacacatggcaatgagaaaggaaagagaattatactgccgagctcctttgttggtagtcgtaggtatatggaacaactatattttgatggtatggcaatttttggccatattggatttccagacctgttcttgacattaacatgtaatccagcatggctagaaattcaacaaaaagttagaaaatacaatctaagacctgatgatttccctgacgttgtctcatga

SEQ ID NO: 69522 - DNA, 1569 bp, Glycine max
  Peptide Sequence Number=SeqID_161207
atgatgttatcttctgctaaagggtcacaatcttacaaagacattagaacagtaaaaaaagtggtgtatggtacatttagagaagcatgctttgcaaaaggttttctaggaaatgatcaagaatttattggtgctttacgagaagctatcacaaggggatctgcacacttccttagaaagttatttgtaaagttgttatttatcaataccatggatagatcacaatttgtgtgggaacaaacatggcaattgatggcagatgatattgtatttaatcatagaatacaaggcattcaattatttgtcaaagaaacaaagcatctttgtttaagtgaaattgaaaatctgctgcaaggcaataggaaaagtctacgagattttccttcaatgccatacctaataggatatgctgctaacacacatggaaataagctcattttcaatgaaatggcttatgataaggaattattgcatgctgaattcaacaattattatcactcactaacagatgagcaggatgctatttttgataagactatacgtgttgttgcaagtcaatcaagtggagtttattttctctatggttatggtggcactggaaagacatttatctggaaaactttatcatctgatatacggtctaatggaggaattgttgtaacagtagcttcaagtgggattgcatcattactactacccggaggaagaacaacacattctaagttttctataccagttcctacaacacataattcaacatgcaatattcttcaagggagtgacctggctgaattgctaaaaatgaccaaactaataatttgtgatgaaactccaatgtgtcacatgtttagttttgaagaacttgataaaagcttaaaagacatcatgcacaatgatagaccttttggagggaaggtcattgttttttgtggtgatttccgtcaaatactaccagttgtgccaagaggttgttggtctgatattgtgcatgctagtataaatgcatcatacatattggatcattgtcaaattcttaaattgacaaagaacatgtgtttgcaaaccaatgttgccaataccaatagtgatgacctcaaacaattttttgattggttattggacataggtgatggcaaacttggagaacttaatgatggttatggcgaaatcagcattcttgatgagtttcttatcaaggactttaatgatcctatccaggcaattgttgagacaacatatcctaacttattacaagactatagcaacggggatttcttgcagaaaagagttgttctagtctcttcaaaagatgttgttgatagtataaatgattatgtcatgtctttgatacctagtgaggagaaagagtattgtagtgttgatagtgttgataaatctgatgaactactcaatcctgcattaggatttctaacacctgaatttctgaacttattgaaaacatcaagaatacctaaccacaagttaaaaatcaaggttggcactcccataatactattacgaaatttggaccatgcaaatgggttatgcaatggaactagacttttgtga

SEQ ID NO: 69523 - DNA, 153 bp, Glycine max
  Peptide Sequence Number=SeqID_161208
atgggagaagtgggggacattgtggaaattttagggttagatggaaaaggatttctactagctacttctgcggttataacaatgggggcagagtttttgttattcgttcgattaaaggatagcaatataggtgactgggtaacattaatctaa

SEQ ID NO: 69524 - DNA, 231 bp, Glycine max
  Peptide Sequence Number=SeqID_161209
atggtcattgcttcccaccactgtggtgtcgaagaaaggttgtcagcaatggtgttgggtggttgctgtagtggtgtttgggttgacagtggtattggctggaggcgaaagttgcgtgggagagtcaagggtatctgcgtccattcaggtctttttggaggtgctggaagtaaaaagggagatgcaggaagcaattcccttttggataacagattattttgggttcaataa

SEQ ID NO: 69525 - DNA, 288 bp, Glycine max
  Peptide Sequence Number=SeqID_161210
atgtcgctttctttaagacgtttcgtgacactaccaaaaattgtgcaagcagactatcaaccacgacgtccccaggataaaacagcccagatcactgaaaactatatttgtcgggggtttaaacactggacttttggcactttcacaattccaattgtctcttttatctcttcctttgtgaacaatgcgatcgactcatacaaaggagttgagttatggaataaggacagggacgaatctgtagggggcgcacaggggggtgctttggcctttggggtccgtaattga

SEQ ID NO: 69526 - DNA, 495 bp, Glycine max
  Peptide Sequence Number=SeqID_161211
atgagagtatattcccaagatgtggaaattaaagaagttagagtttgttgttctaaaaataataaagaggaacaacacaataatgagcttatgatacataatgaacctattgtggaagaactgcaagaagtagcattaaggatgtctcaaagagaaaggagaccaactatttcaaatgactatgtagtatacctacatgaaatagaaatagacttaagcattaatgataatgattcagttttgttttcacaaaccaattgccaaaggattgtaagagagttggttgtaagtgggtcttcaagactaaacgtgaatctaatggaaaccttgaacgttacaagcctagacttattgctaagggatttactcagaatgatgatattgagagacgttttcatctttctcacgaaaggattccttcaagactatcatgacattagtagtccattaagacttggagctacatcagatgaatgtgaaaactgtgtttcttaa

SEQ ID NO: 69527 - DNA, 393 bp, Glycine max
  Peptide Sequence Number=SeqID_161212
atggagaatgtgcaacctgcaagaagggaagggaggtacacgtggagcaacgggaacgagtacgtcggagagtggaagaatgacaccatctccagtaatagtgtgctggtgtggaagagcgggaaccattacgaagggtgttgggagaacagtgttccgaaggggagagggtgggattgggaagtaaagaacctcgatgatggagatggagaagcttggcgcttcagaatcattgtcgaaacagtgatgagaaacgatggtcatggtgaggctgtcatcattccaatctttctcctccatggctctcatcggaaggagttaattgaaacctccaaaattgccatgttggatagtctatgtggcactaaaattgccaacaatgcatctcactaa

SEQ ID NO: 69528 - DNA, 126 bp, Glycine max
  Peptide Sequence Number=SeqID_161213
atggcggcgaaacgatgtgaatggaggatgaaacaaccacgtactaagagtggaactgagtttgagaaagtggtgattgtaaccgaagtgacaatgaagaatactaaccgcttagattctgcttag

SEQ ID NO: 69529 - DNA, 171 bp, Glycine max
  Peptide Sequence Number=SeqID_161214
atggacgtgggtgccgccattgacgtcggcgggaagcttgaaccgccagtggcaacagcggcctcaatgcataccgccattcctcctggcgggacatgttctgaaaagcctactacaacagcatgtgaacgttacaaaatttcgaacgttgggttaagttttcagctataa

SEQ ID NO: 69530 - DNA, 435 bp, Glycine max
  Peptide Sequence Number=SeqID_161215
atggattctaggcggcgtggtaaaaacgcatctatgcaacgcaagttgcaacaacttcgatcggtgaacaaagcctcaattattgtggatgccaccagatacatagaggagctgaagcaaaaagtggatggattgaactcagagctaggaaccgcggaatcatcaatctcccaagacgaactacccatggtcactgtagaaaccctagaaaggggattcctcattaatgtgttttcagaaaggaattgtcccggtatgcttggggcaatactcgatgcatttgaagaactgggacttgatgtgcttgatgctagggtttcttgcgaagacactttccagcttgaagcagtcggaggagaaagtcaagagaacgaaagcattgacgcgcaagtggtaaagcaagcagtgcttcaagcaatccaaaacatggattaa

SEQ ID NO: 69531 - DNA, 276 bp, Glycine max
  Peptide Sequence Number=SeqID_161216
atgtgggattgggttgaaacgagattggaaaggttgatggctaggcggtggcgtttgctcggtggtgttggcataggagtgaaaaggaaaagggttggaatgttcatatgggtaagagaaaagaaagggttggttgatgagggaaaggaaccctattttttcataatagccctggagttgttcgaagttgtcaagttgaatttggagagctctcacctggtcgatgatggcattgaggtggaggtctttcatgggagtaagctaatgaaaacatag

SEQ ID NO: 69532 - DNA, 507 bp, Glycine max
  Peptide Sequence Number=SeqID_161217
atgttaaaacgtgatgaaatttcacaactcgcgcgctcgaaaaccctgttgcattctctcttctctttctcctcccacccgaaatctgccgaaaactactcggtcgacacccacattgccccacattcatttcaatactgtcggaaaccgctcgttggaacccacataacctcctatcgaagaaaagtcgaagaaaaccctacattactgttggaactgtgggtcgaagaaaaccctagactgctcttggaacagtcgtgggtgctcaaagctcaaagctttgtacgctgccaattaacaagctttacgtggttctcaaagctcttttcctttaacctaacctcagaacttgattctcgcctttcatcaaagcaaaaggatttgaggattgaagaccgaatcactgtagctagcaggaaaaacagcactacaaagcttatcattgggggttcagctttgtacagatgtgaggatgaagctactttagctcctataagtattgattaa

SEQ ID NO: 69533 - DNA, 564 bp, Glycine max
  Peptide Sequence Number=SeqID_161218
atgttggaggagccttggatgaacattggttctacagatttcctaaacaagagctccactgccaaggcgaatcgatttgttgatagaggagcctcaacatactgtggttccatatctactacaactcacttcgaaaagcaatcaaaggaatttcaaagaccaccaactgctttcggaggtctaaattacaaggggaacgtgtacgtgctaggtactttgagcaaaaggtttagatgctcaaaatcagctccatctacttctattgctcctgtggaagaccaaatagaggagatgcgtgagacaattaataaattgaatgttgaatttttggcaaagacaaataaggagaggacacttaaggaaaagatgttgcagctaatagagaatcatgaccaccaaagtcaggagatgcgacaacagatgcaagagcaaaatgagcaaatttgtcaacaaaatgagcaagtgcagcctcctagtccatcaactatcatagcggatggaattgagcaccatgttgatgatgctcaggttgatcgtcctcatgtcatgttaaaggatcattga

SEQ ID NO: 69534 - DNA, 852 bp, Glycine max
  Peptide Sequence Number=SeqID_161219
atggcgaaaagaacaagcacagaggcaaatgaaaaccctaaagctacatcaaaagcattaaagaatgcttacctaaccgtgttgtgttcaatctcactttcaccaaaccgtgttgtcttcaaactcccttcaaccaagaaccctagaaaaagcatgaactacaccatcaacgtccaaagcagaaagctctcaccatctacacccatggatcaggaagtctacccttccacgacaactcgcgagtctgctatgagtccacaggtttacgaaaacccaaaacggtgttgtgctgcctctgattccaatgagaatgcatgcaacggcgctgctgaggaggttgcgatacgcataattgaggctggcaagcaggaaagcgattcgtcgccgtcctcgttgaggggtcggggtggggagctgggcggtgaggaggcggtggttgggaggagtgagattttgtcgtatcgttggcgaatggcagaggagagggtgtcgttggtgtctttggatgatggcgctagggattcttcttcttcttcatcgtcctctacttaccagagggtattgaacaagtctgaggaagctaatggtggatcaacgggtgaaagtcgagaccatccaatactcacagatacagagaagactgagaaacataccaaactttgtgtggagcacaacacaagcctacaaagattcatgaaattatgctggatacgcgcagcagcagtcgtggttgttatgaggccttacctgatcacaggaggcccggtggacttaggcacttctccattgatgaagggtctcccttgcacgagttatgatctgagggattggaacaacaatattatcacatag

SEQ ID NO: 69535 - DNA, 414 bp, Glycine max
  Peptide Sequence Number=SeqID_161220
atggctagctgcaagaacatggacaactcatgcaacattttaaaaattgaattcaacctccaacgaccacaacaatggctaactcttgaattaatcaaatttgaaggagcaacttgcaaggaagggttaggaaaccaaaacactctaggtggagccagtagagccaaatccgaaatacaagtccctaggtttagagggaaagaactcagaaggaagatgaagcttgggagcgtagccaataaggaagacggcgatggtgatggtgagggagctagcggcgatgaagaagtggcggtaggcaaaacaggaggtgcaacgatcgttgtggtatcccatgatgatttggatgagcatgccagagattgggccgcagagccagatgaaggtggccctaatgtggggaatccacagtag

SEQ ID NO: 69536 - DNA, 64 bp, Glycine max
  Peptide Sequence Number=SeqID_161221
tgtttgtcagacccgcaaagacccctcgtgggaggatgtgcggataaaggcacaggccatctag

SEQ ID NO: 69537 - DNA, 606 bp, Glycine max
  Peptide Sequence Number=SeqID_161222
tccacgtcgatcctgcgaccgagaaggtcgacagtggctacgagaagaaattaagaacatatttggagattgtcgctcgtgataaggtcgatgtgacatacgagacttggaaggaagtccctgctgctcagaaggattcgatatggaaggatattcaggctgaatttgatattcctgaagcttctaacggtaggacaaagaagaaagtacttcagactgtcaacgagcggtggagacagtttaaatatgatttgacgaggaaatggacacttgcagctgacaaggacagtgtggacgacactgtgaaaaatacagcattaccacagctggtgagcaacatcaatgcctgcactgccgtcgccgacgtcgtccgcaccaccctcgaccctcgcggcatggacaagctcatccacgacgacaagggaaccgtcaccatctccaacgacggcgccaccatcatgaagctcctcgacatcgtccaccccgctgcaaaaatcctcgccgacatcgccaagtctcaggactccgaggttggcgatggaaccaccaatgtggtgttgcttgcagctgagtttttaagggaggccaagccattcattgaagatg

SEQ ID NO: 69538 - DNA, 624 bp, Glycine max
  Peptide Sequence Number=SeqID_161223
atgccctttgtcttcactgactacatgagagctgccataaggatttctgcaccgtgtgaagctagagttatttatgtgatgactcatgattcgattgtacttcgagaggatggaccaactcataagccaatagatcatttggcaagcttcagggcaatgccaaacactttgatgcttcatccagctgatggtaatgaaactgttggatcatacaaagttgttgtggttaacaggaagagaccctcaattgttgcactttacaactcatcaagtaacaagcctaatgttattttgattggaactggttctgagttggaaattgttgttgttgctgctgaggatctaaggaaggaaggaaaagctgttacaattgtttcttttgttagctgggaactttttgataagcagtcagatgaatacaacgagagtgttctaccaacttcagtaacaactagagttagcattgaggtaggatcaacatttggttggcacaacattgttggaagcaaaggaaatgccgtaggcattgatcgattcggagaaagtgctccagcaggaaaaatatacaaggagtttggtatcaccaaggaagctgttattgttgctgccaaagaactttcgtag

SEQ ID NO: 69539 - DNA, 249 bp, Glycine max
  Peptide Sequence Number=SeqID_161224
atgaaagaagtgaaaagagaaaaacatgcctcctatagtagtcttaactcttgcaagagcctaagtgaagaacttcgtgactattatgaaggaaggcataggaaacacattacttctcaatgcctcaccaagaaaaccatgattatgaggagccaagacatttatagtagccaagatgaggctactacttcaccatcctctagtgaaagtgaagaagcaaaatgggaagaatctagtgaagaaatctaa

SEQ ID NO: 69540 - DNA, 321 bp, Glycine max
  Peptide Sequence Number=SeqID_161225
atggttgccactgaaagattgaagcttttttttgtacccttgagagaaaggactagggcttgggatgacgagagtcaaaatctgactgaaggagaactcacttatttgcatgttattgatatgtcacttctctcaggggctatttacaagaaaagaggagagcaacttaggtccattttcacaatggaacataacaggaacttacaaaggtctaacatgttgctaattgctaagcttacctttgtgcctatgctttatgtgtttttaatatgctatcattgtacagagcataacaaaggcaaaggggcagcatccatgtga

SEQ ID NO: 69541 - DNA, 519 bp, Glycine max
  Peptide Sequence Number=SeqID_161226
atgactttcttctgggctgtttctttctcacctcaagagtgccaaggatcagatttccaaaggtggctattccatcactctgcgtccacctggtggacatcctcactgattcaccaaagccaccctccaaagaatgttctaacaacaacaacaacaacaacaacaacgccttatcccactaggtggggtcggctacatggatcaacttccgccataatgttctatcaaatttataagcactccagaagttctagagaggcattgaaaagtgttgaagaaactgttataagacttgaaaagttacttcaagagttgcatgtatcaagctctagttttggaaaagagcatttgaaagcagcttgttctgacttggagaaaatacaaaaactttggaaagaagctaaattcctggaagcatcttttagagcaaaagctgattctctgcaagaggtacagcttctaaccctcaccaacctccttgatcaattctttggaaccattttttataaaaaaatttga

SEQ ID NO: 69542 - DNA, 879 bp, Glycine max
  Peptide Sequence Number=SeqID_161227
atgaagtggaagctagcctgcaccaagaaaactggtgacatgacatctgaagcagcaaaggaaattgctgacaagattgatgcgcttgaggagcagggctcacagggttcctttgttacccatggacgtcatgatatactgactgctaccattgggcgaccaaaacaccctggtcgtgtgcgtgttgtagaagctggtataactatcaagcaatactttggatcaacttcaaggacctcctccgttgctcctgaatacctgcaacagttgacgcaacaaatcaaggaccaactggaggattcaatcacagaaaaagtcactcgacgactaatgttatccctcagccaaatgcaatcacagggactcgcactgcctcctgaacctgatgttggtccttcagctgctcgtgtcagcacaaaggagagttgtgttgatccctcagggaacgatccagacaccagtgactcatacaaatgcgggttgtatattgaagaatatccttctcgcctggttgccgtaggaagagtttatgagggatccacaaccattcacaacatttctttgctgcatgatcaagtcaaggttggtgttgaggagattagagatgcagatgctcccattcctgtacccactaaagaggttaaggtcatgggacaggctcttaacacattccttgcttggctgacacatcttgtcaatcgtttatcagaacagggagctgtgggacccgcgaaaccagcagataggccgaatgatgaggtcgatgatccgttatatctaatgacattgaccatcccacagctttttctgaagccattgcaggttatgtgggatgctaccttgtttggcctgtttaatgaaaatttcccttgtacataa

SEQ ID NO: 69543 - DNA, 576 bp, Glycine max
  Peptide Sequence Number=SeqID_161228
atggcctcatctagctactctaactctccttgtgatgcctgcaagttcttaagaaaatgcatgatggattgcattttctccccatatttccctccaaaagagcctcagaagttcgccaatatgcacaagatatttggagcatgcaacgtgagcaagcttcaaaatgaggtgcagccctaccagagggaggatgcagtgaactcactggcctatgaagccgaggcatggatagaggatccggtttatggttgtgttggggcaatctcagtgctattaaaagtgcaaatattgcaccaacacagggaaagaacctttgtccaaatacttggaagaccttggattttttctttgagcctacttggactcgcccctctagctaaacgtgtcaacttccttactgagcaaattgtgtattacaccggccccacagttggagggcttctgaatgcaacctatggtaatgcaaaaataagcaaatgtaaactcatagcttttgatgttggggttgctatgccatttgctgccattactgctcagatatgccttagtaggggcatatccttccatagccactag

SEQ ID NO: 69544 - DNA, 1071 bp, Glycine max
  Peptide Sequence Number=SeqID_161229
atggctaagttcaagaggtctgatccagagattgaaggccttgtggcagctagtggactaagtcctttgatcgcctgttccctagatacgggcaatcggggactaatgtctgcttttgtggaatgctggcataaggaaactaatagtttccatttgctcgtcagagaggtgactttcaccttggatgacgtcgcgtcgttgctacatctgcttgttgtaggggcgttccacagctttgagttacttcatgtcgacgacgctgtcgatatgttggtggaattactcgaggtcagcgctgtagaggtgagagctgagacgattcagtgtgatggctcttatgttcgactattgtggctgcgtgatgtgtatcagacaaagatcaaggcatgtgactggattgtagcagtgcgagcgtatttgttgcatctgcttagatgcacactctttgctaacaagagtgccacacacgtgcacgtgtgttggatctacgagcatttttcatttgttggttccgttgtacctgtcgaggattatgatgagaggagaccgcgtgcatgtcgatggacctctggcaaggcactgctcgtttccacgtatcacaagcgtctggatagactgactcctgacgtgactatttcgccacatcctgctgcgtcttcgctctctgttgaagaaattgatgatagatggatgcagttaagtgagtacattgcacctatagggcaattacgtgtagtgcctggccactgttcgccagattacatggattggttttacatgatttcacactcattcatgagttcggcacagctaggggatcctcctagagtttcgccagttcagcaatatgacacatttgttaaaccagatgtgtatcagcaactgatggcggcagcagcacctaatgaggcaaacgttgatgtgcatcatgttcaacatgcagtggatggttttgtagcaattgctgataagttggagagactactaaacctgaggatcctgaccgaaggaacacaagcctatactgttgctgaagaatgtttgggcatcataagaagctacattagctaa

SEQ ID NO: 69545 - DNA, 1821 bp, Glycine max
  Peptide Sequence Number=SeqID_161230
atggaagcatcacttaattccagacacatcgttttgttaccgttgacacacaagccagacctgagaggcttgtggtgggccccggccaaccaaggtttcgaaaatcaaggcaaagacttcggtgtcagcaaatgtttctttatggaagaagttcccgacacggcggcgaaccggtccgagccggggctcagggcggagatcgacacatcggcgccgttcgaatcggtgagggaagccgtcacgcgattcggtggagttgggtattggaaacccattctcaacggtcttagtaacaagcattttgcggccactgagccgcatcacacagaagagcttgaccctgaaaaactggaggagcaagctactgtattggagaaagagctgatcctgaaagaaagggaaacacttgatgtcttaaaagagttggaaagtaccaaaaggcttgtagagaatttgaaatcaaagctacagaaagaagaatcggaagcgaatttgaattttcagacaagtgtttgcgaaaatatattgtctgttaaggaggatgagaaagaagataaggaaaacggaatgagtaatgttgttcaggattcaaaggaaggttgtaccccctatacttcatcatccccgggtttaatattaatggaattgaagcaagcgaaattcaatctgaacagaactacaagtgatattgctgatgttcgtgcttctgttgaatcgctcaataagaagttagagaaggaaagactatcacttgagaaaacgcgcaagaggttaactcagaattcttcaaagatatgttctcttgaggaagagctaaaccagacaaaactaaaactgctagtggcaaaggatgccgatttggataacccttcggatattacaagagagctccagcggctgagttctgaggccgaacatttcaagaaaatgggagaagctgctaaatcagaagtcatgaaagcaatatctgagattgaacaaacaaaagctatgataaaaactgctgaaatcaggttggttgctgcccgaaaaatgaaggaagctgccagagcagcagaagctgccgcccttgcagagatcaaagctttgtctcatcatgagaattcacctggagattgtgtggaaaagcatgatggagtgaccctttcctttgaagagtatactgctctaacctgcaaggtgcgagaggccgaggagcaatctaagaagagagttgtagatgctatgcttctagttgatgaagcaaatgtatctaaaatggacattttgaaaaaggtagaggaagccacagaagaagttaaaatcagcaagaaggcccttgatgatgctcttgaaagggtagaggctgctaatcaaggaaagctagcagttgaagaggcgttaaggaagtggcggtcggagggtcacaaacggcgttcttccatacataactctatcaagtttaaaaatgcttacccctctcaccattggaaggaatctcggttaatcgatgtcaatgggttgaatctggtaaatgatgaggtcaagccggttctaaagccaacactgtccataggacaaatattgagcaggaagttgatgatgccggaagagtatgaagccagtggaatgattagagaaagaagctcggcgaaacggaaggtgtctcttggtcagatgctaggcaaacaaaacggggattcatcctttgacaggcaagctgagaaggaaaatggtcagaaaccgttttctgcaaagagaaagaaatttggatttggtcgattctccctacttttgacaaaacaacaaaagaagaagaagccaacactgaacttgaggtga

SEQ ID NO: 69546 - DNA, 1764 bp, Glycine max
  Peptide Sequence Number=SeqID_161231
atggcgatttctcctgaaacgttcccaacccgaaaacgacgacccgaaaacatggcgtcgtttatgtctccgaagataaacgaccttaacgttttgtgctccttgcttcaactcacggaccagatatgttccctaaacctcacaaccaccctcttgaaccgtgtttcctcttccaccatccgcaaaacgcagctcctaggtgtcgttttcgaggagctcgttcgcgtttcaaatctgaactccaattcttccgttctattcctctgcctcgaggaaatgtacatcgttctgcacaatatcaaaatcctaatcgaagatttctccaacggaagcaagttcaatttgctcatgcagatcgaaaccgtggctgataatttccacaggctcaccggagaactctccacgctcctcgacgtgctccctctccaagagctcgacctaaacgacgacgttagggaactcgctctcctcgtcagaaaacagggctcggaagcgaaggcgttcatcggagccgaacaaatcagcctccggaacgacgtcgttttcgtgctcgaccggatcaagaacgagatcgtccccgatcaagcgcatctagcttcgatcttcgagaagttggagattcgcgacgcgtcgagctgcagagcggagatcgagagcctcgaagaggagattcacaaccgtagcgaagaacaaccgaaaacggatctcgtcgcgttgatcggcctcgtccgtttcgcgaagtgcgttctttacggcgcgtcaacgccgtcgcagaagaccgtcactatgcggcggaatcagtcgttggagctaacaattcctgcggattaccggtgcccgataagcctagagctcatgcgcgatcccgtcgtggtggcgacaggacagacgtacgatcgtgcatcgatcaagctctggatggattcaggacacaacacgtgtccaaaaacgggtcaaacgctatcacacaccgagctaatccccaatcgcgtgctgcggaacatgatagcagcgtggtgccgcgagcagagaatccccttcaaagtagaaacggttacagggaaacacaacagcggagttaccaacaaagccgcattagaagccacgcgaatgatggtgtcatttttggtcaacaagctcaagggaaatggacatggaaaggaagataatgataacgttaacgttcctttgagtgttgaagacgcaaacggcgtcgtttacgagcttcgggtgttggcgaagacagattcgggtagccgagcctgtatagccgaagcgggagcgattccactattggttcggttccttaatgcggaggagaatccgaagcctgcagcgaacaagactaagataatggagactgacggcgcgttaaacggcgtcgcagaggttttgatttcgggtgccacgtgggaggcgaaggcgaacgcggcggcgacggtgtttagcttgtcgggtgtggcggcgcacaggaggaggctggggagggacacgtgtcgtgagcgggttggtggggttggcgaagactgggccagagggggcaaggtgagggaggctggcagcatgaattgggcggatagggagacggtggcgaggttggtggaggggggttgtggtcgggatggcggcgaggtgatggcccggcgtggagagggttatttgggagctcatggcagttgggagtgtcagggggcggcggaaggcggcgacgttgttgaggattatgcggcggtgggcggccgggatcgatggtggagagaatga

SEQ ID NO: 69547 - DNA, 1329 bp, Glycine max
  Peptide Sequence Number=SeqID_161232
atggatgcaaacaacagcatcaagagagaaaaatggacacaaacaacagaggagaggttttggcatgaggggcgaaggcccatagcatccgcacgtaggcaacgggaagttgccgctgttgctgaggatgctcctcacgtggatgatgcagctgaagaggtcttccaacatcctgaagaagctggtgttgatgcccagggttttccaaacaggccgcatgaaacatcagttctgactgcctatgttgatcatgctgcaatcattgaacgtcctgaattgaaactatcctccgatggaaggaaggttcagaaattcgggaggcctgctgctgagattgaagggtggaataaggaaacgagcagtttccatcttctagtaggagaggtcaccatcaccctcgatgatgtggcctatttgcttcatttgcccatcataggtgtattccacagctttgacactcttcatgtcgaggaagcggtgttgatgttagttgagttacttgaagccggacactggactgtagtagctcaagtttatttgctgcatttgttaggttgcattctttttgctaacaaaagtacaacacacgtgcatgtggtgttcttggatgccttccgagacctcagtcagagtggaagctacgcatggggagctgccgcccaactgcatatgtacgataatttgaatgatgcttgtaagagctacaacagacaacttgctggatatatcacactattgaagcatttttcgtctattgttgaggcttttacggactcagattatgatgaaaggtcaccatgtgcctactgctggacatctaagaaggcattaccaacatcgacatattggaagcatctagatcgactgacgactgctgatgtttgttggatgtcttatggtgaccatcgtgtagttcgaaagtatgttcagacaattcctccacactgtccgggttcaagattatgcttcgaagatattgatgacaaatggatgcatttctctaactaccttgcactggtgggccagatttgtgttgtgcctgaacaatgtgcactgtactacatggactggttctacatggttttgcatccattcatgaggccgacacagcccagtgatccacctagacatccacctgttatgcaagatgagacatatgtggaaccagatattcttgagtacctagtgacagcaacaactatggaagaagcacctgcacaagcactttctgatgtggagcagcctagacatgcagtggtggcttgccaagcaattgcacaaaggttggagcgattactcaacctaaggatagtgactaaaggcacataa

SEQ ID NO: 69548 - DNA, 1158 bp, Glycine max
  Peptide Sequence Number=SeqID_161233
atggggaatcacaggtttaagttatcagatatgattccaaatgcttggttttacaagctgagggacatgagggacatgggtagaggaagagattcaagaaagcatagcaccacgccctctaggaaaaagaagcaaacttcacccccttcaaccacacattcatcaaaaccaaaccaaccccaccaacaatacaacaacaatatctctagaaagtcctattacttcacaagagacctcaaaacctcaccctcaaacaccccaaaaatcatttcttctcctagaaaatcaaccaaactaagaaccaaaagaagaacaccgagaaccccaaaacttgtctcctcaggttgtagctgccgcaccacccttgaatcagtgtggaccaaatcagattcacattcaccacaagaacactcttcctcatccccatttgacacctctcccgagtcacaatccccagaaatcagaacagaccgtattcttcttccatgttcttcatcattcgatgaaatggtgtccttgtccaccacctcttgtgcctcttgcaggcttaacacaaacataaacaccaccaccaacaacgacaccatcatagacgtggacaaaaacttcatagcaagaaaagataacaagcttgatggctactacaattacaacaccaacaacaatggctatgatgacaccttctcagaacttgagcttcctccaatcataaccaagccatccaagttgctaaagaagagagaactcaaacaagggtccttgaaggtgagaattgtgaaggaacaagactctgaaatgaaggaacagaggaatagtggttctttgaagaggctatctctgagttctcccggggggaggttgaggatccactcgccgagaattgctggccggaggggccggaaaagcgtgtcgtcgacagcgagttctggctcccggagaagcctctccgatagctttgcggttgtgaagtcatcctttaacccacagaaggatttcatggagtccatgatggagatgattgtggagaacaacataagggcatccaaggacttggaagatctacttgcttgctacctttctcttaattcagatgagtatcatgacctcatcatcaaggtgttcaagcaaatttggtttgatttgactcaaccaaggtag

SEQ ID NO: 69549 - DNA, 794 bp, Glycine max
  Peptide Sequence Number=SeqID_161234
gggagttccacaacttcgagctacttcatgtcgatgacgctgttgaaatgttggtggaattactcgaggtcaacgctacagaggcgagagctgagacgattcagtgtcatggctcttatgttcaactatcgctgctgcgagacgtgtatcagctaaagatcgagacatgtcattggatcatagcagcgcgagcgtatttgttgcatcttcttggatgcacactctttgctaacaagagtgtcacacacgtgcacgtgatattcttggatacactgcgtgacttgacacagagtgggggttacttttggggcgttgttgcacttgtgcaaatgtatgataatttaaatgacgcgtccaagagcacggtgagacagcttgtaggatatatcactctatggggccccttgacagtcattaaccgaccggagagggttgtaggacaatttggctacatccaaactattccgccacatcctgttgcgtcattgttctttgttgaaaaaattaatgatagatggatgcagtttggtgagtacattacacctccaggggatcctcctagagtgccgccggttcaacaatatgaggaatttgttgaagcagatatgtatcagcaactgatggcagtagcggcacctaatgaggcagatgttgatgtgcatcatgatgacattgtagcaattggtgataagttggagaggctactgaatctgaggatcaaggaacagaagcatatactgttgttgaaaaatgtgtgggcatcgcaagaagctacattgcccaaccaactgtag

SEQ ID NO: 69550 - DNA, 193 bp, Glycine max
  Peptide Sequence Number=SeqID_161235
atacatagctctggagcagcttctggtgaagtacggtggactaagcaaagatggggagtttggaaatatcgatgctgtcacaaaaatcacagtgaggccggcagcaaaacatacagtggatgcacgcgtcttctacgtcgttgcacgtcggaatgacttagaaactacctgtttctacgatgttgctgggtaa

SEQ ID NO: 69551 - DNA, 444 bp, Glycine max
  Peptide Sequence Number=SeqID_161236
atgacaacaagaaagggtgctacaatgctaaaaaattctcgaaagacttcgtgctcaaccatacggaaggagagctccaatgccacaaacaatttgactagtgcaatccaacatgcttcttggtcagccatggaagaggaagaaggagtaatgatttatgtgtccagtattttcgggcaagatgtcctggacatcgtatccgacatcgtggatcctgcagcttcaattcttcatttgacttttatcttgccttgtgcattgtgcagcaactccagtattttcgggcaggatgtcctggacattgtatccgacatcgtggatcctgcagcttcaattcttcatttgacattttatcttgccttgtgcattgtgcagcccgatcttattcctttacataacgttggacatcatgtgcagcaactccagctttccttcattgtctaa

SEQ ID NO: 69552 - DNA, 168 bp, Glycine max
  Peptide Sequence Number=SeqID_161237
atggcaagggtttcgacaactccattggagcttgaaggcctaggattttcttcatcaatggattcctttgcttcttggaagatgaatgacagtggaatggagaagaaagagagagagaagatgccacttcaaggagaagatgagtctagaagtagctcaccaccatag

SEQ ID NO: 69553 - DNA, 249 bp, Glycine max
  Peptide Sequence Number=SeqID_161238
atgaagaaacataaaaatggaaccttcaagaggaacaaaattgcccccacagagagcaaccttcttcaattcttagtgtcgcaacatgcccttttgcgggcgagcgaggtgaggctcacgggtgcgctttccaaaggaggaaagatgcacggagtcgccaccaacgtttatttgtggaaaatgtcaaaaaaaccaaaggaaaccggtcaaaaagaatattccaagttcgggagttgtatttacgtttga

SEQ ID NO: 69554 - DNA, 1830 bp, Glycine max
  Peptide Sequence Number=SeqID_161239
atgggggagcatgtagcagcggtgcacactgctactaacgctttgcaagcattagggaggggttttgatgtgaactttgatacgaggttgctttattgtaaaggagtttcagggtctagggtagttgagattgatgaagaacaccgtagggagctgtggttgtacgaggatgtggctgttcccgatgtttccagggacattggatgctaccaggaggctatggtgcgtcagagttctggggtccgcagttttaaagagggttttgttgcattcctgatattatgggaaattgcagacaaatgtgccgatgaggccacaattgcgaccacagagatttcaaaaaccttgacattatggcaaaaattgcagtcatggacctataggggacatatctttggggtgtttgatgaatttaacagcggttatgagttgctttttatgattgtggacaagagatggtcctggtgtaatgaaattgagatggtggaatactttaatgaaagggcaaatgtatcagggaagtttcctattgggagttttaattctgcatttagcttcactggttcaaaacatgttgatgaagcagctacaaaaaccttgtcttcagatgggttttacattcctcttgcaaaggttcagcttcaaaaatcccacttaaggttgcaaggaaatgtcaaaaaggctgtcccagtcaattgggacccactgtccttggcaagttttattgaaaattttgggactcatgtcattacatcaataactatgggtggtaaagatggtgttgatcccttttcattcaatagtcaaggggtttatccccaacccacgactgcaacatatcctattgggaaagaagatgtcacagtcatttttagaagaagaggaggagatgatttggaacaaaaccacagtaaatggttatcaactatcaagtcctccccagatatcattgagatgactttctgtcctataactgatctccttgatgagatacctgccaaggagcatttgactcgtgccattggtctttatcttgaatataaacctcctattgaagaacttagatatttcctagagtttcagattccttgtgtatgggctcctttacaggacaagattcctggtcaacaaaggaaggaacctgtatgcccatctttgcaattcagcataatgggccagaaactttatgtcagtcaagaacagattacagtcggacgtaggccagtaactggcttacatctttgtctagaaggaagcaagcagaatcggctgagtgttcacgttcaacacttggtatcccttccgaaaatccttcacccatattgggacagccatgtcgctataggtgctcccaagtggcagggccctgaggagcaagacagccggtggtttgagcctgttaagtggaagaacttttctcatgtgagcacggcaccaattgagaaccttgaaaccttcataggagacttctctggtgtctacatagttactggagcacaacttggagtgtgggatttcggatcacggaatgtattgtacatgaagctcttatattcaaggttacctggatgcacgatccgaagatcgctttgggatcacatcccgaacaagccgccaaagactgtgaatgctggaaacacctccaaccttgataactcaacccttaaagaaaatgccacaggcaacaagttggtgaagtatgttgacttgtctgagatgaccaaaggaccccaagaccctcctggccattggttagtcactggtggaaagcttggtgttgaaaaagggaaaattgttttgagagtgaaatattcattgcttaattactga

SEQ ID NO: 69555 - DNA, 450 bp, Glycine max
  Peptide Sequence Number=SeqID_161240
atgcctaggaggagaagcatttcaactgaaaagtttctatctaaagaggagagcaggatccaagcacaaacaaagccctctaaggaacaacataagattcaaacgcctacaaagaaggccaatgctaatggaactgtggaggaaccagaaaagtctagtaatctaagaacttccattggaaagaaatcagctgaagtttctaacagcggactccctggaaacttggtcaaagttactctaagtaatagaaaagtgatagatgcaagtgttcaatgggcttcacccttatcatctatttcgaagattggaaggtatgccactgtcgcaacctacccttcggcgggagggcgacgcgtgactcgcgggtgcgtgttccaagaaaggaatacgcgcggagtcgccaccaacgtttatttgaggaaaacattggaaaaaccggaaaagacgtga

SEQ ID NO: 69556 - DNA, 408 bp, Glycine max
  Peptide Sequence Number=SeqID_161241
atggctaaaattaaggatagggttgcgcgagatttcgaaggtggcttgatcgtgagcgctcttgaaggagaattccttgtcggagcaaatcttgttgaggatgttccggtacttcttcttcagccttcggatcttctccacgagctgattcttgttgaaattgagttgcagcttcgacttgatttggtcggcagtggcggctttttctcctcgattagctccaggaaacaccgtttcggattggatgagtcggcgaggacgatggtggcggtgggcttcaaaattggagcgtcgctgccgccattggagacgaaggaactggggacggcaacggtgacaccgagagcggtggagggagagggcatgttatcttcgtcgtcgtcttcttcgtactcttcgtcctcctga

SEQ ID NO: 69557 - DNA, 225 bp, Glycine max
  Peptide Sequence Number=SeqID_161242
atgcgtcttggaagggtgttaggcaaagtaatcgatgaacgacaaagcacttttgttggtgggagattcatgcttgatggggtgatggtggctaatgaagttgttgatgagtgcatagcggaaattaaagagtgtagggaagaagaagacaaacacaagagttttatactggttcggcaacaacccgtgcctacatctactccccaagcgacctgcggtccttga

SEQ ID NO: 69558 - DNA, 432 bp, Glycine max
  Peptide Sequence Number=SeqID_161243
atgtacatcaagtccaatcattacaaactcaagttgatcatcacaaatggagatatacccattattagacctgaagcagaatggacaggcgcaaaccatgttataatggagttgaacacaaaagcttgttatactttggcatgtgttttatccaataatgagtataacaagatatgcagactaaagatagccaaagacattagggattcattgagcatcaattatgaaggaaaaaaagatgttcaattgagaaaaactaccactctgatgcgacactatgagagtttctccatgaaagaaggagaatttttggacaacatatttggaagacttcaagtgctttggaaaggatttaaggctctaggacacaccttcaccaaagctaagataaatctaaagaatctagataactttcccaaggtgcatgaataa

SEQ ID NO: 69559 - DNA, 1314 bp, Glycine max
  Peptide Sequence Number=SeqID_161244
atgggaagctgccctattgccgaggatgagcctgtggtagctgcagataagcctgtggtagttgtagacgtacatgcacttggtgctgacgctggtcatgatgctgagggatttctaggtgggtcgcgtgacccatcagtgcttacagagtatgctgaccatgttgcaatcagtgtatggaacgaagaggaccaacctgaattgaagttatcctcccatgggaggaaggtgcaaaaatttggtaggcctgcttctaaagttgagggcctagttgctgtcacaggactaagtcctttgatcgcgtgctcaatagacattggcgatcggggacttatatccgcattcgtggagaggtggcacagggaaaatagcagtttccatcttctcgtgggggaggttagcatcaccctggatgatgtggaatctctgcttcatcttcccattgttggcgccttccataccttcgagcctctgcatgttgacgaggccgtgttgatgttagttgagttactagaggtctccaaagaggctggacattggacaactacaactcgtgcctatgttcttcgtcttctaggttacacgttttttgctaacaagagtgcaacccatgttcattgtgtcttattagacgctctgggtaacttatgtcaaactgggagctgtgcatggggagctgctgccctagtgcatatgtacaatcatttgaatgatgcttgtaggagcagcaaccgacaacttgctggttacatcactctcttacagcactttcatttagttgcggagtgtgtggctgatccaaactatgataaggtgtcaccacgtgcatgtcactggattgctacgaaggcgactttgaagattcctaatgtcagatggatgccttatggggagcatcgacccgttcaggagtttgatttgatttcatgcttttccgatcagctacgttgggggcccgttgccgtcagacaccaaccagagagggtcatgcgccagtttggatacgtccagagtattcctgtagaggatgctgattcatgggtttcatttgaagaaatagacgacaggtggatgcactacttagaccatcttgcaccaacaggtgagatatgtcttgtgccaggtcagtgtgtgcccgagtacatggactggttcttcgtcctcaagccactagcagcaccgacacatgcccgttctgatgtggaccagcctagacatgtagtgcgtctactcaaccttaggatagtcacagcaggcacagagacacacgaggtcatgaaagaatgcatcaggattgctaggggtgtcacataa

SEQ ID NO: 69560 - DNA, 513 bp, Glycine max
  Peptide Sequence Number=SeqID_161245
atggtcttctcattggaagaagattataagggtgccttatttgaaggaccctatattcttgttgatcaatacttgctagttaagagatggaggttgttctttctatccaatgtgaaggaattgattgggtaccacgctgaagagaaagaagggatacataaaattgtggcagtagaagacatctctcatagcgacaatggtgacataagagggttgcagaaggaggatgaagctatggttaacgctgacgttaaagaggataacagttactcaactagagttcaaaatgcacaaagggggcaagaatccacaaaaacggaaaagttaataaagcccaatatgaaagaggagagggaggtgagcaagaaacaagtgtcttatgatgggcctatcaagggaaaaggtttagacccaaagtttgaggtgagcttcggtgaaggtgaagggggcggtgttcattgttacggtggttggtttgacatcgacggcaaacgaggtacccatttttgctag

SEQ ID NO: 69561 - DNA, 474 bp, Glycine max
  Peptide Sequence Number=SeqID_161246
atggaaaccataaccaagcggtttaaagagcttgatgtttatggaaaagttactctaaagattaaacttcgggaaatttcctaccctgatctaaactctttgtgtgctcctccaaaaaaggtgaaaacaaaaggtgctcaaaagcaaccgatgaccaaacatcaaagatcaacaaagtgtgatccatcttactgggagtatgttgatgcattacattctgtgcaaaatagtaattcttcagtcaaacgtagtgcatcatcatctgatcaagcaaaaccaagaaggatcatgccgatgttggatcaatttcatccacgcattcatgattccattgaaaatattgttgatgtcaaagctgatggtatgggtgaagattcatggttttggttcgcaaccatttacttaaagaacttgcaaaatggtctaatgagtatatcaacttgcttggtggcactaacagatttgagaaattaa

SEQ ID NO: 69562 - DNA, 789 bp, Glycine max
  Peptide Sequence Number=SeqID_161247
atgggggcttgcatgcgtgacatgggcgatagggttgagttacaggagattaatgacggtttgagattgacaatgacattatccaagaggttgcgccgctatctccttcattcattgtgtcttcttctctcgtcgttgccaccgccattggtgccgtcggtcactccatcacaatcatcgtcatattctcctttcgcggcgcaacatgaagttgcacctattgctgaggatgtcgagcatgtgtatcatgtagctgatgaggtgcatgaagagcctgtagagacagctgttgatgatgtagttactgatgtcgagggttttccaggcggaccccacgataaatcagttttgatggactatgtttatcatatgacagtgacaatttggaatagaggggaacgtcctgagttgaagttgtcctcctatgaaaggaaggtagagaaatttggcaggcttgctccagatattgaaggcttagtggctgccacaggattaagtcctctaatcgcatgtttgctggacactggtgatcaaggacttatctctacttttgcggagaggtggcataagaaaactagtaatttccatttgccgataggagatgagactatcaccctggatgatgtagcatcattgctacttctgcccattacaggcaccttccatagctttgaggctcttcatgtggatgatgtcgtcttccttttagttgaattgcttgaaatgagttttgaagaggcaagagctgagacagtacaatgccatggggcatatgttcgactatcctag

SEQ ID NO: 69563 - DNA, 1692 bp, Glycine max
  Peptide Sequence Number=SeqID_161248
atgagaaaatccaccagaatctccgccatcggcctctcaaatcctccagaaggaccagaaccgacgaagcctttcagcactcgattttccctgcggtcgtacgcgaggcgcgtgcagctgctcacaccgcagcagagatccgcggtttcgcgaacgggcttcgggaaccttctcctcgttccgaaccacacgctgctgaacaaggtgttcctcacggagctcatggacgcgtggagccgcgagcggcgcccgtttgtgctacgctccggcgaagaaattcggatgactctgctcgacgccgctcttatacttggcctgccggttgccggtagccccgtgagtttcaccgaagaggaaccgttctctgatttagaagagtcgtacggagcaacgaaagcaaaaaggaaggtggcgatgagttttctggaaaataggttggattggattggggaagatgtgagtgaggattttgtgaggtgcttcttgctctacacgatagggacgtttctcgcttcgaacgatgggaaggtggattcgcgtttcttgcggttttttgaggatttggatgaggtctcgggttttgcttggggagctgctgttgttgatgatttgtgtcagtggctggataagaggaaggagcataatgtgcggttagtacggccacaattgcaagatcatgatttgacctttcctcgtgtgtgtcgatgggataatacaaaatctaagcggggtacttcatggtttaaagacttggatgatgaccaggtgatttggaaactcgaacctacttctggagagttacagatagaggtaatcaaagaagcacttgatttgctaggtgacaacaaagagcttcaaagtgtagaaagcagttcaattagcacaccatctagtttgaatttcttttattacaatgctcctgatgtaaattcagggttacagcttagtatcgagaaagaagtacatagagtggacgaggatgatttggagaatcaggtagtggaggacacccccacaaagttgagcacttgtgatgaagaatatagagagcaaatcaatcccgaaaacctgatggtgttggacactcccccggatttaaccatttgtgacaaagtaggtagagagcaagaaatgaatcttgaaaacctggcagtggtagttgaggatacccctacaactaccagtattgctgacaaagtaggcggagatcaagaggtcaacagtgaaaaactcatagtggaggatactcccctgaattacatttgtgacaaagtatgtcgagagcaagaaatgaatcttgaaaacctggaagtgctagttgatgatgcccccacaactatcagtattgctaatgaaggaggcggagatcaggagttcaatggtgaaaaactcatagtggaggatactccccctgagttgagcttttatgatgatgatataacaaagaagaatgtcatgttagaagtggaaaacactgaattgaagatgaaaatagaccaagtaatggaggaaaatgaacttctctatacacagattttatcaaatacccgatttgaagagcagaacaatgagttaaagaaagagctggacttgttgagagaagaaaacagaattttaagactgtcaataagtagttttgcagaccggattgatagacatattttggatttcgaatctaatgcaactaagtaa

SEQ ID NO: 69564 - DNA, 1995 bp, Glycine max
  Peptide Sequence Number=SeqID_161249
atgcacgtggagatgaacaactggacatcctgcttcatagatggccagacgaaatttgcactgatgcgagccaaggatggtggagatggcctgaagacctttgggaagccatatacaacccttttgaaggatgaagtcatgacgatcgtcttgaatgtggcggcgaaagtccacgaaggaggaattgctgagaagctcttgtttaagttcctgcaaaagaaaggaagtttggaacagttagcagaaaaaattggagaggggtggcttttcgtcgctgtgagagggcatcggctgctgcattggatctcctggcacgatagtgaattgtgtagtcattgcctagtaatcgtgtcgggtagcattgctgttcaggttggtaatggcggcgagctcccttacgtacgtggaggcacaaaagagcttagaacagaagggtttgctgaagaagacgattgggtggactggggcaccacacagagcttccttcagactgaggaaggctgcgctagcatcagcgttctagtggaaggagtccttagcgaggagagtcggttcgaggggattgaggagttggccaattctggacaacttcgatctttgtcggcaccggtgccactccttggcacgacacgatatgcccgagatattcctcctgagaagttgcaaaggagcacttcgaaagcttcagaaaaaattggtgtaagctcaggacttcgaaggccttgcggaggtagtgccaccaagctcgtcgaggagctcatcaattgttgggatcgggaatcgatccttgatcatgacggcgttcagggccctgtagtctacaccaaacctccaggagctgtccttcttcttaaccaggagcacagggtagcggtatggtcggacggtgattggagatgtgtggggttgaaggaggatggagtgattagtaggccgaggagggggaagggtgtttggttgttggaacaagggtgcgaattgggtgagcagggcggagatattagggtgggtggttgtgggggtagtgggggaaggagagacccgtatgtgaaagaattcactggcaccattggtctggatcagtcgtcggagttgcggtgtggagatggcttccaggtcctgggtagtatcacccttgagttgaatgatcgtgccgccatggacaaatttcatggtcaaggagttatagtcagtggtgaaggtgtggccttggatgtgaatggtggtggatgggcagatgttgtggcactcaatttcgttgccattgccgacgaggacacggagggccgcgtggctgaccagtcgggcctgcacaaagttgtgcgtgctcctgccgtcgatgaggatcatgacagactggttggagatgcggcccaacaggcggagcgtttctggagcggactgacccgacaacgcttcttcttgctactcttcatctgcgatgaggagaaagaaatgagaggcgcagcggtgcccgcgggtaaacctctcattgcagttgaagcaaaggctgcgctcctgccgggtaataatggtggaagggacgggggtagcgaaggcggagccatgggtgttgcgaccgtggaatgggcgacgttgttccgcaagtttgtcctcctgaaggcgtgccaaaccgaaagcttgaatgaggtgagtgaagcgggtgtcaatggcctgcaaaaatcccgcccaagtgggaaactggtggttgcgggtcatccattggaactaagccagggcggttccttccatggtgaaggaagtaatgggttaggtgaggaagatgaaggcgaagctgtggagtggctcgggttttcgagattagcgactcgaaggaggagatcctccaacttttcagtaacgaaaatttggctcgaggcaagctgggagattgcttccttaatgtgttccaatggagacttagctcgaggggagtccgccatggaagcaagaaatgaaagcaccagatttgttaaggaccagagaactacctag

SEQ ID NO: 69565 - DNA, 2676 bp, Glycine max
  Peptide Sequence Number=SeqID_161250
atggagtcaaggagctgcatgaacgtggcgtgcgccacctcgacgacgattcggtggcgcaaaggctgggccctgcgatccggcgaattcgccgatctctgcgataagtgcggttctgcttatgagcaatcaacgtattgtgatatgttccactcaaatgattctggttggagagaatgcacttcatgtgacaagcgtctccattgtggatgcattgcttctatgtctcagcttgaattattagatactggtggtgtaagctgtataagctgtggaaggaattcaggaccgcaacctattgcaagcaatgaaaagcctaatggatctgggacatcaaaagtacaaaatgtcagtacacagcagcagtgcacatctctggctaaccaattaactgtgaggggtatgcaagtagggcattatgcagagaatgatgagcttcagtgctggttcaaaactcacaacgttgaaacagatgggccttttgcagaaatgaaaccagaaattttaccctcagttggagaacttggaaacacattgatatcacaatttcattgtgagtctaatggatcgtctaaggcttccaaagcagagaactgtaagccagagacagaaatgcgagatatatatgaatcattggcacagacaaatttgagtatgacccttgctgctcctttaggaaattcaaatccctttcatagtgctgttgttgatgaaagggaacaaagtaaaacatctccacttttattggggtcaaggtctcaccatcttttacctaagcctgctaggtcaactattgggacaagcttagaagcaaatgctggcatggtatcgcagattcgtgtagcaagaccacctgctgaaggacggggaaggaatcaattgcttccacgttattggcctaggattactgatcaagagttgcaacaaatatcaggagagtatccaacattttcaaattctacaatcgtgccactctttgaaaagatgcttagtgcaagtgatgctggtcgaattggtcgcttggttttaccaaaagcatgtgctgaatctggtaatttgttaaaactgaaagaggagaccattgtgcaggcatatttccctccaatctctcaaccagagggccttcctttacgaatccaagatgtgaaaggaaaagaatggatgtttcaatttagattttggccaaataataacagcaggatgtatgttttagaaggtgtaaccccctgcattcagtctatgcaattgcaagctggagatactgtaacatttagccgtatggaccctgaggggaaacttataatggggtttagaaaggcaacaaattctactgcagtacaggaaacactaccatctaatatgcccaatggttctcattcaagtgaaacttcctattctggtgtttatgtgaatctacctatattaagtggttactctggccttcttcagttacaaaagggatgttcagaaacccacctaaatgcgctgtctaaaaaatggaactcagctggtggtgacatgagttggcataacattgacatgcctgaaagcagaaaaagagatgagttgccgttgccacctgtgatggttcctgagaagaaaagaactcggaatattgggtcaaaaagtaagaggttgcttattgatagccaggatgcactggagctgaaacttacttgggaagaggctcaagatatgctccgtccacctcctactgttaagccaagcattgtcatgatcgaggatcatgtatttgaagaatatgaagaacctcctgtctttggaaagaggagtatattcgtagttcgatcaactggggtaaacgagcagtggacgcagtgtgatagttgctcaaaatggcggaagttgcctgttgatgtacttactcccccaaagtggacatgtgtggagaacttatgggatcagagcaggtgttcatgtgctgctcccaatgaattgaacccaagggaactggataatcttctgaggctgaataaagactggcagcaagccagagactggccctggaacatgaatcttcaggactggatgctttggcaaatgcagcaatactgggtgatgatgcaagtgactctggcaggacatcagttgttagcaccacaaaacatcctcggcatagacctgggtgctcttgcattgtctgtatccagccaccaaaagcggcaatccgaacgtgaagcagagattgctcagagaaatcagttatcatggcggaccaaagatgaatcagaagtagatagcaccttacgacatttaactccagttgacagattggagaatgaggtacgggtgcaaaatgaattggattcaaggagtcaaaaccatgcggtggctgaagctgccaagggacaattagatttgaattgtcaacctgatcgagaagatgtgcaagcttggccgaacaatttgagcatgacgagtcttcttgaagaagcaaatctcccgctggaaacctacctaaagcgaaatggccttagtagcttgatatcagagcagcaaacaaattcagcttcaaatgtgcaagcacagacaaccaatgatagtgagggaaaacacaatgaggattgtggaaccgctttggttattcatgagagggaaagcagtcctgaagagaacagtgggcaagacagagagcaaaacaattcactctcatga

SEQ ID NO: 69566 - DNA, 1029 bp, Glycine max
  Peptide Sequence Number=SeqID_161251
atggctccaaagaagcttctctctgagagggcaaggaaggatgccgcgggagaaggatccagtgtggctccacaagcggacatggaattcgacggacactggttccaaagtgaggaacaccaacgctgctttgaagcgatcaagagttggaggcaatggactcaacttgcagggcccatggataaatatgactcagaaatagtcatggaattctacgctaatgcatggcctacagaggaaggagtcgggtataagcgctcttgtgtgcggggccaatgggtcccctttgatgaagatgccattaataagttcttagggcatccgttggtcctggaagaggggccagctgctgtgtgttttggggcaggacttcgcatgaagtgtgacaggaagaccgatctggatgacactgcttctcagcaacatcctcccagcgatcataattctgattttcccttgccgaagtgccagctggtctacgccatcttgactcaggttagtattcatgtggcccatctaatctcaaacgccacttaccaatttgtagggatcacgccccccagacacctagtggacccagaaaagttcaacagagcattggggttttcgaccttgatcacgggtctctgccagttctatgaggcgcagcaacagaggcaggaccatcagcagaagccatcggcagatgcactgccgccgcctctacaacagccaccattcctaaagtccatctctgctcacatgcagaggatggaactctatatgaagcatgtgactgaccagcaggcggccaatcataagggccaggtgcagctgaatgagagtttttatcagtataccctgcatcaacagagccaggatcccagtccttactcgtggcctactcccaagcaatttgaggccacagttgcatggcctggagataggcccagttttcaggaaggggcaagacccatagggacccccagagatgaagatggagctcaggaagacgatggcatggccgatgtgatgaacttcttcctttga

SEQ ID NO: 69567 - DNA, 681 bp, Glycine max
  Peptide Sequence Number=SeqID_161252
atgtctatcccctacaaggtcattgcatgtgtgccgaaaaaggaaaggaaaattgggaggaactcttggcaggaaggagaggccggagttttgtgctcatgtgaaggattcccaaacatccccttgataggagcaaagggttgtattaattataattccatactggccataagacaattaggctaccctatgagaggggcaccgtcggaagagatcatcatgcctttcgtcgcatggggtttcaacgaaggcaatgcagaaatgcttcagagaatccgaaaagtgtggaatacaatggaaagaaaagataaggagctttggggaagcaacaacggtgttattggtggctatcataagtggttgaagactcggacgcaagggataacttggctctcaaagctaaagagtccaagtagggaagaagctgaagtccctgaggagagtgatgaagtgccagccttgaaagcagagcttgaaagaacgagagtggtcaaagaaaagttaaagacgacagtcaccagggttaggaaagactgtgatgagctaaaggatgtcaacgtgactacggcccccgaaaaaaagaatatgacagaaacaagttttgaggggctctatagggcagtaacaatgagctcaagcttcgaaggaccgaaagggacgagtcaaaggtggaaagtatga

SEQ ID NO: 69568 - DNA, 120 bp, Glycine max
  Peptide Sequence Number=SeqID_161253
atgaggccaaggcgctaccaaatcgcaactgtaatcaacttctacattgttcttcattcgtcatctggggtcctctttgttgctttgtacatctttatctcattcttctaccatctgtaa

SEQ ID NO: 69569 - DNA, 318 bp, Glycine max
  Peptide Sequence Number=SeqID_161254
atggtcattttctggaactttctagacctgaactcacccaggcctacatctggcttgcctgggccatgggaaagcttcaaccttaagcaaccagctcgcctaggcgagcttcccctgcaacaaatggccttttcctataaatattcatgcaggggaagggtttcaggggttggaaaactgaggaaagaagggaaaaacgcagaaaggagaaagaaaagaataagaaaaaaacagtcgaagcgttgccaaatcgaattatggatcgtttcctacatcatttctcttgctagccttgtaccctatgcaacagtcggttag

SEQ ID NO: 69570 - DNA, 750 bp, Glycine max
  Peptide Sequence Number=SeqID_161255
atggaacatgagttgaacaacatttacataagaaatgcacaaatgagggtcaatctcccaaggttcgacaaaggggtggggagtacttcgaatcacaatcaaaactatgcccaagcagttagacaaggggatgggacaaagaagcataaatggaaagctaaaggggtaaaccaagtgggaaagcatgaagaactgtggctagatgaagtgtatcttgtaggtggtatagggaatctgaaactgaactatattggagatctgacggtgctgatcttcgatattaaagatgtagagggatggaagaactcaagtgatggggagttatctaaaagaagcgtgtatggatgggactttagttccttgatagatgagtgttatgataactgtggcgaagatggtgttaagttgcaaggagatggtggtgggaaaggtgacaaaaaagctaaaagagtcgatagtggagtcagtacaaaagggactgaagctaaaatagtgtgggggtgggtggtgaacttaaaggcgtcaattccctgcatagttgaggagaacacaaaaatgattaagcgtgaaaagggggatgaagatactcaaaaggtaacaactcatgagaccaagataaaggagaagaagagtaatgtgcccaaagaccaaagggagggacacttgtgtggtcgaaactctatacttgctcaagctagaagtccacacaaggtggtgaaggtgggtactactccagataagattggtgga

SEQ ID NO: 69571 - DNA, 213 bp, Glycine max
  Peptide Sequence Number=SeqID_161256
atgaaggtgaagatagcggtgttcagtattgcggtggtcgtcggcagcggcatacaagttgagaagaacgcgcgaggaagaagcagagcagagcagcacaacagcaccaccaccacgccgccaacaatggtgaagaagcaactcacgtcaccggcaccaacagtccactcgaggtcgcggaatcgcgcagaagaagaagtctggtcacggtag

SEQ ID NO: 69572 - DNA, 285 bp, Glycine max
  Peptide Sequence Number=SeqID_161257
atgtttccaattattggggggacccctatgctcttccctcatgttaagtaccaacctttcgaagaggagattctcgagtattacgagatgcattacgttgtcaaaacaaacttgaaattccaattggtaagtactttcttgtggatgcaggatatacccatggtccagggtttttatcaccatatcgagggactagatatcatctcaatgagtggattagaaacacccctcaaagttacaaggagatatttaatcttcatcatgcaagtgcccgaaatgcaatag

SEQ ID NO: 69573 - DNA, 330 bp, Glycine max
  Peptide Sequence Number=SeqID_161258
atgaaggaggacttgacgaaattgagagatatgaacaaagatgatgtcaactcccaagctaatgtagtaaaaagtgttgaagatgaagatgatgtgtttttggcaataaatgatgagttagggaatgatggaaaaatgaaggttgaaggcatagggagcgtgaagatgaagctctatgatggtgttcttcaaactttctcaaatgtgaggtttgcaccttctattattgtcaatatgatttctatgggagagatgacatcgcaatggtacaagtatgttggttcaaagtggggatgcaaggtgtacaaggggagatacttggtgttgtga

SEQ ID NO: 69574 - DNA, 1446 bp, Glycine max
  Peptide Sequence Number=SeqID_161259
atggctttgatattggatcaacaatcaaacttcaagcacttttgtaaaatttgcaaaaaaggttttggttgtggcagagctttgggaggacacatgagggctcatggcataggagatgaaagtggtcacatggatgatgatgaccaagcaagtgattgggaagataggttgggtggaaatgtgccaccaagcaacaaacgcatgtatgccttaagaacaaaccctaatagactaaagagctgtagggtgtgtgagaattgtggcaaagagttcttgtcatggaaatctttccttgaacatggaaaatgcacctctgaggatgccgagtccttggtctcgtgtcctggatccgatgccgacgatggcggcatcggcagtggccggagaggatgtggctggtccaaaaggaaaaggtcattgagaactaaggttggtagcttcaattacaattgcccatcaagcgaggaagaagaccttgcaaattgtttaatgatgttatccaatgccattgtagatcctcttatagccgagccagaagaatcttgtgcatcggctagcaaagaggaggaacaacgaagaaatcccatgaacttcattgcaccattgtcatacaaaatcaacaacaacaaccagcaccttgttgataacaaggccaaaggggttgccaagggcttgtttgaatgcaaagcatgcaagaaggttttcaattcccaccaagcattgggtggccatagagcaagccacaaaaaggtcaagggttgttttgctgcaaagctagacaaccttgatgacaatatcatggaggatgatgtcatcacacatgaagagttcttcccaacaaaatcaaactccaccctccaatttgaccatggaagctccaatccctcattggcctcttcctctaagagaaaacccaaagtgcatgaatgctccatttgccacaggagcttctcttcaggacaagcattagggggacacaaaaggtgccattggatcacatcaaatgctcctgacacctccacattaacaagatttcaaccatttcaagagcacttggatcaaatacccaaatttgatacctcttctgagcctcttgatctcaaattagaccttaaccttcctgcaccatccaatgaccttgcaagaaggaatgtgtcttcagaattttacttgcggccttgggttgcatcaaaggatgctaaagatgataacaaaaatagccagtgtcaaagtctccacaaccctaataacaatcttgatattgacaatgatgaggacaaaaacaacaacaactcaatgcaaaacatggacaatgaaggtgatagtaagatcaagttggcgaaactgagtgagctaaaggacatgaacactggtggcagttctttgccatggttgcaggtgggaatcggttcaactgctactgatgtggaaactgataactgctga

SEQ ID NO: 69575 - DNA, 426 bp, Glycine max
  Peptide Sequence Number=SeqID_161260
atgatgataacaaaagatgatgacaaaggtgatgacaaaaagctcaaagatcaatcaaagaacaactcaagtgatcaaaataaaatcaagaacaattcaagagttcaagataaaatcaagaagaattcaagactcaagaggagagttaagagtcaagaatcaagattcaaggttcaagatctcaagaatcaagatcaagattcaagactcaagattcaagaatcaagagaaggcttaatcaagataaggtacatcctttgtggtacaagtagagggtacatctacttgggtttgactgagaacaagagagggtacatctcttgtggatcagttctagtagagggtacatccactaggttcaaagagaacaagggagggtacatcccttgtggatctttgcttgtgaaaggatttttacaaggttga

SEQ ID NO: 69576 - DNA, 429 bp, Glycine max
  Peptide Sequence Number=SeqID_161261
atgtatggggtaaagggtgtcacaaacacccctttgtctgaagaggaggtcagccaagccttagaagaattcaagaaagaagaagagtcaatctttccacaagcacatgaatcattggtaaatattctatcgaagaaacaaaaagcaaaggagattatggtatgtcctcgttgtagtgtcgtgtttgatagatcaacaaccaaagcttttgaagcatcaaaaattcgaaaaggtttcgaaaaagttcaggaatcaaaggagtttgaagtgagtagtttggcacttcgaagggaaggaactgctgaaggttcaaggaagggatattatgagtatcaaaaaatccaatggagaaggcatccaatgatgaggagagatgtgatactagcaatgcaacataaaaatgctacaaaaccatcagtcttcgactaa

SEQ ID NO: 69577 - DNA, 1083 bp, Glycine max
  Peptide Sequence Number=SeqID_161262
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaagacaatagaaaagcaatcccctaaggctagtatgcaagagaaaactagctctataaatgaaagtgaaaaagcaaaaggggaagaatctagtgaagaaatctacccccaagaagaaggacaaccattagtggttaaagagaagtgtaaggaggcacttgctagcattgccacacctcttgggcttgagtttattcctcaagtaaagaagttgttggatgagggtttggtttgcaagagcttaaatccttgtgcttttttggtgcccaaaataggtattattaggcaccaagtccctaaaataggtggtatgatgaatgttttgagtggtgcaacccttttttgtaaaatcactcgtacacctaacatcttcctggtgtgtgtacatagggacccattaggtaggaataatcaatatgaaaatacagaaaaaagtgttgagggaaggagcccaaagtatgaagaacctcgggatttgaggtcaaatcctttccaaggtggagggaatgatgcaatcctaccccgcaagggcattggatag

SEQ ID NO: 69578 - DNA, 204 bp, Glycine max
  Peptide Sequence Number=SeqID_161263
atggatgatggaagccaaggtttcttttacgaaccctccattttatatggagttgagcctaatgatattggtatggggaatgataatgatgaaaatgtgggtgttgatgacactgatatgcatttgcaacctagctatctcgatttttctagttatttcatgactaatgaggtttttaaaaagagtgatgatttgttagaatga

SEQ ID NO: 69579 - DNA, 372 bp, Glycine max
  Peptide Sequence Number=SeqID_161264
atgacagtctcgcctccgtttcctactatttcaaacccaagcacaaaggtgttggagaagacgagggtttaccattacaagaggctcattttagaggcaggttactccaaggaacaacactccctcttccgcacggttactctgggcttcaaattaaccaaacaaagtatgtggagatctactccaaactggctagctgtttccactagtcgttatccaactggtcatttcttggccaatcaaggtggcattggtcttcagtttgcacagcttggtcgagatgcttctgcaattgtgaacattagaagtgttgatgaagctgtagtgattggtgctgcactctctctgtcttcttctgcatttgttctatag

SEQ ID NO: 69580 - DNA, 468 bp, Glycine max
  Peptide Sequence Number=SeqID_161265
atggcattcttgggagaaacaagcaatcagaccattgctaactcgagattagccttcaattttccaaatggatcaatcactcacaaccaaactggtgtttattttcaaagtctcactccaacaccaatgcaagttcctaatggttgttcttttgagacactcaagagtaggatgcacaacacccttcaactaactaatgatcaattagtggatgaaatctactaccaaaaaccattcatagatgcatgtcaacaatatttttttcaatctctacaattaacaaatgatgatgatgtttacacaatgttaatgtgcaatgagcaatattcgtgtattggccctatagaattattatgtaccatcaatagaacatcgaatggcatgcttaacttgcttcaatccactattacttcctgctcatgttgcaatttcgtattaccaatgggaagtggaacataccatgtcaag

SEQ ID NO: 69581 - DNA, 177 bp, Glycine max
  Peptide Sequence Number=SeqID_161266
atgtcgacaatgaaagggcacaagaaagggagagagattcgagggaaaggagtttgcaaagacaagctaagatgtgttgaagaagtattggatgagagtgagcgcaaaaagatgagaggctatgaagcacagtctactgaggagaagcagaggcttttaaagttaagaataaattga

SEQ ID NO: 69582 - DNA, 1446 bp, Glycine max
  Peptide Sequence Number=SeqID_161267
atgcagagctggaagtggaacaggaagaaaccacctgttttccctttgcttgtgcttattttactgttcttcatagccttctcaaccctccacagtgaacacattatacaacgaatccatgaaaatccagatcatgttcacaaccaccaagaagtttcttcagccacctttgtcaaacccaacctctctggtcacctaaagcaagctgcagaggttttggatagattcagtagatgcaactccactgtagagtacaatggccgcaaagttgcttggctcggcgattctcagcattccggtcactggagtgcgaggccggaaagttgtgatgttttttcaggcaaatgggtttttgataatgtttcacatccactttacaacgagtcagattgcccttacatgtctgaccaattggcctgtcacaagcatggaaggtctgatttggggtaccagtactggagatggcaaccacataactgcaatttgaaaaggtgtagttccctgttactgacactgttaactgaagtggaaggaaaggacatgaactacacccaacaaattttcataaatgggagaccaaggagatggtttttcagggactacaagcgcctatttatagggactaaaaatatatttaacccgccaacaaaggtggaatgtgaaagaaatgtgggagaagttgagaggcaaaaggctaatgttttaattcctgctgataagagatcaatgtcaccaaatgctcatctcaccattttcagagcagaggaatacaatgcaactgtggaatttctctgggctcctcttcttgttgaatctaattctgatgacccagtaaatcacagactagatgaacggataattcgtcctgatacggttcttagacatgcatcactgtgggaaaatgctgatatacttgtttttaacacatacttatggtggagacaaggcccagtcaagctattatggacagctgaagaaaatggagcttgtgaagaattggatgggcatggagccatggagttagccatgggagcctgggcagattgggtatcttcaaaagttgacccactcatgaagcgtgtcttttttgtgacaatgtcgccaactcatctctggagccgagagtggaaaccaggaagcaagggtaactgttatggggagaaggatcccattgaccttgagggctactggggaagtggttcagatttgcctacaatgagcaccgtggagaagatcctaagacatttgaactcaaaagtttctgtcatcaacattactcaactatcagagtatagaaaggatggtcatccttccatttttcgcaaattttgggagccccttcggccggaacaattgtcaaatcccccgtcttactctgattgcattcattggtgcttgcctggggtacctgatgtgtggaatgagttactcttccattttttgtag

SEQ ID NO: 69583 - DNA, 1224 bp, Glycine max
  Peptide Sequence Number=SeqID_161268
atgatttcctttactgtttccttcttgcttaaaacacaagtatgcaaccgcaaacaatcatggagagatcttggaagggccatcgttatcaacttggagcacatcaaggccatcatcaccgcccaagagttcctcctcctcaactctcacgacccttccgtcaccccctcccttcatgagcttcaggcaaggatcatccgccaccacaaccaggatgatgttgaccccaaccccaaccccaacgatgccatcaagattctttccttcgagttcgtttccctcgaggcctgtttagaagctgcttgtagcgtcttggaaaatgaggctaaaactttggagcaggaggctcatcctgccttggacaagctcacctccaagatcagtactctcaatttggaacgcatttgtcaaactaagagccgattagacaccatcatcggtcgtgttcagaaggtcaaggaggaattggagcacttactcgatgacgatgaagatatggctgagatgtatctctctgaaaagctagccgagcaacaggtcttggagggtgacgtcgatgatgacgactgtggaagcaatgacttccaagattattttgatgatgtcaaagaatcaagagttaagcaagttccaaagaatcaggcttcaagaatcaagtctcaaagaatcaagattcaagaacaattaagtttcaagattcaagaacaatcaagatcaagattcaagactcaagattcaagattcaagagaaggtacatcctttatggtacaagtagagggtacatctcttgtggatcagttcaagtggagggtacattcacttggtttttcaaagagaacaagggagggtacatcccttgtggatctttggcttgtaaaggattttacaaggttgaaagaaatctcaagaaccgcaggccacttgatccaacaacgacgacaacgataccttttttgccgacaacaatgatcttcttcaacctgatgttcatgatcacactcacaggcacctcttccttcccttttaactcttctactcacttctccctaacctctaaatgtaattcatctttcaatttttttaggaatgctcctgaattatcattcgacaatgttctcggtagggacaaccatggaacccgcgacaacgccacctatagtgccatcaccaagcaacttgatgtcgaggagcttgagatgctcttggaggcttactttgtctag

SEQ ID NO: 69584 - DNA, 123 bp, Glycine max
  Peptide Sequence Number=SeqID_161269
atgggttgttgtctcagtggtggtggtggtggtggtggtgttgaggaggatggcagggtgtcgccagtgatggcaagggtttcaccagcagctgcaaggagttttccagtggcaaaagtgtag

SEQ ID NO: 69585 - DNA, 345 bp, Glycine max
  Peptide Sequence Number=SeqID_161270
atgtgtgtgagcataaggaagactgtgagagaaaaggcaactcccttgatgatgaccaaactgtcaccgtccacgcgtttgcagatgacaatgtctatgccgaagccacagagaaaaggaagggagatgtcgacatcgatgatgtggaagctttggcaaatggagtggaaaagaagtgttgcacatatggggatgaggaagaaagcaggggtttgggggtttctgaaaaaattgaaaggatttgatttgatcgcaagcaataggtgtggtagtaagggtaggggacgaaggattggccgtgtgataggagggcaacgaacaaatttccaaggcaacgaaaaatga

SEQ ID NO: 69586 - DNA, 579 bp, Glycine max
  Peptide Sequence Number=SeqID_161271
atgaacacccatggaaacttagcatacacgaagttgacctacgtacctcgcggagaaagctttgagcacccacgagtgtttcagcaccctagtagcaacagtgtatgttgggttttcttcgagccagacttccaagaacagtgtagggggttctgtggattcgagcgaggacaatgtgggtgtcgagggagcggtttccggcgggaggagaaagagaagagcgatttcaggcaggaggatgacaaagagaagaaggagggaaaggttttcgagcgcgcagggcttgtgattttggaggataaagttgtgaaggttcacctttatagaaatgggttcaaccctaattattggatttggagtgatcatggtgaagacatgccacatgttgatttaaatgataacaatagttacatggatgcatcaagtagtgcaacagatgtggctcaaggtgaacaatttatgttaatgcaagagatggtatatgatgctatgaggaaaccttttgaagctccaaaaagaatatggaagaacctccaaatgaagatactcaaagattttacaatatattggtggacgtga

SEQ ID NO: 69587 - DNA, 771 bp, Glycine max
  Peptide Sequence Number=SeqID_161272
atggagcgtttcatccatctaaggttgcggcaaaggctgtcactttgtccattaggcaacaatttggtcacctttggcctacatggggaggaattccaaaagatcgtcaagaactttttttccagtgtttttaggtttcatccatctaaggttgcgacaaaagctgttactttgttcattaggcaacaatctggtcacccttggcctacatggggagcaattccaaaagattgtgaggaactttatttccagcattttaaggctaaactatctcaagttaggtctaatgttgcatcaagtgttggtgaatcacaacacattcctgtagaccctgctgaagaacaaagacttatgagttggtgtcggttgcagttgggggaccaaagcgtaagggacaaatttatggcattggagaccttgctcgtacttatgaatttgaaaatgaaaacttcatgcaacatacgcaaggatcttccagttgcgctcaagatgccggaaagattaaccgaccaagggaggagtttcgtcaatcaaaggaataaatgtgtgaatttcagtcagttgtcctttagttcctacctcctgaagtgcgaaacattattcatcaacatcaacaatcccaccagcaacatcatgaccagcaacagtaggactagttccagcaacaagacaatgaccaagcagacgactagcaataacataatgagtagtagagacactctcgcaatgactattttgattattgagttagcaacacaaaattactattaa

SEQ ID NO: 69588 - DNA, 888 bp, Glycine max
  Peptide Sequence Number=SeqID_161273
atggctacaccacccagctctcctccgccttctactggtgcagcatcacagtcgtcatctacgttgaagcggacaagaaaagccacatgtctaagatcattggcgactagaccagttggggcagagagacctctggtccatgtggatcctgcgatcgggaaagtcgacaatccctacaggaagaagttaagaacatatttggggatcgtcgctcatgataaggtagatgtcacatacgagaattggaaacaagtccctgttactcagaaggatttgatatgggaggatattcagccgacaaggaaagtgtcgatgacactatatacaaaaagtacgacattagcaaggagaagtgggcccaattttgtcagacctgcaaagacccttcgtgggagatgtgcgaaaaagggcacaaccatcgagaaacaaaacacttcccttcaagtgttgtctcgtgggggttatgaatatctagaaaacaagttgatggaggataagaaaaagaagaaagtggaggaagctactaaatacagaagcactaacaccatgattgatccttcatctcccatcagacgacacgtgaagtggaagatggcctgcaccaagaaaactgggcaaatgacgcctgaggcagcaaaggaaattgatgacaagattgcctcacagggttcctttgtcgcccatggatgttatgatgtactgactgctgccattgggcgactagaacaccctggtcgtgtgcatgttgctagagccggtgtcacaattaagcaatactttgaaccggctccaaggacctcctacacgtcttcgtccatggctcccgaagacctaaagcagctgacgcaaaaaatcaggacagctagagagtcgatcacagaaaagtga

SEQ ID NO: 69589 - DNA, 318 bp, Glycine max
  Peptide Sequence Number=SeqID_161274
atgagggtacatctacttgggttgttgactgagaacaagaaagggtacatctcttgtggatcagttctagtggagggtacatccactaggttgttcaaagagaacaagggagggtacatcccttgtggatctttgcttagaaagaagaagagtcatagcgacagtgatagcgagaggcgacacggagtgggagtgagaaagaagattcgcgacgtggtggagaggaacagagttgcgacgaagatgatgatgcagaggcaacacggaggcgacacagagctgcgacagagacgaagatacgctagagacgtacgttag

SEQ ID NO: 69590 - DNA, 482 bp, Glycine max
  Peptide Sequence Number=SeqID_161275
atggaacgaggtgaggtggaggcaaaaagggaaggtggtgggagaaagggtcgagacaaggtgacgaccaaacatccttcttcttcactaatattcctcctaactatagggcaaaagacctatggaatatctaaagagtatgataaaatttcaaaggtcttcattccaaagaagacggaaaagaagggagaaagatttggttttgctagaattgaaagggtggcagactctagagtatttgctcttaagctagatgagatcttcattgataagtctcaagcgggtccaaagaaagaagaaacccggaaggacgcacacaatgaagcttcatatgcaagtgtggtgaagttaaggagcagtttagccatagttgaatggggttcttctatggcttggtgtgtcttttgtccttccacaagatatctggtctatgtacgaccagatgggagtgttagtgaaaggaacaagttgagaagatggcg

SEQ ID NO: 69591 - DNA, 2940 bp, Glycine max
  Peptide Sequence Number=SeqID_161276
atgaccatgaaaaagactaaaaaagttcataggactgaagttgaactgcttggagaaatcatcaacattgtcaatcttgtgttgacgagtttggataagtttgatcctgaatcaagtagacttataggaattgacaaacaaattcaacatttagaatcactgttacatcaagaatcaaaatacgtccgtgttattggaatttggggtatgggcggtattggaaagacaacaattgcggaagaaatatttagcaaactacgctccgaatatgatggttattattttctggcaaatgtaaaggaagaatcaagcagacaaggaacaatttatttgaagagaaaactattttctgcaatacttggagaagatgtggaaatggatcatatgcctagattgtcaaattatattaagagaaagattggtcgtatgaaggttttaattgtgcttgatgatgtgaatgattcaaatttaccagaaaaattatttgaaaaccatgattggtttggacgaggtagtagaattattattacaaccagagataaacaagtgcttatcgctaataaagttgatgatatataccaagttggggccttgaacaacagtgaagcacttgagctttttagtttgtatgcctttaatcaaaatcattttgatatggagtattataagctttcagagatggtggtcaattatgccaaaggcatcccattggttcttaaagttttgggtcgtcttctttgtgggaaagataaggaagtatgggaaagtcagctacacaaacttgaaaacatgccaaatacagatatttaccatgcaatgagattgagttttgatgatctagatcgcaaagaacagaagattcttttagatcttgcatgtttcttcataggattgaatttgaaactggacagcataaaagttttattgaaagacaatgaaagagatgattcagtggttgctgggttagaaaggttgaaagataaagctcttgtaaccatttctgaagataatgttatatctatgcacgatatcatacaagaaatggcttgggagattgtgcgccaagaatcaattgaggatcctggaaaccgtagccgattgatcgatcctaatgacgtttatgaagtattaaaatataacaaggggactgaggccataagaagcataagagcaaacttgccagcaattcagaatctgcagttaagccctcacgtgtttaacaagatgagcaaactacagtttgtctattttagaaaaaattttgatgtatttcctcttcttcctcgtgggcttcaatctttcccagctgagctaagatatctttcttggtcgcattaccctctgatatctttgccagagaatttttctgccgaaaaccttgttatatttgacttgtcaggtagcctagtgttaaaattatgggatggagtgcagaacttgatgaatttgaaagtacttacagtcgcgggttgtttaaacttgaaggagcttccagacctttcgaaagccacaaatcttgaatttctggagatcagctcttgttctcagttgcttagtatgaatccatctattttgtctctcaagaagctcgagagattgtctgctcatcactgttcccttaacacgctcataagcgataatcatttaacctcccttaaatatctcaaccttcgagggtgcaaggcactaagccaattttcagtgacatcagagaatatgattgaactagatttatcattcaccagtgtcagtgcatttccctcaacttttggacgtcaaagcaatctcaaaatcctaagtcttgtcttcaataacattgagagcttgccttcaagcttcaggaatcttacaagattgcgatatctgagtgtagaaagttccaggaagcttcatactctgtctctaacagagcttcccgcatcccttgaagttcttgatgctacagattgcaaatcattgaagactgtatacttcccatcaattgctgaacaattcaaggaaaataggagagagattctcttttggaattgcttggaattggatgaacattctctcaaggctattggcttcaatgcacgtattaacgtcatgaaatctgcgtaccataatttatctgcaacaggtgaaaaaaatgttgatttctatctcagatatagtagatcttatcaagtaaagtatgtatatccaggaagcagcattccagagtggttggagtataagacaacaaaggattatttaattattgatctttcttctactccacactccactctgttgggctttgttttcagctttgttattgctgagtctaaggatcacaacagagcagtatttcttgactatccattttatatcactgtcagtgaaggcgagggtgaaagtgaaaagggtggtattgacatctttgtgtctcacacagttagggttgaatccggtgtgtgtgtgatgtatgaccaggaatgttctcactacctacacagtagagccaaaaatcagacacggcttaaaataaaggttacaacaaaggaagtggctccaagcgattcaaaacggggtctggagttaaaagggtttggggtcaccccaataacttactcagtatatcagaatttcattcaagaaataaacagctcggctgatcatagtttcaatcaacaagtgaacacctcagctgatcacagtttcattcaacaaacaaattccccagcaaatcacagtttcattcagcaaacaaattcctcagcaaatcacagtttcattcagcaaataaacacctcagcagatcacagtttcattcaacaagtaaatttctccgcagaccacattttcattcaacagatggaagtgcccagctctatgcttttcactcaaatacttgctatcatcatcatcttgcttatacccttctggtttctggttgttaagaggcgcagactttaa

SEQ ID NO: 69592 - DNA, 261 bp, Glycine max
  Peptide Sequence Number=SeqID_161277
atggtgtactacagtcaccgtgccaaaaatgtcgccggccagcgactagatgatggtttcttaggaagctgtgggagggtgttggaagattactttaatgcacctccgatgttatttaatgtttttttttctttgtcagatgttgtggaagttgtgggaggcaacgatgtagaaatcgaatatttctacatcgttgctaaggagagaaacgatgttgaaagcgcaggttactacatcggtgctggcgagaaacgatgttga

SEQ ID NO: 69593 - DNA, 426 bp, Glycine max
  Peptide Sequence Number=SeqID_161278
atggtgagaggagtgaacttgaagctccttaagactatttgcatgttaattatgttagaactggatgatctttcactagacaatctgatgcaatcctatcccgcaagggcattgggtagaagactccaagtagattgggctagagatccaagggaaggccctaggctaagctctaacttctttaggaatcttcttaaggaagcttctcaaggaggtgaacttagttatgagagggcattctctccaagattcttatccaaggctcatcttggtggtgaagctccttcttccatggcttattccctagtggatggcgccgccttttacctcttctcctttgtcttccgctgcatctccatggcggagtttaaagattatgccagtagtggcctagagaatacttgtaagcttggagttgtaggatag

SEQ ID NO: 69594 - DNA, 445 bp, Glycine max
  Peptide Sequence Number=SeqID_161279
tcagctatcatcaaaggattcgtttctttcaaaggctgaagccaaaactattttagaaatcaatgccatttctgaggacgttgtttgtgttaccgtggggactattagcaaaatagtcatggataaccattcatggtgttatccagcctgtgctcaatgtcataggaaaactgacatccaaacaggaccattcacatgtggatgtggcaaggataatgatcagcctgttctaagggcgagccctggtgcagtggtaaagttgtgccttggtgacttgttggtcatgggttcgaatccggaaacagcctctttgcatatgcaagggtatagacttaaggtcatggttacacaaaacaatgagagtggcaaatttttgctctgggaccatgaatgtgctgaattgattggccaaacaactgatggtgtaaatagggtcaagattgaa

SEQ ID NO: 69595 - DNA, 809 bp, Glycine max
  Peptide Sequence Number=SeqID_161280
atggagcttagtgcacaacctagcgccacgcccaaaaccttctctatctcatggcctcaaagaagcacagagttggtaccagtcagccacaaagggcggagcccgcatgggactccaccagatttgtctctgaggtcgcctagcatcgctatcaggacaacgttcatctctgaaacactcttctggagaggaacatggagctcgcttatactcagtatgatgaattccttgaggagttggagtgaagatgttgaacgccttcctggagacgccgatcatcatttcggagggggagtggctgaccaatttttcccagtttcttcacacctaccccaaccatcaaaccattacgaggaagctgtgtatgccgggtggccagtttataatattgaatgccgaaggggctctatgaaagattttgtggaaggacttgaccactctcgctcaaacatggagtgtcttatggacatggacttgggtagcatgatattctcccagatcactcaaattgcccagtccaactcttctagcaccattattaacctaacttatatcaagaagaactattggaatccaacagatccttccattgttttttcagggccacaaaaggctacgactcgggccactccagatgctttgccagtagttcctccttcggtctccattccgccttcccttttctccactcctcctgaccaactcattcctatgatgcagtcttcaccagggccaatatcttctcatgttgagccttcatcagctctccctccatcagctagtcatgtcgctagaggctttcttggagc

SEQ ID NO: 69596 - DNA, 327 bp, Glycine max
  Peptide Sequence Number=SeqID_161281
atgaaatcaagcattattgtcaaccaaaacaacaataatacattgaaactattgtgtgagcaacaagatgaccacatctcacaggattcgtccctccctcataacaagagttatgttcaaaagcctctcgatagaatactcccattctatgaattaatgttgaatccaactcagtttcaggccaaagaagagaaggttcaagtagctgatgactcgctcagtgagccagatccgctcagcgagtggcttctgctaagcaaggcatacaacttgcttagcgggttgggaaaccctagaagaggatcatttagagatgtgctcgcctag

SEQ ID NO: 69597 - DNA, 412 bp, Glycine max
  Peptide Sequence Number=SeqID_161282
atgctagatgaaaacaatgctcatgcaaagagtttaaggatggcaagggatagattgacaggcactgaagtgcatactgtcagactcaaattgatcgccggtcgggaaaaagatggtcgtacatataatgtgccaagtgttccagaaattgttgcacttatagcaggtgatattgatgcaaattcgaacagagatattattgttgaaactcaaaatgatcaattacagaggatacatgaattacattgtagttatctagctctacaatatcctctattgtttccttatggagaagatgaatataggcccggcattctacatcgtgatacattaagtgggaaaaaaagaaaaaagaatcgtcttacaatgagagagtggtttgcttatagactgcaatgcagacccaatgaag

SEQ ID NO: 69598 - DNA, 666 bp, Glycine max
  Peptide Sequence Number=SeqID_161283
atggagttgattgaaaatatggcagccagtgaccatgccatccttcgtgatcaagcctacacacctacaacgaagagtcttctcgagctcacatcacaagacacactactagcctggcacaaactcctacccaagcaactagaaaccctcacagagatgctgagcaagcttcctcaacagttgcaggcagtgcaacttgcccattcttcagtcatgcatattgggggatgcaacatctgtggtagggcccatgagttagccatgtgcatggtccaagacgatgtatccaaagaagtcaactatatgaccaatccacaccatcaagggttccatcaaggaggacctccaagatacaatcaggggggatatttctctcaaggccaagaagacactttgaatcagtttatgcaactttctctatcaaatcacaagagcactaagtctgccatcaagaatctagaggcacaagtgggtcaattagctacgcaattggctgaaacgtccacgaacagttttggggccaacacagagaagaatcccaaggaggagtgcaagtatttacttgatgaaagtacacattgtttcaagtcaacaaacaagatcaagaaaatcacagataaggacttagtcaaattgttaacagaatctcatttttatttgcaatag

SEQ ID NO: 69599 - DNA, 678 bp, Glycine max
  Peptide Sequence Number=SeqID_161284
atggcacgtattgctgacaagataaaaaccattgatggatctaaagaaactctaaaacttgttgtaaggataattgagctctggtttgttgggacgtcgggcaggtctaaacaagctgaggtggtctttgttgactctgacccgttagttagatatttttcttattcacagggtgatcaaatccatgtggtctgtaagcaagaccagttaaagacatggaaaatggatttgaaggaaggttgtacttatatgatgcataattttagagtcaacaagaatgatggacagttcagagtttgtgatcatccatataaattgacatttattggagttacggttgtcagacagtgtgaattggatgggcttccttttaaaaattatagatttgcagatttttcgaatgtcattgctggcttattacagtctgacctattagtagacatcattggtgtggttgacgaggttgtctttcgtcatatttcacccataagtaaaagagttgtttttaagcttatgaatctaaggctttcagaattgggcattgagatccgctcagttttgacacgtcgttcgcagtgtagttcacaggctttaggttctgctcaattatcatcaagggaaacattcatttccaagtcagaggcaaagaccatttctgagataaacaacctttgtgaa

SEQ ID NO: 69600 - DNA, 504 bp, Glycine max
  Peptide Sequence Number=SeqID_161285
atgacttcacattcatcatcggctacaagcaagggcccatcaaactgcttggcagcaatacggttttcggctgcattccatgtttccaaggcttcgcaagtatggcaaccgatacttttttctgatggactaaaagaatttagaaggactcacggcattgacgacagtgtcatcatgcggttttttgttgctgacaaaaatacttccttcgaggtggatgtcattggacctatccattggcagggccgtccaaggtcggttctggctaccaggagacacatctttacagccgatgtcaccgaacacatgatgcaacagagcttccctttgatcaccatgcacgatggtgtcccatctgttgcccagccatggttccaatatctctctgagaatagtttaatagctggagatgaggtaatattcttcttcagatttgacgaacacgtatgggaagttctatttagaaaagaagttgtatgggatgatgaggacctctccaactga

SEQ ID NO: 69601 - DNA, 573 bp, Glycine max
  Peptide Sequence Number=SeqID_161286
atgctgcgtgagctagggctagggtttttcctcgtcgttgtttcgttactcctttggcggttttttggttttgacttcgatcctcttcacgatcgagacgctaattcttggttattcttcctgattgcttttgttcttgtgctcacgatcgcacttcgtgcagctcactactgcactatatgcagcaacagcggggacgcgagtgaaggagcgtccaatatggctttgggcaaatcaaacccgccggacatcgatgaggatctccacagccgacaactcgccgtgtatgggcgagagatcatgcaaaggctcttcgtttacttcctgtctgctgtgaagaatctcattcttactggtgtcaagttcgtgaccttgcatgatgaggggactgtggagctatgggatatatccggtagctttgtgttttcagaaaatgatgttggtaaaatcagggcagcaacttctgttagtaagctgcaggagctcaacaatgcagtggttgtacaaagcttgactactcagctgactaaagagcacctttccaatttccaagtacctacttcctctgtctaa

SEQ ID NO: 69602 - DNA, 576 bp, Glycine max
  Peptide Sequence Number=SeqID_161287
atggttactaaattcctcatattcttctttctttccatcattgccctcacctctgtcactgccgaagatggcacaggtttcgtgggctcaccaaaccgtaagttcctgggcctgaaaaccaaagaaaaactcagccatttcaggttctattggcatgacatattgaccggaagcaacccctccgctattcaaatcattccctcagttccaaaatacaacacaaccacttcgtttggtttggtaagaatcttagacaaccctttaaccttgggaccggagttgagctcgaagcaagtggggagggccgaagggctctacgcgtcggcgtcgcggtcggagcttagccttctgatggtcatgaacttcgccctaaccgaaggaaagtacaatggcagcaccatcaccattatgggaaggaatagggctctcagcaaggttagcagggagatgcctgtgattggtggtagtgggattttccggtttgctaggggatatgccctggtcaagactcattcttctgatcctaagaccatgcaagctacggttgagtacaacgtttatgttcttcattattga

SEQ ID NO: 69603 - DNA, 732 bp, Glycine max
  Peptide Sequence Number=SeqID_161288
atggcttccatcaacttcaaccccttcggtggaaactggttctcaaaaccccctaatcccctccctctcccttccctccccaacaccctcaccgacgcaccctccctccctcccaacttcgccgcaatctccctcccaaaccccttccgccgcaggcccaagcccaagtccgccgagcccaccgaacccgggccctacgagcagctggcccggcaggtcctctgggagtgcgagaccctcccggaccaccgccacaccccggaggtcgataagatcctcgccgacaatgacgccgccttcggcggcgacgacgactccgttttcgtccgccgcgaggacgcaacggacgaggaggtgcgggagaacgcggagctcgtggagcggctccgcagcagccccgtggtgcagttcatggcgcgcgccgaggagattctggacaagatgaacgagatggagctgaaggagaacgagaggccgtaccacaaggaggattgggaggtgtggaagaatgtgcccaatgttattgggcttgacgggaggcccatgcccagaaaagcccagaaaacccgcgaggaggctgatgataagttttgggatttcgctaggcagttctttttcgggctgtggaatttcaggcagaggccctaccctcctgggaagcccattgacgcggcccagtctattgggtataagaaccttgagaggcgctactatgactgtgagttgcaatga

SEQ ID NO: 69604 - DNA, 594 bp, Glycine max
  Peptide Sequence Number=SeqID_161289
atggagtccgaactcaaagacctcaattcgaagccaccgacctacaatggcaacgccaacagcatttgcgatgaccgtcctctgttgaagtcggagcctccggccttcgccaatagcatcgtcgagatggagaagaagctcaccacatacgttcgccgtgacgtgtacgacaccatgggacatagcgagtttccagggaaggagaagctcttgctcgacttcgcgttgggcactcttctccccattcgaggtttgcactctcttctctactctgactggcgaggaggaataggaagattacgctcatatgagtgggttgaggagaaccatcattgtttcgtgtgggctattgatcttctacagaagaaccaggataatgctaaagccagtttagaagttcttgctgctgatatgcaattcttgatgcaggttttgatgatgccaaaaataatttacttgataatggttgtcatcatcaaaacgggagagaatttgaatcatgcaagttttgatgatgctaaaaagaatttacttgataatggttgtcatcatcaaaaagggagaaaatgtgaatgtatgaatacaagtttttga

SEQ ID NO: 69605 - DNA, 279 bp, Glycine max
  Peptide Sequence Number=SeqID_161290
atggcagcaacaatggctgaccctgagtttgtcaacttgatacatggaaagaagcttaagaagaagttgcttcaaatgttggagatcattgcaagagtgatcacagacactaatgtcaaactttggttcaatgctctcaaagatattgtctctgagatcgatgacttaacgatgtttccgccaaagctgctactcaaaagcagattgaagattatgttaaatggagtcttcttaaaaaaccatttcaatttgggattagcggaagtaaaattcttctaa

SEQ ID NO: 69606 - DNA, 207 bp, Glycine max
  Peptide Sequence Number=SeqID_161291
atgatttacattctccccctttttgatgatgacaaccattattcaaggcttgatctttttgacatcatcaaaatcttcatgattacaaaatggaagttggaagttggaagttggaaggggaagttactggaagttgaaattggaagtggaagttactggaagttgaagttggaagtggaagttgctggaagttatgttgattattga

SEQ ID NO: 69607 - DNA, 480 bp, Glycine max
  Peptide Sequence Number=SeqID_161292
atgctccaaccatatgggatcagcataagcttaaaggagcactcaaacccggtgacccccaaggcctatactccgaagagtccgtcagagcctcttcctcctgattcagcaatttctcattgggacattgtcgcaacctacccttcggcgggagggcgatgcgtgactcgcaggatgcgtgttccacgaaaggaatacgcgtggagtcgccaccaacgtttatttgaggaaaacattggaaaaaccggaaaagacgcgatctacgaacttttaagtgaaaggctcgggagttgtatttacgcgcggggaaggtgttttcctttgctcctacgtacccttcctttggagaggaaatcagacctacgtagttctttcttatgcgtgaatcaagtggttctcttttacttgaaaggtgatcattttaaggcgttggaccttaaaaatgatccattttacttgattaagcgagaaatgacttaa

SEQ ID NO: 69608 - DNA, 432 bp, Glycine max
  Peptide Sequence Number=SeqID_161293
atgccaagagggccaaggctaagaaagccatggtggataagggcaaaggaaaaacaacaagatcatgtcatcatggaagaaaacttcatcaaggatggccttcaacctgaaactctcgttcattcttccatgctcaatcaattggattacgatatcccgagggaagtcaacccaaacatctccatggattccattgcccgctttcaggaaaattcggagaaggctgaggagaaattgaagggtgatctcgatgaagctgaggctgagatcctcaagactcatgaagtctacttcttcaaggctatccaacaagccaaatgcttcttcaaggaagtcgacctctccctctttgatattgacaaggacataaaacacaaagaagagttggttcctaaagctgaagtagaagttggcattgaaaaacctacctag

SEQ ID NO: 69609 - DNA, 252 bp, Glycine max
  Peptide Sequence Number=SeqID_161294
atgtctcgagacttcacatattgtgaaacaaaggatgccaagtatcccaaagtggccgatcaaaggttgcatatcatcaactccattggagcttgtaggccttggatcttattcatcaatggagtcctttgcttcttaaagtttgatagcagcggaatggagaaggagaatgatgattggagatgccacttcaaggaaaagatgagtctagaagaagctcaccaccataggaaaccatggataagagcttga

SEQ ID NO: 69610 - DNA, 294 bp, Glycine max
  Peptide Sequence Number=SeqID_161295
atgccattgaagaccttgatgagaggcttaagtgcttctatacagtcatgtgctgaagcaaattctacaataaatgtttatgttgccaagagaatacacagtatagaaatggtttccctcagttattcctgtcatgaggagaaagtagaacttgaacaacaggaaacaagaagattaaggaaagagcttgagagcgaaaaggcagctcgagaagaatcttgggctaaagtttccgttcttgagcttcagataaatgctacaatgcgagatcttgatttgagaggcggaggttaa

SEQ ID NO: 69611 - DNA, 1359 bp, Glycine max
  Peptide Sequence Number=SeqID_161296
atggattgcgacaccaagagactgtgtagaaggtggcctccttggaggcagaggtcaaaccgccaactgtctaccaaagttagtggtgtattggccaatttgctatgcacccgattagatggtgatgaattgtttatatgctacaaagacttgcaggctgagaagatggacctaggtggcaatgtggagagcttggcggctgagaaggataggcttgctaaggtagttgccgatttagaggctcgacttaaggagtcaatgtccagactagaggagtccgagttgtgggctaccaaggagagggagactagcagggagcttgaggaatacttctcccctaatggttgtgaggaattatgtttgagttacccctggttaaatgtcttgcctaatcagtgtggggataggttgcttgacctgttgagtttctcctctgatggttatgaggatggggtggcagttcgtttggttgaacttgaacccttgacggtggtcatcatagttgctgcatgtggaccttgggtttgtcgagccttggaccaggaacgtgtttgccctgggttttgtcaaacctacggagctgtgtcaaggcttaccaaggacgggccatggattttgtggacctacatgtcactcactatgggtggaatgtattggagacaaaatggctttctcttacatatgcgcctcttacgaagtagcaggattgacaagggaattgtccaacctaggtttggacactgtgttcttgcatacatgccgctcaccatgggtggtcgtactggaggcttgataatgatacgctcttgcattatgccactcgccgcggtcataatgctagaagaagggctcaccaagggcagacctagggttttgagagcctcggaggttggttgtgaccctgaagggaccttcctagttggggccaagcttttccatctagctatatgtgagtcgataaggagtttcattggttgctatctggagtgtacagtgggccctgaggatgactctgttagctgcctctgcttagctgttgttgtcggtgacaatggtgtatgtgaggtcgtacctgcatatgaggggtttctaggtgactatttccacctcgttggcttggtcccagtatgtccattccacacatggctaaaggccaagggaagctcagactatgaagccagctcgcacctctttgtagctagggagcgtcctccgatatggagaccgggtcatccaatttggttcttcttgttctccgaccataatttcctcaacatctatggtgggagtttggagcatctcttggatgatggtcttaaggtgcccgaccttcttggtactggccagcttgaagagtag

SEQ ID NO: 69612 - DNA, 720 bp, Glycine max
  Peptide Sequence Number=SeqID_161297
atgttgcctccaatttgtttccaagttattgagtggcaccaaccggatagagtattgagacaatttggaatgcaacaaccaatttcagggtgtccttcgcaattccagggcataggcagacgaagggaggctgttgaagcggaaccatatttctacccagggatggaagagcgtggccatggaatttattatacaccaccaacattttcccagtatcctacacaaatgtatcaatatccttttgaaggtcatcaaagtgatacttctgcaagctcttcaacattgggtggtgttgcagaaacatatccgattttttcatggcctgctatgaccccttcacagcaacatgatgccccaatcccaacacctaatgtcccattagaacacaaactaaatacattcaagagaacttcaagcaatacaagtgagttgtctgagatatctgaggtcacttgtctaacatacataaatcaattaaatgaacaacttccacgttcagattgcattggacatcgatgcctgttgtgcccttctgctccacatctactacatttttgttggtgctcagatggttcgagccaatccatctcattccttatccttgttgattttggtcgacacttcgcacaaattttagttggattagggataagtgtccatgcatcatcagaaggaggaattgccgcttcattcccaagaggccaccattatgcagagtaa

SEQ ID NO: 69613 - DNA, 738 bp, Glycine max
  Peptide Sequence Number=SeqID_161298
atgggtgtgtctcgcaggaggaactggcgagatcagtgcacgtcagcatgtctcgcctgtgaaactggcggcaccctccagctcagcatacttctcgctatctacaatggcggaacacctatgtcgccaaaccttcttccggaagaagaatttgtgatttccggaagtgctcaggaactacttccagaagaacgtcatccggaatgtttccggaagaagcttcttccggaagatttccattttcttccggaagaaggttcttccggaatttccattggtggtcctgtgaagtatttgaaaatttggtggtcccgtgttctgtatttgaagaggaagatccggaatgagcacttccggaagttactaaggcctattccggaagaagtgcttccggaaaacacatccggaatggtccttagtaacttccggaagcacttcttccggaagttactaagacccattccggaagaaggtcttccggaaatcaatggaggtatgactttgcgatgtcacaagaagttcatatggattatgattatgataatcaagaagaatgtgggggtgaatgaaccacatgtggattgttcaaatgcttttaatacatctcaggtattcgctactcgagatgatgttttgcaatgggctcgaacagttgcccatgaaaatggatttgttgcaatgattatgaggtctgacacagagaccggtagcagagaagagttcatttgtcttaattgg

SEQ ID NO: 69614 - DNA, 522 bp, Glycine max
  Peptide Sequence Number=SeqID_161299
atgggggatatgctaggtgcacccagattttttgctggtgcacccagcaatttattgaaatgtcaattttgcccttcatttaaaaacataaaaagttttttccctctttcggaagcattctgtcttctcttccgcgaaaaagcttccttcctctcttctctcttccgcgaaagcaagcttccttggtggtcttcttctccgcgagacttctctgccttcatcttctccgcgaggcttctctcttccatttgcattcgagaggacgccgaaaaaaatggcggaagcttagtgacggtgagccttccggaagacccgttaggggttcttccggaagaagatcttccggaacttccggaagaagatcttccggaacttccggaagaagatcttccggaagatttccggaagaagggttcttccggaagtaatgaaacgacttccggaagaacaggtcttccggaaagctctcggaacacctcttccgcttccggaaacattccggaagagggttctttcggatga

SEQ ID NO: 69615 - DNA, 474 bp, Glycine max
  Peptide Sequence Number=SeqID_161300
atgactcaaatcccaaccgaaccttacaaaggctcatctagatctagtctgacccggtcactgaccgagtcaactcgcctgactcacctacctgcaccgagtcccaatcactcctctccaaggaccacatcatcgtcgccatctccgatttgcacactcacaacgacaatcggttcaactcgctctcgaaaagcacacgtttcacacaagatttcaaggagaattgcgattttctcttcagaacgaaatgcttcatgccggtgctggttgaaagctgcgagagaggaattcacattcaacacaagagagaggacattgggtttggtttcggtggtggacgcgtcttctcaagagcctagggaagatgaaagagacaatggaaaaaggaaagcgagcgaggcgaggagagaggaattgaagagtcacacgttttttttaaaaaaaattacactgattcaactacagtttttatga

SEQ ID NO: 69616 - DNA, 873 bp, Glycine max
  Peptide Sequence Number=SeqID_161301
atgcttagtatgatacattatcaggacttcactggaaaaaaggacatgattttttgtggggtgtttgatggtcatggtcctctaggacacaagttatcacagtgcatacgtgacaatctacccgcaaaactgtcagcatcaatcaaacagtcacaagaaaaagccatgaaacactatgacgctaatgctacaaatggtggcagtcatagtgatgactatgttgaggataaccaaaatatgtcctttccttcatgggagggaacctttatgaggtgcttcagtgaaatagatgaaaagtttgctaagaacatagacactgacggatttcggggcggtagcactgctgtaactgtaatcaaacagggtgaccaattaataattggcaatgtgggggattctcgtgcagttctttgcagaagagcacctgacaatcgtcttattcctgttcaacttactgttgacttgactccagatattccaagagaagctttgaggatcattaattgtggaggtagaatttttgctacagaagaagatccaagtgtaaacagagtatggatgcctaaaggggactgccctggactggctatggcaagagcctttggaaatttttgcttaaaagactatggtgtcacctcgatcccagatgtatcatacagaaaacttaccaagcaggatgagtttgtggttttggcttctgatgggatatgggatatgctatcaaacagtgaagtaataaacatagttgcttcagcaccaaaaaggtccatggcagccaaattgttagtaaaccatgctgttcgggcttggagatataagcatggtttcaaggttgatgattgttcagccatatgcttgttcctgaaggattag

SEQ ID NO: 69617 - DNA, 832 bp, Glycine max
  Peptide Sequence Number=SeqID_161302
agtttgattcatcgatgcctcacataagagaaatcgttgtgaagaaagtgcgtcacgcaattgattctgaatccaattccaatggaaaatgctctgttccagagtacaaaaaaaagcaggtgagaaatgcagaggctttgattgaagaggagccactgaagccatggatcactctgaagagaaacgtgaagaacataaagtacctatcttcaatggttgatataagctttaaggataggtatgtgtatattgatgttggagctagaagctatggctccagcattggaagttggtttaggaagcagtacccgaaacagaacaagacctttcatgtgtatgcaattgaggctgataaaacgtttcatcaggagtatggaacgaaaaagggtgttacattgctgccttatgcagcatgggtgaggaatgagagtttggtgtttgagattaaccgcgacccgggggagaagaaggttcaggggaagggcaggggaatggggaggattcagccattgaagtcttcaggtggttttgatggtggtgagcttgagaagatttcggggtttgatttcgctgaatggttgaagaatacggtttcggagaacgattttgttgtgatgaagatggatgtggagggtactgagtttgatttgattccaaggttgtttgaaactggggctatctgtttggtggatgagatttttctggagtgccattacaataggtggcagaggtgttgccctgggcagaggagtcccaagtatgagaaaacttatgatcagtgcttgcagctcttcacttctctcagacaaagtggagttcttgttcatcaatg

SEQ ID NO: 69618 - DNA, 204 bp, Glycine max
  Peptide Sequence Number=SeqID_161303
atggcaaaatggaagaaaaggaaattagaattttgggtaaagattgctgtacgtgctcggttctatggtgtagtggttagcactctgaactttgaatccagcgacctgggtttgactctggcaggactcataattgatgagattaatcctgatttttatattattctttctcatagccaaaagttagttttgttgaacttgtga

SEQ ID NO: 69619 - DNA, 326 bp, Glycine max
  Peptide Sequence Number=SeqID_161304
gcggtgaggtagacggtgtcctcattgctgtccttccaggcactgcgccaggaggagaggacggaggagggattttcggagcggatgtcttagggggaggggaggcggcggaggaggagggagcggagcataagggcgtgggaggaaggggtgaaggtgtagaactgggaggagatgtgggggtcgggggagatgaagagggggttggaattggaatttgggggtgtggaaggggaagagtgggaggaggagggggaggaggggaagaggagagagaaggaggaggaggtggtgttgctggggagaggggggttgtgaggggatag

SEQ ID NO: 69620 - DNA, 72 bp, Glycine max
  Peptide Sequence Number=SeqID_161305
atggtcaacttaatgatgaacacttggacaaagaaggcaggatatccagtcattcaattcatgttgaattga

SEQ ID NO: 69621 - DNA, 111 bp, Glycine max
  Peptide Sequence Number=SeqID_161306
atggcgctaggaggagaagaagctcgaacggcagtgcaaaaacaaccaaacggcacagggaagagggaggtgtatattggcagaaacacccctaaaactcttacattttga

SEQ ID NO: 69622 - DNA, 4395 bp, Glycine max
  Peptide Sequence Number=SeqID_161307
atgctgcctcagttaaccattccatgctcaactgtttgcacagccgccttccctttcaagctctcaccgcattcaagaaccatttccagttgcattctcttgaaaatgttgatgaggttaccgttgccttgtccctcaaggcatgtcagggagagtcaaaactcgggtgtcaaatccacggatttgcgtcatcctgacatagtgtcttggaatactgtgctttcagggtttgaggagagtgtggatgctttgaattttgcacgttctatgcattttcgtgggatagcttttgatctggtgacatatacttctgctcttgcattttgttggggtgatcatggatttttatttgggtggcaattgcattctcttgtggttaagtgtggatttggttgtgaagtttttatagggaatgcacttgtaactatgtattcaaggcgggggatgttggatgaggttaggagagtgtttgctgaaatgcctgaaagagatttggtttcgtggaatgcgatgattttagggtatgctcaagagggcaaatgttatgggttggaagcagttttattgtttgtcaacatggtaagacatggtatgttaattgatcatgtttcacttacaggtgcagtttctgcttgtggtcatatgaacaacttagagcttgggaggcagatacatggtttgacccagaaagtgggatatggaacacatgtttcagtttgcaatgttttgatgtcaacttattcaaaatgtgaggtccctaaagatgccaaagctgtttttgagtgcattagtaatcggaatgtagtgtcttggacgacaatgatttctattcaagaagaagatgcagtgtctctctttaatgcaatgagaattaatggggctctgcttgacatgtgtggcaagcgtggcgacataattgagtctcaaagagtgttcaatgagacacctgaacgaacccagtttgctaggacagccataatatctccctatgcccgccatggagtctttgagtcagtgatgagtttgtatacagaaatggagagggaaggaatcaatcctgcctccatcactttcctttctgttttggctgcatgttgtagaaagggcatgattgatgtcggtcatagagtctttgactctatggtgaagaaacattcaattgagccaacctctgagcattattctattatggtggacatgttaggccgtgtaggacgactagatgaggcagaagagttgatgcaccagattccaggagggcctggattgtcagtgttgcaaagtttgcttgggtcttgtagattacatgggaatatggagatggctgagaaggttgttggtagattgatagaaatggatcctgcaagttcaggtccatatgtgttaatggcaaacttgtatgctgagaaaggaaagtgggagaaagttgctgaagtgcgaagagggatgagagggaggggagtaaagaaggaagttggatttagttgggtggatgtttctaatgttgattccttatatttgcatggtttctcctctggggataagtcacatccagagtctgagaatatttgtaaaattgccgagtttctgggactgcaaatgaaaattttgaaagagaacagagaaacggaaggagagtggtatcatgaacccaactcgttcgggcatagtggggaccactatgactcgctattctcgtctatagtcatgttatgccctctcaaaacccgtcacagagtaccgttgcaactatcattcagactttgttccaaattcttccacgcactcaaacatgaccaccaccagttcgactttattccccacccaaatgctgcctcagttaaccattccatgctcaactgtttgcacagccgccttccctttcaagctctcaccgcattcaagaaccatttccagttgcattctcttgaaaatgttgatgaggttaccgttgccttgtccctcaaggcatgtcagggagagtcaaaactcgggtgtcaaatccacggatttgcggtatgtagtgggtttgtgtcgtttgtcacggtgtcaaattcgctcatgaaaatgtactgcaagtctgggaattttgggaaggctttgattgtgtttgagaatttgagtcatcctgacatagtgtcttggaatactgtgctttcggggtttgaggagagtgtggatgctttgaattttgcacggtctatgcattattgtgggatagcttttgatccggtgacatatacttctgctcttgcattttgttggggtgatcatgggtttttatttgggtggcaattgcattctcttgtggttaagtgtggacttggttgtgaagtttttatagggaatgcacttgtaactatgtattcaaggtgggggatgttggatgaggctaggagagtgtttgatgaaatgcctgaaagagatttggtttcgtggaatgcaatgatttcagggtatgctcaagagggcaaatgttatgggttagaagcagttttattgtttgtcaacatggtaagacatggtatgttaattgatcatgtttcacttacaggtgcagtttctgcttgtggtcatatgaaaaacttagagcttgggaggcagatacatggtttgacccagaaagtgggatatggaacacatgtttcagtttgcaatgttttgatgtcaacttattcaaaatgtgaggtccctaaagatgcaaaagctgtttttgagagcattagtaatcggaatgtagtgtcttggacgacaatgatttctattgacgaagaagatgcagtgtctctcttcaatgccatgagagttaatggcgtgtatccaaatgatgttacatttataggattaatacatgctgtaacaatcaggaatttagtgacagaaggtctaacgattcatgggctatgcataaaaagctgctttttgtcggaacaaactgtctccaacagcttcattaccatgtatgccaagtttgagtgcattcaagaatcaaccaagatttttgaggagcttaactgtcgagaaacagtatcatggaatgcattaatttcagggtatgctcaaaatggctcatataaagaagctttgctcacatatttgtctgcagttaaggagataaagcccaatcaatacacatttggtagtgttttaaatgctattgctgcggctgaggatatatcattgaaccatgggaaaagttgccattctcacttgctcaaacttggtttaggcactgatccaattgtttcaggggctctgcttgacatgtatggcaagcgtggtgacataattgagtctcaaagagtgttcaatgagacacttgaacgaacccagtttgcttggacagccataatatctgcctatgcccgccatggagactttgagtcagtgatgagtttgtatacagaaatggagagggaaggaatcaatcctgactccatcactttcctttctgttttggctgcatgttgtagaaagggcatggttgatgccggccatagagtctttgactctatggtgaagaaacattcaattgagccaacctctgagcattattctattatggtggacatgttgggccgtgttggacgactagatgaggcagaagagttgatgcaccagattccaggagggcctggattgtcagtgttgcaaagtttgcttgggtcttgtagattacatgggaatatggagatggctgagaaggttgttggtagattgatagaaatggatcctgcaagttcaggtccatatgtgttaatggcaaacttgtatgctgagaaaggaaagtgggagaaagttgctgaagtgcgaagagggatgagagggaggggagtaaagaaggaagtcggatttagttgggtggatgtttctaatgttgattccttatatttgcatggtttctcctctggggataagtcacatccagagtctgagaatatttgtaaaattgccgagtttctgggactgcaaatgaaaattttgaaagagaacagagaaagggaaggagagtgtggttactacgatggaactatatttcaccgcaacattaagggttttatgattcaaggtggagacccaactggaactggcaaagggggaactagtatatggggcaagaaatttaacgatgagataagagaatctctgaagcacaatgcaagaggaatattggcaatggccaatagtggtccaaatactaatggaagccaatttttcttaactttcgcaaagcaaccccatttaaatgggctatacactgtgtttggcaaagtaattcatggatttgaagtgctcgatctcatggagaagacacaaacaggggcaggggaccgaccacttgcggagattaggctcaatcgtgtaacaatacatgctaatccacttgctggttag

SEQ ID NO: 69623 - DNA, 1962 bp, Glycine max
  Peptide Sequence Number=SeqID_161308
atggatttttcttatgagatgtatatggtgcagggttttatcactgatcaagaaacagcaatggaagaactttacggcaatattgagaatactcgcagatttaacacctgcttgaataatatggctattcgaatagctacagtttttgcttcattgaagatggaagattttaatggactactcttgactcactgtaacgagagtgttgcatgcatgctatggttgtttgcgtggttgtcaaacttaagttcaaataaaagtagattgctacttacttgtaatgtaagaagagttaggaagggattttcatcatacatggaacacattgtgaaggttagacaacgagggagagtagtcccaaaaggttcctttccccaacctcaaatcaacataagggagtcttactctttcagccataaagagtctcttagggagttaccatgtgtgtggtatcgtgctgcaaaggatagcgacgagtctacagcaacagcagttcgtgaattagttcctaccaagcttgctaatgctgtttgggacatggtttctaaatataaatctaccattcccggttttccacaaaatgaaacttgtgatatgctcattgttgacagatccgtagaccagctctcaccttttgatgactgtgttgaatctgcaccacagattgcacctgtcattcatgaatggacctatgatgctatgtgccatgatttgttgactatggatggagataaatatatgcatgaggttcccagcaaagtcgggggtcaacctgagataaaggaggttattctacaagaccatgattctgtctggcttgaactacgccacactcatatagcagatgctagtgaaagactgcatgaaaagtttaccaatttcgtatcaaagaacaaagcagcacaaattcaacaaagcggaagagatggtagtgaactatctacacgagatttgcaaaaaatggttcaagctttgccccaatacactgaacaagtggaaaagatctcactccatgtagagatagctggaaagatcaacaaaattatcagagaaacagaccttcgagagcttggacagttggaacaagatcttgtttttggggatgctggagccaaggaagttattaattttttaagaacaaagcagaatacgactcctgaatataagttgcgtttgttgatgatttatgcatctgtctatcctgaaaagtttgagggtgataaagcttcaaaactaatgcagttggcaaaactatcacctgatgacatgaaagttatcagtaatatgcaacagctggcgggatcatcaaacaagaaatcatctgctgctggtggtttctcactcaagttcagtaaccagaagacaaagcaagcagcgcgcaaagatcgtactgaagaggaagaaacatggcaattatttcgattttatcccatgttagaggagctcattgaaaatctaagtaagggagaattggcaaagaatgaatattcctgtataaatgagccaaatcctagtaatgcacgaggttcagttagaatcagcaaacagacccagacacctccaactactgctcctcattcaatgagatctaggaggactgcaaactggggacgagctcgtacttcggatgatggatattcaagaaacaagttgtgctttaaaatgattacagtttcagtttcaagtttcaaccctgattttatacttcttcctaacttcaatagtgactccacattgaagaatgtgactactgatttcaaaaggatgggaaagcgaatctttgtgtttatcattggtggggctactcgatcagagctgcgagtttgtcacaagttgacaccaaaattaaaaagggaagtaatcctaggtactacttccatggacgatcctccacaatatcttacgaaattaaagttattgttcgacaacaatgtttcacagctgaatggcctcgggatataa

SEQ ID NO: 69624 - DNA, 423 bp, Glycine max
  Peptide Sequence Number=SeqID_161309
atggcgagcgctgtagatgcttcaggaaacccgatcccaacgtcggcggtgttgatggcgtcgtcgaagcacattgggataaggtgccactccgagaatttggagtttctgaagtgcaagaagaaggatcagaaccctgaaaattgcctcgataagggtcgtgatgtcacccgttgcgtccttggcctgattacccctaaaggaatgcacaacattttgacaaaaaaggtactgctcaagctgaagggaaaattttaccacagccttaccactaaaggggaagggagactgggaaacactgtaggcaaaagcattaagaatgctttagaggtggttgtcgctttgtctactgacaagattcacaaatcacaatggaacactatagtatcatttgattcatgtaaacaatccacctccacctag

SEQ ID NO: 69625 - DNA, 435 bp, Glycine max
  Peptide Sequence Number=SeqID_161310
atggacggaaaccctaaacgagaatggtccctcaacgacttcgagatcggaaagcctctcggaaaaggcaaattcggcagagtctacgtcgccagagaagtcaagagtaaattcgtggttgcattgaaggttatttttaaggaacagcttgagaagtacagaattcaccaccagctgaggagggagatggagattcagttcagcctgcagcaccagaacgtgcttcgtctctacggttggtttcatgactcggagcgcgtctatttgattctcgaatatgctcacaatggggagctttacaaggagcttagcaaaaaagggcattttaatgagaagcaggctgcaacgtgtcaaggttttggaggtctctgcaatcgcagtgcgactgcattggtagcgtttgtcccctatttcttgcaatatcaaggattgtga

SEQ ID NO: 69626 - DNA, 294 bp, Glycine max
  Peptide Sequence Number=SeqID_161311
atggagcacattgttcaaatgaagggaagattgaagttgaatgttaccacaaccaataatggggatatgagaaccattagaaacagtgatgtgttgatattttcagtaccagaagcattaaaggataggaagctagaactcttaccagccatggtttgggaacaagagctagatgtcttactgaaagggtccataaaggctcatagacattccaatgacaacggcgaaaggtggctgacgatgcaggacggcatcgaacggcgaccagtggtatacgcaatgactggacactaa

SEQ ID NO: 69627 - DNA, 2484 bp, Glycine max
  Peptide Sequence Number=SeqID_161312
atggctgctgctggggttgcagccgagggtttgtctccaaatgctgccaaggcagaggctgagaatgctactcacctgtctgtagctttggtggagaatgccattgtgatacttatgcttgctgaggaacatttacggtcacagagcaagcaatcctcttctttacgccctacagacggctctccatctcccctctctctcttttatccagtccattataacttaaagccattgaccaacacaagtgcagaatcagcagaactcaggggtgatcgcacatcatcatctagcaactctgggggagtctctcttgatgtactttcttcaatggctgatgaaaatggtcagatctctacttcagttatcgaaaggcttgctgcagcagctgcagctgatccatatgaatctgtttcttgtgcttttatatcatatgggtcctgtgctaaggatttagcaattgggtggaaatatagaagccgtttatggtatggtgttggccttccatcaaatacagcctctcttggtggtggtgggagtggatgggatttttggaagtctttattggagaaagatgccaatggctactggattgagcttcctttggtgaagaagtctatggaaatgctgcaagcattgttgctagatgagtccgggcacggtggtggtcttggtataggtggagggtcaggtaccggaatgggagcaatgactgcgttataccagcttttagacagtgaccagccattcttgtgcatgcttcggatggttcttctatcaatgagggaagatgatgatggggaagaccatatgctgacaaaaactgcaagtagcatcggtgcagtgcctgaaggaaggaaactacagtcagcacttttgtggagtgttctcgcacctattctcaacatgccagtttctaattctaagaaacaaagagtcttggttgcatgttgtgtgctttattccgaggtataccatgctgtgagcatagaccgaaaaattcttcgtaaaaagtaccttgaggctatcttaccaccatttattgctgtcttaaggaggtggcgccctcttttagccagaatttatgaacttgcaactgcagatggtttgaatcctcttatggttgatgatgatgcactagcttcttatgccgagtcaattgaggctgctcttgatatgatatctccaacctgggctgctgcttttgcatctccacctgctgcgatggcattgtctatgattgcagctggtacttcaggtgcagaaaatcatgctccttcgtcaaatgcgcagattaggcgtgaaacctcattgctggaacggaaacatgctaggcttcattcattttcaagctttcaaaaacctctggcagtccctaacaaaacatcacagataccaaagagcaaagcagctgcgaaagatgctgcattggcagctgctcgcgatcttcaacggttttcaaggattggttctggaagaggtcttagtgctgttgcaatggctacatctgaacagcgaaggagtgctagtgatatggagcgggttaaaagatggaatattactgaagcaatgggagttgcctggatggaatgtctgcagccaattgatacaaagtcggtgtacgagaaagatttcaatgctttgtcatataaatttattgctgttcttgttgccagttttgccctagcaaggaatatgcagcgatctgagattgacaggcatgctcgtgcaaatataatatgtcagcatcacatcagcactggaattcatgcatggcgcaaacttattcgccagttaatcgagatgagaagtctttttgggccttttgcggattatttgtactgcccacttcgtgttttctggaagctagattttacggaaagttcttcccggatgagaagatgtatgagaaggaattatcaaggctctgatcatttaggtttcgctgcgaattatgaggattattcaggggagaacaatgatcacaccactccagttttatctgcagaagcaattacaatagaagatgtaaatgaagatgaagaacaggcggaaactgaaaatttggatgctaggattgatgatattgaagacaaagtagagaatcaacctaatttttcaaaagcagctgaaaaagttgcacaagaatctttagaatcctctgctattcaacacgaaagtgatgagggtgttgttcagagttcttcagcctttgcacccggttatgttccaagtgagcttgatgaaagaattgttattgagctaccatcaacaatggtccagtcacttagggttgtacagggaaccttccaacagaaggagatccaccacgttgtgttcggaatcatggcatgctgtggctccagcgaagaagatgacgccaacaaggacaatggtgtaacgactttcagatatgaggttttgccggggatgaaaaaacccatggaggaaggcgcagtcctcgctgttgacaggcaccagatatga

SEQ ID NO: 69628 - DNA, 900 bp, Glycine max
  Peptide Sequence Number=SeqID_161313
atgttggagggacatcaagttttggggtttggcttctttgtaattggtttatggcacttgttcaaccacatcaagctccatgccctttgctccatgtcctacacatcaaccctatggtttcccaccacaaaatctagatacttggagctcaaattcataataacaagcagcacaatcttcattgccttggagctcttcatctcgccggctcgtcaccaaccattcaaccctgatggatccattccctcagatcatctccacaactttgaacactcctccatggccatgtccttcttggtctatgccacctttgccctagttcttgacaaaatatgctccaaagctcaatatgagttaacccatttcttaggagccatagcttttgcacaacaatttcttctcatccaccttcactctagggatcacatgggactagaaggccaataccactactttttgcaacttctcatccttgtttctttgtccacgaccctaatgggtattggttaccctaatagcttcttggtcagctttgttcgttctttcagcataatgttccaaggtttgtggcttatggtcatggggtttctgctttggactccagggtttcaagccaaaggttgtgtcactcaccttcgtgaatatatggtcacatgcaatgatgatgatgcccttcatcgtgctaaatccttggtgaacattctattcagctggctattgattttagtcaccattttcgtgatgtctttctacttggttcttgtcacaagatatggtattgaaaaagtggagtatgcttcactggtaaaggagcagcatcaccttgaaaatggcttaaccatcgacgttgaatcccaaaaccataagcacgcaaacaatgtggcagatttgtcaacataa

SEQ ID NO: 69629 - DNA, 819 bp, Glycine max
  Peptide Sequence Number=SeqID_161314
atgaagaagcagagaaccagaatcccagattccatggaaacccagtacgaggagagtgagaaagacgagtcttcctcttcttatagttcctcagaagacgaggaggaagagatagagaaggagctggctgatgtaacgtttgaggagttgcagaaagcacgctcgaatggggcacatgcatttttccagaaacccaaagaagacataaaattaaaaagggctaacaagaataggccaatggaagctagtagcaagaagccagttactgggtttagagaggtcatccaagctccaaagaaggttgtacgtgatccacgatttgaatctctttgtggtaaacttgaccctgatggaaactgtcagataatgctgaaggattcttgttctgatctgtatcatagtgcgtaccaagaagtatcaaggtttaggaagagatataatttcttatacgaaaatgatcttcctgctgaaagacaggctcttaagaaggaattgaaaaaatataaagacccgaagcgtgtaaatgaaatagaagaacgtatatcatggattgataaacaagtgaagtctgattcagcgaagcatattgatgcagaaatatcggctaagcacaaaaagaaagagagagaagcagcaaagcagggaaaacgtcctttttatctcaagaaatctgaaatacggaagcaaaggcttattgaaaaatataaccatctcaagtcatctggcaaactggaagcatttgttgagaaaaggaggaggaggaatgctgcaaaggaccatagatacatgccatatcgtagatctggtgatgtggaatag

SEQ ID NO: 69630 - DNA, 195 bp, Glycine max
  Peptide Sequence Number=SeqID_161315
atggctttggtgtcacaagctaaacctccttacccttgcatatgcaaagaggctgtttccggattcgaacccatgaccaacaagtcaccaaggcacaactttaccgctgcaccagggttcgccctcaactttacctgttgttactatggaattcaaatagctgagcgattttcaataaccgcagtagtggcctaa

SEQ ID NO: 69631 - DNA, 159 bp, Glycine max
  Peptide Sequence Number=SeqID_161316
atggaaggaatcatgaaacaagtgcagctaacctgcgatgatggcgtgtctcggcggctacgggagcttcgttggagtttggcggcggcgcacggcggagttgctgggaagactttttcaggttgttctcaaactacactactgattgtaacgactagg

SEQ ID NO: 69632 - DNA, 219 bp, Glycine max
  Peptide Sequence Number=SeqID_161317
atggaagaagatgaaggacaatgtcttctccagcctctcaaccctatttctctctatttttcacatagtaaggcttggctagactctggttgtggtggtggtgggctcttggacttcttagcacatgaaggcttgctcagcgagcatgtctcgctgagcgagagtttcccatccgctaagcgagctggctgcctcgctaagcggatgaggctcacttag

SEQ ID NO: 69633 - DNA, 846 bp, Glycine max
  Peptide Sequence Number=SeqID_161318
atgttcgatagagtgggagacaaactcttatggaatgggggagaagatatcaagccaaaatacttaggagatgacatggtattgttagtgggactcacgaatgatagagctgtacaactgggaatccttccacatgcatgggatctggagtatattaagcagatcgtgttggcggcaggagaagtggtgattgtagatgacgatgtcgatgaatttcagagaatggatatggcgcgggagtgttggatgaaccaagagttcttgaggggcaaggacgcaagacaacagaccgacagacaaaattctcggcatggaacattgggtaataaccttaggttattgacacaaagtcagaacctagtcgcatcagaaggtagaagcggacccaccggagcaggcaaaagaaaaattgaggaggtcaccaggggacaaagtgaggctgatggagcggaagcaggagtcaatcaaagcttcacccaacaaagaatgtttggggaaaagtacacaaaaggggtgatagtgactactacatcgaaggagaaacaagacaaaaatagggaaaagcaaaagcaggtagatgcaacggatgaggtgcataacaacaatgaaagtgggcaggaaatggacctactgatgtcacacgattttgaaatagagttgcaagagtcacatgcttgtccacatgataaggagggagacaagcccttaatgggccttactaaaaacaccaacactggaataaacgaaggggctgaaggcaatatggcaggaaaaacaaatgagccaacaagtgcgatgaaagtttattccaaaaccagaggcggatcgcttgatacaggtcattga

SEQ ID NO: 69634 - DNA, 384 bp, Glycine max
  Peptide Sequence Number=SeqID_161319
atggtattattgctaaggcttttatgtcttgaggttttgccaagatcaaagactgttcttgctgttggacctggtaagcttccctgttgcttgatttatgtcaggaccaaaatcttctgtggattcagtgagtgggagattgcccctgctttgacagcattcaagaagcatgtcctaatatgtcttcagaactgtaaaggcatgcttgctacatgccaaggacaattttaccattttcaaagaatactgggtgcaccagcaataatgctgggtgtacctagcaacattaccaatgaacttaaggctgcaaaatctgagattcagaagtggcattcttcatttcaaaatgaaccttttatatctgctgagactactccacgttag

SEQ ID NO: 69635 - DNA, 169 bp, Glycine max
  Peptide Sequence Number=SeqID_161320
agcttccactaagcgcaacactcataggctaagtgcgaggaagactctagaagaagatgagccatacaggaggcttcctggttatggaaagctaaatcctctgttggatcttccttgtaggtacctgatcagtggaaactggtctgactctaaagtccttgatagttga

SEQ ID NO: 69636 - DNA, 336 bp, Glycine max
  Peptide Sequence Number=SeqID_161321
atggcagtcataagcccaacaaagatttctcaacctctgtttcccagaggatacaaccccaacgtgacatgtgcttatcatgggggagttccggggaattccattgagcattgtatgaccctaaaacataaggtgcaaagtctgattgatgccggttggttgagattcgaggaggagaatcgctcaacctgcacagttcttttcacttttccttgctacaaggtcatgacaaaagacaacaatagatacctcagagccctacactggggcaatgagaggcaccatgcaagagtctcaagcgaacctaagggtagatcagaagttctcacctggtag

SEQ ID NO: 69637 - DNA, 328 bp, Glycine max
  Peptide Sequence Number=SeqID_161322
agtggtacctggagatatgtcgcgggggtcaggagaccttggggacgtcaggcgagctcctggcagtcaacagataaaaggaacaaagaccacaaagcaaggaggcttgtgtggtggctggccaactgtgaatcttgaagctaggggagcttctggtaatcgattaccaggggatgtaatcgattaccaggcttcaaaagggaactggaacactgtggaggcctctggtaatcgattaccagcctgtgtaatcgattacacagaggaatgggtcactggtaatcgattaccagtggctatgagacaaattgtgttgcggcatagttag

SEQ ID NO: 69638 - DNA, 1872 bp, Glycine max
  Peptide Sequence Number=SeqID_161323
atggtaaaagtagccgagtatattccggatgctttaatgaaaaaagtttcttcgaaggctattaagacctatggatggattcctgagtccgagctattgctttggaacagctctttaaaagatgaaaagaccggttatccggtaagagttgctgtggtaccaagcaatagtgatgttatcagaagtgctgaaagatattataaaaatgattcgatcatggtgttcaactctccaagtctgatcgaaaatgcgaatgtaaagatacctaacggtcaaattgtatatgtttacaaacaagctgagaataacaaaagatttttagtgggtaaaaaaccgaatattgacatcgatagtatcagtacaggattatatggctgggtaagttccaatgtgatttcagcatggggggaacgttctgcagtaaaaatgaagaatacaaccggtgttacagaaacggctttagggttacatgaaggagcgccgggaggtagtgatgccgcaagcaggactgcaattcttcttacggatgttaataagagaacgccacttgaaaatatttaccctgttaagcttgcattaaaagaagcaccaactccggattctaaaaccaaatattttaccaatatcctggactatagtaagaactatgtcttaaatgtattgggagaacctatttattttgaccgttatcgtgagatcacggaaagaaataaaaacatcaacattgtttttgctttagatatcagtgcacctaatgcactctatgctccgattgtaaaaaacaattcttgcggagataatgtagctgtttccagcttaaatgctgattacagtaaaataatctctttcatagaagataagattaatgagatgaattgtcctaccaacagtggttatcaacccgtaagtgaaggtttaacggcggcaggaaatcttctttcagcggttcctgatgaaacgaaccttgtaattacagtggggacatctgccaaccagagcgggaatatgtatggcgtaatcaattctcttacgcaagcacaggcaaggctgatcatgttccagacgagctctagatcatctgatacgtataatgacttcgttttgctggggcagaatgttgtttccaatacggcaaaaaatattgccgagctgaaaaagcaaaaaatcattaaccagaatgatgttttaactaagaataactttaaccttgtggaaggagatgaaggcttcttctctttagattatccaaagcaaagtatgtctcagggatttgtaatattccctaaaaaaggagatgtaacgacaccgggctatctgaaaaaatcagttgatagtttaatttcacaggtaaccatggataatatgtcgatcgataattccctgaatgcttatttccattcctcagtaggagcgggaagaacagatgtggatctgaaatataaatatctgtatccgggacttaccaatcgcgttccggcgggaattgccgctcagctgatcaattacggaagtccgttcctggtaaaagggtatgttccaaaagatcttaaagattataaaccaggccttgaaaaaggaattctgatctctgaaacagaatatgataacctaaaagctttctatagggaggtatatgagaaaactggtccggcaagagcagacttcaaccagtcaaaagcaattaaagaatatgttcgtcttgttaaaaaatataatccgacaacaacattcatagataaaggtgatctttacgagcagcctatgtcttatgcggtgggattgacgacaggtttcgatttgtctgaagaagagctaatgtcaaaatataagcttaaaggatggagaaaatctaagatcgttctaaatgaaaca

SEQ ID NO: 69639 - DNA, 141 bp, Glycine max
  Peptide Sequence Number=SeqID_161324
atgtcgggaggaaaatgtgagtcgcgactttacaacgaccgatgtcggctaaaggcccaagtggagaaggacgaaggcccaagtggacaaggacaaagcccccaagtggagaaggatgaatgctcaagtggagacggatga

SEQ ID NO: 69640 - DNA, 708 bp, Glycine max
  Peptide Sequence Number=SeqID_161325
atgactgtacggcgcaccctttttaaaggcggcactatcctgacgctggacgccagcgtgcccgacctcgtctgtggcgatgtgctgattgaggacgatcgtattgccgccgtgggggaaaacctttccgccgacgatgcgcaggtgattgatgcctgcggccatatcgtgatgccgggcctggtggatgcgcatcaccatatgtggctcggcgcgatgcgccgcctgatgcccaacgttgacgacctgtttgcctatatcgatgtggtggcagaaacgctcggcgcgcattaccgtccgctggatatgtacctcagcacccggctgacggcgctggcatgcctggatgccggcatcaccacggtgattgatgcctgccacagttcacgcagtccggcgcataccgatgcggcgctcgacgcgctgcaggagagcgggattcgtgcgctgcacatggttggcgcagcaatggataagcaggcttccagcgatcatctgccgggcgatctggcccgtctcgccagccgctggaatcacgccggcagtcgcgtgcaggttggcctgtttggtcagctcaatctggcgtgctgccggcggagtttgccgaacccagcttgctgggtccgcacaacattttcaatcactgtacgcgcgtaccggcgcacatctggcagcagctggcggacgcgggcgtcaacattaccgtga

SEQ ID NO: 69641 - DNA, 1035 bp, Glycine max
  Peptide Sequence Number=SeqID_161326
atggagcgcggcctgagctgcctggcgctgtttgccgagcgcctgcaggggttcagcgccgccaacgtcaccatcgtcggtacgcacacgctgcgcatcgcatccaacgcggaagagtttctgcagcgcgccgcggaggtcatcccttatccgattgaggtgatttccggtaatgaagaagcgcgcctgatctttatgggcgttgagcacacgcagccggagaaaggccgcaagctggtgattgatatcggcggcggttcaaccgagctggtgatcggcgaagattttgagccgcagctggtggagagtcgccgcatgggttgcgtcagcttcgccaacctctacttcccgaaaggcgaaatcagccaggagaatttccgccgcgcccggctggccgccgcgcaaaagctggaaacgctggcgtggcagtaccgtctgcagggctggcagtatgcgctgggcgcgtccggcagtatcaaagcggcctgtgaagtgctgatggcgatgggcgagaaagagaagcgcgtgacgccggaaaacctcgacatgctggttagcgaagtgctgaagcacaaatcctttgctgccctgagcctgccgggcctgtcggacgagcgcaaggcagtgtttgtaccggggctggcgattctgtgtggcgtgtttgacgcgctggccattcgcgagctgcgcctgtcggatggcgcgctgcgtgagggcgtgctgtatgagatggagggccgcttccgccatcaggatatccgcagccgcaccgcgcagagcctggcaaatcattacgccatcgacagcgaccaggcacgccgcgtgctggaaaccaccgagcagctgtacagccagtggctggagcagaacccgaagctggccaatccccagctgacggcgctgatgaagtgggcagcgctgctgcatgaagtcgggctgaccatcaaccacagcgaaacagttcctgccgatgatcttcctgctgcggctcggcaccctgctgaacaatcagcgccaggccaccacgcgccctga

SEQ ID NO: 69642 - DNA, 621 bp, Glycine max
  Peptide Sequence Number=SeqID_161327
atggtggaggacactgagcggaaccgcaattttgcgtttattccgccggacattccgtccagcaacagcatcacggagtcagaatgggaagccgctgataaaagcaatccgctcattgagcgcatgcgttttctcggcatctattccaataacctggaagagttttacaaagtgcgctttgccgatctcaagcgccgcattctgattggcgaagaacaggggacgcccaccaccctgcgccatttgctgaaaaagattcagctgcgggtacagaaatcggatcaggagttcgatgcgctgtataacgatctgctgctggaaatggcgcgcaaccagattttcctgatcaacgagcgccagctgtcacccaatcagcaggagtggctgcgctactactttaagcatcagctgcgccagcacgtcacgcccattctgatcaaccacgacaccgacctgattgagttcctgaaagacgactacacctatctggcggtggagattatccgcggcgaagaaatccgttacgccctgctggagatcccgtccgataaagtgccgcgctttgtgaatctgccggcagaatcgccgcgccgtcgcaaagcccatgattctgctggataa

SEQ ID NO: 69643 - DNA, 481 bp, Glycine max
  Peptide Sequence Number=SeqID_161328
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggagggtacatctacttgggttgttgcaactgagaacaagagagggtacatctcttgtggatcagttcaagtggagggtacatccacttggttgttcaaagagaacaagggagggtacatccacttgtggatctttgcttgtaaaggattttacaaggttgaaaagaaatctcaaggatcgcaggtcgcttggggactggatgtaggcacag

SEQ ID NO: 69644 - DNA, 300 bp, Glycine max
  Peptide Sequence Number=SeqID_161329
atggcgtcatcaagtgcaaagaccatggacagattaaagctcctaaccttccccttttggagatgtttagattctttaaccactctatttcccccaccagggactccgacaagatttatcgcatcccattcgtcaaaagcattgttttctaaagaaaaactcaacatgcagcaggggcaggcatgtattcccttggttaggttccctgaccctaactatggtatcaaaaactgtaaattttataataaactcccttcacctattgtgagctccccgtcggttcctctttgggtcacttag

SEQ ID NO: 69645 - DNA, 168 bp, Glycine max
  Peptide Sequence Number=SeqID_161330
atgacgggaactgattcaaacacaactatcattgatggcctcggtgttgctggatggggagttggtggaatagaagcagaagctacaatgctcggccagcccatgagcatggtcttacaaggtgttgttgggttcaaattattaggcaaagatgtgtgggtcctctag

SEQ ID NO: 69646 - DNA, 276 bp, Glycine max
  Peptide Sequence Number=SeqID_161331
atgaaagttatactaagcaagccaacaagaaaaggaaggaagtggtacttgaaccagacttatcaaggtaatccttgtggcgtctaccctgacttatcttccttcaccggaagtggcgtctaccctgacttatcttccttcattgaaagtggcgtctaccctgacttatcttccctctttggaagtggcatcaccaaaacctccgtagcctgtatcaaacgatctgcttctcctcaggttcacatcacaaaagctctaagcaaattagaacgatga

SEQ ID NO: 69647 - DNA, 408 bp, Glycine max
  Peptide Sequence Number=SeqID_161332
atggagtttaagggatatgcctcagtatggtggaatcaagtgaggaggatcaaattgagaagtctcaagaggccaccatggcaagagttgcaccactatgcctctttggaggatctcattcatcaagctatcaaggtggaacaacaagtaaagaggaaacaaacatacaagaaggagtcaggatcttcatttaaatctcatgaaaaggtgcttcccttgtcccaattgatgctagcaatctcttatgtggaaggccttggcagtatgataaggatgttgtccataatggtctcacaaacaaattttcatttgtataaagggaaaaaggttaccctcacacctatgtctccaagtgaggtttgtgaggatcaaataaaaaatgagactgaagagagaacaagagactaa

SEQ ID NO: 69648 - DNA, 324 bp, Glycine max
  Peptide Sequence Number=SeqID_161333
atgcccaaattcgcagcccaattattcaagtgtagttttgacttccaagcccaattcgacaaaattgaagctttccagggactactcacattgagcatttggagttttgtagtattctataggccctacacaaggcagataggtcaacgtgcatccactgctaagcgcagcttcagcacgcttagcatgacaagggaatctggaagagcacaaggatcaaggtcacgtgctaagtgcgagatcagcttgctaagcgagacgtttgtcccttgccaggctcagtggacgactagcgccaagcccaaatccacttactcgcgctaa

SEQ ID NO: 69649 - DNA, 165 bp, Glycine max
  Peptide Sequence Number=SeqID_161334
atggtaagaaccgagtatcgaacactcggggaacttgtgttatttggtggccttgttcgtgctcgttcgcttagcgcacttatggaccgcttagcgcacattagtgaattctggcttagcgcatgcctttctcgcttagtggatgaagtgaagcggtgcacttag

SEQ ID NO: 69650 - DNA, 399 bp, Glycine max
  Peptide Sequence Number=SeqID_161335
atggaccagcgtggccatggaatgtactacatgccaccaacattttctcagtatccttcgcagatgtatcagtatcctttcgaaggtcatgatactaatatgtctgcaagtgaacattcgtatggtggtgttgcggaaacacatcctcatttttcatggccgaccatgacccattcgcagcaacatgatgccccaatgacaacacctaatgccccattagctccgcaatggaatgcgttgatttgcgtcacgagttttctgctgaggctgagcaacaagggcggtgacagcgggcaagaagaaatcctgatcgtgaagctcgaaggtgggatcgaccatgtggcacaggctcacgccatcacggacaccataatgactgattttgatgtctctatttaa

SEQ ID NO: 69651 - DNA, 171 bp, Glycine max
  Peptide Sequence Number=SeqID_161336
atggttaaagaggagtgtaaggagacacttgttagcattgccacacctcttgggcttgaggttattcctcaagtaaaggagtttttggatgagggtttagttcgtaagagcttaaatcattgtgctttgttggtgcccaaaataggtattattaggcaccaaaatccctaa

SEQ ID NO: 69652 - DNA, 149 bp, Glycine max
  Peptide Sequence Number=SeqID_161337
gtcgagacaaggttaaaaagcagaaaccaatcaaggtacttagggacgggcgcaaggagaggctagggtcacgaccaataggtggtcatcctttgcctagcctgggacaaacggaaagtgccgctgcaaagcatcctaatatcctttaa

SEQ ID NO: 69653 - DNA, 520 bp, Glycine max
  Peptide Sequence Number=SeqID_161338
atgaaggcccctgacgaagcaatggacttaattgaaagcatggctgctagtgacattgccattttgagagaccgaacccatattcctaccaagaagagtttattggagctaacctcacaggacgctctgttggcacaaaacaagtttctgtccaagaaactagagacactaacaacaacactcagatgtacaatttgtggtggagctcatgaatctggatgttgtatccccaatgaagagcaaatgacacatgaagttaattatatggggaatcagcccagaggcaatttcaatacaagtggatttccaggatttcagaacaaccagcagtatcaacaacagagacagtggcaaaatcaccctggtaaccaattcaacagagaccagtgtggttcatctacaaggccacaacagcagatgccaaatcactatgaccgaaccactaagctggaagagactctagctcaattcatgcaagtgtcaatgtctaaccaaaagagcactgagtctgcaattaaga

SEQ ID NO: 69654 - DNA, 201 bp, Glycine max
  Peptide Sequence Number=SeqID_161339
atgtctactgcaagctgcatggtggacatgggaaagaaaatactgcatatgggcatagaagatcaaaagatcagctttgattttttccaggaggacaaagatccacctagccaaaatgtttgtctgaaagtgcatgtgatggaggaaaagagacctgagaagaaggtccttgaagtaggaactctcttggatcctggataa

SEQ ID NO: 69655 - DNA, 414 bp, Glycine max
  Peptide Sequence Number=SeqID_161340
atgtaccctaccttgttctctttgaacaacctagtggatgtaccctccactaaaactgatccacaagagatataccctctcttgttctcagtcacaacaacccaagtagatgtaccctctacttgtaccacaaaggatgtaccctccaatgtgttaagacaaagttctcaggcggttagtccttcgaaactttgtgaagggggaaacaaaagaattcttaggagggaagaatcaaaagaattctcagactgtgtcgttttgaattctttgacaagggagaagggagacacaaaagaattcaggcggttagtccttcgttcttttggaaaagggagaagagagacacaaaaagaattcaggcggttagtccttggcgaaatctttttggcaagggagaagagaatgaaaagatga

SEQ ID NO: 69656 - DNA, 651 bp, Glycine max
  Peptide Sequence Number=SeqID_161341
atggataatgaagagggagtgcaagaacagatgaaggccgagctatcggccttaaaagatcaaatggcttctatcacagaggccatgctaaagcttcagaaaactatagaagataatgctacggcggtcgcttccaatacaactagggaagcggaaccggttctacagcccgcaataaacttgggccgagacagaaacatgatggttttcggtcggaggtatagtcctcaagcctacccttatggtttgcctccggacttcaccccccctaccgctccagacgatttgagccaagcccctacctttgaggggcaactccctcctcatgccgactatcctctgcaagaagatgatgaaggagatgcccatctaggccctctacttcccctcaaggatccggccccccatgaattgcctcaaccaaacatagtccgccacgtcccgtctccacccgcacccgttaacgaggacgacgtgtccaaaaggtcatcttcgcatgtattgccaaaggatggggacatattctacggacgaaaagttgttgatgcatttctttcaagacagcttagccgaagcagcagtggcatggtataccaatctggaagcttcttagatccggtcatggaaagacttggcaactgccttcattag

SEQ ID NO: 69657 - DNA, 301 bp, Glycine max
  Peptide Sequence Number=SeqID_161342
atgactaggggcaatccaggtgatttacaaccctttgatcttgaaatagatagaacctttcatatattagttaggcatagtgtgcatcctggtcattctatgcattttgagcattttgagcatcctgatcattttgagcattatgttgctggtgattctgaatattctgattttgagcatttggctattaattttcatactgagaacatggctcaacctccacctcgtgagaagactcttaaggagatggctgcacctgatttcacttatgaaagtttgtgcattcaatatcctgatgagg

SEQ ID NO: 69658 - DNA, 363 bp, Glycine max
  Peptide Sequence Number=SeqID_161343
atgggaggaactaaaaggcttttagtgataattcccaaggtggtcatatctctcttgatggtttctagagtagggactaccagcaaaaatatgttatcaaagagaaaaactctagatgagggttcactgtcatcaagcaagtcggagacccaacatgaccacagattcacctccactccttatgttcccatggacccggtccccagtggagtcgtcaactgtcgcaacctacccttcggtgggagggcgacgcggggctcatgggtgtgtcttccaagaaaggaaaatgcacggagttgccaccaacgtttatttgaggaaaacgtcggaaaaatcgaaaaaggtatggtctacgaactttaa

SEQ ID NO: 69659 - DNA, 342 bp, Glycine max
  Peptide Sequence Number=SeqID_161344
atggaggggactgttttcactcctgcacttgaaggaattaagcttgtaaaatcagagcaaggagaaattttgacccagcctttcttggatgcttgcaagcatatactgcctgttatagacaagtttggagctgctatggcccttgttaaatctgacatcggtggtaacatatcggtagcaatgaagcttgctcctgataggaaaaaattcatggaggtgatacaaggcactggtgatatcagtgctgatatacagaaattttgtactgacttttctcctatctttgaagagaatcacaagtttctggctcgttgtggcttggatgatatgaaggcgtcatga

SEQ ID NO: 69660 - DNA, 942 bp, Glycine max
  Peptide Sequence Number=SeqID_161345
atggtgaagttctcaaaggagctagaagctcaactgataccagaatggaaagaggccttcgtcaactattggcagctgaagaagcagataaagaggatcaagctctccaggcttcccaagcaatcccaccaccacgcaaaaccagactttggtctctccattttcgattctttaagcttctttgttaagaatatcgctcaaaacttctcaacttccgaccatcatgacctcaacatcattcaggtgaggaagaaaaccacaaagggtgacgaagaagaaatctatgagacagagcttgcacaattattttctgaagaggatgagatacgtgtgttttttatgaggctggatgaggagctgaacaaggtgaaccaattttaccggagacaagagagtgagtttatcgagagaggagaaaccctgaacaagcagcttcagattttgcttgatctcaagcgaattatcagtgatcgtcgccggaaaaattctccgtcgaagccatatagcaccggaatatcccctcaatattctccaacccgagattctgattattcgggaaattttggagattctgatgaaacaaattcagaaatttcacatacggatgaggtaatcacaacattagagagaaacggtataagttttgtgaattcagcgacgaggacaaagacgaagaagggaaagccaaaaacggcaatgagaattgatgttccagccaccaacccaactcgggcaattacagctatcactagcatgctgtgggaggatttagtcaacaatccaaccggagacttccttcacaagagaaagctccaatgtgctgagaaaatcatcagaagtgcctttgtggagctctataaaggccttggcctactcaaaacttacagtatgaatcttcaatatctaagtgtgaaaacgagtaaagctaatctaaaattgtaa

SEQ ID NO: 69661 - DNA, 243 bp, Glycine max
  Peptide Sequence Number=SeqID_161346
atgagtcatcatgaagacgagactcctaagaataagtctcataaacaagaagaacataagatggtgaaaaatacttcatcaccgtatgaattaaattccaacgacaacatgagaattggacgaggaaaaagaggaatagtacgtgcaaatgttgtgtacgatggtggaacaagtgcagacaccaggatctcagaaggagacagttcaggaccgtattttgaggacgctgattggagcaagtga

SEQ ID NO: 69662 - DNA, 312 bp, Glycine max
  Peptide Sequence Number=SeqID_161347
atgaatgggaatactagaacttacaccgacatggagacaagttgcagaaatagaactaggagtgttgctaagctaaatggacaacagttatggcatacttgcaagaggttggccaatgggataaagctacacagtccacatgatattctgcaaattcaaccaacaacgaggatattgaagagtgtcagtgagttgatagcagcaattaaaaatgttgcggaggtacaagagagtagctttgttgttgttgctttgtgccaatgtctttgtggccaatgtggttgcaaggaatgtggcaactgtgggaaatga

SEQ ID NO: 69663 - DNA, 1320 bp, Glycine max
  Peptide Sequence Number=SeqID_161348
atggataggtgctggtttaataagttcaagccaaaggataaaacaccatcttcaaaaaacaaggaaacaggcattgcaaaagggtcaaaacccccaacaaatgatgaagcaccttccaatgtgaccaaacagaaggttgcagctgcaaagcagtacatagaaaaccactataagaaacagatgcaggacttgcaggagagaaaggaacgacgtaatatgctagaaaaaaagttggctgatgctgaagtttctgaggaagagcagaacaatttgcttaaatattttgagaaaaaggagagggaatacatgcgccttaagaggcataaaatgggggctgatgattttgagcccctgactatgatagggaagggtgcatttggagaggtcagagtctgccgagagaaagcaaccggtcatgtatatgctatgaagaaacttaagaaatcagagatgcttcgcagaggccaggttgaacatgtaaaagctgagaggaatctacttgcagaagttgatagcaattgcattgtaaagctttattattcctttcaagatgaagagtacttatatctcataatggagtatctacctggtggtgatatgatgacgttgctcatgcggaaggatatactgacagaaaatgaggccagagatatcaagcctgacaacttgctgctagatagaaatggtcacatgaaattatcagactttggattatgtaaaccactagactgcagtaatcttcaggaaaaggacttctctattggaagcaacagaagtggagcccttcagagcgatgggcgtcctgtggctcctaaaagaagccaacaggagcaactgcagcattggcagaaaaataggcgaatgctaaggcttggaaccaaaggggctgatgaaataaaggcgcacccatggtttaaaggtattgaatgggacaaattgtaccaaattaaagctgcttttattcctgaggttaatgatgaattagatactcaaaattttgagaagtttgaagaggctgacaaccaaactcaaccttcctcaaaatcaggcccatggagaaagcagtgtggagtgacactgggccactacaaggaggctgtagcatcttggtttagttgtgcggctgtcacaactgctatcccggagtggcagaatgggcgaaatcatggtggagtagcttccttggtcctcttggcttttggccaaggcatcggtcctcctagcgcaattaaaggattctacttcttagcttgtcctttttcacttgatggcctttctggatcttcagcacctgctatagcggcgctagtgggctattga

SEQ ID NO: 69664 - DNA, 1440 bp, Glycine max
  Peptide Sequence Number=SeqID_161349
atggatcatgttattggtggaaaattcaagcttgggaggaagattgggagtggatcgtttggagagctttacttaggtgttaatgtgcaaagtggggaggaagtggctgtgaagctgatattgtgcctgcttcttttaccatgtgttactgagaagaaagggctttttaggataactgttgagttggaaatgttgctggaatctgtgaagaccaagcacccacagcttcactatgaatcaaaactatatatgcttcttcaagggggaactggtataccccatctaaaatggttcggagttgagggtgactacaatgtcatggttattgatctccttgggccaagtcttgaagacttgtttaactattgcaatagaaaattatccctgaaaacagttctgatgctggcagatcagctaataaacagagttgaatacatgcactcccggggttttctgcatcgcgatataaagcctgacaactttttaatgggtttaggccgcaaggcaaatcaggtatacataattgattatggcctggcaaaaaagtatcgggatcttcaaactcataagcatataccatacagggaaaacaaaaatctcactggaactgctcggtatgcaagtgttaatactcatttgggagttgaacaaagcagaagagatgatctagaatctctcggatatttgctcatgtattttttgagaggaagtctcccatggcaaggcttgagagctggcactaaaaagcaaaaatatgacaagataagtgagaagaagatgcttactccaatagaggtcttatgcaagtcatatccattggagtttacatcatacttccactactgccgaacgttgcggtttgaagataagcctgattattcttatcttaagagactatttcgggacctattcatccgagaaggttatcagtttgattatgtatttgattggactatgctgaagtatcctcaaattggatccagttctagagcccgaccaagtgggaaaccagtcataaaccccggacaatcaggagagagaatagaacggccttcaggtgctgttgaggcatttgcaaggaggaatggctctggacttgttctgcaaagtgagcattctaggcataggtcttcagatgatgtgccatcttccaaagacgtgcaagctgattctgagaggcctcgcagctcttctcgtaatggcagttcttcaaaaaagcctgtcttgtcaagcagccggccaagctcttctggtgagccaagtgaaagccgtactagccgactggtcttaagcagtggccgactatcaacaactcagagacttcaacctggttttgaatccaaaacatctttatctcgggcttcggcaacaagaggtggtcgtgatgatacactcaggagctttgaactcctgtcacttggttcaggaaaaaggaaatga

SEQ ID NO: 69665 - DNA, 654 bp, Glycine max
  Peptide Sequence Number=SeqID_161350
atggtgacacaggaaacaagaatctctgttaacaacatggttagggtttttcgggcaccaccagaacaacctatggcgatgcctcaaccaagagcaaacttaattccctatgctactcagtcgatggttgctacttcacaaccatttcaaggtccaggtccatcacagtccatgttgtctgcctcgaataatgttgctgaaagggcacaattatttgctccaccaattcaccacagggaaatggaggttactcaaatgaagcaggagcatgacaagaggcaagcaagcctcatagctgaacacaacgaacagctaaagcatacccaactgcaagctgaaaaggaattgagagagaaaacaatgtttatgaggaatgatcatgaagctcagatcaaagcattgaggtgtgaacttgaagatgagtgtcggaagctggaagaggagttgcatcttcaaaaatccaaagaagacaggcaaagggctttgttgcagttgcagttgaaagtgatgagtgacaagcccaaagaggaccaagaagtgaattcaaaacagagcatcaaaggaggaggccatcctcatccttcaaacattggtgatttgttttcagaagggtctcttaatccatatgcagaggatccctatgcatttgattag

SEQ ID NO: 69666 - DNA, 150 bp, Glycine max
  Peptide Sequence Number=SeqID_161351
atggaaaaagtgaaaaatctattttcaccccaccatttgatctatagtttatgcccaatcccccgaaacaacaacaaacataggggatgcccatcaatacttgaaggacataattgtaataacagtccatacaatcgagtagatgactaa

SEQ ID NO: 69667 - DNA, 543 bp, Glycine max
  Peptide Sequence Number=SeqID_161352
atgcagctacaagatggttctgttggtaaagtcattaataacctctcacaagttctggcaagggtggtgggagaccagagcatctttccccacctacacaaaaaagatcactctgcccatgttattgagaagttctctcactatgttggtaggcaaatgggattcttagagagcgaggttccagcagagctgtgtagattggcagatgagtatttgataaaacccaaggagtgtgtagaaagcatccttgaatatcttgctcatcagaaggatcctaccactttatgccagaaattgattgatgagtttgaccgatgcatcctcagttatttcgcatttaattggaaccaagcttcttatatgattagtcaggtattgagtgttgagtcacctcagaaaatacggctaaaaaagattctattggaagctacaagggaacagaggtttgagagagtaaccaagaatctgaaggtggcaagagtgttctctacattggtggaagagatgaaagcaataaaggttgactcacaaaaaacgacatag

SEQ ID NO: 69668 - DNA, 1050 bp, Glycine max
  Peptide Sequence Number=SeqID_161353
atgtttctcaaagtccagctgcactggaatgtcatcatcgctgctgaaaatctgcaaccggaaggtctgatgcttcatagggcaatcattgtccgccttctgagtgactttgctgtgaagaaggccaccaaagatctgggatactttcttgcagtgaccacactggagaaaataggggaaggaaaggtcagacaacatactggggatgtgctcttccctgtggtttttaatgtcatcaccttcaagtttttcaagggtgagatattagagggtgttgtccacaaggttctgaagcatggagttttcatgagatgtggtccaattgagaatgtctatctctcaaatttgaagatgcctgattaccgatatgttcctggcgaaaacgcatgcttcatgaatgacaaaatgtcaaagattggaaaagatgtcacggtccgcttctcggtgataggtacaaagtggatggaagcagaaagggaatttcaggcattgtctgtagatgtgtcatctgacgttgtagtatttgatccatttgatgctgtccctgttgccggaaacgaaatggatttgattcctaaccctaatgctaaccccaagcaacctgcgttttgcctaaaatggccatggaatgatgcaaaccataactctaactctaaccctagtccctgcaattttgagggtccatggctattcaagtcactccaaaacgttggcttaatcgctttcaattttgcgagctctttttcgagtcggaagaagaaaacgagtccagcggcagcgtcgtcgtcggaggcagagcagagagcgtttgcgtcggctctggccagcgggaaggaggcgactttggtggagttctactcccccaagtgtaggctctgcaattccttgctcaaatttgtctccgaagtcgaaaccaggaactctaattggctcaacattgtcatggctgatgctgagaaccccaattggctacctgagtttttcctcgggcttagtaaaaatcctagggacattttgtctacaagtgatgttgtgactgttactgattaa

SEQ ID NO: 69669 - DNA, 1071 bp, Glycine max
  Peptide Sequence Number=SeqID_161354
atgcaaacgacatcgtatagtcatcctctattctgtttctcttgcagaaacatcagtacaaatgggaagagtaagggttctgtgaaattccgtgcaccatatccctctcaactgggtcggaaatgtggattcaatgggagacctcgtgtttatatttctcccagccccataaaaccaaacaggttgtatgtgcttcataacacaggtgacaaccatccatctgctttttcagtagatgatgaaatgaacacaaaccatgctccaaatggcatgtcaccgacatttctcagcaactggtcacctccaaggtacttgtggagggggttatcagttttaatcctggcagggcaggtggttgtcaagactctaaagggaaagattcattggaggaacactcttcagcaactggagagagttggtcctaaatcagttggagtgtgtcttttaacttcggcttttgtgggcatggccttcaccattcaatttgtaagagagttcaccaggttgggattaaatagatcagtaggtggggttttagctctggctttctcaagggagctaagtcctgtggttacagcaattgtggttgcagggcgcattggaagtgcttttgcagctgagttaggaactatgcaggtttctgagcaaactgatacattaagagttcttggttcagaccctgttgattatctggtgacgccaagagtgttagccacttgtattgctttgccccttttgaccctgttgtgttttacattagggatggcatctagtgcccttcttgctgatggtgtttatgggttgagcatcaacattatcatggattccgctcagcgagctctcagatcatgggatattattagtgcaatgatcaagtcacaggtttttggtgctatcatatctattgtgagttgtgcgtggggagttacaactttaggaggtgctaaaggtgttggggaatcaacaacctcagctgttgttatttctcttgtgggcatcttcattgctgattttgctctttcttatgttttcttccaaggggcaggagatcagctaaagaattgtgtttaa

SEQ ID NO: 69670 - DNA, 3066 bp, Glycine max
  Peptide Sequence Number=SeqID_161355
atgtgtcttgagattcttgtttacaaatttccggatgtgcctccaatggaccgccaaccatctgtagataaccaagataatattcaaggccaatttccacatcatatgttccctccttggcctgttcattctcccccaggttctgtaccagtcttaccaccatatccagtgcaaggcattccctattatccagcatatccaggaagcagtccatttatgcagccaaattattctcctatggaggaccccagactaattgctggtcaaaataacgggcgcagaaggcattccatggatagtaggcacagcaatactgaatcagaaacacaggatgaagtggatatggagagggaaggttcacatactggagatcaacagaagaaggataggcaatcaggtagacagaaatctggcgtggtggtcattcggaacatcaattacataacaatggcagaaaattctggcagtggatcatattcagattctgcctcagaaaccggtgaagataataaggaatctgtgaagacctctaagagaagggaacccggaaaagaatctttgaagaaattggattcatctgataaggaagaaaccaagcatgggaaggatgcagatggaggccattggcaagcattccaaaattgtttactaagagatgttgatgaagacagacatgtcattgaccaagaccaatatgatcaggaaaaggtgaatgacgtgagaagaaaaaaacacattgctgtcaatgatcctttagtttttaatgaccgggaaatgcatgaagttcaaggaagttctgctatagatatgcataacattagcaaaggattggctcacatgcctaagacatccagtgatgatttattgttatctgcaagcgcaggacagtctggtgatggttggtctggagatgatgtacaatccttagaagtaactggaaaaaagggtggttataggagggcttcccgtgatgagttcatcatttccaagcaagaacatcaatttggcaatgcttacccttcctcggatattgaaacttcactaggttgttcaaacagtaaactagaaaggaagttgtttcatgatatgaatgatgattcctacatattggagcatagatcaatgggagtcaatgatgcaggaaatgttgagagaaatgctattaacatggactcggagatcccaatggtgcagcaatcttctgatgagataaaccatatcaattatgagccagatgaattgagcatgttgcctgaacgaggagctgaaaggggatcgatgagttatgaccctgctttagactatgaaatgcaggcccaggctggtggtactttacaaaataagaacaaagaggtagtgactgacaccaaaccaggatctaagaggttggataaggaggcaaaatcaaaacttacctcgaataattctgataaaagaaagaccggtgggccgataaggagagggaagacttctaaacttaatcctttggatgaagcacgagcacgtgctgagagcttacggaactacaaagctgatctccagaaaatgaagaaagagaatgaagaggaagagatgaaacgcctagaagccttaaagatgaagaggcaaaagaggattgctgccaagagtagcgcaatcactgcacagtcgccatcacagctaaccaagaaacaacttccaacaaaactttcgccaagctcccataaagggtcaaaattttgtgattcggagccaggagaatcctcaccccttcaaagattccctgtcagaactgcatctgttggatctaatgattctttgaaagcctcaaaaaccagcagattgatttctagaagccacttggataataacaaattaagccgatcagtgtcttctttgcctgaatctaagctagagaaggatgataacacaactgatactaaggcatcaatggcaaggattagaagattgtcagaacctaaaataagtactactcatcagacttcctcagttaaaccacatggcactggaacaatatcaaagactaaagcagctgatggacccgagagcaaaaagatttctgctattgtgaaccatgataaaagcaagacagcagccctcccagaactgaaaatcagaacatccaaagcaactgaggttcctcagaacagaaccacagtcaaagagaaggcacataagttgaatgataacaagtcttctatgaattcacaaggtaccatgctgaagaaaaatgaaattggtacttcattcaatgatgatggagacaataatcctgtagttgagaagactgttgtgatgcttgagcgtgagaaaccttatgtcccccctattcatagttctgaagaaaattttgatatcccaaagaaacaatatgataatgatgaagtgatggaaaaaacagagacagcatctaattatgttgctattcgtgctcctgtttcaccgttaagcatggatataatagataaagaaacctcagagagacaatcacacctgcaacccatatctactgaggtcaaaattgacaatatagagaaagaaacttcaaaatcatccagtctttgtattgctgcggaaacatatcatgccccatatgctcgggtttcttctatggaagatcctagtaccagaaatagtgagtatggtaaagcagcccctccaagtttagagactgcagcaattggtgtggagactgttaaagtacatgtgtctaacaacgagaactcaacacttgagaagattcctgaagcaattgagaagcctctggtaaaggaatcatcatccaaagggtttagacgactgctaaagtttggaaaaaggagtcatagcttagcttctgaacgcaacatggaatcagataatgtcagcattgacaatgaggcagatgaggttggaaccaacggttcttctaacgaagctctcacattttctgaaggacaaacctgtgattcgagggctgaggtccagcccattatgttaaatctggccatactaaatgagtttggggacaaccctgcacaagcctcaacaatgttgaaatctaaaattaaacacactaaattctga

SEQ ID NO: 69671 - DNA, 366 bp, Glycine max
  Peptide Sequence Number=SeqID_161356
atggctagggtcaccttagggaggcgagatcacaactggaagtgcgtccggaaagggtcgcgcatgcgccgtcatgcaccgtggatagctgctgtttggctcgtcaaaggagcggtgcgtgagaactccgatggagacgtgagtgacagatttgaggaatcttcggctggaaatgggcttaaggaggttgaaccggatgcaagtggttcgccgaaaaaaatgaaaattatagccagggataatgggtctatcgaggtgcctctattaggctctaggtaccctgtgtctgaatacagcacgggactgagtttatataggcttattgcacttgttacaaataaatggaggatatttgatttcctctag

SEQ ID NO: 69672 - DNA, 513 bp, Glycine max
  Peptide Sequence Number=SeqID_161357
atgaacaaggcatccgttgtattttccggcctgctgatggccgtttccgccggcgccatggcggctacctctggcgatgacgtggatatcagcaaacagccgctggaaaaggtcgcgccttacccgaaagccgaaaagggcatgaaccgccaggtgatctacctgccgaagcaagagcacgaagagaactacaaggtggagctgctgatcggcaagacgctggaggtggactgcaaccgccacatgatcggcggcacgctggaaaccaaaaccctgtccggctggggctacgattatctggtgctggagaagctctctgaaccggcctcgaccatgatgggctgcccggacaacaccaagaccaagcaattcatcgccgctaacctgggcgacgccgcgatgcagcgctacaacagccgcctgccgatcgtggtgtatgtgccgaaagacgcggaagtgaaataccgcatctggaaagccgaagataccgtaagccaggccgagcagaagtaa

SEQ ID NO: 69673 - DNA, 591 bp, Glycine max
  Peptide Sequence Number=SeqID_161358
atggtcgattggatcaacatgttcgcgctggcggtcaacgaagaaaacgccgccggtggccgcgtggtcaccgcgccgaccaacggcgcctgcggcatcattcctgcggtgctggcttactacgacaagttcatccgtccggtaaacgccaactcctacacccgttacttcctggcgtccggggtgattggcgcgctgtacaagatgaacgcctcgatctccggcgccgaagtgggctgccagggggaagtgggcgtggcctgttcgatggcggcggccgggttgaccgagctgctgggcggtagcccggcgcaggtgtgcatcgcggcggagattgccatggagcaccatttggggctgacctgcgatccgctcgccggccaggttcaggtgccctgcatcgagcgtaacgccatttccgccgtcaaggcggtcaacgccgcacgcatggcgatgcgccgcaccagcgaaccgcgagtttgtctggataaggtgatcgaaaccatgtacgaaaccggcaaagacatgaacgccaaataccgcgaaacctcgcagggcgggctggcgatcaaggtcgtggcctgcaactga

SEQ ID NO: 69674 - DNA, 300 bp, Glycine max
  Peptide Sequence Number=SeqID_161359
atgtcatcaagtcaatcaatatcgatcaatacacaagtgttatgcaacatatacactaagactcaatcctatatgcaatgtggtaccatgttagtgaaaaaccatgtcgggtgcctaagagtacatgacaagacaaaccacacattaggagaccagtcagggttacggtattttgtgagaatgctccaaccatatgggatcaacataggcttaaaggaaaactcaaactgggtgacccgcaagacctatactccaaagagtctgtcagagcctctccctcctgattcaggtccaacctag

SEQ ID NO: 69675 - DNA, 138 bp, Glycine max
  Peptide Sequence Number=SeqID_161360
atgccaccagcagaagtaagttctatcaagaagggaccaatcactagaaccatgagcaagaggctccaagaagattgggctagagctgctgaagaaggccctagggttctcatgaaccttaggggctccatattgtag

SEQ ID NO: 69676 - DNA, 1248 bp, Glycine max
  Peptide Sequence Number=SeqID_161361
atggttcatggtccatgtggaattttgaggcctgcatctccacgcatgaaggaaggtaaatgcagtcgattttatccaaaaaaatttcagctcacaactcttatagatggagatggttatcctgtggatcgtagaagaaacactggtcagacaataaccaagaatgagattataattgataatagatgtattgtaccctacaatccaaaattgctgaaaaaataccaagcacatataaatattgaatggtgtaaccaaaacacttctatcaaatatttattcaagtacatcaataaaggatatgataaagttacggctgtcatggttcatgatgacactagaacagttccccatgcaaacactctgaatgatgaaatcaaggaatatctggattgcatatacatttctccatgtgaatctacttggaggatctttggttttccaatacatggtagaaaaccttctatagagaggctacagtttcatcttccaagacaacatagcgttctctaccaagaccatgatgatattgatgatctcctctctaacccaagcatttctaaatcaaaatttatagcttggatgaatgcaaaccaagcttttgttgaaggtcaaagcctgacttattctgaatttgttacaaagttcatgtataaccaaaaacagagatgctggcaacttagaaaaaagggttatactattggtaggcttcaatgggttccccaaactacaggggaaatattttatttgaggatgatgctgactgtctctagaggaccaatctcatttgaagatatcagaacagttgctggtgttgaatatcctacatatagagaaacatgttttgctataggttttttacaagatgatagagaattcattgcctcaatcaatgaagctaaagactggggctcaacaccttatctaaagaatctttttgtattattacttttgataggtaccatgaataaacctgaacaagtgtggggaaaaacttggcattgcttaagtgatgatattctatatagtcatcgcagatcaacaagcactccaggattacatattgatgactgcaacctgatgaatctggtattgcttgaatttgaacggttgttacaagccaatcaaagatcacttaaagactatccttgcatgccatatcctgagaatgcaaatttactaacacatgcagacaatggccttattttgtctgagttgaatttcaacaatgaagaacttagatcataa

SEQ ID NO: 69677 - DNA, 573 bp, Glycine max
  Peptide Sequence Number=SeqID_161362
atggctccgaaaaagctttccgcaaagagatctaggagggacaccgcggatgaagggaccagtgccgcccccgagtttgatagccaccatttcaggagcaccgagcaccagcagtgctttgaggtcatcaaaggatggtcgttccaccgagagagacgcgtccagctcaggcacgatgagtacactgattttcaagaagagatagctcgccgacattggacgtcgctagtcactcccatggctaagtttgacccatatatagtcctggagttttatgctaatgcttggcccacagaggagggtgtgcaggacatgcggtcatgggtgaggggtcagtggattccttttgacgcagatgccctcggccagttcctgggtgacccgctggtgttagaggaaggccaagagtgcgagtttagtcagaggaggaacatggccgatgggttcgacgaagaggccattgcccaactattatgcataccgggtcaggacttcgctcggaccgctgcagggagggcaggtgccggatcatgcgcaccaagcatgaccaccttgaaacccaaatgtggatga

SEQ ID NO: 69678 - DNA, 243 bp, Glycine max
  Peptide Sequence Number=SeqID_161363
atgagggattgggggaattttctccaccgaatccttgaggaggattctaaggattatgctctgattacattattcttcttgatctcacttagagagctcgtcttgctaagtgggcgtccaattttcgtgcttagcacgacaattcgcactgagtgcaactccctctgcactaattctcgctcagcgcaattccctctcgggttggaattgcgcttagcgcgctcctcgcacttagcgagatag

SEQ ID NO: 69679 - DNA, 294 bp, Glycine max
  Peptide Sequence Number=SeqID_161364
atggcaggacgtggtagggatcagaaccgtgatgtccaagaccgcatcacaactgtgctggaaactctagtgcagggacgtgatgtggagccgacagagtatcgaggactcatggcttttcctgagactgagaagattttcgaggcgataggttgcctcgaggagcataaggtcccttatgcaacattcatgctccaaggagaagctgagaactggtggaagttcgtgagacctacatttgctgcacctagaggcgtgattccttggaatgccttcaaggacaaattcctataa

SEQ ID NO: 69680 - DNA, 294 bp, Glycine max
  Peptide Sequence Number=SeqID_161365
atgaagctcaagtctggggaacctttgaagcatatcccttggaagaaaaggccaaaggaaagttatcctactgataggataataccccagaatactaatgatggtaaaattcgaacaaagttttatgttccagaaccggtgtttcaaaagacagaagatttagctgatgattattcctcattaaacagagattgggaagactataatgctcaattaatggaggacttattgcacaagaagagataccgttatcatcacctggtgtatggaagtctcacaagatcagaggcataa

SEQ ID NO: 69681 - DNA, 240 bp, Glycine max
  Peptide Sequence Number=SeqID_161366
atggccattattgtcaatgcggaagcttgtggttacgtgagcatgaactactaccaatatatagatgttgtttacaccaatgagcacatcttaaaagcatactccgcacagtggtggcctcttgggaatgaaacggcaattcctccttctgatgaggcatggacactaatccctgacccaactacaattcgtgcgaaaggtcggccaaaatcaacaaggataaggaatgagatggattga

SEQ ID NO: 69682 - DNA, 285 bp, Glycine max
  Peptide Sequence Number=SeqID_161367
atgtataaacagaatcagaaggactttctcaggtttgtagtgaggcttggctacaaaaatttgttggtggtatacactcccaataaggatgttaataactctgctcccatactcattgaaatccgacaacctcaaactaatcatgcacatgtctctcaacccataggggagacacatgaaatgccccttcacaatctagcggactttgagccttgcctcggatatgccactgaagggcaagcagttggtggtatacccctgcaaaacacttttgagggcccttag

SEQ ID NO: 69683 - DNA, 291 bp, Glycine max
  Peptide Sequence Number=SeqID_161368
atgatgatctcaaagaacacttcaaggttcaagaggaaatttgatttcaagaatcaagaatcaagattcatggttcaagcttccaagaatcaagatcaagattcaagaatcaagagaagaattaatcaagataaagggtacatctacttgggtttgactgagaacaagagagggtacatctcttgtggatcaattctagtggagggtacatccactaggttgttcaaagagaacaagggagggtacatcccttgtggatctttgcttgtaaaaggatttttacaaggttga

SEQ ID NO: 69684 - DNA, 297 bp, Glycine max
  Peptide Sequence Number=SeqID_161369
ttaaaggttgtcagcgaagagagtttcgaagcgccggaagaggatgaagaagtccaagttctcaaaaacgagttaggaaaggcgagacttgccaaggagaagttcaagttagccgctacagacatccgaaaagagagtgtcggattacgagaagagaatgcaactaccgcaagagcccttgaacaagagaccaagagggctcgcaaggaagagtatggtcgtaacaaatttcacggagctttgtggggtagcaacagtgaactcaagctgcgaagggaagaaagagaccagtcgtga

SEQ ID NO: 69685 - DNA, 454 bp, Glycine max
  Peptide Sequence Number=SeqID_161370
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacaggtactggtcaactaaatggtattcctgtagctattggaattatggattttcagtttatggggggcagtatgggatccgcagtaggagcgcgtatgcaagaaggaagtttgagcttgatccaaatggctaaaatctcttctgctttatatgattatcaaaaaaataaaaagttattctatgtatccatacttacatctcccactactgggggggtaactgctagttttggcatgttgggggatatcattattgccgaaccaaatgcttatattgcatttgctg

SEQ ID NO: 69686 - DNA, 639 bp, Glycine max
  Peptide Sequence Number=SeqID_161371
atggaacttattgagaatatgggtgctagtgatcatgctattttgcgtgatagaactcatgttcttacaaagagaagcctgttagagctttcttcacaagatgcaattttggcacaaaataagctgctagcaaagcagcttgaatcacttacagagacacttagtaagttgccaactcagttacaagtggctcaacctttccattcagcagttatgcaggttggaggttgcagtatatgtggaggaccgcatgaatctggttgttgcatacccctggatgatgttgcaaaagaagggcaaggatggagatctcatccaaggaatcagttcaataaagaccaaggaggacaatccactaaacctcagaatcaggggcctaacatgtatgaaaggaccaccaagcaggaagagaccttggctcagttcatgcaagtttcaatgtccaaccacaagagcactgagtcagctatcaagaacctggagatccaagtgggacagctagccaagcaaatagctgagaattcttctggaggttttggagctaatacagaaaaaatcccaaagaagaatgagttagtagctgatggagaaaaagaaaaagaagaagatcagatgaaggagaaaaaaaataaaggatga

SEQ ID NO: 69687 - DNA, 189 bp, Glycine max
  Peptide Sequence Number=SeqID_161372
atgccgatgtgtatggattcctcgagccaccgtccatacaaagatctaggcaatcgcaatttgaatcagaaagttatattaagaactagatgcaagaactcaaaaagggattcgtatctaggagcctacttgaatggtgcacattggcaaatggtcatcattttgcctcagaaaaatgttgtcatctag

SEQ ID NO: 69688 - DNA, 312 bp, Glycine max
  Peptide Sequence Number=SeqID_161373
atggcttccatgatggaggccatgttaggaatgaggcaactcatcgagaaaaacttggccactgctaccactgttagtttggctgccgaagcagacccaactctccaagctaccgcgcaccatcctcccccaaacgcggtaggacgaggaaggagcacactggggcacaacagcaacccccattttggatacaatcgggtggcttacccttatggattgccgcctaattacacaccaccagtcatgcaagacgatgcgggtcatatctcttcccccatccttgaaggggagcctcctcgacagcccgacgag

SEQ ID NO: 69689 - DNA, 333 bp, Glycine max
  Peptide Sequence Number=SeqID_161374
atggagtcaggtgacatgcgggggtatcgtatggttatccgcacttttcgtcaaccaggggcaaatgagcccgttgacgcgcagagactaagttcatcttctgcaccttttgtcatcctgacccatggagtcaggtggcatgtgggggtaccgtatggtttttactctagtcgtcgtgagacatgcaagctcgacgacacacaagatttttctctactgggcggggggcaatcaagttcgatggcgtggggaagtgtcgtggttgtcccactatatcgctttcaagacactgaagttttgttgacgcatttgataccttttctttctttctga

SEQ ID NO: 69690 - DNA, 417 bp, Glycine max
  Peptide Sequence Number=SeqID_161375
atggtagcaggaaatgcaaccatagaaaaacctagggaacaatgggatgaagaagaaaggaaaaagggcatggatgaatattttagagtatcaaactacaagaatgcaaaagaaatgtgggataccttacaagtaacctatgaaggaacaacagatgaacacgaaatggaactcatgagactaaatcaacacaaagaaaatgacaagaaaaagaaaggaatcacacttaaagcttcatcttcaattcaagaaggaagtgataaagaagacttgaatgatatagaagaagatgatgatttcagtttcttcgtaaaaagattcaacaaattcctaagaaacaaaggaaaacaaagaaagatcaaacttcaaatcaaagaaaagaagagaagattcatcttctgttcaaaagtgttatga

SEQ ID NO: 69691 - DNA, 288 bp, Glycine max
  Peptide Sequence Number=SeqID_161376
atgaaggcccaagtggagaaggatgaaggcccagaggcagagacactttcaagactattaattgttgctgaaacttatcaaggtaatccttgtggcgtctaccctgacttatcttccttcactggaagtggcgtctacccagacttatcttccttcaccggaagtggcgtctaccctgacttatcttccttcaccggaagtggcgtcatccaaaccttcgtagcctgtatcaaacgatccgctcctactcaggttcacatcatctggtatcagagcttcgactcttga

SEQ ID NO: 69692 - DNA, 653 bp, Glycine max
  Peptide Sequence Number=SeqID_161377
atggccacaatgatggaggccatgatgagcatgaagaagataatggaagtcaatgcggttacaattgccgctaccagcactgttgctaaggtgaacccgacgtccccattcgacatcaaccaaatgaatcatccaacctcagctatggccttcccaccatatggcttgcctcccaactatacaccacccaatgtagcgtacactcccagtgagaatgtcaacaactccactcccatactcattgagagcgggcaaccccaaactgatcatgcacatgtctctcaacccatgggtgagacacatgaaatgccccaccacaatctagtcgacttcgagccttgcctcgaatatgccactgaagggcaggcaattggtggtatacccctacaaaaccctttggagggccctcagtatcacccccagctacacctcttgcattacacaacaagtaaaaaccctcatgctatggcagaaatgggaaagttggatcatctagaggaaaggcttagggccattgaaggaggtgaagattatgcctttgctaacctaggagagttgttcctagtacccaatatcatcacccctcccaagttcaaggtgctggactttgacaagtacaaggggactacttgccccaagaaccatctaaagat

SEQ ID NO: 69693 - DNA, 345 bp, Glycine max
  Peptide Sequence Number=SeqID_161378
atggatatctgcgaagatactgacattcttgtaatcttgggaaggccattcatgttgaccgcaagctgcatagttgatatggacaagcctgctccagaacaaaatgtttgcttacaggtaatggaaggaggtcaagaggttctaaagcttagaaaacatcttctgaaaaatagtcctttcgctaagtgcaagcctcgcgctaagcgcatctttgttcatgcgctaaaccgagattctcaagcacttagtgcccaacccttgcatctgaggctgatttggtccgctaagctggccaaggctgagctaagccaacttcaattcgatctgaattcgactaagctgtag

SEQ ID NO: 69694 - DNA, 375 bp, Glycine max
  Peptide Sequence Number=SeqID_161379
atgactctttcatcatggcagaacaaactaaacaggctggtggctactccactcagctctcatcctcctcctccttctcctcctcctcctactgaagcagcatcacaattgtcatctaccttgaagcagacaagaaaagccacacgactaagatcattggcgactagaccagctagggcatacagaccgatggtccatgtcgacccttcgaccgggaaggctgacaatccccacaagaagaaattaagaacatatttggggattgtcgcttgcgataaggtcgatgtaacatatgagaattggaagcaagtccatgctgctcaaaaggatttgatatgggaggatattcaggctgaatttgatatccctgactga

SEQ ID NO: 69695 - DNA, 732 bp, Glycine max
  Peptide Sequence Number=SeqID_161380
atgcacgtcctcgccttcagagggctacacaccctcaccttcagaggacttcacgtcctcaccttcagagggctagaccccctcatcttcagaggactgcacgtcctcgccttcagagggttgcacgtcttcacctttagaggacttcacgtcctcaccttcagagggctacaccccctcatcttcagaggactgcacatcctcacctttagtgggctacacgccctcgcctttagaggactacacgtcctcgccatcaaaggactacacgtcctcaccttcagaggacttcacgtcctcaccttcagaggacttcacgtcctcaccttcagagggctacaccccgtcatcttcagaggactgcacgtcctcgcctttagagggctgcacgccttcaccttcagcggacttcacgtcctcaccttcagagggctacaccccctcatcttcagaggactacacatcctcactttcagagggcggcacaccccgccatcaaagggctgcacgtcctcaccttcagaggactatgtgtcctcaccatcagagggctgcacgccctcacctttagaggactgcatgttctcaccttcagagggttgcacgccctcgccttctgaggattacttgtcctcgccatcagaggactgcacgtcctcaccttcaaaggactacacgtcctcgccttccgaggacttcacgccctcaccttcaaagggcgacacgtcctga

SEQ ID NO: 69696 - DNA, 588 bp, Glycine max
  Peptide Sequence Number=SeqID_161381
ggatcgcacccacaagacacccaatggacccggaaaagtccaacagggccctggggtttcaggctctggttacgggcctctgttagtcctacagggtgcccgtccccccagcaagggatcgcacccacaagacaccctgtggacccggagaagtccaacagggtcctagggtttccagctctgattacgggcctctttcagttctacggagtgcccgtcgcccccagcaaggtcatcaggccccctactaaccgagctttcatcaagaaggcgagacaccacagcagcctggggatgactggcagcggcaacatatgcaccgccgccaccttcagagcccctcagctcatctatgaaggctggagcgttgtctacaacccgtggccgaccaacgttaaagaagcactactaggaggcaacctagaattggctacaaagaagctccccgcgaagcggtccaggattccagtgtggccccacaagccaacacaggctttgacaaacaccgattccaaaacgtggaacatcaatagcgtttcgaggccatcaaaggatggtcattccttagacagagataagggcagctga

SEQ ID NO: 69697 - DNA, 336 bp, Glycine max
  Peptide Sequence Number=SeqID_161382
atgtcaatccttaccctcggaagcaaaagaaagaaaattcccaatcaaaagaaaggaaattcccaatcaaagagtgggagaaagcaaaaagaaatgaaattcccaatcaaagagtgggagaaagcaaaaagaaaagaaaggaaattcccaatcaaagagtgggagaaagcaaaaagaaaagaaagaaaattcccaatcaaagaatgggagaaagaaaaaagagaagaaggaggaaagaaagcccctgatcgggggtctaaggaaaaacagaagaaatatgcagagaggtctttggaccggacaatatctgaacaatacagaattgtcaccaaatga

SEQ ID NO: 69698 - DNA, 342 bp, Glycine max
  Peptide Sequence Number=SeqID_161383
atgagggatttgcggatgaagcttagtataattgttgttctgctttcttgtatgcaaagaagatctactgcaagtggcttgatccccattgatttggatattaacgccacttgtagaaggcgtaattcagagagaatcaaattttttttgcagaatttagaagcaacaacaactccagaagaagaacctcaatcttctgaggcatcttctagttttcctattgtagggcactttcatatagaacctgttgaagacccaatcatggctgaagagccaagaagagtaaccctggaggattattcaagttctattgtgccacaatttttcactagtattgtatag

SEQ ID NO: 69699 - DNA, 279 bp, Glycine max
  Peptide Sequence Number=SeqID_161384
atggccaaagtggacaaatcatgccgtaatgcagttctgcagcttctgttgactggagaaacaaacaacgaggagaagaagttggatttaggcgttttgggttcagatatggacaaagatgatattttatgggcgaatttggtaggtgatgacaacaatgagggagagaaggaagagacaaatatggagacaaagtccaagtgctttcggtgctcgtcatttagaatcgatgttcttgatcaaaatgaggtagtgacgacgatgatggagtatccatag

SEQ ID NO: 69700 - DNA, 1575 bp, Glycine max
  Peptide Sequence Number=SeqID_161385
atggatactggtggcaattctttaccatctgcacctgatggggtgaagagaaaggtgtgctatttttatgatccggaggttgggaattactattatgggcaaggtcacccaatgaagccacatcgcatacggatgacacatgctcttctagcccattatggattgctacaacacatgcaggtccataagccatttcctgctagagacagggacctttgtcgatttcatgctgatgattatgttgcattccttcgaagcataactcctgaaacacagcaggatcatctgaggcaactcaaacgctttaatgttggtgaagattgtcctgtttttgatggcctctactctttctgtcaaacatatgcagggggttcagttgggggtgctgtaaagttaaatcatgaccaatgtgatattgctgtcaactgggctggtgggttgcatcatgccaagaagtgtgaggcttctggattttgctatgttaatgatatagtccttgcaatcttagaacttctcaaacaacatgagcgtgttctatatgtggacattgacatccaccatggagacggtgtggaggaagctttctacactactgacagagtcatgactgtttctttccataaatttggtgactattttcctggtactggggatgtacgtgatattggatatggaaaaggaaaatattactctcttaatgttccacttgatgatggcattgatgatgagagttatcattttttgttcaaaccaataattggcaaagtaatggaagtgttcaggcctggtgcagtagttctccagtgcggtgctgattctttatctggagaccgattgggatgtttcaatctttcaattaggggtcatgctgagtgtgtcaaatacatgagatcattcaatgtgcccctcttgctactaggtggtggtggctacaccattcggaatgttgctcgttgttggtgctatgagacaggagttgctcttggaatagaagttgatgacaaaatgccacaacacgagtattatgaatattttggtccagattatacccttcatgttgccccaagtaacatggaaaacaagaattcccgtcatttacttgaagaaattcgatctaaactacttgagaatctttccaagctgcagcatgctcctagtgtccaatttcaggaaagacctcctgattctgatcttggagaggattgcgagtttgatcgcaacattgttgtattgttgatccattatgatcctaatgtgtgggctcgggttggctcttacccagccgatgaagatcatgatgatggagatgagccttgggatccagattctgacatggacgttgacgttgaacgtgagcttgtctcgagcaaagtaaagaaagaaattgctgaacctcagcccaatgatctggaggaccagagaagtggagagcatttgagagactctgatactgcagttgcggaaacctgcatgaaggctctagatatttcttctcagaaagctgatgaagataatgtgaaagtagaacagaatactgtgaatgatttggccaaagagacggacctgaagggttaa

SEQ ID NO: 69701 - DNA, 570 bp, Glycine max
  Peptide Sequence Number=SeqID_161386
atgattaatttgggaatttgggaagagttaatggataggtgtgcggtggtcccgccaccttgtccagattcaaaaagcagtgattatgattggaattgggtggtaatgggtgctctggatcacatatcggaactctttgactgctccagtggcagttccaagcacaagaagcgcaagcaattgcagacggtggaggtgaaagtgaagatggactgcgaaggatgcgagaggaaagtgaggaaggcggtggaggggatgaaaggcgtgaaccaggtggatgtggagcgtaaggccaacaaagtcactgtggtcggctacgtcgaggcctctaaggtggtcgcccgcatcgctcaccgcaccggcaagaaagcagagctctggccctacgtcccctacgacgtcgttgctcacccctacgcacccggagtctacgacaagaaagccccctccggttatgtccgcaacaccgatgatcctcactattcccatctcgcacgtgccagctccactgaggtccgctacaccactgctttcagcgacgaaaacccctccgcctgtgtcgttatgtga

SEQ ID NO: 69702 - DNA, 1206 bp, Glycine max
  Peptide Sequence Number=SeqID_161387
atgacaagccacgaagaggatctggatctcctcctttcccttgacgagagagttgctgaaacccctccatcttctcccacaatctcagacgatgatgatgatgaacttgaacttcccaaccaaagggaaagggataaacccgacatgtccgttttcaaaagcgcccttcaggattgccttccttacgatccccccaaaccaactaacaaacccgttattaatgttgattcccaccttgaaaagttttcgggccttcgaataaggaaccaattgttaactcctgccgagcttaaggaacatttttcagacattcgttttgttcggctgtcggttatcaagaattccttagttggggatactgtttctggaagttgggccactgttggagtattgaccgagaaggggactcagaagacaagttcaacagggaagagctattgtatatggaaaattggctgtttagatgaaactactgtttctcttttcttgtttggagatgcttatcagatgaacatgcaagagcaggctggaaccgtctttgcactctttaattctaccgtccgcaaggataatgcgggtaatggtttttctttgagtatatactccaccagacaaattatgaagatgggcacctctgttgattatggagtttgcaaagggaaacgaacagatgggatggcttgtaccctaaaagcatcagagaagtattcctcaatgcgaactgaactcaagggaggaaacttaagaacagcgtttaggcctatgggttacctcaaatcagaaggaatttacttagttgaccctcttgctgacaaaacaaacttgaagaagtctcagcctgtgaaattattgtccgtggatggtatcagaaaggcattgagtattaataataatttctataccagcaatgcaggaaaagtaacaacagcttctcattcgcaagggattaggtttctttctgaggttgcagccaagtcggatccaaaaatgaagaataaaggatcaaaatttccaaatgttcaaaacaaatggacagagaagaggaaatcatcttttccgaatgtgggatcctctccagtcataggaaaccgacagtcgggtgaaaagagaataaaaccagacgggcaggttttggctgataaaaccctaaagagaatagaaaagatgattgaaattgatcttgttagttcggatgaagacttctga

SEQ ID NO: 69703 - DNA, 168 bp, Glycine max
  Peptide Sequence Number=SeqID_161388
atgaaagttctttttaggtctccaacagcatcaaggattagagcaaagattctatacgcaacttcgaaggatgggctgagaagagcgctggatggaatcagctatgaactccaggccacagatccaactgagatgggattcgatgtaattagagacatagccaaatag

SEQ ID NO: 69704 - DNA, 1155 bp, Glycine max
  Peptide Sequence Number=SeqID_161389
atggagttgaacgagtatgagagagagagtggagaggcagaatgggatacagagagagcttgcagagaacgtaacagagtgtgggtgggaaagggaccaaggcacaactatgacaggaaacggtacagccagggagcaggattgaccggtgagctgaatggatcagtaaggcaaagggaagaagaaatcactaattggagggatgcaacagacattcaatccttctacttcacacgattcccagaggaaatgggggagaaggatatgtggctgaagtttaagaagtggagagatctgcgagaggtgttcattgcacggcaccgaaacaggaatggccggcggtacgattttgtttgtttcaaaggagttgaagatgtgaagctccttgaacgacagctagacaacatggtcataggtggccttaaacttcacgctaacctcctgaagcatggaagggagaggacaacagataagaaagctaattcagaggtgcaaagtaaggtgggtatgaacaggagcagagcatgtgtggatggccaggaacataacagaaatgatgcggtactcaacataggagatgtaagaatgttcaatcaacacacacatcagtggacaaagccaaggtcgtatgcgaacgtattggcgacaggcattagaaatgtggggaaaagagaaattcaggggcagaagtatcagacattaacaacatcccactcctcattgcagctaaacatacccatggaacaggtgaaacgattcagtaacacctgggtagggaggctacggaaactgtctgcttttgacaaattagaagatgagttcatgtgggaggcaggaccggaggttaagccaaagtatcttggggacgacatggtcctcttggttggcctcaacgataccagagcggaggaattgtgtaacgctgaagaagataaaggaatatctctattccattcgctagagaagtggaacccgggtttgcgaactgggtacaggttggtatggattctatgctggggtgtaccactgcacgcatgggacataaataacatctcgaagattgcggcagtggtaggggaagtggatgacgatgcagaagaactgcgaaagcttgatagggcaagggtgttaatcaaaactccacgacgatcatga

SEQ ID NO: 69705 - DNA, 1017 bp, Glycine max
  Peptide Sequence Number=SeqID_161390
atggaaaactggggggatgtgcaaccaaatgttccaatttccaagggagattgggaagatatgtctagctggaaagaaaacagaagacagctggagatgattcaacaaggtatagattctaaattttgtgagtatagtctgggcaattgtaaaatggacttgcctaatcgtgataaacaactgactgttgctgtgaagacagcattgagagatctgcaaaatgataataaaatcatggtgccaacctctgttggaagctcttcatttttaaaggataaggatcctggtactgattctaatagagtttctggcaccaagagacccttgtctgactacccattgaatcaccagctccaacaatctccaagcaataatgctgcaaatggacatcttgtgtatgtccgtagaaaatcagaagcagaattgagcaagggcattgcttatgaaaatccaagtattaatgcttattgttcacattctaggcaactttgttgtgaagaggagactgctcaaccaaaatctcagataaaggagccacctcagttaaaggaacctaaggcttcttgcttcccagcatttgcaccttttcctatggcttcttcaatgaactcatctggaaagccttcagttcctatttctcttgggaaatctgccaagaaattagcaccagttgagtccaattatgtgacagcttcttctggcccaactactattggtaatccaaagggattaaaaaatttgcactgggacgagcgataccaacaattgcagatgtttttgaggaaattggaccaatcagatcgagaggaatatatccaaatgcttcactccctgtcctcagttgaacttagcaaacatgctgttgagttagagaagagatcaattcagctttcattagaggaagctaaagaattgcagcgtgttgctgttttaaatgtcttgggtaaatcagtgaaaaacttcaaagcacccgcagattatgacgaatgttcagacaagttgaagacattatcatga

SEQ ID NO: 69706 - DNA, 195 bp, Glycine max
  Peptide Sequence Number=SeqID_161391
atggtgaaagtgaagttgggaaaggaaaatgaaaatgaagacgaagctggggagaaaaatgtggaagacaagaaggaatattgcggcgaggggtgccaaagtcgatgtggtggtcctgcaggaggtgatctgagcagcatcatccccaggagcagcttcgaccagatgctcaaacaccgcaatgaccttgaatga

SEQ ID NO: 69707 - DNA, 891 bp, Glycine max
  Peptide Sequence Number=SeqID_161392
atgtcgaaggaagtgagccagcagaggaaggactacgtagaccctccgccagcccccctcatcgacttggccgagattaagctctggtccttctacagagccctcatcgccgagtttatcgccacactcctcttcctctacgtcaccgtcgccaccgtcattggccacaaaaaacagaccggaccatgtgacggcgttggccttctcggcatcgcatgggccttcggtggcatgatctttgtcctcgtctactgcaccgccggcatttctggtggacacatcaaccctgcggtgacttttggcctgttcctggcccgcaaggtgtctctcattcgtgccctgttctacatggtagcgcagtgtttgggtgctatctgcggtgtcgggttggtgaaggccttcatgaagcactcctacaactccctcggcggcggtgctaactccgtcagcgctggctacaacaaaggcagtgctctgggtgcggagatcatcggcactttcgtccttgtctacaccgttttctcggctaccgaccccaagagaagcgctcgtgactctcatatccccgtgttggccccattgcccattgggtttgccgttttcatggttcacttggccaccattcccatcactggtaccgggattaacccagcaaggagcttcggtgctgctgttatctacaacaatggcaaagtttgggatgaccattggatattctgggttggaccattcgtgggagcgttggcggcggcggcgtaccatcagtacatcctgagagcagcggctattaaggccttagggtcgttcaggagcaaccctaccaactatgggactgatacccaacaaaaagtgataaagcagaaagctgaaaaccttgaagaaaagaaatag

SEQ ID NO: 69708 - DNA, 1320 bp, Glycine max
  Peptide Sequence Number=SeqID_161393
atgttgcatcccaggcctaggaagaagtctataaacactgtgaatgcaaacaattctgctagaagcactttagagtccaacaagttggttcttaatggttttgatgttgaagagaaaaatgatggctgctacagggcaaagcctactaagaaaaggaagtcatttaataaaagggaatgctctgatccagaaagaatcaaaatcaagatgctggatgatttccaaaagaggaacttggattctagagcttcgactcttgatgtctattatggggctcaacacaatgcgcagctgaactcagtttctgtcatgcatgatggctactatagcagtcaaccggccattacagggctggggcaattgcattccgtgccaagcagtggttcacatcatgaaatgcagcacagcatgcaaggaccgcttcaaggacagctcactttcagaacgccaacagtgcaagggttttttgaccttcaagatagtctagaagctatggtcaaatgtggtaagtggaggacctttgcctctggtctctggtctctgaggaatgaagaggaagttcttacgactactgcatattcgtgtttctggattgtagttggaaaagttccagactatgattatgatggattggttagtccaaatgtaagtgtgttgggggtgaggccgaggcgagttgtgaatgtgagtgtgttttctcttcaaaaccctctcccgccaacacaccgcgcttcttcttcttcttctgttttgtgttttgtgaatagtgagatgagtgctgtgaacatcaccaacgtcaccgtcctggacaaccctgcttcctttctgactccctttcagttcgagatttcctacgagtgtctcaccgctctcaaagatgatttggaatggaagctcatttatgttggatctgctgaggatgagacctatgatcaattattagagagtgtccttgttggtcctgtcaacgcagatccacccgatccatcaaagattcgtgaagaagatataattggtgtcactgtgcttctgttgacctgctcctatctgggtcaggaatttattcgtgttggctattatgtgaacaatgattatgatgatgagcagctgagagaggaacctccaccaaaggttttaattgatagggttcaaaggaacattttgtctgataagccaagggttacaaagtttcccatcaatttccaccctgagaacaatgaaaatgaagagcaactcccgccatccgagcacccatcggaaactggagaagatccacttgctgtagttgatcgtgatcctccagatgagaaggattcttaa

SEQ ID NO: 69709 - DNA, 243 bp, Glycine max
  Peptide Sequence Number=SeqID_161394
atgcctaaatcatctcccaacatgcatgtgaagcaagaagtatcaacaagagtcaagccaaggctattgtgcaagcaatcaatggggcaaaacacactgaataaaatagatgatgatggctcaaattctcaccaagggaagggaccaatcactagaaccatgagcaagaggctccaagaagattgggctagagctgctgaagaaggccctagggttctcatgaaccttagggtagatttctga

SEQ ID NO: 69710 - DNA, 333 bp, Glycine max
  Peptide Sequence Number=SeqID_161395
gaaaataggggaggagcttgccacccagctcgcccaggcgagcttagctcggccaggcgagctaggttgcttccgccaaaagcaaccgccttctggaggaacatcttggaaggcccaactttcagaatgttatggaaactcacggattgcgtaacaatacttccttttgattttcggcatgttacggaatttcaaggattgcataaaatgcttcattttgatttccggcatgtctcggaacttcacgaattgcctaacgatgggtgtcaagtacctcgaagtggtcaaacgaaagttgcatgccaccaaacaatggtcaccggacgaaattag

SEQ ID NO: 69711 - DNA, 213 bp, Glycine max
  Peptide Sequence Number=SeqID_161396
atgtgggaaaggcttaagtcatctgtagtgtttcctgtgcgtcaagggtgcgattccccttgggtgcgttcaggcaaggtgtgggcaaattgctcgtcgccctggggacgtctgacacgagcctctagccgatcatggtcagcctttagctttgttgatatgaaccctcatggcacaagggctgacttaggatcgtctaggattagaccttga

SEQ ID NO: 69712 - DNA, 422 bp, Glycine max
  Peptide Sequence Number=SeqID_161397
gcattgcgattaaatgctcctttaccataccacatctagtcactcttttccttcaacactttaacatccctcttgattctgaaccttatgttccaaccaagagatccttcttgatcagtgctgctgtgattgcatcttttggttaccgcaaagagcgtgatgtctcttgggtaaaaaagggtgatcaacccaatgttgatgaaggacacttaccagtaggagaggattcctctctccttcagagtattttggacaggtttgatggacttcaaacctatgttggtgaaaggtttgatgctttggaacaacaagtggacatgcgattcgacgagatggactcaaggatcaccaaggttgaaggagatgtcactttcatccgcacatgctttgatctaccaccaccaccaccaccatcatcttag

SEQ ID NO: 69713 - DNA, 363 bp, Glycine max
  Peptide Sequence Number=SeqID_161398
atgccaagcacctcacaaggaccaaagaaaggtcgcatgtcatcaagcaaaggtccccggacgaaattaggctactatccaccagaccttcctccttctattggagttcctcgaggcagccaaggagcagtgctgaagaaagttctccataggattgctgtgcagagctctaacttccttgtcccaggaataaaattcccaccacaaaggcattattttatgacaagagaaaaaaaggtgggatgcagattcaacttgactttggcagaaggggcagaggtcattttgaaggacaatctgcctcctaataaggttttccttagatggaagcctatcccaaagaagtctccaagcaaaagctag

SEQ ID NO: 69714 - DNA, 84 bp, Glycine max
  Peptide Sequence Number=SeqID_161399
atggaggatagggtcacgaccgaccaatcgtcgtcccttcccggcactgggccagcggagaacgtcgctgcaaggttcaagtag

SEQ ID NO: 69715 - DNA, 289 bp, Glycine max
  Peptide Sequence Number=SeqID_161400
atgtgggtgcaagccattggtctgtttgctcaagtgacctgtgctcctgagtttggacttccaagaccgttcaatcagagattactcgtcttgcacgttggtgggggtgccggcggacccttgggtactagtaccctcaccttcagaggactgcacatcctcactttcaaaggactacgcgtcctcgccttcagaggactacacgtcctccctttcagagggctacacgccatcgccttcaaaaggctgcacgccctcgcctttagagggctatgcatcctcattttca

SEQ ID NO: 69716 - DNA, 253 bp, Glycine max
  Peptide Sequence Number=SeqID_161401
atgtcggggttgagccaacgagggaggtggaaggcggccttgatgaggaggtattcatcatcaaagtcccaaatttggaaggagagtgaggggaagcgttgggagatttggaagaggaggaagatgacgaaccactcgtcgtctaggttttcactgaagcagaggggcaggaagggttcaaaggagttgaaacagagaaggttttcactaaagcagaggggcaggaagggttcaaaggagttttacagagaag

SEQ ID NO: 69717 - DNA, 204 bp, Glycine max
  Peptide Sequence Number=SeqID_161402
atggaatcataccagtgttttgaaacacttgatagcaatcaaatgcttccccatcaaagaattctagatgaaaacagtgtagaggatgacaaggagggtagaattggtgtcggggatgctccggtggccccgggacgtggtgttcgagttgctgcaacagaggtggatgaacccttacgcttcttggatgattctgccatttga

SEQ ID NO: 69718 - DNA, 423 bp, Glycine max
  Peptide Sequence Number=SeqID_161403
atgctgctgatgagcgaatcgcgtgccaaagcgctcggtttgaaggcccgcgcccgcatccgctcgatggcggtcgtcggctgcgatccttccatcatgggttacggcccggtgccggccagcaagctggcgctgaaacgcgccggcctgagcgtgcaggacatcgatctgttcgagctgaacgaagcgttcgccgcccagtcgctgccatgcatcaaggatctggggctgatggacagcatcgacgacaagatcaacctgaacggcggcgccatcgcgctcggccacccgctggggtgttcaggctcccgcatctcgaccaccctgttgaacaacatggaacgtcgcgacgcgcagttcggcctggcgaccatgtgcatcggcctgggccagggcatcgccaccgtctttgaacgcgtttag

SEQ ID NO: 69719 - DNA, 1124 bp, Glycine max
  Peptide Sequence Number=SeqID_161404
atggatccggccaacagcgatgaagcgctgcaggagattgcacaggatctgcaggaaggcgcggatatggtgatggtgaaaccgggcatgccgtacctcgacgttgtgcgccgcgtaaaggataccttcggcgtgccaaccttcgcttatcaggtgtccggcgagtacgccatgcatatggcggcgattcagaacggctggctgcaggagcagcctgcggtgatggagtcgttgatgtgcttcaaacgcgccggcgccgacggcgtgctgacctacttcgccaagcgtgtcgcccagcgcctgagggcgccttttgcattacatcttctggaactgtcggttgtcgatgctttggctgacctgtttgttgatcaggttcagcaacaacatggagcgggcctcgccgtccggctcggtgtagatcgcctgcagcccttcgaacacgccgtcgacgatcaggacggtatcccccggctgcggggtttccggatcgacataggtttcgctggcgtgcgtgcgcagctcatcgatcaccttgctcgggatgacgctcggcagcgcgccgaagcgcacgaagtggctgacgccgcgggtggcgctgatggtggtggtgtgaatgcgctccgggtcgaactccacaaacagatagttgggaaacaggggttcgctgaccgcgatacgcttgccgcgcacgatcttttccagcgtgatgatcgggctgaggcagtttacctgctgccgttccagatgttcctgcgcccgcaacagctgaccgccgcttccggatacatagtgatgcaagtttcagcgtgtaacatcacctatctctatgaatatgcggctattagcgaggggtcacacacttatcgatacggcgctgtatggcaaggcgttgcgccaccggctgtgacgctattcatcgtttttgaccgagggaagataaatggagctgtttctgttgagcaacggcaagctgtctggcgaagccgagctgctggggtatgccaaaagccaactgctggcgatgattgcgcgtcgcggcatcaaatccgccgtttttatcccttatgcgctgatccgttacgactacgaccagcgtgcgcaggagctggcgcaaacgctgg

SEQ ID NO: 69720 - DNA, 607 bp, Glycine max
  Peptide Sequence Number=SeqID_161405
atgacaacgcgcggcggccatcggcgcagcgctgaggagtatcaccgtaacagattcgccgcgaatggaaaaacgggccgcgtcggcgacccgttgggggaaaggcgattacagcaggcggcgggcggcgtccaccacgatctgcaccgctttgctttcggtgtttttcatggtctcggcgttcgggatctcttgctgggtgcggttgacgatcaccccagccaccatgccggcacgcaggccctggctggcgcacatggtcagcagcgtggcggattccatttcatagttcatcacgcccatcgcctgccattcttccatcgagcctttgaagcggctgaccacacggccggagtaagtgtcgtaacgctcctggcccggatagaaggtatcggaggaggcggtcacgccgatgtgcgtggtggcgccgctggccttggccgcttccaccagcgcggtggtgcaggcgaagtccgcaaccgccgggaactccatcggcgcgaagtgcaggctggcgccgtcgaggcgtaccgccgccgtggtgaccagcacgtcaccgacgttgatgtttgcctgaatggcgccggtggtgccgatgcgcaggaag

SEQ ID NO: 69721 - DNA, 228 bp, Glycine max
  Peptide Sequence Number=SeqID_161406
atggccctaaggaagcttgcctcaaagagatccaggaaagacaaggcggttgaaggaaccagttccgctcccaaatatgacagccatcgttttaggagcgctgagcaccagcagcgcttcgaggccatcaaaggatggtcattccttcgggagagacgtgtccggctcagggacgacgagtatactgccttccaggaagagatagttcgccggcggtgggcatcgctg

SEQ ID NO: 69722 - DNA, 240 bp, Glycine max
  Peptide Sequence Number=SeqID_161407
ccaaatgcagtcctagttgtactcgcaaatgcaatcacaggggactcacactacctcctgaatctgaggttgggcccttctgctactcgtgtcagcacaatgggaaagttgtgtcaattccttagggataaacagggagttgagggaccagcgaaacctgcagataggttagatcctgatgtcaatcccatatatgtgatgacattgaccatcccactggttttccttaagcctttgtag

SEQ ID NO: 69723 - DNA, 174 bp, Glycine max
  Peptide Sequence Number=SeqID_161408
atgtggtgtgaacaagaagtttatatggattatgaaaatgaacaagaatgtggtgtgaatgaaccgtatgttgattgttcggatgcttttaatacttctcaggcttcgtgggaaaccagtgcatggaggggaaggttggatggtgaagttgatctgtgggattcacaatcatga

SEQ ID NO: 69724 - DNA, 816 bp, Glycine max
  Peptide Sequence Number=SeqID_161409
atgactccattgccgtcactccaaaaaggtttacaacacctaatgtcctatcttttggaatttgggatgaccgtccctttcaatgagtcaatctctttctttctcataagaggactgcacgtcctcaccttcagaggactacacaccctcaccatcagaggactacacgtcctcaccttaagaggactacacgtccttgccatcagagggctgcaagccctcaccatcagaggactacaagtcctcgccatcaaagggctgcacgtcctcgccatcagagggctgcacgccctcacctttagagggctacacgccctcgccttcagagagctgcacgtcgtcaccatcagaggactgcacgccctcaccttcagaggactacacgtcctcaccttcagaggactgcacgtccttaccattcgaggactgcacgtcctcaccattagaggactgcacgtcctcgccatcagagggctgcacgccctcaccttcagaaggctacacaccctcaccatcaaagggatgcacgtcctcacctttagaggacttcacgtccataacttaagaggctacagagggctacacgcccttaccttcggaggacgacacgtcctcgccatcagagtactacacgtcctcgccttgaaagggctacatatcttccctttcagagggctacatgccctcgcctttagagggctgcacaccctcgccttcagagggttgcacaccctcacctttagagggctacgcgtcctcactttcagtgggctccatatctgttccttcagagaactcaaggtcctcaacccttaa

SEQ ID NO: 69725 - DNA, 342 bp, Glycine max
  Peptide Sequence Number=SeqID_161410
atgcagaattcaaaacgggatgtgtaccaaggagcctacctgaatgggccaggcaactaccttaaaggaataattaacagtgctttgaaaggacttgacgatacttcacaaagtaaatccaaggctgctgctaggtggattgttcttaaatgtaatagacaaaaaggaagcactgagtgtgggtattacgtcatacactggatgtcaactataatcttaggaactttcaagaataattgggaaatgtatttcaatgatgctagaccatgggaaccagagagattgaaggcgctttgcatccagtggacaaagttttatttgaaagttaaaaatgaaacctag

SEQ ID NO: 69726 - DNA, 1503 bp, Glycine max
  Peptide Sequence Number=SeqID_161411
atgattaatccacctgccagtgaaaaagacagaatcaatcccgtggtgttttacacctctgccggactgattctgacattttcacttgtcaccattttgtacagcgatctcgctgccggctggattcaaagcgccgtcaactgggtgtcgtccacttttggctggtactacatgctggccgccacgctgtatatcgtctttgtcatctatatggcctgttcacgctacggcgccatcaagctgggcccggagcagtccaaacccgaattcagtctgctgagctggtcggcaatgctgtttgccgccggcatcggcatcgatttgatgttcttctcggtggcggaaccggtcacgcagtatatgcagccgccggaaggcgccgggcagactctggaagcggcgcgtcaggcgatggtgtggacgctgttccactacggtctgaccggctggtcgatgtatgcgctgatgggcatcgcgctcggctacttcagctaccgctataatctgccgctcaccattcgctcggcgctctatccgatcttcggcaagcgcattaacggcccgattggccacacggtggatatcgcggcggtgatcggtaccatttttggtatcgccaccacgctgggtatcggcgtggtgcagctcaactacgggctgaaagtgttatttgatgtgccggaagggctgacggcgcagatggcgctgattgtactgtcggtagtgatcgccaccatttcggtgacctcgggcgtggataaaggcatccgcatcctgtcggagctgaatgtcgcgctggcgcttggtctgattctgtttgtgctgtttatgggcaagacggatttcctactcaacgcgctggtgctgaacgtcggtgattacatcaaccgctttatgggcatgacgctcaacacctttgcgtttgatcgtccgacgcagtggatgaacagctggacgctgtttttctgggcgtggtgggtggcgtggtcgccgtttgtcggcctgttcctcgcccgtatttcccgcggccgcaccatccgtgagtttgtgctcggcacgctgattatcccgttcaccttcacgctgctgtggctgtcggtgttcggtaacgcggcactgtacgagatcatccacggcgatgccggttttgcccaggaagtgatggcgcatgccgagcgcggtttctacagcctgctggcgcagtacccggcgtttaagttcagcgcctcggtcgccaccattaccggcatgctgttttatgttacctcggcggattccggctcgctggtgctggggaacttcacctcgaagctgaaggatatcaacagcgacgcgccaaactggctgcgcattttctggtcggtggcgattggcgtgctgaccatgggcatgctgatgaccaacggcatctctgcgctgcaaaacaccacgtggaagatcatcgccgcgccagcgccagccgtgataccgcgccctatattccggcgagcaatgatcgtctga

SEQ ID NO: 69727 - DNA, 291 bp, Glycine max
  Peptide Sequence Number=SeqID_161412
atgcggctccgcatgccaccggactcttgggtcacgcattttgtttctaaacaaccatttagaggaaacactggatcccacaaaaataggagaaaatcactcaacgtgtatcaatctcacacagggcaaggattgacattctcaccctgggtcaaggtttatgataagttgggattttggctcaaggcttgtagaacggctggtcatgatatatgtcagggtttggccagtggttcggggataaaggggatgttctacattatttccatgatacacatgcaacaatggtga

SEQ ID NO: 69728 - DNA, 321 bp, Glycine max
  Peptide Sequence Number=SeqID_161413
atggctggtacattcttccttttgaaacagcaaaatagtttagagattatgagtgggacgccacagaccacgcgtagcagggaccacgaggacaaggagtggccgcggctatacattttgctgcagctttcctcgggaccttgtcggcgaccgtacccattggatgaacaatgcgaagaggtaaggttgaaacctaaaagaaatgtgtgttttgcgaaggttccagggctccttgcctctgaaattagcaatttaatttcccaagatatatcagtgctccctgataatataggttgggaaattaggagaaacccacattaa

SEQ ID NO: 69729 - DNA, 384 bp, Glycine max
  Peptide Sequence Number=SeqID_161414
atgttgtggaagcttgggaggattgatggggacccggcgttgagaggaacgaggataagggctacgtgggagtacgtgagctcagttggaggtgggcaacaggggatggtggagtggtacctggagatatgtcgcgggggtcaggagaccttggggacatcaggtggggtgctattgcccaaaaccaagcttgaccaatcccgacccaacccgggcatagtcagtcatcaacagataaaaggaacaaagaccacaaagcaaggaggcttgtgtggtggctggccagctatgaacttgattgatatatgggatatgggctctggtaatcgattaccaagggtgggtaatcgattacaaggcttaaaaatgaagacaggaggctaa

SEQ ID NO: 69730 - DNA, 328 bp, Glycine max
  Peptide Sequence Number=SeqID_161415
gatttttaatctggcaagttcgtcatcttctaatcattatgatgtggcatctgcaccattagaggatgatttgttgtggatgcaaaaaaatcatatatcacaacatatttggaatggtgctaatgataggatgttaaaaatccaacgagctacaccattgtacaatcatagagaagcaccgcccgacgaaattattcctctattacaagtttcgagtttgtacccgataatgaagttggcgcagttgaaagcaaccaagaagggcttgaaagatttgcttgtgcttgttgacaaaagcagctcaagggtgccaatgagatatttgtaa

SEQ ID NO: 69731 - DNA, 497 bp, Glycine max
  Peptide Sequence Number=SeqID_161416
ggtacatcctttgtggtacaagtagagggtacatctacttgggtttgactgagaacaagagagggtacatctcttgtggatcagttctagtggagggtacatccactaggttcaaagagaacaagggagggagtaagaagaaaagttctaaagttagaaattttcttctcaagttaaaactctctattgtgaatcaccttcttggtcttggaaaaacgtttgaagatgatgagctaaacatcaaaatcctcaactttctttcaagtacttgggaaccaaagatcaaagtgatcaaggaatccaaggacttagcatcaatgtcgatggaagctctgttcgaaaaattgcttgcatatgaacacgagtttattcaacaatctggtgcagaaaaaacaaaaaaaagaaatgaaaaggaattgcactcaaagctaaatcttcaaaggaagatcacaaagaaagttccagtgatgatgaagatacagagaatttcagcttaa

SEQ ID NO: 69732 - DNA, 111 bp, Glycine max
  Peptide Sequence Number=SeqID_161417
atgacatatgaatatgattttgtagcatggaaaacacctttcaatggaaatggctccgagaaagctttccacaaagagatccaggaaggacgccgcggccgaagggactag

SEQ ID NO: 69733 - DNA, 627 bp, Glycine max
  Peptide Sequence Number=SeqID_161418
atgtcagtcgtgatttgccttgatttgtggatgacttgttggatacaggaagacttcggaggaggacacccagaccccaatttgacatatgcaaaagagttggttgctcgtatgggattgggcaaatctgaaccccaagatgagcccccagagtttggtgctgcttctgatggtgatgcagatcgcaatatggttcttggtaaaaggttttttgtcactcctttagattccgtggccattatcgctgcaaatcctgttgaagctataccatacttttctgctggtttaaagggtgttgctaggagcatgccaacctctgctgccctggatgttgttgccaaacatctgaatttgaaattttttgaggtccccacgggttggaagttctttggtaatttaatggatgctagattatgttcagtctgtggtgaagaaagttttgggactggttctggccgtattcgtgagaaagatggaatctgggaagttttggcctggctatctatacttgcatataaaaataaagataaacttgaagacaagcttgtcactgttgaagacatagttcgtcagcattgggctacttatgggcgccattattataatcaatatgactatgaagtatga

SEQ ID NO: 69734 - DNA, 417 bp, Glycine max
  Peptide Sequence Number=SeqID_161419
atgttttccaagaaggagggaatgatgagaatcatgaaactggccaaatacaggctaaaggcccaagtggagaaggacgaagcccccgagtggagaaggatgaaggcccaagtggagaaggatgaaggcccagaggcagagacactatcaagactattaattgttgctgaaggcccaaacttatcttcctttaccggaagtggcgtctaccccgacttatcttccttcaccggaagtggcgtctaccctgacttatcttccttaaccggaagtggcgtctaccctgacttatcttccttcaccggaagtggcgtcatccaaatcttcgtagcctgtatcaaacgatccgctcctactcaggttcacatcagtcggcctgcaagcgtttttaaaaaaaaattgcgcaatgtcggctga

SEQ ID NO: 69735 - DNA, 393 bp, Glycine max
  Peptide Sequence Number=SeqID_161420
atgttggtggcgacttcgcgcattttcctcccatggaagacgcataaggaagggtggtgtctccaggaaagcattcagcgtctccccatcaaacttgatcagcttccctcgtactcgaacctggcgaggaaatttttcttttgggtcgtacaaattcaaatagaactcgttgaccgaggccacgtcaatgtgaccatcttcatactgggtcaaggccctgtgccagttcctccggatcagctcccatctaaagtcatcatactcagtcacaaaaagattcatgttcctctccggaaggatgttcctggagtgaacgttctgtgcgtaacgtccctatgcgacctcagaaacgaatcttgtcgtatcgtatggttcctgaggtcgggaggctga

SEQ ID NO: 69736 - DNA, 477 bp, Glycine max
  Peptide Sequence Number=SeqID_161421
atggaactgattgaaaacatggctgctagtgatcacgctatcttgcgtgataggacacatattcccaccaagagaagtttgttagaactttcatctctggacgcttttttggcacaaaacaagttgttgtccaagcagcttgagaccttaatagagacattaagtaagttgccaactcaattaaatgttggaggttgcactatttgtggtggagctcatgagtctggtcccattgacgacacaacacatgaagtggatactcaggtttccaacatgtccagaattacaaccagcaacaaggacaatgaagaactcacccagggaaccaactcaacaaagaccaggattgattcaaggtgttttgatgataacaaagatgatgacaaaaagttcatgagaatgatttcaagattgagtcaagagcaattcaagaatcaagagaaagtttcatcaagaagattcaagattcaagaataa

SEQ ID NO: 69737 - DNA, 321 bp, Glycine max
  Peptide Sequence Number=SeqID_161422
atgctcagtagataccctctacatggaattaatgcaaatttcactttaatttcagcaactggtgtctcgctaagcttgacccatgcgcttagcgagtatcatccgctaagcgaggcatcagcctgtttagcgagtaagaggaatcttgaagggaatcttccatgcaagcacgcgctcagcgtgttatcagctcgccccgcgagtcatttgtctcttcaggcgcttagcgcgcctggctcactaagccattgttcacttactcgcgctaagcgcgcctttgaggacagaaagccctttttaaagcctgaagtggaaaattag

SEQ ID NO: 69738 - DNA, 932 bp, Glycine max
  Peptide Sequence Number=SeqID_161423
atgatgcctccttcctttcccttcaccgccacacgccacgagtctctcccctccgttgattttcaccattttgtagttgctcaatccgtgaaccaaagcattgcgtcaagctttaggcggagttttaggaagagctttaggaagacagaggatcttgagaatgtgaataatgttgcttacgagcctcatgaggagccttatgctcaaattacggaggatgtaggtggtgattcacagggtttttcaggtgtcttccatacctttgaagcaattgatgtagagcaggttgttgacttgtcaattgagttgcttgaacttagtagacaatatgtaaaagatgagatagaccaatgtagaaggacatatgttcgcctagtttggctacaagacatttatcgtagcaaatgtgacgcaagacaatgtacagtagtagctcaagcatatttattgcatcttgtagcagttgcactagtccatatgtatgacaatctgaatgttgtgtccaagcataccacaaaacatcttgtaggatatatcactcttttgcggatctatgagcatttccctacaattgcaaatattatttctaatgaggattgccatgagagaaaaccacatgcttgtcattggaagtctaggaaggcattaccaatgacctcctatcgtaagcgcttgaataggctaacgtcagatgctgttagctggatacctgatggtgatcatcgtgcattcaaagaatttgaactctccattcatccactccctactgctctatctctatccatagaggagattgacaatagatggcttcagttttctcaataccttgcatcagttggagagttttgtagttttcctagtcagtgtgcaacaagttacatggagtggttttataggatatctcagccattcatgagtctgccacagcttgg

SEQ ID NO: 69739 - DNA, 549 bp, Glycine max
  Peptide Sequence Number=SeqID_161424
atgcctaaatcatctcccaacatgcatgtgaagcaagaagctaagtctccaacgttgttttctcttgaggatccagcacagttctctttgagactattaccacctcgagatagtctgacatcatctaccccatcctcgtcttctgtgtctatcctagttaggcctcccgatgttgcacctacaccatctctaccttcaactaaagctagaccatcttcatctcatgttaatgcacatggaccatctccggtgcctgcatccacaccatctccatcctccgttgatgcacgtggaccatccccagtacctacatccacaccttccccatctccgcctgtgagcaatttgcctatagatgaagatgttgtaaatttggtaatggaagacccccctcttaacaatcgtcctatggttatgttaattaatggaacgtttcatccatctaaggttgtggcaaaggctgtcactttgtccattaggaaacaatttggtcagccttggcctacatggggagcgattccaaaagaacatcaagaactttttttctag

SEQ ID NO: 69740 - DNA, 750 bp, Glycine max
  Peptide Sequence Number=SeqID_161425
atggatggagctaaaactgatagggaagtgggtgggaacaaaggtgtatcaaacaagcagatccgacttaagattttttcaccaaatgttcttgatatcacactggtagatctcccaggcattacgaaggttcctgtgggtgaccagccttctgatattgaagctcgcatcagaacaatgataatgtcatatatcaaaactcccacctgtctcattctagttgtcacaccagctaattcggatttggctaattcagatgctcttcagatggcagggattactgatccagatggtaatagaacaatcggtgtaatcacaaagttggatataatggacagagctactgatgcccgaaatttgttactaggaaaagttattcctctccgacttggttatgtaggtgttgtaaaccgtagtcaggaggatattcaaatgaaccggagtataaaggatgctgttgttgctgaagagaattttttccacaatcgtcctataaggaagttcttatgcatagttaacagcatacaatggtttagcaatagttgtagtgttcctcaactagcaaagaagttgaacctgattctgacacaacatataaaggctgtgctacctgggctgagagcacatataagcacttcactagttgctgttgtgaaggagcatgcaagctatggagaaatcaccgagtccaaggcatgtgttaatactaggatgcatcttggatgtccctatgacttactagatacttaa

SEQ ID NO: 69741 - DNA, 345 bp, Glycine max
  Peptide Sequence Number=SeqID_161426
atggagaagagattgaaacctccacttgtattgtcttcatgtgattccgttttctccctccacgaatattatctcgcaaatcccaacggtggaaaaaggaaaaagctacaatgcgaaaggtatttctctcagctcaaacatgatataaaaattcccaacggtgagaatgctcgtaattgggctgaaaacgtagtgctcaaatttcacgacgatcaaacggtgaacgagtccgagatcatcatttttctgagacaggttaggtggcctgcgggaaaaagagagaattttgggggaagagagaagaaacgaaattgtgaggtagaggagactgaggagtcagtatga

SEQ ID NO: 69742 - DNA, 222 bp, Glycine max
  Peptide Sequence Number=SeqID_161427
atgtcgaggcaacaacaagatgtagaagcaaagcttcatgatgatgacaaaaagctcaaagatcaatcaagaaaaattcaagagttcaagataagaatcaagaagaattcaagactcaagaagaaagtcgagagacaagaatcaagattcaaggttcaagatctcaagaatcaagatcaagactcaagattcaagaatgacgagaagactcaatcaagataa

SEQ ID NO: 69743 - DNA, 435 bp, Glycine max
  Peptide Sequence Number=SeqID_161428
atgcagaagtactaccatctggtcaaacaactcttagagcatttcgtgcataaggaactggcccatgttgacaggggacagaaagaccaagctaatgctttagcccgcctggttagcactaagagaccaagtcagcaccagacgtttatccaggagacctcacctcccccaccatcgatgttatcgaggtcttctcaagcagtagaggccagaaaggcaagacaccaagcttcacactatgttatcattaataatgaaatgttaaggaaattcatctcaaggccattgctaaagtggatcgatgaaaaccatatggagtacgtcctgaacaaaattgattacgctgagtatgttaaaacttacaaggaatgccaagaattcgacaatgtccaccacgcatcatccaaagcactccatagcatcacatccccttga

SEQ ID NO: 69744 - DNA, 255 bp, Glycine max
  Peptide Sequence Number=SeqID_161429
atggcattagggatcatggcagcttgcccaggcgagtttttgcttcaacctaaagtaaccttgctcacccaagcgagctggcgagccacagggttcagaaaaaggcttgaaatgacctttttgcccctccccttgggtatcttttgcattctagatcgaaacattgaatggtcatctgttcacgctataactagcgttcaacaccgtaaatcgactagcaaagatcaacaaacgatagtccccgggcaaaattag

SEQ ID NO: 69745 - DNA, 267 bp, Glycine max
  Peptide Sequence Number=SeqID_161430
atggcagatgtaacatgtggtccgtgtaacaacgcatggccatatccactccttttgcaagctacaccaagcttgcatatgcctcgatgtactcgacatcttcagtacctaaaagttgttggttgtagggcaaccaggcccacttgggccctccagaagattcctccagaaggctgttgcttctggaggaagcaaccttgcttgcctgggcgagcggagctcgcctgggcgagctgggtggcaagcttctcccccaattttctataa

SEQ ID NO: 69746 - DNA, 516 bp, Glycine max
  Peptide Sequence Number=SeqID_161431
atgacgaatgtgttgactagggtttttctcatttttgaaaaaaatagacgcgtggctccgatgaaggttcaaccaattgcaattgacatcgattccaagaaggtgaaggacactggcggaaatagcagcggtggtggtggttcggaacgagtcagtgctaaagtcgcgcttgagaagctaggtctgcttggtgaaaacggtgcagaatttcatggaggagcagccactggcgcgatgctcgtcatggaagaggatgaggatgaggagactcttctggtgagggttgtcgcgcgcggtgatgaggatggtggtggctgtcacgtgcacaccgacctgtggtggaaggatgaagaagatgaatgggttgaggcggtggggccaggggtggattgggggctggattgtgaaggaggaggaggaggggagggaggcagtggcggggatgctgttggcggtgacgaccaccgtgaagagcaacggtggcacgggagagaagagggagaagaagattgttag

SEQ ID NO: 69747 - DNA, 447 bp, Glycine max
  Peptide Sequence Number=SeqID_161432
atggaacccttcaataacaagtttgatggcatgacaactacagttgacataccaatgtttattccaatgtcattcaaccctcatcaaggcatgatactcaatgaaattcaggccatggtagctccatacatgtttggggcaaacaaagataactcaattgatggggaggagcaaattgttagaaccgcgtactcaatatctgctaacagacaaactcgaaggacgctcaagccaaatggattacttgatcaagaggttaacttagttgtgcgtaagatgacaagttttgaaagatatatgtatggacatggtgcaacttggcaatttttctggaacaaatgttttgggattcatcctaatagatttatcaatctgagtaagccaaaatttagtacttacactttggaggtgctgcatgatgtaggccaacaagcatttggatcataa

SEQ ID NO: 69748 - DNA, 444 bp, Glycine max
  Peptide Sequence Number=SeqID_161433
atgcaaaagatgccaaaaagaaggggcaaaagggtcttttcattgagtttcctggaccctagctcacccaggctagcctctggcttgcctaggccctcaaatgacttcaagctgaaggaaccagctcacctgggcgagccaattactttaggagtaagtctcagctcacttgggcgagctgccatggtcccaagtacccttttttctataaataggcgtgaaggggagctgaggaaggggttccaagggttagaaggtgaaggaattgagagaagagagaaagaagaagaagaagaagaaagaaaaggaaacaatgccgaggcactaccaaatcgcgactgtgatcaatctctacatcgttccttgtttggtgttcttcgtgcgatcgtcggggtccctcttgttattatgtgcacattcatcttctccatctatcatcggtga

SEQ ID NO: 69749 - DNA, 435 bp, Glycine max
  Peptide Sequence Number=SeqID_161434
atggtgatgcaatcctaccccctaagggcattggataaaagactccaagaagattgggccagagatgcaagaaaaggtcctagggtcatggccatcaaagcggggcatgttgagcttcatgtgagggcggcgaaccggagagggagatgggttaagaggagaggaaacctgaccttgggtgaggcaattgatggcctcctccaatctgtcggtggtgacttgcctagtatggtgctcaggcatattggtggtcgtaaccaacttgttggctattgtatttgcacttcacgcatattccttgaggtaattgggcctctttgtgactctctttggcctattaatgtggttgctagcttctgcaatcttgcaatgcatgaagtaaagactttggctctttcagacataaagggacatgtagcattcttcaacatatga

SEQ ID NO: 69750 - DNA, 729 bp, Glycine max
  Peptide Sequence Number=SeqID_161435
atgtcgcggaggtcaggagaccttggggacgtcaggtggggtgctattgcccaaaaccaagcttggctaatcccgacccaacccaggcatagtcagtcagtgagaacctgtgacgtacctaagcaggcgagctcctggcagtcaaccaataaaagaacaaagtccacgaagcaaggaagcttgtgtggcggctggccagctatgtatcttgggtggtatctggaaattagcctctggggtgataagacactggtaatcgattaccagttgggtgtaatcgattacacagtgttacctgctactgcgcagttgatccatgatcgcgttgtgatggagtgcctagagggtgtttgggagaccctcgaaggcaatgagaggtgccgatttcgtggcacaattcgactcactgctacttcattagtacatccggaggaacccgcacgcacacttcagcaacccgtggagtggatactacctacacctactccatatcgactagttgagccggttcaagtgatagaggtgtcatcctctgaagaggatcttgaagaggacccagaggagttacctcctgaacctgctatggacacccttgacttacctgaggatgatgaagacccactccctgatgttgattctctagaggatatcatgtcagcatctgaggcagactctacagaggagagtggccctggagggacaacgaatagtgacgactcttcatcatag

SEQ ID NO: 69751 - DNA, 1911 bp, Glycine max
  Peptide Sequence Number=SeqID_161436
atgcaagtaaattatgttgttatcattgctatttgttgcaatcagaagctgcttgaagatgaggttgaaatgcctgacttcaacgggggagaggtggttgccaattcgacggatgaagaaaacaattctgcagatggggataacactgtactatcaaccagacagctccaaaagtacggtccaagatctgtcagaaatgaacaagttagaaatagaaaaagaatttctgaagcactgttacattccaaagaaagtgcctcagcatcccatgctacatgctccaaagcaaatacatctgggatttggaaagctaagccaagattttcattggcatcagtgttacgtaaaagtggggacattggtcattcaatctccaatattgagagcttgcctgaaattgtaaaagctgttgatcctagagcttctgcaaatttagatggaaatcatctagaagatgatgacagaattgaaataaattcagatattgcgcctgctgaaacagaagcttttcctcatggatttaatctggccccaatggctgatcttttttacaatctccaagataaggctgatcaggggaagccagtgttagagatggaggaagcacaaatttgggctaagaaggtggagttgccagcattcatggggggacagacccaattggttggaatgccagggttgaaaaattctttgagccaaaacaacccagattcagattgggagtcattttccacagctttgatcaaaagattcggagatcgccatgggaggaccaacatttcaaagcggaaacacatgttgcgcaagatattgaatgaagaagttgattcccatgcctctcaacaagacaaaaatagcatggagggaagtgggttagaattcagtgaactaaatgctagttcttgggcaagaaaggtggaactacctagctttgatagaagcatagaagggggaactgatttgaaggaagaaaccaaaaatgatgaagcaaagttagcaagagaaaaaaagattgaaaaggttatggaggaagaagttgatccatcaataaagagggagatgcacaaggaaaatggagtgacgaatgtaggccgcgaagatgattttcttgataacccaattacagatttgatcaagaaggaagtcgaaactggtgatgcaaccaagccacattgttttcaagattcagatttccataaaaagattgttatggtaaaacaaaaatcattcatgaaggtggttggaacaacaatggtgctggaatcttggaatgtcaacttgttgggtgagcgtttagcattaaaatttgttgtgtctatggctgacagcttagccatggagctaaggcagaaggaatgtactgagccagtcaagctgattaaaattatatggagtccacccttgtccctcccaccaccaaagctcaatttgcatgcagggattccaaccttgagagcaaggttgatttttaggaggggtgtattgttaggatacaaggagaatgaagagttagttaatatagagacagtcattaacagtgaagattcccctgaacctgtggatagtggatcatcaagtgacaaagaggtaagtggtcaacacaagaaaattactatccctggaaagaaaatgcagaccgtggcagaacgatttgaagaagctttagggacatcctctgttatgactgaagaacgatttgaagaagctttagggacatcctctgttatcactgaagggacacatgttggagcacttaattcattgagacctggaatatttggaaaactacagcagatgatgctgaaagaaaaagaaacagacatggacttctggaaaaagttacaagccgaagctaggccagatagtaaaacttttgcttttactttctctgcagtttccattcttatctaa

SEQ ID NO: 69752 - DNA, 1665 bp, Glycine max
  Peptide Sequence Number=SeqID_161437
atggcacctgcaggtgcactgataggtccaattgcattttccattattgtcattggaaattctgctgttttcattggactttggagtgcacattttgtttggacatactactgtgtggcaagaacaaataggttcggactggttttcaagcttgtggtgctcatgtgtttgccaattcctctgttactttggccaatagtgggtattgttggaagccttttaggtggaattggatatgggttttttgctcctcttcttgcaacttttcaggctgtagggaagggagagaatgttaaccagaaatttcaccactgcttcattgatggttgtcggtcaacaattgaaagaagctacacagtggttcaagatgtcacagacttctgctttcactcctatttttcatacatggatgaactaagagaaaacttaccccatcatgaaaagccgttagatatccaactgtcattattgccatgttgcttgttggtgatcatggttggcgtgccattggatatggctttaatcacatgtattgctatatggaagagtccatacatgctgttcatagggtggaaaaggctattagaagatttgattggaagaaagggaccattcttagaaactgaatgtgtcccatttgctggccttgccatcattctctggcctttggctgttgtagtggctgtattagcagcaaccattttcagcctttttcttgccctatatagtggagtagttgtccatcaggaagactcagtgaagatggggtttgcctacattgtgtctgtggtttcactttttgatgaatatgtaaatgatttactctacttgagagagggatcctgctttcccaggccgatataccgtagaaacaagagtcatgctattgagaggaaaaaccttggaggaggtgataatgatttgagaaattggagggatggttcacaaaattcgaaacatgccatacaacaatccagaagtctgaaatggagaattcagcaatatagacctgtgcaggtatgggactggctgttcaagtcatgtgaggtgaatggaaggatactcctccgcgatggtctggtaagtgttggggaagttgaggaatgcattttgaaaggcaattgcaaaaagttaagcatcaaattaccggcttggtctttgctgcaatgtcttctaacttctgcaaaatccaattcagatggattggtgatctccgatgacgtagtgttgacgaggatgaatggaccaaaggatggagtgtttgagtggtttattggacctctactgattataaaagagcagctaaagaaccttgagttggaggaaactgaagagacttgcctgaaagaactagtcatgaaatgcaaaaatgaattgccagaggagtgggatagcactggattcccatctgatgatactgtcaggagagcgcaattgcaagccataattagaaggctgcaggggattgttgcttccatgtcccgaatgccaacttttcgaagaagattcaggaatttaatcaaggttttgtacatagaagcattgcaggctggtgcttcagctagccatattggaggcactctaattcccaagcacagggagaagggctcaattcaaagcaaagacaatgttgatgaacttgatgaacccagcaatgaatgttga

SEQ ID NO: 69753 - DNA, 609 bp, Glycine max
  Peptide Sequence Number=SeqID_161438
atgggcccgaaatatatcctaaggctcatgagaaccctagggccttcttttgcatctctggcccaatctacttggagtcttctatccaatgtcagtgactaccacgccttaggaagttctaccgcgttcatgattttttacttcagcaacaacagttcaatggtgacgacctcacgggatgatgaaagggaactcccttgggatcacctcaagaatgaattacttgagggttatggcgatattggcaagggtgacatctacgaatgtctagctgctctccatcaacacagtgggacggatgaggggcgagtttgcagtatgcaaatgctcggtatgttattgtgctctcgtttgttgaatctaactcgcgtagtggagcgtgaattgtcagagaaagacgatgctccttcactacctcaaaatggtgggtttcgcaccaggtttgggtcgggttttttagcttgctccaacgaccatgggtcctttagcccaactcatgtgggttgccttcctgggctagtttggggatttgtatgtagtaattgggaggtgcgtgatggcaacactactagtcttggtcctcccaagcccaacataagtgatctctaa

SEQ ID NO: 69754 - DNA, 964 bp, Glycine max
  Peptide Sequence Number=SeqID_161439
atggcgtcgcgagggagctccgctgtgtacgacactctgtcgcgatggcaagggcggcgttgcgaggcagttactcttcgtgtctcagcggcggcagggagagtgagtgatgctaaagttgatgtctcgttaagcgagctcaatgtgcttagcgagtgtcattcgctaagcgaggcatcaacgcacttagcggataggaggaatttggaagaaaatctgtcacgcaggcatgcactcagcgcgtcatcagcttgctcagcgagtcgtttgtcaccttccaggcttagtgcgagtatggcgctgagcggaaattcacttactcgtgttaagcgcgagaatgatgctaagcacgatgtcgaggctaaatcctcagttggggattcttgctatgaggtggccacagattcatcttcatctactgaaaataaaaagcttgaaggaaaacttgatgccttgatcaccatacagatctttatccttctttgcagcaatctggagtcaatgagcaacctgaagcctatgctgcaaacatttacaatagacctccttaacagcaaaaccaacaacaacagaataattatgacctttcaagcaatagatacaatccagaatgtcgctggtccaagcaagccatatgttcctcctccaatacaacaacaacaacaacagtcacaacaaggacaacaagcatctgaggctcctcctcaaccttccttagaagagtttgatgagaatcatgaaactggccaaatacaggctaaaggcccaagctacggatatttggatgacgccacttccggtagacgccacaaggattaccttgataagtatgataattggttcaacaaggaacccagagagaaactctcaccaaattttatcaaatgccaaaagtttttgatgagaatcttacggggcggatcgtttgatacaggctacgaaggtttggatgacgccacttccg

SEQ ID NO: 69755 - DNA, 129 bp, Glycine max
  Peptide Sequence Number=SeqID_161440
atggcagtgatgcaatcctaccccacaaaggcattggatagaagacttcaggaagattgggtcagagatgcaagagaaggccctagggttctcatgaaccttagggtagatttcgggcccatggactaa

SEQ ID NO: 69756 - DNA, 189 bp, Glycine max
  Peptide Sequence Number=SeqID_161441
atgaacaaaaagggagaaagtacccacttggaatggtggagtcaagggaaggaaaaagcagacgaaggattaagagaggaagagaagattgagaaagagaaagagaagattaaagaagaaagagtaacgtggagaaaattggggaagggaaagagaaacggagagggaagacaggcgattattaagtga

SEQ ID NO: 69757 - DNA, 3102 bp, Glycine max
  Peptide Sequence Number=SeqID_161442
atggaaaatcatggtgcagtgtctgaaaccaagtgtacgtttgatgttttccttagttttaggggtgaagatacccgtcacacatttacttgtaaactctatgatgctttgtggctgaagggaattgacacctttatggataataaagagctgaagaatggagacaaaattggccctactcttcataaagccattgaagaagcaaggatttcagttgttgtcttgtctgaaaattatgcagattcttcatggtgcctcgatgaacttgtcaagatccacgagtgtatggagtcaaaaaaccagctcgtttggcccatcttctacaaagtgaatccctcggatgtgaggcatcagaaaggaagttatggtgtggccatgactaagcatgaaacaagtcctggaatagacttggagaaggtgcacaaatggaggtcaaccttgaatgaaatagccaacttgaaaggaaaatatttggaagaagggagggacgaatccaagtttattgatgatcttgctactgacattttcaaaatagtatcttctaaagatttatctagagaaatgtttatagtcggacgagagtatcgagttaaagaattgaaattacttctagatcttgagtctcgtgatatcacttgcctgttagggattcatggaactggtggaattggcaaaactacacttgcaaaagctttgtatgactccatttacaagcagtttgacggtacaagttttctcaacgttggagaaacctcaaatcctaagacagacttaaaacatctgcaagaaaagcttttatcagagatacttgaggacgacaaaatccactggagaaatattgaagaaggaaccgcaaaaatagaaaggagacttggttttaaaagagttctaatagttcttgacaatgttgatgacattaaacagttgaataatttggcagggaaatgtgcttggtttggtcctgggagcaggatcatcataacaacgagagataaacatttgctagatcttggtgaggttgaaaagagatatgaagtgaaaatgctagatgagaaagagtctctagagctcttttgtcattatgcctttcgaaaaagttgtcctgaatcaaactataaagatctgtccaatcgagcaatgagttgttgcaaaggccttccattggccttagaagtactaggctctcatttgtttaaaaaaaatgtggatgtatggaaggacgcattggatagatatgaaaaaagtccacatggaaatgttcaaaaagttcttagaataagctatgatagcctgttccgccatgaaaagtctatttttcttgatgttgcatgttttttcaaagggcaacgattggattatgtaaaaactgtactagatgcatctgatttcagctcaggagatggtattacaacattagttaataaatcacttttaactgttgactatgattgcctgtggatgcatgatctaatacaagacatgggtagagagatagttaaggagaaagcatacaataaaattggcgaacgcagcagattatggcaccatgaagatgttcttcaagtattagaagatgataatggaagtagcgaaattgaaggaataatgctcgacccccctcatagaaaagaaattaattgtattgatactgtatttgagaagatgaagaatcttcgaattcttatcgttcgtaacacaagcttttcacatgagcctcgttatctcccaaaaaacttaaggctacttgattggaagaactacccttcaaagtctttgccatcagaatttaatcccactaaaatcagtgccttcaatggaagtcctcaactcttactggaaaagccatttcagtttgaccatttgacttacatgaatatctccggttgtgataaggtttctgaatttcctgatgtgtctagagccatgaatttaagaaaattgatacttgatggatgcgagaacctggttagcattcataaatcagttggacatctcgctaaccttgtttctcttagtgcttcaaattgcacacaactccatagttttgtgccaacaatctatttgccatctcttgaatccctttcctttgttctttgcacaacactcgcacactttccagatatcgaaggaaagatggataagccattagagattgttatgtcatatacagctattcagaagcttccagattccatcaaggaacttaatggccttacctatcttgagatgacaggttgtgaggaactccgatatttaccaagtagcttatttaagttgccaaatttggtcacattaaaacttgcagaatgtgctttccttccaaggtcattgagaatgtttataggaagtccttcaacgtgcgcaaaactagagacattacatttcgacaatactgggctgacagactatgatcttaagactattgttgccatttttcctaacttgaaagacttgaatgtatcgcggaacagattttctgatctcacattgagcattgggaaatttactaacttgacaagtcttgacgtgagttattgtacggaccttaaaggaatgccttcaatactgccatcaagtgttcagaaagtagatgcaagagaatgtcgatccttaaatcaattttcatcaaacgccttatggattcaggtaaaaaaagaaaagaatgaattagaagtcatgatgccaaaaagggagattccaaaatggttccactatgttaacaagggacggtttccggatttcaaggctcgtgggaagttccctgcggttgctatagcgtttgtatttggggaagtgaatgccattgacaaagctaatagaagtataaatgttggcattcacttgttgattgaggatgaaaggagaaagtttcgtaatgtccctgtccctgagaatcatgtgttcttgtgtgacctacgaggtttgttcagtttggaagaatgggaggatgtaggtgttggagttggtaatgattggaagaccatacaggtttactgtgacacaaagttgcctctatgttcatggggagtttatgtgtacaagagtgaaagtaacatgaaatatatccaattcccgtctaatgatccctgttcctccttctaa

SEQ ID NO: 69758 - DNA, 90 bp, Glycine max
  Peptide Sequence Number=SeqID_161443
gaaaaggaaggagaagcttgccacccagcttgccccggagagctaggttgctttctccaaaaggcaccgccttctggagaacttccttga

SEQ ID NO: 69759 - DNA, 189 bp, Glycine max
  Peptide Sequence Number=SeqID_161444
atggaaagattcgatttcgggaacttaccggttgaagaccgaagaacgacgaagaacgaacgaagaacgatgaagaacgggaaaaagagggaggtggttgccgcccagctcgcccaggcgagttgggttgcttccaccagaaggcgccgccttctgttggaaccccctggaaggcccaagtgggcctag

SEQ ID NO: 69760 - DNA, 204 bp, Glycine max
  Peptide Sequence Number=SeqID_161445
atgacaattttgatcgccaatactttgacaacatttcatagagatgaaagactcgggaatacatatgctatgcatggaaaatgtaattatgagattgagatgcccaaagaaacatcatttcctagttcaccatgcattagaaatgggtttatgatcccaacatggttggctcatgagaaaaatgcaaggatcatgcataagtaa

SEQ ID NO: 69761 - DNA, 1236 bp, Glycine max
  Peptide Sequence Number=SeqID_161446
ggtgggggagtggaggttgatctatggtcatgctgggtctccgactcgcttgataacagtgaagcctcatctagagttttcctcttttggtgatgcattttcgccggtagtccctactgccacaatgttgttacctaagaggttagcaccacccatagaggagtttgaggggatcttaggatgcccgataggagggaggaagccatacctcttctcagggtactatccttctatggtgaaagtagcaggagtggtcaatatctcggaacgagaattagatcaagtgaagaaaattaggaatggagtagcaggaatactgaggaagtgcttggatgagaaggcaaaaactctggcaagccaaggagagtgggtatcattcatggacgtattaacattgctagtgtatgggacaatactatttctgaatgtagatagacttgtagatctagcagcgatcgaaacctttcttgcttatcaccacaacaaggaaagcccagtcattgctgttttagcagatgtgtgtgatgcattcgacttaagatgcaagaattgtcatcacatgtgcttgggaaaggataaagcaaattgggaagaactcttggtaggcatgacgggtccattagttggttcccacgatggaaagaagggggagggcaagagtattatgctcatgatatcctatgagaggtgcgccataggaggaaaccatcgtgcctttcatcacacgaggggtctgaatggggaagaggcagaagtgcctgaggagagtgaagaggtgaaagccttgaaagctgagtttgaaaagacaaaagtagcgaaagagaagctaaaggtggcagccactagagttaggaaaaaaagtgataagttgagggatatcaacatgaccgcgactgaagcgctagagcgggaaacgaagaaagccaaaaaggaagagtggagtagaaacaagtttcgaggggctttgttaggaagaagtaatgagctcaaacttagaaaggccgagagggacaaatcaaggatggaaagcggaagtttgaaagagcaattgagaaagacggaagagaatatgttgataatcattgatcaatataaagagaaggtgaacctagctgctagtcacgggcagatgctaagagacaagcaggcgaaggtgtcggccttgcgggttaaaagggaagcaagggaagaggtgatggagttattgcataaagaaggcatgaaatggatggatag

SEQ ID NO: 69762 - DNA, 75 bp, Glycine max
  Peptide Sequence Number=SeqID_161447
atgggtcggtccagagttgcgttgcgctccgctgacgatgacccaaaccacaggtgcttttctgcctctcgttaa

SEQ ID NO: 69763 - DNA, 126 bp, Glycine max
  Peptide Sequence Number=SeqID_161448
atgtcgatgctattcttgaaaccttcggactatgcaccagtagtttttgtgattgaaagcaagaaaggtggtggtcgtggtggttctggaaaaggccacggtggaggtagatttgctaacttctag

SEQ ID NO: 69764 - DNA, 315 bp, Glycine max
  Peptide Sequence Number=SeqID_161449
atgatgcatgatgatacatatattatagcagatccacctatgttgcccgttcacacaacagctatgccacaaccacctacacctacaactgttgattcaaacatgcctcgacatgcaatggccgcttgccaaaagatagcaaaaagcttggaacatatgatcaatatgaggatggtcactgttggaactgatgcatacactctgactaagcattgtttaagattagctaggggtgtcaccgagcaaggaaatgtttatgtttgcttaagacgaaggagggatacacaggacagagatggtggtggacagcgatga

SEQ ID NO: 69765 - DNA, 555 bp, Glycine max
  Peptide Sequence Number=SeqID_161450
aagaactgctggaacttggatgagcttttggtcacattcccagggacccgcaaggccagggctagaggatttgaaggcccatcttcatccgctccccctgcttctactgcgccaactcccttaccaccatcagtatcagctactcttggcacctccgctcagatttcagacattgtagtgtcgatgctgcagagccttcaccatgaattataccttgtgatgcagagtatccatgctctggctcagcatcggcccattatgcgcatggaggagttttcaactcaggtggcctggccaggagtccagccttcttcttttgggggaggtaaggcctccacagcccaggagcctaagccgaagctagaggccgctgctcagaaggctaatctagaggatattccagaggccaccccagttgctcaggaggacattgtagaggctactccagagactacttcgtatgcatcaccagtgactacacctatgctggagctctctaaggaggaggacgatgctacagatatggattatgcagtagatttggcaacagaatag

SEQ ID NO: 69766 - DNA, 423 bp, Glycine max
  Peptide Sequence Number=SeqID_161451
atgttgaaagttgcattttgtttagtagagtctcgagcagattggagcattggagagaagaaacctaaattatcaggcgaagataggccttctatgacagatttgagtggatacagttttaagcgagaagaatttgatgttgaatatgacaatgatgcagaacaagtgttggctgatatggaatttaaggacactgatactaaagctgaatatgcaatgaaactgcacggtacatctacttgggttgttgtgactgagaacaagagagggtacatctcttgtggatcagttcaagtggagggtacatccacttggttgttcaaagagaacaagggatggtacatcccttgtggatctttgcttgtaaaggattttacaaggttgaaaagaaatctcaaggaccgcaggtcacttggggactga

SEQ ID NO: 69767 - DNA, 249 bp, Glycine max
  Peptide Sequence Number=SeqID_161452
atgtgcaatatttggttttctattgttggtgactctgcgcgttttcctcccttggaagatgcacccatgaatctcgcgtcgccctcccgccgaaggcttctcgctaagccaatctgccggcttagcgagtcatccgctaagcgcaccactcttgcggttgagcgcaccactcctgcggctgagcacgaggaagaacctggaagaaggatgagctggacacacatgctaagcgagggctcattccgctaa

SEQ ID NO: 69768 - DNA, 399 bp, Glycine max
  Peptide Sequence Number=SeqID_161453
atggttttgaaagatgagttaaaggcttgtccgaggtccaagaggagtttgtcccaacagctaagcgagacagaaggaaacatgttggccatcatcgataaatacaaagaagagttgaacctggaaatggctcatgagcataggctagtggatgagtacgccaaggtatcagtggaaaaggaagcaaggggaagagtaatcgattcattgcaccatgaggcgataatgtggatggaccgattcacccttaccttgaacggaagtcaagagcttcctcgactgctagctaaagccaaggcaatggcggacatatactcatcccccgaggagattcatagactcctcagctattgtcaacacatgataaacttgatggcccacataattaggagccattaa

SEQ ID NO: 69769 - DNA, 255 bp, Glycine max
  Peptide Sequence Number=SeqID_161454
atgtcatgtacgcctttgctatatgattatttgaggatattgccatgttgtgtacatcccccttgtcgcaacgtgcccttttgcgggcgagcgaaggcgagtctcacgggtgcgctttccaaaggaggaaagatgcgcggagttgccaccaacgaaggtattagcacctctcacgtcgacaaaagcggggctcttgctcctacgtaccctccatcaaagaggaaatcagacctacgtagttctttttatgtgtga

SEQ ID NO: 69770 - DNA, 636 bp, Glycine max
  Peptide Sequence Number=SeqID_161455
atggtctgcagtgatcaggctgaaatgaccgatagattgctggccgaatcattaacttttgataatcgcatcatgcactatataattgttagaattttacttccccggtcttcaaatttagcacaagcctctgaggaggatttgattttgatgtgggcttttctcaccggtcgtcagatcgactgggcctatttggttcggtaccgaatgcataaggcattacgggccaatgcacctctaccttatccacagttgatagctttgtttctgcgtcattttcaaattccgcttgatgatgagccatttgttcaagtcaagcgatcctttgcaattggtgctggtgctgtgacttcctttggttaccgtaaggatcggaatggtcaatggctgaagaaagacgcactccctcctcaagatgagcgtactccttcacctcctcctcagcgtgaagattcagcactcctgaatgaagtccttaccgaattacgaggtctttgttcttatgttggtgaacgttttgactcattggatacacgctttgccggcatggatattcgcctcacacaagttgaagaagatgtctccttcatccgtacttgctttgatccaccaccaccgcctccatcatcctcttag

SEQ ID NO: 69771 - DNA, 255 bp, Glycine max
  Peptide Sequence Number=SeqID_161456
gtgtgtgatatatatccacgcattgaattggctaacggccaaaccaaatacgccaaatacagtgattcaaaaagcattcaaatgcctaagttgtgccgtattacaatgatgagagtgatgagcaaaatgacgacgacagcgatgaagtctatttcattgaagcctttgggaagagacggcaccgtgaggccccatttgctggaggagattccgattgtggtgcctagctttcaccttgacatgggagaggtttga

SEQ ID NO: 69772 - DNA, 527 bp, Glycine max
  Peptide Sequence Number=SeqID_161457
atgactagaggcaatccatctgacttacaaccccttgatcctgaaatagatagaacatttcatagattagttaggcatagtgtgcatcctactttccctgaacattttgtgccttttgaacatcctgagcattctgttactggtgagtctgtgcattctgttattggtgattttgaacatcctgattttgagcattataattttgaacattctgagaacatggcacaacctccaccccgtgagaggactctaagggaaatggctgcacctaatttcacttatgaaagcttgtgcatccaataccctgatgaggatgtcctatatgttcttaaaactggaccaatccatttgcttccaaagtttcatggccttgcaggtgaagaccctcataaacatttgaaagaattccatattgtctgctccaccatgaaacctccagatgtccaagaagatcacatctttctgaaggcctttcctcattctttagagggagtggccaaggactggctatattaccttgctccaag

SEQ ID NO: 69773 - DNA, 447 bp, Glycine max
  Peptide Sequence Number=SeqID_161458
atggcctatgtcgccagtaagggcgcggtgattgcgatgacccgctccatggcccgcgagttgggtgaaaagcggatccgtatcaacgccatcgcgccgggactgacccgcgttgaggccacggaatacgttcccgccgagcgtcatcagctgtatgagaacggccgcgcgctcagcggcgcgcagcagccggaagatgtcaccggtagcgtggtctggctgctgagcgatctttcgcgctttatcactggccaactgatcccggtcaacggcggaagtgaagtacctggtaccgggtctggagcgcggtttacaactgctgctggcgtttggcgaacagcatcgcgatctgacctttgccgagctgcatcggctggtggatatgccgaaagcgaccgcctatcgcgtggtgcagacgctggaatatatgggctttctcgagcgtaa

SEQ ID NO: 69774 - DNA, 285 bp, Glycine max
  Peptide Sequence Number=SeqID_161459
atgcaggcactggccggttttcacgtcgaataccgcctcatgcagcgggcattccaccttgccatcttcgacaaagccctggctcaggagcgcataggcatgagggcaaacgtcttccagcgcgtaatattcgccatcaatcagataaataccgatttccttaccgtcgatattgccgctatatgggaaatcttcctgtacttgctccgcgtcacatacgcctatccagctcatcgcaatcctccaggcttttgtttcatatatgaaactctgtttcttatttaa

SEQ ID NO: 69775 - DNA, 276 bp, Glycine max
  Peptide Sequence Number=SeqID_161460
atggagaattgcactaagcaatcactacgcatggctccaaactcgggtggaggacacatgaacgaaaacgcaattcatggggctccgaaaaagggttgcagaccgaaggtccaccgggtttttccaaaggaaaacatgctttttgcaaagaaaaatgaaatcattgcactaacaatcttactacgcatggcttccaactcgaaggtggaggaatgcttgaacgaaaacacaattcatggggctccgaacaagattgagaatggagaattgcactaa

SEQ ID NO: 69776 - DNA, 387 bp, Glycine max
  Peptide Sequence Number=SeqID_161461
gatgtggctggtggttctatgtttcattctgcaaattctcttacatcatgtggaaataatttatctaataatgaggcgcaaccgccaagaaatgtgagcaatttacatggtgatgaagatgatgatgatgattatcttgtgtctaactcatacgttgaagagtctttagacgaagatgatagtgtcgacggtatatctgatacagatgatgaagtcaccgacatgattcaaccagtaagaattgttcacccagtagaagcacctaataagtcacctatatcagctattgctctgggtacattccattgcgtacctaatggggcgttaggtgttggaattggggcatcatgttgctgtgaaggggtcatagttggccatgaaaaatga

SEQ ID NO: 69777 - DNA, 90 bp, Glycine max
  Peptide Sequence Number=SeqID_161462
atgggttcgggagttgtttacgtgcggggaagagcgttgcccttgctcctacctatcctcaagtgcgatgaggaactcagacctacgtag

SEQ ID NO: 69778 - DNA, 474 bp, Glycine max
  Peptide Sequence Number=SeqID_161463
atgtcggccaggaaagatgaccgatccaggtctaaaaaagaagaatcaccggaagacgccgatcgactatttcctaatcgacatcgtccaaatattatcgggggattgaatagaaaaaacaataacggacattggtcgttaatagccccgattgatatttatcgattgacattgtggaatttcatttccaaacgctggccgataatattctttacggtcggcttagttttttcgtgcaagctcaaccgaagttgtgtttcggtagacactggcatgtactcatttactcggcttcaaaaacattgggccacgtcgacaaaaaaacattattcaccgatattgataaaaaaagatggtagtcgatgtcggccagaaaagatgaccgatccaggtctaaaaaagaagaatcaccggatgacgccaatcgaacatttcctaatagacatcgtcgaaatattatcggggaatgaatag

SEQ ID NO: 69779 - DNA, 156 bp, Glycine max
  Peptide Sequence Number=SeqID_161464
atggcacatcaaaagcccccaaacttagccttttgcactcctgggcaaaatgaaataaagaacaaaatccaaggaatgaaaggaatgggtaacatcaaattagcttacgtatttctcaatgaacgtcaaggaatgaaaggaatggtacaaatttga

SEQ ID NO: 69780 - DNA, 339 bp, Glycine max
  Peptide Sequence Number=SeqID_161465
atgagcgtccatgtggctcagttgatcgttgatgccatttatttatttgcagagaagtattgcacgcctagacaggcgcagggcgatgcaccgcaggccgcagatgcaccaccaccacctcaccaggccgatccagctgggtcatttggcatggagcggtatttacagaacttggttcgccagcaggcggccaaccacagggcgcatgtgcagacccatgactgtctctaccagctcagcctcagtctgcagggccagggtttcgctccttttccgtgccctactccaaatcagtttagggctgaggtcgcatggcccagagattggcccgagaactag

SEQ ID NO: 69781 - DNA, 264 bp, Glycine max
  Peptide Sequence Number=SeqID_161466
cttgtagccagaatcactgacaatatagtaagtgaaactgagcatgaggctctataccaagatgatgagcttgtagggcttcaagaagtgttgaaagttgaccctgatgtcattaatgagtctcttgctgatgttgatggaggtggagaagagatagatgcagatttactcaaacaactagacttggttgaaccagacgaggatgaatgcatattaagtgagaatgacattgagagtgattttgatgatatagatacttcttag

SEQ ID NO: 69782 - DNA, 444 bp, Glycine max
  Peptide Sequence Number=SeqID_161467
atgtcaggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtggtcttcgtcattggaagtgcggtagacagactttgtggaatggcagtcacagcatgggtttctccctcattctcaccctcttcatttgccccagttttctcattcgtctaagcaggatgatcaaatttgcctcttttcggacccacatcgatcctttcactggcgaagaccaaatccgcaaagctttgagg

SEQ ID NO: 69783 - DNA, 552 bp, Glycine max
  Peptide Sequence Number=SeqID_161468
atgactagaggcaatccatctgacttacaaccctttgatcctgagatagataggacatttcatagattagttaggcatcattttataccttttgatcattctgagcattccattactggtgaatctgtgcattctgttattggtgatttagaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcatattgtttgctccaccatgaaacccccagatgtccaagaggatcacatatttctgaaggcttttcctcattcattagagggagtggcaaaggactggttgtattacttgctccaagtccatcacgagctgggatga

SEQ ID NO: 69784 - DNA, 711 bp, Glycine max
  Peptide Sequence Number=SeqID_161469
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaagattgatcgaagacttaaattcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 69785 - DNA, 246 bp, Glycine max
  Peptide Sequence Number=SeqID_161470
atggtagccataatcccagcaaagattcctcaacctccatttacccaaggatacaactcgaatggaacatgtgcttatcatggaggagtttcgggacattccattgagcattgtatgaccctgaaacataagacagtaatagatacttcagagccctacattgggacaatgagaggcaccatgcttgagcctcaagcgaacctaggggcagatcagaagttctcacctggtaggttgaaaacctaa

SEQ ID NO: 69786 - DNA, 255 bp, Glycine max
  Peptide Sequence Number=SeqID_161471
atgggagatttaaactacttccttgggctacaaattaagcctaggatcttcatcatcaatggattcctttgcttcttggaagatgaatggcagtggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 69787 - DNA, 306 bp, Glycine max
  Peptide Sequence Number=SeqID_161472
atgaatcaaccatgcaagcacgcgcgtaacgcgttatcagctcgcttagcgagtcgtttgtcaccttccaggcttagcgcgagattggcgctaagccaaaattcacttacttgcgctaagtgcaaaaatggcgctaagcgcgatgtcgaggtagagagccttttaaagcttgatttgcacagaatgaaagatagaccaagagagatgcacagagagccgagctctagcattgaaagatgtattgtctccttagaacttgatatagcaggattaggttaccgtatgtctggaaatggagtgcggtag

SEQ ID NO: 69788 - DNA, 495 bp, Glycine max
  Peptide Sequence Number=SeqID_161473
atggattggcttagacgcggcctatctaggggttcaaggaatagcaaaaccccaaatatccaaacgcagtccaactccgaagtacagcaacacctagaagaaagcatatacgggattaccgaggaactcatcaaccacatcaagaccttcacccttgacacctttaagaatttccctctccaagtaaatagtaatcatagattgcttggaattggaagcattggtttctcactcttcgtagggaaacccaataatgatacgatgaagttgaaggcagttatggggaagacactcaatcctcttcaaccaaagttcgaaatgaactttctcagtggcaagagaaacatgcaatcctcgtactctcaagagtcaagagaactttaccttcgtctgtataccaagtattgcaaggctgatggtacaaccgcaaaagtgttattccactgggtgatgtctttggaatctctttctgagattggaagactgaaatcctaa

SEQ ID NO: 69789 - DNA, 240 bp, Glycine max
  Peptide Sequence Number=SeqID_161474
atgcttcctttcgactctcgacatgtcatggaacttcacggattgcctaacgatgcgtgtcaagtacctcgaagcggtcaagcgaagggaagtaaagataagacactaatttcgttcgagcagaacatcattcggctggtcgatatccctgccagtggaaccttcgctattgcacccgatcgtctctgcccagcagagaagaatcccgcgcgtcgttgggctttgaatgttttcggatga

SEQ ID NO: 69790 - DNA, 396 bp, Glycine max
  Peptide Sequence Number=SeqID_161475
atgcatatccaaggcactctgctggaacctttgacaagggcacaaacactagtggacccttcggacatcgctattaggcttttggagccactcaaggtggagttccctattttgagctacgccgatttctacccgttggctggcgttgttgccgttgaggtcacgggtggacctgaagttccattccaccctgaaagagaggttctgagggtattatgttccaagatatcactactctattgctttctgttgttgcaggaaatcgtgccacttgaggaagtttttcagactctgaggtgtgattcaaatggactcacaatagcatctgcagaaagaaacacaaactcaaacccgcaaaacaccaccatagcaaaccttacaacacttactgtgtga

SEQ ID NO: 69791 - DNA, 441 bp, Glycine max
  Peptide Sequence Number=SeqID_161476
atggaaagagctacacatttgaatggaagcagaatcgcatttggatggaagcggtggcggaggggctatagggaaagtagtgaagtgcctcgagctattccaccgcagaaacaggtcttgcacaagggactcgagctcactacgtccattggagaaagatcggtcgtggcgtgtttggcgctgtacgtgttgaagaaaatcaggctcgcgcgacagaatgaacgatgcagaagatctactcatcaagaggtagtatgcagtaatgcactttctactatgtttgcattgttactggatactgtgaagatggagacattgttccaacatctttctaaccaaggatcaagatgttcgcctagcatcaaaggaatgaacctcaaggaagagcaagaagaaggaaaagtaacctatggaaaaaccttcgagcaagtcacaaattaa

SEQ ID NO: 69792 - DNA, 423 bp, Glycine max
  Peptide Sequence Number=SeqID_161477
atgggctcaaaaatctaccctaaggttcatgagaaacctaaggccttctttatcagctatagcccaatcctcttggagcctcttgctcatggctctggtatgctcgagcttatgtggtatttggacaatagttgttcaaggcatatgacgcgagacaagtacaaatttatctcttttatagcaaataagggaggctatgtaacttatggggacaacaacaaaggaaatttttttggtatagcggaatggagaaggaggagagagaggatacgccacttcaaggagaagatgagtctagaagaagctcaccaccataggaggccatggataagagcttggaggaagaaggagatgaatgaagggagaggaagagaagatcacaaaattttgtgttctaaaagagctctgaaatctgaagtttaa

SEQ ID NO: 69793 - DNA, 765 bp, Glycine max
  Peptide Sequence Number=SeqID_161478
atgatatatgcggtgaagaatgtgagaatccctaagtttgtggacttggagtggttttctcagctagggtttaacttccctaatttgcttaaagcacagggtctgtccaagtttgtccaggtgaaaggaactttctacctagagctagtgcaagtcttttatacttgtgctcgtgtcgatatggaagaaatggttatcgatgctgcagtttggaaggtagtagccgaactggacatgggtggagtccgtaagtttgatgaatctgttgacgggtacaacaagatgcaaacttacagaagtatgctccttgacccagcaaggaatttgaggaattgcctaggtataggtggtttaactgctaaagacagaaagctcatgtacctcataacctacattttcacaccaaggtctagcaaccacggacaagtgattgatgacgatttacagattgtgtatggttttaaatcaagtattcaaatgaattgggtacttctgattgaagacatcatgttgaagagccatcggttagtggattatgagtttccgtatgttgtgctagcctctagattcattgattattttaataccgatgtctctaatgagatagtagattccaccaaagcgtctaatgacataatcgaaaggcatctcaagaagcttgagatgagatttgttgaacacaaatggatcatggccggagagccaccaccagtagcaaacatggaccagatggaagatgaagctcaacaagagtttgcgtactaa

SEQ ID NO: 69794 - DNA, 258 bp, Glycine max
  Peptide Sequence Number=SeqID_161479
atggtggacgcgcaaacctcctcaacgaccgtttctcttcgcggatgcttcctcgcagcaccaccgcaagctgcctcggcaacctcctcaacgaagaagaagaagaggcacaaagaagatgtgcaagcaatgaagaagaaggcgcaagaagatgaagaagcaggaagaagaagaagagagttgatccgaaagaagaagaagcagaagcgcaaacgcggggagggagagagagagggcattatggccttttcacagtaa

SEQ ID NO: 69795 - DNA, 207 bp, Glycine max
  Peptide Sequence Number=SeqID_161480
atggcttgtagaaagctaggccaggtgtggctgaggaagaagaaggtgtctattttggccttatatgccttggaggaatttggacattgtgctaacaaggagacagcccctaacggcacagaggattcgtggattctgcttctagaagaacattcccagctcagcctcatttggttgcataatcctcaaggtatcgtggcttactaa

SEQ ID NO: 69796 - DNA, 822 bp, Glycine max
  Peptide Sequence Number=SeqID_161481
atggcccgcatgaagaaaactgaccaaatgacgtctgaggcaacaaagaaaattactaacaagattgattcgttggaggagcaagcgtcacagggttcctttgttgcccatggatgtcaggatgtactgactgctgccattgggcgaccagaacactccggtcatgtgcgtgctgctagagccggtgtgacgatcaagcgttattttggacccgctccaaggacctctcgcacgtcttcctccatggctcccgaagtcctagagcatttgactcaacaaatcagggaccagctggaggagtcaatcacagaaaaatcgcagatgcaatcacagggactcgcacagcctcctgagcttgaggttggtccttcagctgctcgtgtcaacacaaaggagacttgtgttgatccctcggggaacgatccagacacaggtgactcagacaaatgtgggttgtacatcgaagaaaatcctccccgcctggttgccctaggaagagtttatgagggatccacaaccattcacaacattcctttgttgcatgatcaagtgaaggtcggtgttgaggaggttagagatgcaaatgctcccattcttgtacccattgaagaggttaagttagtggggcaggcacttaacacctttcttgcttggtcgacacatctcgtcaagcatttatcagaacaggttatgtgggatgctaccgtgttcggggtgtttaatgaagactttcccttgtacatacagttgcatatgactgagacaagtatacgagcagggaattctgatgtgtatggattcctcgagccacagtccatctag

SEQ ID NO: 69797 - DNA, 237 bp, Glycine max
  Peptide Sequence Number=SeqID_161482
atgaagaatggtggaaaaccttcgcaaaatcgcccacggaaacgtctcggaagcgttacggaagcgcctcggcttggattttcttcacggaaacaatttttctcactaattttaagtgaatctcagatatcaggagggggaaagagggaggtggttgccgcccaggcgagctgggttgcttccaccagaaggcaccgccttctattggaacatcctggaaggcccaagtgcgcctga

SEQ ID NO: 69798 - DNA, 222 bp, Glycine max
  Peptide Sequence Number=SeqID_161483
atggctttagggactccaaacctacaaaacagattagatctaacaaaatccacaacaaccttagtgatgcaatcctaccccccaagggcattggatagaagactccaagaagattgggccaaagatgcaagagaaggccctagggttctcatgagccttagggtagggtaccctagaaatataggatttttcagcccttgtattttagggcacctagactag

SEQ ID NO: 69799 - DNA, 1128 bp, Glycine max
  Peptide Sequence Number=SeqID_161484
atgaagggtagagttaacctagggttagaaggtgagagtatgcttgaaattccatttaggacttatgagaaaggttgggctgtgctagagagaaaaacaaatgaccaaagtgaacaaagagccatttctagggtgcagcagaattttggccttgtgcagaaaaatgcttgtgtgtggttggctgtggaaagagtagtacagaatgagttctggatgtttgctagtagatcccaacgagttttctgcctttgccctgttttgcttggtttgttagtttgtgatgatttggatgttgaattacctggatgttggagaagcttgggaggattgatggagacccggggatggtgggtttatgtgcgatttgtggatgtggaaaacttgttgtgcaccatcgcccgaccgccacctagtaccacatgtgatggagtggtacctggagatatgtcgcgggggtcaggagaccttggggacgtcaggcgagctcctgacagtcaacagataaaaggaacaaagaccacaaagcaaggaggcttgtgtggtggctggccagctgtgaatcttgaggctaagatggtctctggtaatcgattaccaaggcttcaaaaagggaactggaagactatggaggcctctggtaatcgattaccagactgtgtaatcgattacacagaggaatgggtcactggtaatcgattaccagcgcagctaatccatgatcgagtggagatggagtgcctagagggagcttgggagaccctcgaaggcaacacgaggtgccgatttcggggcacgattcgatttacggctacttcattggtgcatccagatgaacccgtgcgcacgcttcagcgtactatggagtggatactacccacgcctacaccataccgtctagtggagccagtccaagtgatcgaggtgacatcatccgaggaagaccctgaggaggatcccgaggagctacctcctgagcctgttgtggaagctcttgactttctagagggtgatgaggacccactccctgaggtggattctcccgaggaagtcatgtcggcatctgaggcagactctacggaggatagtggcccgggggagatggcgatcagcggaggctcttcatcctag

SEQ ID NO: 69800 - DNA, 870 bp, Glycine max
  Peptide Sequence Number=SeqID_161485
atgtatttctcatacaaaattatattcttatttttcctatgcacttggggtgcaaaagctgaggaccctttagggcgattctgcaatgaaaacaccatcattggcagtggaggaaaattatcagccaatattgataaaatattgactgaaatagccctcaaaactccctccactggttttgttgccaccacatatggcaaagaccaagacaaagtgtacgcactcgctcaatgtaggggagatgttagcacccaggattgctccaattgcatccaagatgcaacgaaacaaatccgccaacgctgtccaaaccaagtggatgggagaatttggtatgattactgctttttaaggtatagtaacaagagtttctttggtgaggttgatacatcttttggtatattctatttcaatgttgaaaatgtgactgaccctgaagattttaacaaagagcttggggctcttatggatcacattagagcacaagcagtggtgcctagagaggaagggcttgggaagggaaaatctgtgctgtccccatttgtgacactttatgcgttagtgcagtgcactagggacctgtctgagatatcctgtgctcagtgtttgtctattgcagtgaacaactttcccaatttttgcagcaatcgtaaaggatgtagagtactgtacagttcttgctatgttcgatatgaactctacccttttttcttccctcttgattctaacaaaacaggaccttccaatactgcaaaaacatgtgcatcttttccgttttccctcagtaattttacagcaaataatgtaatgtgggaggtaaagattgtaattcaattaagttggcaaattgaattgctagctgaaatataa

SEQ ID NO: 69801 - DNA, 711 bp, Glycine max
  Peptide Sequence Number=SeqID_161486
atggatgggctagtggacctagcggcgattgatgccttccttgcttatcaccatgtctcacacctcttttttcatgaaagtagacccgtttttcccctacaaggtcactgcttgtgcgccaagaaaaggaaggcaaactgtgagcaactcttggctagtgtggtaagggcatgcattaattggttcccccaatggaaggaaggaagatatggggttttgtcctcgtgtgagggattctcaaacgtccccttgatgggaacgaggggttgtatcaattataatcccatccttgccataagacaacttgtctaccccatgagaggagcgtcgtcggaagaaagtatcatgcctttcatcacacagggtttcagtgaccccaatgcgaggatacttcgaggaatccgcaaagcgtggagcgcggtgcaaaagaaagacaaggagcttagagaaagccgcaatgggatcatcgacggctatcataagtggctaaaggctcggacgctagagttggattggctcccaaagctaaaggtttcaagcgaggtagaggctgaaacccccgaggacagtgaggaggtgcaagccttaaaggtggaacttgaaagagcacaagcggtcaaggaaaagttcaagacgacggccatcaaggtccgaaaagaatgcaatgagctgagggacatcaatgtggccactgccgaagctttggagtag

SEQ ID NO: 69802 - DNA, 201 bp, Glycine max
  Peptide Sequence Number=SeqID_161487
atggcagtagtgactaccagtaacaatatgttatcaaagaaaaaaactctagatgagggatcactcttatcaagcaagtcagagacccagcatgaccacagattcacctccagtccttatgttcccatggacccgggagtagggctccttttcaactcaccgtgtgtgaaaaaaggtgttggtgctatgtgcatcaaatga

SEQ ID NO: 69803 - DNA, 531 bp, Glycine max
  Peptide Sequence Number=SeqID_161488
atggttgctaggacaggattaagtcctttgatagtgtgtttgatagacaccgacgatcagggacttatatcctcctttgtcgagaggtggcaccgggagacttctagtttccatcttcttgtgggggaggttttgatcacgctggacgacgtcgtgtctcttctccatctgccgatcgttggcgcattccatgacatccagcctttgtacagcgacgaggcgatgctattgttggttgagttactgatggtctcaccagaggtggccatggccgagacaggccaatatggtggaccatattgttggatatacgagcactttccgtcatttgcggagtgcaatgctgatctggactacgacgaggtgtcaccacgtgcgtgtcggtggattgtgacaaagaagactgtgaataaggtatctacaacgacgaacaggcaacacctggatcgtctgaggatcccagatgtctgctggatgccatatgcggagcaccgacctgtgcaggactttcatccgatttcgtgcttctaa

SEQ ID NO: 69804 - DNA, 442 bp, Glycine max
  Peptide Sequence Number=SeqID_161489
accgaagaatgacgaagaacgaacgacgaacgacgaagaacggttgaaaatcttcgcgaaatcacccacggaaacgttacgaaaacgttacggaagcgcctcggcttggattttcttcacggaaacaattttcctcaccaattttaagggaggagcttgctacccagctcgcccaggcgagctaggttgcttcctccagaagcaacagccttctggaggaacatcatggaagcggtcaaacaaaggttgcatgccatcaaacaatagtccccgaatgaaattagggtatgacaaagtctattgtcccaagaaggttttccaaagctctgactttaatttgctggcagccatctatctcaaggtggcttactctcaatttggatggttctgctcatggggattagatgggagtaggatgtggggttctatgaagacttgctaa

SEQ ID NO: 69805 - DNA, 351 bp, Glycine max
  Peptide Sequence Number=SeqID_161490
atggtggaaagagagatgatcacaatgatagtagacacgctgccagtgttctactacgaaacgttggtgggctacatgccctctagcttcgcgaatctagtatttgcgggcgagaggattgaagtaggcctgaaaagagggaagttcgactatgtcgcccctgctggtacaagcaacagaagattcagagcaactgtggcaaagaagaaggaaggggatgttgccaaaggagtcattacgctaagcgagctcaatgcgcttagcgcgcatcaacggctaagcccagcaccagcgcgcttagcgagtaaaaaggaatctggaaagacatctgctacacaagcatgcgcttag

SEQ ID NO: 69806 - DNA, 348 bp, Glycine max
  Peptide Sequence Number=SeqID_161491
atgtcatccaaagctccgcaagatggcttcctcgtcaagctcagctctttctcagtctctccacagccaaaaattctcaagaaactcaacaacccttccgaaattgagattttagctttaaataggcattcctcgccagtcttctcgcttagcctaagggttaaaggcagtgcgcttagcgagttcacactcgctcagcgcctctgtacagctcatccttcttacagattcttttgtgcgcttagcagatggctcgcccagcgcgtggcgtggcccagcaagttcataaattctgcacttcaccaatcttgcccattttgcctgaaattgaaaaggaatgatcattaa

SEQ ID NO: 69807 - DNA, 105 bp, Glycine max
  Peptide Sequence Number=SeqID_161492
atggctatttataggaaaaggccatttggtgtaggggaagcttgcccagggcaagagactcataaagttacaccacaagagactctgagagcatgcgaaaattaa

SEQ ID NO: 69808 - DNA, 240 bp, Glycine max
  Peptide Sequence Number=SeqID_161493
atggcgactaagatgaaacgacgcccattcgaagccttggattctatagccccaatcacgtctatgccccacatcgaaaatgaccatggtgctaacaacacattcaatcactctccatggcaatccagtaatacccatctctcaaaatcttttgggccatggcatgcccattggcatgggtgccaaaggatccttcatgcacctctaatggttttcctctctaggaatgtgatgaaatga

SEQ ID NO: 69809 - DNA, 228 bp, Glycine max
  Peptide Sequence Number=SeqID_161494
atggccccgaagaaactccctgctaaaagagctaggaagaccactacaggagagggatctagtacagctccacctttagacatcgagtttgatgggcaccaagcgaaaattgcaaggaggcattggacgcagctggcagagcccatggctaaatatgatcctaaagtagtcatggagttttatgcaaatgtctggcctactaaagaaggtgtcatggataagctttag

SEQ ID NO: 69810 - DNA, 228 bp, Glycine max
  Peptide Sequence Number=SeqID_161495
atggatatcgacaatctaatgaactacccagatacggtgtctttggagcctgttacgcgaaaggaagcgcttatggcgtcgaacactcttcacaactttatgatacaatacaaaaatacaacacctgagctattggatgcaataagaaaagttagagatgagctccaaatagacttgaactttaaagaaaaacagacaactattgaatcatatttcaatagagtgtaa

SEQ ID NO: 69811 - DNA, 477 bp, Glycine max
  Peptide Sequence Number=SeqID_161496
atggctggtacattcttccttttgaaacaacaaattagtttagagattatgagcgttgcctctgttgcactttcatctttgaacacaaacaagcaatgtcttttcaaacctcaaggatcatcacaatccgcttctcctttacttcagaatacaaatatccagtttcaccatcaatatgggcagcaatgtagaaaactcttactaactccgagtaaaatgtgcctttcatctccactagcttcttcaatccatggtactcaagaagttaaggaaaaacaaacctttaagccttcaaccattccaagttcagaaactaggattgaatcaactcctttccactgtacttgtaggatgccttatagtgctactctgaaaaccaaggaatggcctttggagagggtggtggtgagggagaacgtgttgtccttttgcccttgtttgaagagccaccctttgcagactccttctccttcttag

SEQ ID NO: 69812 - DNA, 204 bp, Glycine max
  Peptide Sequence Number=SeqID_161497
atgcatctgagccataagcatttcttcatgcattcatccatttttcccgtaaccgatgtcggagtcttgatttgcacaggcgcctgggctcaaaaagaggttctatcaggtcaagatcaagagcctaggagtcgccagtctgaaaaagttagggcagttgatgggtcaactccagcgatgagcctttcgcaagacctatggtaa

SEQ ID NO: 69813 - DNA, 789 bp, Glycine max
  Peptide Sequence Number=SeqID_161498
atgtcttggaagcattatggaagcacctcggctaagatttttttcacggaaacaatttttctcactaattttgagagaattctcaataccagaaaggctgaatcttttttgctctgccctctttcccctatttataggagaaaagagggaggtggttgccgcctagctcgcccaggcgagcagggttgcttccaccaaaagtcaccgccttctattggaaccctcaggaaggcccaaaactttacggattatgtaaagacacccattttctttccgaaatgttgtgaaaccttacggattatgcaacgatgcttgttttccttccgaaatgttgtgaaactttacggattacgcaacgatggttgttttgagggttccgaagggagcaaacaaaaagcaaagcttcatgatgaatcaagagtgattcaaagatgttttgatgataacaaagatgataacaaaggtgatgacaaaaagctcaaaggtcaatcaaagaatgagttcaagatattcaagatagaatcaagaacacttcaagattcaagaggaaagttgatttcaagaatcaagaatcaagattcaagagatcaagatttcaagaatcaagattcaagagatcaagattcaagactcaagattcaagaatcaagagaaggcttaatcaagataagtatgaaaaggttttctcaaaaattgagtagcacatggatttttctcaaaacatgtttaccaaagagtttttactctctggtaatcgattaccagattgttgtaatcgattaccagtag

SEQ ID NO: 69814 - DNA, 351 bp, Glycine max
  Peptide Sequence Number=SeqID_161499
atgaaggttagaggacgagtatgtgaaggtattggtccaacaagcggaaagggaagcaagagagagagagtgatcgactcattacacagagaaacaatgatatggatggataggttcgctttcaccttgaatgggagtcaagagcttccaagactactagccaaagcaaaaggcaatggcggacgtgtacttggctcccgaggagtaaacaccataactaaacacactttcaggcacccctatcgaacccattccaaaactagagtcatgggtgacatagaagaggtacaagaacaaatcaaggctgatatagaggccttgaaggatcaagtggcttctgttagtgcttag

SEQ ID NO: 69815 - DNA, 264 bp, Glycine max
  Peptide Sequence Number=SeqID_161500
atggttagaactagaggtcttggtcgagctttaggccaagcaataggaaaagtcttggggaggagagacgcgagtgacgatgatgccccccagcggcgaaggcctattgcatcagcccccgcagtggaattgaacgaagagcagtcaaaagcacatgttgaagaagttgttactgatgttgagggttttccaggcggaccccatgacacatcagttctcaaagattttgaaaatcacattgcttttagagtctcgaatggagag

SEQ ID NO: 69816 - DNA, 417 bp, Glycine max
  Peptide Sequence Number=SeqID_161501
atgtctgcttttgtggaacgctggcataaagaaattagcagtttccatttgcccgtcggagaggtgactatcaccttggatgacgtcgcgttgttgctacatctgcctgttgtattccatagcttcgagctacttcatgtcgacgacgctgtcgaaatgttggtggaattactcgaggttaccgctgcaaaggcgagagctgagatgattcagtgtcatggttcttatgttcaaatatcgtggctacgcgacgtgtatgtgatgaagatcgaggcatgtcactggatcgtagcagcgtggggttatgcttggggcaatgttgcacttatgcacatgattatgatcagaggagaccgtgtgcatgtcgatggacctcttgcaaggcactgcccacttccacgtatcgcaggcgtttag

SEQ ID NO: 69817 - DNA, 1509 bp, Glycine max
  Peptide Sequence Number=SeqID_161502
atgcgactgctgtcgctgggtggcaaatggttttatcgcgtcatcgccagcctgctggtggtgatttcggtggccgccgcttattacatggcgttctttaacgtggtgatcggttacggcatcgtggcgtcggtcatgaccaccgatgtcgatctctctaaagaggttatcgggctgcactttgtgctgtggatggtgctggtgagcgcactgccgctgctactgatctggcgcaataacctgagcctgacactgattgaacagctgaaaacccccggtcagcgcctgaaacctacagtgatcctgctgctgagcgtagcgctggtatggctgccgattcgctacttcgacaagctgcaaaaagccaatgaagagctcaccaatatcgacctgccaagctatggcggcgtagtggcgcactcttatctgccttcgaactggattgcggcgctgggcctgttcgcctggaccaaggtggacgagaagctggacagccaggagttgctcgatccggcgaagaagtttacctatgtggcgccgcctggcattgacgatacctatgtggtgtttgtgattggcgagaccacgcgctgggatcacatgggcatgctgggctataaccgcgataccacgccgaagctgtcgaaagagaagaatctggtggcattccgcggtgaatcctgtgataccgccaccaagctgtcgctgcgctgcatgtttgtgcgcgagggcggcaccatggataaccctggccgtacgctgaaagagcagaacatttttgcggtgatgaaagagctgggcttcacctccgagctgttcgccatgcagagtgaagtgtggttctacgacaacgccgatgtgaataacttctcgttccgcgagcagattggttctgagaagcgcaatcagggcaaagcggtggacgatatgctgctggtgccggaactgcaggcttcgctgcagcgcttcccgaaaggcaagcatttggtggtgttgcacacgaaaggttcgcactatctctattcgcagcgttatccgcgcgagtatgcccgctatcagcctgaatgtattggcgtggacgataagtgcagcaaagcccagctgattaacgcctacgacaactcgattctgtatgttgataccatgctggacagcgtgctggatcagctgcgtgataagaaggcgattgtgttctatgccgcggaccacggtgagtcgatcagcgaaaatatgcacctgcacggtacgccgcgcgagatggcgccgccggagcagttccgcgtgccgatgattgtctgggcatctgataagtatttgcaggacccgactaaccgcagcaactttgagcggttacaggcgcagcagcgcgtcggcaaaacccatcgtcatgttgagctgttcgacaccattttagggtgtctgggttatacctcgccggatggcggtattaaagcagcgaataactggtgccaggcacctgccactgccagcagtgcgaaagcgctgtaa

SEQ ID NO: 69818 - DNA, 285 bp, Glycine max
  Peptide Sequence Number=SeqID_161503
atgcttaaatcaatcacttgtggaagcaatgacttccaaaattattttgatgatgccaaaggatcaagagttaagcaagttccaaagaatcaggagtcaaaaagcttcaagaatcaagtttcaaagaatcaagattcaagaataatcaagtttcaagattcaatcaagtttcaagaatcaagattcaagaataatcaagatcaagattcaagactcaagattcaagaatcaagagaagactcaatcaagataagtactaaaaaagtttttcaaaacattgagtag

SEQ ID NO: 69819 - DNA, 609 bp, Glycine max
  Peptide Sequence Number=SeqID_161504
atggtgaaaccatcgaagaagcgcaagggttctttgagtagaagccaacggcactccgaggctcaggatactccaattccttcctccatttcctcctcctcattgttctcatcgaaagaacaacgtacaaagtacataaacctcttctcctcttgttctatcattgaccctaagttcatagatatggatttcttttctgatgagagtttcgagtgcattcaagcatttcagaactcaaatctcattccctttatgtctttaaaacttcctgtgtattctgaattagtaaaagctttttattctaatcttgaaattcaagagagtaccttgatttctgaggtctttgggataaagatgttcatttatcaatccctcttctatgatttgacccaattgtctagcgaaggtgtaccaattgaaggtgcattggatgatgattggaaatttgatttttctgtgcatgatgtccgccagttgatttgcaccaaccaagtggatatgatcagaaggctgcttgccatttcattggctcttgaaagccgcatccttcattatctaatttttcgtatcccactccctacatcttcaaaaccttgcataggtttctga

SEQ ID NO: 69820 - DNA, 228 bp, Glycine max
  Peptide Sequence Number=SeqID_161505
atgaatattacaatttacaagcttaatacattacgcacgggtgcgtcttccaaaggtggaaaatgcgcggagtcgccaccaacgtttatttgtggaaaacgtcagaaaaaccgaaggaaactggtcatgaagaatatttcagattcgggagatgtatttacgtttgaggaagaggtcgacaaaagcggggctcttgctcctacgtacccttcatcgaagaggaaataa

SEQ ID NO: 69821 - DNA, 585 bp, Glycine max
  Peptide Sequence Number=SeqID_161506
atgccttacgctgaccaccaaggagttaggggctttgacctgatttcctacttccagggtcagctaagatggggtcctattgtggtctttgttcgaccagagagggtggtacgacaattcaggtatattcaaacgatccctccaccgcctgttagtgcttcactgtcatatgaggagatagatgataggtggatgaatttctcggaccatgtagcacctgcgggtgagattcgtgttgtccttggacaggtatcagcagactacatggattggtttttccagatatctcatccattcgtcacaccaacccaggcaggtgatcagcccagacatccacctgccccacatgatgaggaatacgtcgagccacatatcccagaggttccagtggcatctaatctccctagagattcagtgatgcttgtaaaggttgtgaagcaatcgcagaaaggttggagcgtgtgctcaaccttaggatggtcactaaaggcacagagttacacgagatcatgcaagattgcctcaggatcgctaggggtgacgcctcagatggaagtcttagggtgcgatgtagatgtcgcatag

SEQ ID NO: 69822 - DNA, 117 bp, Glycine max
  Peptide Sequence Number=SeqID_161507
atgcagaattcacacgaagatgtctacctaagagcctacttgaatggtgctttaaagggatttaatgatagtcaaggaagtaaatctaaggttgcgactagagggattctagttaaa

SEQ ID NO: 69823 - DNA, 618 bp, Glycine max
  Peptide Sequence Number=SeqID_161508
atgcctatcgaccgagactactttagtctccccttcatcaaccagaggcaagcgagcccgttgacacgcagagacaaatatggtcatttgcaccctttcatcgaagactcaatgtctatcgaccgagactactttagtctcccatttgtcaaccaggggcaagcgagcccgttgacacgtagagagcaatatggtcatctgcacccttttgtcaaagactcgatgtctatcgaccgagactactttagtctctatttcatcaaccagaggcaagcgagcccgttgacacgtagagaccaatatggtcatctgcaccctttcattgaagactcaatgtctatcgaccgagactactttagtctccccttcgtcaaccagaggcaagcgagcccgttgacacgcagagacaaatatggtcatctgcacccttccatcaaagactcaatgtctatcgatcgagactgctttagtctccccttcgtcaaccagaggcaagcgagcccgttgatacgtagagaccaatatggtcatctgcacctttttctcgaagactcgattctttcgaccgagactactttagtctccatgtcgtcaaccagtggcaggcgagccctttga

SEQ ID NO: 69824 - DNA, 381 bp, Glycine max
  Peptide Sequence Number=SeqID_161509
atggatgtcgaagaacgggttgaaaacctttgcgtaattactcacggaaacgttacggatgcgcctcggcttggattttcttcacggaaacaattttcctcagcaaatttaagagaatacgaagtgccaagaaggctgaaaccccttccccctttcattcctccccctatttatagcaaaataggggaggagctttgccacccagctcgccaggcgaggcaaggttgcttcctccagaagcaaccgccttctggaggaagaaactggaaggcccaacttttgaagaagttacggaaactcacggattgtgcaaaaacacctcctttcgatctccgtcacattacggaatctcacagatcgcgtaagtctggttccttttga

SEQ ID NO: 69825 - DNA, 103 bp, Glycine max
  Peptide Sequence Number=SeqID_161510
atgtgggatcggcacaggcttaaaggaacactcaaactgggtgtatttactcccaaggtctacactccgaagagtccattaggatctctccctcctgattcag

SEQ ID NO: 69826 - DNA, 222 bp, Glycine max
  Peptide Sequence Number=SeqID_161511
atgggggagacatatgaaataccctaccacaatctaggtgacttcaagccttgcatcggatatgccactgaagggcaagcagttggtggtatacccatgcaaaacactttggagggccctcaatttcacccccaaccacaacccttgcattccactgcgagtaaaatccctcctgctatggcagcagataaaatctctagaggaaaggctcagagccattga

SEQ ID NO: 69827 - DNA, 105 bp, Glycine max
  Peptide Sequence Number=SeqID_161512
atgggttcgggagttgtttacgtgtggggaagctcgcccaggcgagctggttacttcacccctaagtcttctgggggcaggcgagctagaggctggcctgggtga

SEQ ID NO: 69828 - DNA, 600 bp, Glycine max
  Peptide Sequence Number=SeqID_161513
atgcttgcatttacttctgctggtattaaactagacaaatcaattaaccgttcaagaggacctcctacaattagaattcagggtcaaccatgtcaccgcataggcaatttattaccaatgtctggaaaagaacccaaatttgcaccattatatatctttgacacagacaatgaagttaaaaatagaattaatgccatcagtgaaatgctggataaacacaatgcgcatgctaaaagttttaggatggctagacatagattggcaaatagtgatttcgatcatgttagattaagattgatatctactcgtgaaaaggatggtcagacatacaatgttccaactgtttcagaagttgttgcacttattgtaggtgattttaatcccaactcaagaaaagatattattcttgagattcaaaatggacagttacagagaatacatgaattgcactctagctatctaggcctacaattccctctgcttttcccttatggtgaagatggatataggcctggcatacttcaccgtgcaacaccaaacagcaaaaaaaaaagagagagagagaaatcgtctcactatgagagagtggtttgcttatag

SEQ ID NO: 69829 - DNA, 618 bp, Glycine max
  Peptide Sequence Number=SeqID_161514
atgaagctgtttttgaaattcaagaattcagagagaggtccggtcagtttcacagctggtgaccaggggagttcccaggtttcaggttcaagccaattgtcgtcaaaagatgcatttctttcaaaagctgaggcaaagacaatctttgacattaacaacatttctaaggaaattgtttgtgttactgtcgacaccattaatagaattgttatggataaccattcacagtgttatccagcctacagttactgctatagaaaaactgatattgagacaatcgcattcacatgtgcatgtagcaaacataatgatcaagttgtgctgaggtatagagtcgaggtgatggtcacctacaaagaacaaagcacaaaattttttatgtgggaccgtgaatgcattgagctgattggacaatcagctaatgaatttaacaagctgaaaatagaagagggtgatattgatttgaatgtttctcctctggctcttgataagttgctgggttatgtccttgcatttaaaatcaaagttcaacccaagtttaacaataatgttgttcttagatactcaaatgacttagatttgatcaatgttgtggtggatatactgcctgatgctgag

SEQ ID NO: 69830 - DNA, 672 bp, Glycine max
  Peptide Sequence Number=SeqID_161515
atgtcggggctggatttcgcccagactgctacagggagtaatgtcttgcctagcgatcataactccgatctccctctgcctaagtgccagttggtgtatgtcatcctgacacggatgagcgtccacgtggcccaagtgattgctgacgccatctatttgtttgcaggtatgccacccaccaggcaccccctagacccggataagtctaacagggccctagggttttcggcgttgatcacgggcctctgccagtcattcggggttcccgtcacccccagtaaggtgatccgaccgccgatcacccaggccttcattgagatgtactgcacgcctaggcaggcacagggtgatgcacatcaggccgcagacgcaccgccaccacctcatcaggccgatccagctggatcactaggcatggagcgttatctacaacacttgattcgccagcaggcggccaaccaccggggccccagtcagcaggggcagggtttcgctccttttgcatgccctactccagagcagtttggggctgaggtcgcatggcccggagactggcccgaggcccaggcaggggaggagcctgtaggatcccccggtgaggcagaggaggcccgtatggatgaagaaatgatggacttactcggtttcttgggaggaagtagagccacgtga

SEQ ID NO: 69831 - DNA, 177 bp, Glycine max
  Peptide Sequence Number=SeqID_161516
atgcgcggagtcgccaccaacgtttatttgtggaaaacgtcggaaaaaccgaaggaaactggtcacaacgaaaattctaagttcgggagttgtatttacgtcgacaaaagcggggctcttgctcctacgtaccctccatcgaagaggaaatcagacctacgtagttcttttttaagg

SEQ ID NO: 69832 - DNA, 231 bp, Glycine max
  Peptide Sequence Number=SeqID_161517
atgagccatgggcgcctgtatcaacaaaggataaagaacgcgttcgacaagaaggggcagaatcatcttaggccatggtcagaagtcaagacaaagttgacggcagaaatcaaccaaggtacttatggacggatgcaaatggaggatagggtcacgaccgacaggtcgtcgtcccttcccggtgctggacaagcagaaaacatcgctgcaaggcagcccagtatcctttga

SEQ ID NO: 69833 - DNA, 447 bp, Glycine max
  Peptide Sequence Number=SeqID_161518
atgatgacgctggcgttattttgggagagagttgtgttttgtaatcaactcctctgtagttgcgacgaggcgggtcgttacacccaacccttgcatctgaggttgatttggtccgctaagctggccaaggatgagctaagccaacttcaattcgatccgaatttggctaaatttcgaaaacttcgtctctgcattctctctctcaaaaaatttgcacattttgcatctgtgctttctttttgcattatcaacttcgaagaaacaaccatacaccatccaaatgcgatgaactcgctaagcgagcatgctgcgctaagcgagttcatctatactcattgtatagaggcgttctctgaagaactagctaagcgcgattaccgcgctaagcgagttcatcctttgaggatgaatatttatcctcttgttgaactacctgtggctaagtga

SEQ ID NO: 69834 - DNA, 399 bp, Glycine max
  Peptide Sequence Number=SeqID_161519
atggctgccagtgaccacacaattttgcatgacagagttcatattcctaccaagaagagtttattggagctttcatcacaagatgccttattggcccaaaataagttgttgtccaagaaacttgaatatttaactgaaacactaagttgcacactttgtggaggagctcataggtcaggcttatgtattcccactgaagaaacatctcatgaagttaattacatgggaaaccatcctagacaaaattttagtgcaggtggattttctggattgcaacatggccaaccttaccaacagcataatcaatggagaactcacgctggtaatcaacctttagtacaggtgaaggagtttgatgagaaggttctgaaggagagaaccaagattgatccaatataa

SEQ ID NO: 69835 - DNA, 189 bp, Glycine max
  Peptide Sequence Number=SeqID_161520
atgttgctgggtgcacctagcatgtcccaacataaaaacaggacagagcccatcctggatccagctgccaagttcacccatttatggcaacggtcgtcccaaacttgttcagggtgttgctatgcgcaaccagcaaaattgccggtacacccagtaattgtgcgcaatttccattttgccctttcataa

SEQ ID NO: 69836 - DNA, 348 bp, Glycine max
  Peptide Sequence Number=SeqID_161521
atggcgagtttgctgaccatctcccacgtggcaaggaaaacgccagtggtgatggcgagttcataccacctgcaaatcgccagcccttctagcgagtctgagcacaggtacacgatgaattcggttataacagtgttgtatttcaatggaagggtatatgaagataatgatggtgtaatatttgaaggcagtaaaaaagagattcagattaaacgtggaattagtttcaatgctttgaagaaaaaaattggagacaaggaaaatatattgccttgcaaatttgcgacgacgaagacgttgaaacgatgctggaaagttttaaacaacaacaagaaatgtcagttctag

SEQ ID NO: 69837 - DNA, 330 bp, Glycine max
  Peptide Sequence Number=SeqID_161522
atgaagatgaaagcaaacaaaacaagaaatgaattgaaagtctcggattcaaacacttaccagttgaagaccaaagaaccaacgaagaacggacaaagaacggtgaagaaaaatgaaaaatctgcacggatttgctcacggaaatgtctcggaagcgttacggaagcacctcggcttggattttcttcacagaaacatgttttttcatccaaaacagctgaaatgcatagcataggggttagggatcaatttacacagcccccttcccctatttatagccaaaatggggaggtgcttgccgcccagaggcttcctgaggaagatttctga

SEQ ID NO: 69838 - DNA, 183 bp, Glycine max
  Peptide Sequence Number=SeqID_161523
atgccgcctctctggttccagttcttcgcgtttttctgcacccgtcagggcccgttttcaaagaaattccaggatgtcacatctgctatcgtgacctatgagtccgatgacatgcagagatacacaagtgattatctgcacaaacaatttctgttgaccctaacccgtgaagttaggtggtag

SEQ ID NO: 69839 - DNA, 147 bp, Glycine max
  Peptide Sequence Number=SeqID_161524
atgtttggtggcggtgcacgacgttttgatagtggaggctgggtcgccgacgtttgggctgatgattgtggaggacaggatggtgcaattggtttggattatggtttggtgtttggaggtgtgggtggtggccgtttgaggcattaa

SEQ ID NO: 69840 - DNA, 204 bp, Glycine max
  Peptide Sequence Number=SeqID_161525
atggtgttgcacctttggatctgcgaaggtaatcaaccgatgaaagtcgacagtgatgttcgccagggagggaggtggagagaaagaggcaaggatggtatcagagctatttctgatcctgggaccacgcttccgctaaccctcgcttgtggtgacaagcacccaccattcgttgttcatgcatcaagcccaagaagtgtttga

SEQ ID NO: 69841 - DNA, 378 bp, Glycine max
  Peptide Sequence Number=SeqID_161526
atgaacaattaccagatagcaccccaagacccttattatcctcctccaggctacgcccctccttatcccccaccacagggttacccgccaccgggttacccgtcagcgccgccgcagcctccgccggggtacgtgccgtatccgccgccgcagtacgaaggctaccaaggctatttcaatcacgggtatcctctgccaccccctcccaattaccactgccatcacgctcagcaccatcacaatgataaccccggttttacttctttcttgcaaggctgccttgctattcaaaatcatgaccaaccggtcatcaaggcacaacttttcctcctcattggaaacaagattaatatttatatcactaggctattcaagtaa

SEQ ID NO: 69842 - DNA, 498 bp, Glycine max
  Peptide Sequence Number=SeqID_161527
atgttgggagagttattattgttaatcaaagcaatagcaaggaagtttgatgtcattaaagaaattaatggcccaaaatacaaggagtctcaaaatgattaccttagatcccaaggaacctatgttgcatccatatcaagttcaatgtatgggccaaaagttatgatcaatgaagtaatgtcagatatcgaaaactttagaaagaggtataagcttgagattaaggtgttttatggtaaacatcatgcaaaagttatgttttgggattctaattgtacccgcctaattagactattaactgttgacctcaagaaattgatgattgaagttggtgaagatgacctaagactatatccaaaacacctagataacatgattggttgtacttcaacctttagggtaaagtatagcatcaagttcaacaattttcctatatcaaggatggttgatgatctagaacttataaatttaattaaagaacaacttgattctgattag

SEQ ID NO: 69843 - DNA, 285 bp, Glycine max
  Peptide Sequence Number=SeqID_161528
tgctcaagtcctcatacctattactgttcaagaaataattccatagaaaataatgtttcaattattgttgatgacattgttcaagaacaagacaacaatgaggttctccctcaaatacctatacaacaacctcaaaaagtgtcattaaggagatctattagagagaagagaagttcaatcccagatgattatattatctttttccaagaacatgaggatgacattggtttaacggaggatgatctaatcaacttctgtcaagctatgcatagttctaactcttaa

SEQ ID NO: 69844 - DNA, 276 bp, Glycine max
  Peptide Sequence Number=SeqID_161529
atggggaaaatcaccgtcaagttggatcaaagaacatgtgattgtgggaagcctcaaaagctatacatgtcattgctgcatatgaatggcaacggaatggagaaggaagagagagagaggagacgccacttcaaggagaagataagtttagaaaaagttcactaccataggaggccatggataagagcttggaggaagaaggagatgaatgaagggagagaaagagaagagcacgaaattttgtgctctaaaagagctctgaaatctgaagtttaa

SEQ ID NO: 69845 - DNA, 384 bp, Glycine max
  Peptide Sequence Number=SeqID_161530
atgatggacatcattggagtagactttcttggctttgctccaaacatcataacatatgtcaaatgcctggtacgaaggttgaagactgggatcaatagagaaccaaaatgcactgcacaaaaaggcattgattgctcccattgggctcggtctttattgggaatcaagtgggtgtcgccgaagaagtgccacgtgctggaaaggagggtgggcatgaacttcacgtgccgaagaagaagcatacatgggagcatgtgtggcggcatgccagacagggttatggtcgcttataagggtgacagtgatcggagggcacacgttggaaaaagggagacgatgttgccactaaacagtggcaaagaacggaggcactattctccgtga

SEQ ID NO: 69846 - DNA, 840 bp, Glycine max
  Peptide Sequence Number=SeqID_161531
atgccgtttgggctctgcaacacctctaccatatttcaagctaccatgagtgatgctggtggtgaggtggcaaatcaaccagtgcatgtgcctttgattttgcctaaagttcatggtcggttctactattattttggaaaaccattggaaatggaagggaggaaacaagaactgagagacaggaagaaagctcatgagatttatttacaagtgaaatctgaggttaagagatgtattgcttatttaaaggtgaaaagagaaagcgatccctacagaggggtatgcgcgatatcgggggcatcgttgtgtgggtgggtgaccttcaagagtgagagcaaaagagggaaaggggagaagttggggaagagaaaagagagatgggcaagaagagaacacgttctctcgcacctttatcatttccaacagtttctccctcttctttctcttgcaacacttaggatacaacgccttggcgagctttgccaacaccgtctcgagcttcctaactcgcacgacgagatcgaagccgcgcgcctggaggttgcggcggaggtcggagatagagtcgataaggaaggcggcgcgataggggccaatcttgtcgaagcagaaaatggggaggacggagagggagtcattgttggcaacagtgaggcactgattgttgaggaggccgaggttgttatgaaaccagacaagggcggcacgacggcgttggaagggggattggcggagatggtggatttgaaggaggttttggaaggaggaggagtgatggtggagagagaaaggtgtgtgaaggatgaggcttgggttgggactttgagcttgcttggttga

SEQ ID NO: 69847 - DNA, 123 bp, Glycine max
  Peptide Sequence Number=SeqID_161532
atgggcgaattcggagacccttttgggcaaagtttccggcgagctcaacgggtcgggtctggtcggcgacaaggcatgagggggtgggttggggagcacaaggaggaggaccggaaaggttaa

SEQ ID NO: 69848 - DNA, 1047 bp, Glycine max
  Peptide Sequence Number=SeqID_161533
atggcctccagaaagaggaaattatccacatcccgacctcatgtaccctatgatatgactagatttgtttctgaggagcttgaaaggaggtggtggcataaagccttgaccaggcatcctaatggtcgcattggtgtggccctggtcaaggaattttatgccaacttgtttgatcttgaagacaagtcccccaggcaagtcagagtgtggggcaagcttataaagtttgatgttgagatgcttaacacattcttggaggccccagtggttttggagccaggggagcggtactccacatattccaaattctgccatgctcatccagacccacaggagcttgcatccaagctatgcatcctagggcgaggattcattctgaacactgagggtgcaccttggaagcttctgaggaaggacctcactacattagctcagacctggagcggcgaggttagtgtatgggttggtgatgaagatggacatggacttaggctccatcatctcaagccggatctcacagatggcctagtccaactcctctcggcttggcttccctgctttgatcactgccttaagaactgttggaacccgaatgatcccacaatcacctttccgaggacccgcaagactcgggctcggggaccctctgatatctctacctctgctccagcttctacctcagcaccagcaccaccactagctcctattcctgcacctctagcactcacagcaccctccagccccttcgctcagagctcagacgtcttggtgccgatgcagcagagccttcaccatggcttatgcctgcatggaggatttcatggcccaggtggcctggccaggagtccagccttctcctgcgagggtgaggctcctacagcccaggagctgcagccagagccggaggcgacagcggaggagactctagaggttacgcctaccgccacgcctttagaggccactgggagggagacggcactactgacactgattacttcgcagatatggcagcagcgcagagcacctaggacccctggcccacattag

SEQ ID NO: 69849 - DNA, 534 bp, Glycine max
  Peptide Sequence Number=SeqID_161534
atgaatggcgactccaacgccacgtgggaaaaagcgaagtcgctagcgggaatgacgacaccaacgccacgtggcacggcccggcggaaagcgccaccaccattggcgccatttgtgcaagggtgggcagcgatcttgatgggtgtgatctcacgaagcattccatggtacacaatgatgatcctccacgacaagctcccattcctaaagcaaatcgacgaccccatggctgtgttccacacccatgccgttccggcgctctcgacgtcgctgttgtgcatggccaaatccctcttctacatggtccccgattgggaaaagtacattaggctggcctatggcctccagaacgatgcaactcatgcgggagttgtgcaagggtgggcagcgatcttgatgggtgtgatctcaggaagcattccctggtacacgatgatgatcctccacgacaagctcccattcctaaagcaaatcgacgatcccatggcggtgttccacacctatgctgtcaccggcgctctcgccggtgcctaa

SEQ ID NO: 69850 - DNA, 591 bp, Glycine max
  Peptide Sequence Number=SeqID_161535
atgtcagttttggaattgtacatagaaaaggatgtggctggtggttctatgtttcattctacaaattctcttacatcatgtggaaataatttatctaataatgaggcgcaaccggcaataaatgttagcaatttaaatggtgacgaagatgatgatgatgatgattatcttgtgtctaactcatacgttgaagactctttagacgaagatgatagcgttgacagtatatctgatacagacgatgaagtcaccgagatgattcaaccagtgagaattgttcactcaatagaaggtgtagaaggaaatcaaaatccattttggaatgatgttttgcattataacaatatcaactggagtcatcctgatgaggaggacatttgcggtttggagatgccatcgacttttaatgttgggcaagaattatatgttggcatggaatttgatagtaaagatgtggtcaaaaatgcagtcaaacaatatgttatgaaggtgcatcaaagtttcaaagttgttgaaaccaaatcgaacaagcatgatcagagaagatccgtcaataaaagtgtctttgattcaagagaggataaacagtga

SEQ ID NO: 69851 - DNA, 387 bp, Glycine max
  Peptide Sequence Number=SeqID_161536
atggccttctacgccttcgcgggcgtacttgtatgctgggtggagtggggattccgcatgtcattcggcaagaaaatgctgaactttggtgcgtggatgctgtttgtgcctctttggcttactttttcgtataccgtcactgcctttagcatttggttggcaaagcctggggttattgatttctctggcggatatgttattcacctctccgccggagttgctggcgcaggcctgctttggatgggttggagtgggttcaacggtggaggtccgttcgtggcgagcacggtggcatctctggccgtccttaacacacacgtgtgtgctgctgctagcatcatcgtctgggtcctactgtgtttggggccgtacagggatgataactga

SEQ ID NO: 69852 - DNA, 1518 bp, Glycine max
  Peptide Sequence Number=SeqID_161537
atgggtcacgaagatgaggaggatgatgatgataatatcaatgatgatgatgatgatgacaacagtggtgatcatgttcttcaacaacaatacacaatcacacgtggtcatccaagaacaagagaaggagagctgttcaaggagcttgtggacgaggttgatgaggctgttttgtcgacgacaaaacctcgtacgcggttaatttcgctctgcttgtcggcaatggtgtcttcaatgcgcttggccaccttctgcacctcctctactgggaagagggacgcgagtgaggtcacagaccccttcttcggcaatgacacttacttgggaccttcccacgcgacagctgtgcctttgacgctctcagcttttaaaaactatggttctgaagagaaagaggcagagacagtgaaccacctcactcagtgccgtaaaaatacaaagacgagtttgaaagaccatctttgtacatcattcaactacaatgactcccgtcacctgttcgacgaaattcccgaccgaagcgtggtctcctggacctccatcattgccggttgcgtccaaaacgaccgcgctagggacgcggttcgcgtctttaaggagctgctggttgaggagagtgggagtgtggagtccgaggatggtgttttcgtggactcggtgcttctggggtgtgttgtttcggcgttttcgaagctggggtggagaggtgtgacagaaggtgttcatggattggtgatcaagaggggttttgagaggtgtgtgggggttgggaatactttgatggatgcttatgccaagtttggggagatgggggtggcgaaggtgtttgatgggatgaatgagagtgatcactatttttggaactctgtgattgctgagtatgcgcagaatgggttgtcagctgaggctttttctgtttttggtgacatggtgaagagtggcaactttagatataacgcggtgatcatggattggtctttcaggagctttgcagctggggaagtgcatacatcatcaggtacttctattgttgatatttactgcaaatgtgagagagttgagatggctaggaaggcatttgattgcatgaaagtgaagaatgttaagtcatggactgctatggttgctggttatggaatgcatggccgtgcaaaagaggctatggaaatcttctacaagatgataaggtctggggtcaagccaaattacattacttttgtgtcagttttagctgcttgcagccatgctgttgagaggatgaggatattgatgaagagtcgtggattgcttaaagcccctggatttagtatagttgaacttaaagctgcaagaacttgggtatatgccaaatgcaatatggtgcttcatgatgttgatgaggaagagaaaggaatggttctaagagttcacagtgagaaactggcagttgcctttggaatcatgaattcagttcctggcggtttcatcatttcaaggaagggtcgtgttcatgtggggactattggtgacagcaattga

SEQ ID NO: 69853 - DNA, 363 bp, Glycine max
  Peptide Sequence Number=SeqID_161538
atggttacgacgcttacctcgacagtggacggtgacgacgctccctcgacggtggacagtggtgttgctcttcacgaaaacctcctcaatgcacctcgcaacctcttcatgacaagctcctcttcacggcaacaatggttcgtggctgaagaagaagaacaacctttcccgacaatggtgacaaatggagacgccggtgagaaaaataagatctcccatccaaccaacacgatcatgccatcagtagatgcatccaatggcaagaaatcaaacatcacggccacagagaccaatggacataatcaagctgtcagtagaagcctgtgcaatttaaatccaatggctctcactagcagcatatga

SEQ ID NO: 69854 - DNA, 1605 bp, Glycine max
  Peptide Sequence Number=SeqID_161539
atggaagttatgagagtgtctatggaagttttgaccttgttccaagcagctttgcatacacattcctcaatgcaatcccgacaacttatcatggttagggccagaggattaggttgtgccttaggtcacgttacttgcagaggtgtgggtagaggaaatcgtgatgattatgatgatgctctgcagcgtcgacgacctaccgcatctgcacgaaggcagcgagtacttatgactgctgcgcacgatgagccagtggtccctgcgccagatgtagaggctgatgtattttcggatgacctgatggcaccagctgatgtagaggacactggtgcagacattcctctagacacaggtgcgcaggctgctgagaatgagcatgagggatttccgggtggtccgaacgacctattcgtgttgacccagtatgcggatcacgttgcttgtagcgtatggacgagagaggagcgtcctgagttgaagttatcctctcacgggaggaaggtccatactttaggcaggtctgtccctgccattgagggactagttgctgggacaggactaagtcctctgatcgcatgttcggtagatactggcgataggacaattttgtcctcgtttgtcgagcggtggcaccgggagatgtctagtttccatctccctgtgagagaggtgacgatcatgctggacgacgtctcatcacttctgcatctgcccgtggttggcgacttgcacgcctttcagcccttgcatgtagatgatgcaattcagatgttggtggacttattgatggtctctgcagaggctgtcagggctgagacaaggcagtgtcgtggaccgtacgtacgcctgcaatgggtatatgatatctacgagcgccgatgccaggcaggtcattggacaactgcggctcgcgcatatcttcttcatcttctgggttgcactctgtacgcttggggagtagctgcgctggtgcatatgtacgaccagatgaacgatgcctctatcagcagcagccgacagcttgacagttacatcacattgctgcagtgttggatatacgagcactttccctcagtcgcggagtccactgctgatcaggactactacgaggattcaccgcgtgcctgtaggtggattgcgacgaagaagaccatgaagagcatatgtacaccggcgtacagggagcgcctggaccaactctggattttggatgttggatacacccagaccattcctgctccgcctgtcgattcatgggtgtcatatgatgatatacacgacaggtggattcactactcggatcatatggttccagctggtgaggtttgcactgtgtcaggtcagtgtgtcagtgactacatggactggttctttcgcatctcgcatcctttcatgacatcagaccaggcatcagatcctctgccagatggtcatgctccgcaaccccgagtcatccctcaggccccacagacagatatccctcacgtgccagagccaggagcaccgtcgacatctgcgaggcccgttgtggaggagcctaaacatgcagtggttggagcgccatctgagcttaggggtggtcaagccaggctcatcgacacatga

SEQ ID NO: 69855 - DNA, 1401 bp, Glycine max
  Peptide Sequence Number=SeqID_161540
atggatcagcgacagcgagagaagctgcttcacaaaaccgaggcctgtgctttcgtggcaggtgttgttccggagctttcccttgtcaccgttccagggaacaacaccaacaacgttaacaacaacaacaacgttgtttctcattctcaatctaacgggtcgggtcggatccaggaaaacaaccaccaccttggactcgttgctgctgtcacctccgccttcggtaccgttcaaaggaagaaaaggatggcgagacaaagaagatccactaaacccacttcgttgatgaaccatctcaacaaccataagcacaacaagcctcgttctcttccttctcccagtgcatcctcctcgtacgtgccactctcctccgcaactctccagcccgcacgtgaaatcgatcaaagaaggttgagattccttttccagaaggagttaaagaacagtgatgttagctcccttaggagaatgatattgccaaagaaagcagcagaggctttccttccagctcttgaatccaaagaaggaattgtaatcagcatggatgatatagatggtcttcatgtatggagtttcaagtacaggttttggcctaacaacaacagtcggatgtatgtacttgaaaatactggagattttgtcaacacacatggccttcgctttggagattccattatggtttaccaagatagtgaaaacaacaattatgttattcaggccaaaaaggcttctgatcaagatgaatttatggaagaaactagtgataccatcaatgatatcttccttaatgattatgaggtgaacaaacctggttgcttcaatgtaactaatcctgcagtgaatgatacaggcatgtcattcatatatgagactaccttctcaaatgactcccctcttgattttttgggtggatcaatgaccaatttttcaaggattgggccagttgaaacctttggctctgttgagaatttcggtagcaactgtttggaatcaaccgcgaaagccacgacggcgagccgattagccgcgccgagagaagatataaccaactgcatcgcacactttagcatagaacacgagcgtggtgaagaggatcgcgagaacttggaaagattgcgagaactcgagccacatgaaagacatgaaagcggaaatcgcatggtagaagagctgaaagaaaacgagcttacaacgtcggactcgtcccaagggggaaacatagcagccactggagcgggtcttgtagcgctgccagagccaccgcgtctctttgatttcagtggcggcggagaccaagaggtcggcgaatatggtgacggagatgacggacatcgagaggctgtggagcacgggaatgggtcccagcggaacgggtctgccacatcgaagaaacaaggctaa

SEQ ID NO: 69856 - DNA, 264 bp, Glycine max
  Peptide Sequence Number=SeqID_161541
atggtgatcttgaatttgcatccggaacgatctgaaccgagtgtccatggcttggattgcatcacgtgtgcaatggtttctgaaagtgatagtgattcaccttcccctagatccgctaagctaatggcttcattggctaagcaaatggataagttgcaaataaatattgagaggagaatgggaaagaggtttgatgagatacaaaaaagcactcaagagttgagtggaaaaatggaagacatagagaggaggaggcatcattga

SEQ ID NO: 69857 - DNA, 237 bp, Glycine max
  Peptide Sequence Number=SeqID_161542
atgggtgccaagtttgatgaaggaaccgattgggaaaataacaaaaaaccgtattttcccctcaccggaggctccgtacttgataacggaggacgcatgaacagcgctaggcaatcaattcatggagcttcgaataagatggtggaggatgcacaaatgacaatcaattcgtggggctccggactcgatggtggaggatgcatgaatgacaatcaattcatggggctccggacttga

SEQ ID NO: 69858 - DNA, 327 bp, Glycine max
  Peptide Sequence Number=SeqID_161543
atggagaggagtatgattgatgctgccaatggtggagctcttggtgatatgactcctgttgaggctaggaatctgattgagaaaatggcttccaactcccaacaattcattgcaagaaatgatgctattgtccttagaggagtccatgatgtggccacggattcatcttcatttgctgaaaataaaaagcttaagggaaaacttgatgccttggtcaacctagtaactcagcttgccatgaataaaaaatctgcacctattgcaagagtctgtggtctatgttcctctgcagatcaccatacagatctctgtccttctttgcagtaa

SEQ ID NO: 69859 - DNA, 162 bp, Glycine max
  Peptide Sequence Number=SeqID_161544
atgtatgtgcgcttgataaggattacggataagtggtttttacgggatgggtacattagcttcctttatgctgattcagttggaagtgtatcagaagcttttggaaatttattgatggaacaggatgcggtgctgcaatgcagaaagtgtgttgctttatag

SEQ ID NO: 69860 - DNA, 189 bp, Glycine max
  Peptide Sequence Number=SeqID_161545
atgacccgcaccaagaaaattgggcagatgacgtctaaggcaataaaggaaattgctgagaagattgattctttggaggagcaggcatcacagggttcctttgtccccatggacgtgaggatgtcctcactgctgccattgggcgaccagaacaccctggtcgtgtacgtgttgctggagccgatgtga

SEQ ID NO: 69861 - DNA, 438 bp, Glycine max
  Peptide Sequence Number=SeqID_161546
atggccccaagaaagctttcctcaaagagatctaggaaggacgccgcggccgcagggactagtgccactcccaagcgcgtccagcttagggacgacgagtacacagatttccaggaggagatagctcgccgacgttggacgccactggtcactcccatggccaactttgatccggatgtagttctcgagttttatgtcaatgcttggcctacagaggagggagtacgagacctgcggtcatgggtggggggccagtggattcctttcgatgcagacgccctcagtcagttcctgggatacccgctagtattggaggagggccaggagtgcgaatacggtcaaaggaggaactgggctgacagatttgacgaggaggccattgctcagctgctatgcataccaggtcaggattttgcccggaccactaccgggagacgg

SEQ ID NO: 69862 - DNA, 369 bp, Glycine max
  Peptide Sequence Number=SeqID_161547
atggtgagtcaggattttggctcacggtttgtagaatggctagacatgatacatgtcagggtttggtttggttcaaggataaaaagggatgccccacattatttccatgacacaaatgcaaaaatgatgatttggaaactttatgcaaaactggtcatgcatgcacctatgcggacactcaagcgtcaaatttttatggtcatgacgatgttcctaaacgaagaactctacacggttccagaatttcaaataaacatcatcgataataatgatataagcactaacgcaacaatccaaacaaaaatgtatgcgctgtacaaaagacaatcgaaacaacaaaaacaaacattagtctgtgggatcctctag

SEQ ID NO: 69863 - DNA, 207 bp, Glycine max
  Peptide Sequence Number=SeqID_161548
atgacgatctcggactcattcgccgttggatcttgtgcacgttttaaccgttgggagtttcgaaataatgttcgtggagggagacaaaaggaatcgcatgaagatagtccaagtggaggttttaatcctttctccgtttctctcacgtttgggaactctatcggagcagtcggaggaaaaactggaggaatcctagggaaccgttag

SEQ ID NO: 69864 - DNA, 498 bp, Glycine max
  Peptide Sequence Number=SeqID_161549
atgatggaaggagatctcatcaaagaactcggccaattccatgatgtaggcctgtcaattgctgcctggatgcccagagcgcatgcttcgtattcagccatgttattggtgcagtcggaccccagcctggcagtgaaaggggttgatggggacccggtgctgagaggaacgaggataagggctacgtgggggtacgtgagctcagttgaagagttgatttgcaccatcgcccgatcatcacctagtaccacatatgacggagtggtacctggagatatgtcacgggggtcaggagaccttggggatgtcaggcgagctcctggtagtcaaccaataaaagaacaaagaccacaaagcaaggaggcttgtgtggtggctggccagctatggatcttgaatgatatctcgaatatggcctctggtaatcgattaccaagggaagttgagatggcctctggtaattggttaccaaggggtgtaatcgattaccaggcttag

SEQ ID NO: 69865 - DNA, 153 bp, Glycine max
  Peptide Sequence Number=SeqID_161550
atggcgatattggtggatggcgaatttgatgctaacagattgtttgatgaagctgttttttggacttggacttggctaagacattttgagaaacatttctcaactcatcttaatcaatgggcaagcaatattagtcagggttttatcatgtaa

SEQ ID NO: 69866 - DNA, 183 bp, Glycine max
  Peptide Sequence Number=SeqID_161551
atgcggacatctccgtctcatgctgaagacgctgacatctccgagaagggtgcagatgacgatgtgtctctgcatgccaccggactcttgggtcatggtaacaaaaggtgggatggtcgacaaaagcagggcttttgctcctacgtatcatcaatttctgatgaggaactcaggcctacgtag

SEQ ID NO: 69867 - DNA, 297 bp, Glycine max
  Peptide Sequence Number=SeqID_161552
atggttatggaggcttcatggctaggattttttgggagaggcaaggacacaagatgtcttggtgaggggtattcttgttttttgggagatgattcatatccgggagttgctacgtgcacccagcattattgctggggcacccagcaaacagtgaagtggcgaaactgcccttcagcaattattcttccggaagaagtacgcacagacaacttccggaagaacgtcatccggaatgtttccggaagaagcttcttccggaagaattccattgtcttccggaagaagcttcttccggaa

SEQ ID NO: 69868 - DNA, 282 bp, Glycine max
  Peptide Sequence Number=SeqID_161553
atgagtcatcattcatctagtgttaatggtgaggatgagagggaacaaataagggaagaagaaagaaccaaaatactgaaagagttaaagaaagaaaaacatgcctcctatagtagtcatgactcttgcaagagcctaagtgaagaacttagcgactattatagaggaaggcataggtcacatcctagacctcactcccataagagtgaaaaggaaagaaagcctcaagaggctaacattaacctcccatacttccatgggaaggacaatgtaaaggcttag

SEQ ID NO: 69869 - DNA, 246 bp, Glycine max
  Peptide Sequence Number=SeqID_161554
atgaatttattgcctagcgttgttcatgcgtcctccaccatcgagtctggagccccgcgaattgattgcctagtgctgttcgcctatcctccaccctcaaatcttattcgaagacccatgaatagattgcctagcattgttcatgcgtcctccaccattaagtccggagccccacgaattgattgcctagtgctgttcgtgtatcctccaccgtccgattcggagcctcatgaattgattgcctag

SEQ ID NO: 69870 - DNA, 453 bp, Glycine max
  Peptide Sequence Number=SeqID_161555
atgtttttgtgttctatgctgaaggcgcaagtactaaacatcgatgtctcgagtgaggatgtctcctccacctctaggaacctcacaattgtagaagcaaagcttcatgatgaatcaatattgattcaaagatgttttgatgataacaaagatgatgaccaaaagctcaaaggtcaatcaaagaatgagttcaagatgttcaagatagaatcaagaatacttcaagattcaagaggaaagttgaagaacactttaagattcaagaggaaagttgatttcaagaatcaagaatcaagattcaaggatcaagcttccaagaatcaagatcaagattcaagactcaagattcaagaatcaagagaagacttaatcaagataactgtaatcgattacaatgttttggtaatcgattaccagtgccttcgaacgtcgaaattcaaattcaaatgttaa

SEQ ID NO: 69871 - DNA, 81 bp, Glycine max
  Peptide Sequence Number=SeqID_161556
aacaagacttgtatgcattctcttgattttaggactgtcatcatcaaaaagggggagattgtggaagcaatatcttccaag

SEQ ID NO: 69872 - DNA, 168 bp, Glycine max
  Peptide Sequence Number=SeqID_161557
atggtttccggggcttccgtaaaattttgggaaaccttggaaaatccaagccgaggtgcttccgtaacgcttccaagacgtttccgtaagcaaatccgtgaaggttttccgtcgttcttcactgttcttcatccgttctttgttcgttcttcgttcttcaacgggtaa

SEQ ID NO: 69873 - DNA, 186 bp, Glycine max
  Peptide Sequence Number=SeqID_161558
atggcttatggggcttccgtaatgcttacgtgccttaggaaacttcctgaggaagccatctgctcgcttgggcgagccagggcgagctttggcgagcaaggtggcaacctccaccgcattttggctataaataggggaatgaggctgttccaaaggatctcagacatctcaggctatgcattttag

SEQ ID NO: 69874 - DNA, 732 bp, Glycine max
  Peptide Sequence Number=SeqID_161559
atggtggaagaatttgaagagatcataggatgtcctctagggggaaggagaccatacctcttctcagggttctatccctcattagctagaatttctaagatagtccaaatctcggcgcaggaattagaccacagaaagcaactcgaaaatggggtggttggaataccgagaaaatgtttggaggcaaaagcaagaatcttggcaggtagaggcgaatgggccccgttcatagacattctcgcactgttgatcttcggaggagtcctctttcccaatgtggatgggttggtgaatctagcagcgatcgacgcttttctcgcctatcatgaccacaaggaaagcccggttgtcgctatgctagctgacctatatgacaccttcgaccgaagatgtgataagagcggtacgaggattgtttgttgtactccggctctttatgtatggttggtttcacacctttttggccaagagcaaacaaagaaagagcgtctgtcaattggttccctcgatggaaagaaggaagaatcgggggttcttattttgtgcggaggattttcaaatgttcccttgatggggacaaggggttgcatcagttacaatcccgttcttgctataaggcaacttggctatcctatgaggagggcaccactagaggtagagctcgcgcctgtcatttcacgaggtttcaataagaccaacggggagacacttcagaaggtccgcaaggcatag

SEQ ID NO: 69875 - DNA, 150 bp, Glycine max
  Peptide Sequence Number=SeqID_161560
ctcaatagtgagtgactcttctttcttgggagaccccactgttcctttctccgagggcaaggatggaaattctcatcctaggtcaagaacagccggacgtgacgtatgccggggtgttgatttggccaacagctcagggataaggggaat

SEQ ID NO: 69876 - DNA, 1236 bp, Glycine max
  Peptide Sequence Number=SeqID_161561
atggaactgcgcttctacaactacctgctgccacgcaaggacatgatccagctgccggtgacctcgctggaccgcgagtggtacgaactggtggccggcgtctacatggacgagttcgccgaatggcacgcaaaggatctggtggtgcgcgagagcgtgtccggcatggtgccctcagcgggcgtgggtacctgcttctcccggcgcgcgctgctggcgctgagcgcgcagaccgacaaccagcccttcaataccgacagcctcaccgaggattacgacgtcggtgcgcggctggcggcgatgggcatgcagtcgatcttcgcccgcttcccggtgcagttccgcgtgcgccgtccgtcatggttcggctgggggccggtgcgcgagcgtacccagcagatggcgctgtgcgtgcgcgagtacttccccgacaacttccgtgcctcgtaccggcagaaggcgcggtgggtgctgggcatcggcctgcagagctgggagtcgctgggctggcgtggatcactggccaccaagtacctgctggcgcgcgaccgcaagggcatcatcacctcgttcgtcagcatcatcgcctacatcatcttcctgcagctgctgctgttctggctgttgaagatgaccgggctgtggacgatgcagttccccagcgtgttccaggccggtacctggcagatgaatgtcgcgctgctgaccaccgcagcgctggcgacccgggtcgtgcagcgtttctacttcgtcaaccggctgtacggctgggagcacgcgctgatgtcgatcccgcgcatggtggtcggcaacatgatcaatttcatggccaccgcccgtgcctggaaggtgttcctggcctacctgctgttcggcaagcgcatggtctgggacaagaccatgcacgacttcccggatgcagcgcagctggtgcagacccgcaagcaactgggtgagctgttgaccacctggcaggcggtggaacccgagcgcctgcagcaggcgctggaccagcagcaggcaggtcgccagcagccgctgggccgcatcctgctcacccagggctggctggatgacgagaccctggccgaggccatcgcgttccagggtgacctgccacgcgcgtgccgatgcctgcgtgcaatggcgcatgctgccgctgccgccgcgccaggaaggcaccctgcgactggccgtgggccagtccgctgcccgaggacgccgtggcattgctga

SEQ ID NO: 69877 - DNA, 249 bp, Glycine max
  Peptide Sequence Number=SeqID_161562
gccaaattaatgattggactcagatgttcaaagacaagattgtcggaggcaacttctatggtcatgcataaagctgtgataaaagtaggaaacccgagtcttgaggagttagactgggccatagaagtaatctacccagaaatgagggctctgacattcatttccagctcagtaactaggccaaagattagcctagctcgatccacaatcagatccgatgtgtgggaggtcggagctaggttggagtag

SEQ ID NO: 69878 - DNA, 201 bp, Glycine max
  Peptide Sequence Number=SeqID_161563
atggccagagaaaacagtcctttcgctaagcgcaagcctcgcgctaagcgcatctttggtcatgcgctaagccgagagtctaaagcgcttagcatccaacccttgcatctgaggctgatttggtctgctaagctggccaaggctgagctaagccactttcaatttgatctgaattcggctaagagacagcctaaccgctaa

SEQ ID NO: 69879 - DNA, 198 bp, Glycine max
  Peptide Sequence Number=SeqID_161564
atggatcgcccaaagaaatgtgccaattttaatgggcttaacttctctgacagaaatgagcaagtccaacttcacctcagtgttttggatcatgatcttgctatgttggaagagaagtatgttactattattgatgctaatagcaatgaagagaaacccactataaagattgggaaagatcggatagactcagcctaa

SEQ ID NO: 69880 - DNA, 363 bp, Glycine max
  Peptide Sequence Number=SeqID_161565
atggacgaagatcaatggacatatgactatacgatgtcacaagaagttcatatggattatgataatgaagaagaatgtggtgtgaatgaaccacatgttgattgctcgaatgtttttaatacctgtcaggtctttggtactcgagatgatgttttgcagtgggctcgaacagttgcccatgaaaacggatttgttgcagtgattatgaggtctgacacagatactggtagcagaggaagaagttcatttgtgttaattgggtgtgaaaggagtggtctgtacaagagtaggaataaagaattcgttagaagagacactgggagtaggaaatgtggttgtcccttcaggcttcataggaaacca

SEQ ID NO: 69881 - DNA, 369 bp, Glycine max
  Peptide Sequence Number=SeqID_161566
atgaagggtcgtaggaagaggaagaggaagaaaaaggccgtaggaagaggaagaatgatgtgcacgatggtctggaagaggaagaagaaggatgcgcacaacgacaacaataagaagagaaagaagaaggatgacatgacggctatgcagactttgtgtggggttgggtccattactactgagaaaaacgtaaatgcaaaaaaagacaaaatgcttgtgaatgagaccaccgccatctctgacatctttggcaaccttaagaatgagaccagccatgtgattattatcatgaatggagttactgttctaacaaacacaaaaggcttgacaatggagcaaacacttttaccagcatcgttgagtccataa

SEQ ID NO: 69882 - DNA, 486 bp, Glycine max
  Peptide Sequence Number=SeqID_161567
atgttttccaagaaggagggaatgatgagaatcatgaaactggccaaatacaggctaaaggcccaagtggagaaggatgaaggcccaagtggagaaggacaaagcccccgagtggagaaggatgaaggcccaaacttttggcatttgataaaatttggtgagagcttctctctgggttccatatttaaccaatctcagacttatcaaggtaatccttgtggcgtctaccctgacttattttccttcaccggaagtggtgtctaccctgacttatctttcttcactggaagtgacgtcatccaaatcttcatagcctgtatcaaacgatctgttcctagtcaggatcacatcaagtatcttgataaaaaaaaattgatggctggagatgaagttgtcttctacttctggttttatgaccatgcatgggagcttttgataagactagaaattgaatgggaggaggaggacatccaccttgaagactga

SEQ ID NO: 69883 - DNA, 483 bp, Glycine max
  Peptide Sequence Number=SeqID_161568
ctttctacttcagccccacttccagctttagcagacttatctgcccagagctctcagacttcagatgccaaattgaaaagcttgtttgaaggacagattctcatcatgcaaagcttgcaggaactacctcagcaaaggccaattatgagtgtagagcagttcattgggaaggcacctcaacaacatgagctagaactagaaaatgatcactcatttgaagccatcatccctggagctgttgacttttcaaaaataaaattagagacgagatccaatgaggttactcatcctggaccagtgctagtaccagctgatgtaccatttccagggatggatccatcttcacctcagcatgcaacatactcttctactcctatcttagagatacctgagggccagaccacaccagtcctggccctggacacttctcctccagctactccagtattgcatctgacagataaggaggatgttcagtcatag

SEQ ID NO: 69884 - DNA, 3363 bp, Glycine max
  Peptide Sequence Number=SeqID_161569
atgtctaactggggtttacaggtcatatttcctgccttagataaacgagtgaagaatgttgcacacacctattttttggaacatgagggagagggtcttctttttgatcaattgtttaagttgccaaattccaatttgctaaatgaagagagctatggaagagaattagcttcttgcattggagcccttcgaacatcaatttgccagcatatgtttaaggaaaaggaacaggtcttccctttggttattgagaaattttcatctgaagagcaggggtcattggtatggcaatttctttgtagcataccggtcaaaatgatggcagaatttcttccctggcttgcttcatatatatcatctgatgagtatcaaggatgctttaatcagaatgaagttttcaacttcaatttgcttgatgtcaaggtcatctttggatggatggaaggactaaagataaaacatagaaagtgcacgcatgataccaaggttcaatggaaggatgttggtatgagcaacttactcagtcataatgaaaaggtgtattctatttgtggatcttccaaaactgtcaaaaggaaaagggtggggctaaatgaagatcctactaattcaaatatatcatgccctttagatgaattgttactttggcacaaggctataaagcaagaattgagtgatttagctgagacagctagaaagatacagctatctgaagaattttctaatttgtcatcatttagtgggaggctgcaatttataactgaagtctgcatctcccatagcattgctgaggacagagtaatattccctgctataaaagcagagctgcattttctccaagaccacacagatgaagaactccaatttgacaagcttaggtgtctgatagatagtatccaaagtgctggagctgactcatcatctgctgaattttattttaagttgagctcccataccgaacaaatcacagatactatattgaagcactttgaagacgaggaagctcaggttcttccactggcacgaaaattatttagtccccaaaggcaacgagaattactttatgaaagcttgtgctcaatgcccttgaaattgattgagtgcgtgttaccatggctggttggatcacttaatcaaactgaagttagatcatttcttcagaatatgtatatggcagccccagctacggatcatgcattggttacccttttctctggttgggcatgcaatggatattctaggaacagttgcttctattcaagcacaacaggtttatgtcctgataggagattgatggaaataccattttgcatgtgtgaaccttcattcggtctcaatgaaaaatcttcagccattcaacaagaagatgaaaatggctgtattggaccagtcaagcatggaaagcctgaatcaaagcaagacaatgatgttgctaacctgatggtaactggaaaaaccctcagctcatctcttaatcagtcttgctgtgtccctgaattaagggtgaatgcaagtaatctagggcttggttctttggccttaacaaagtctctgcgagaactatctgattacccatctgcaccttccctcaattccagtctttttatgtgggaaaccaatttagtctcggctgacaatcaatgcattgcacggcctattgataacatatttaaatttcacaaagccatacggaaagacttggagtatttagatgttgaatctgtaaaactcaatgattgtgatgaaattttcattcagcaattcactggtagattttgcttgttgtggggtttgtatagagctcatagtaacgctgaggatgatatagtatttccagcattagaatcaaaagataatcttcacaatgtgagccattcttacactttggatcaccagcaggaagagaagttgtttttagatatctcttctggactcactcagcttactcaattacatgaattgctatataaaaagaattggtctgatcatataactaattgtttctctaattatgctggttgctatgatattgatactgtacaaaattacaacgagctctctacaaagattcagggcatgtgcaaatctatcagagtgacactagatcaacatattctcagggaggaacttgagttatggccattgtttgatagacacttttctctggaagaacaggataaaattgttggtcatataattggtactacaggggcagaggttctccagtcaatgctgccatgggtaacttctgctctcgcacaagacgagcaaaacaaaatgatagatacattgaaacaggctaccaaaaacactatgttctgtgagtggcttaatgaatggtggaaaggacctgcttcatctttaaatatcactacaccaggagattactcactaggtactgatgcatatgaagattcagagcatagctttcttgcattccgacctggatggaaagatatattcaggatgaaccagaatgaacttgaatcagaaataagaaaagtttctcaagattcaactcttgatccaagaagaaaagcatatcttattcaaaatctaatgaccagtcgctggatagcttctcagcagaagtcgtctcaatcattgggagttgaatcttcaaaaggagatatattggaaacttcactttcgtttcatgatccagagaaaaaaatatttggatgtgagcattacaaaagaaattgtaaactccgtgctgcttgctgtggaaaactattcacgtgtcagttctgtcacgacaaagttagtgaccatttgatggataggaaggctacaactgagatgatgtgcatgcagtgccagaaaatacagcctgctggaccagtttgtgcaacaccttcctgtggcagtctcttgatggcaaagtactactgtagtatttgcaaactttttgatgatgaaaggactgtttatcattgccctttctgcaatctatgccgtctgggaaagggacttggtgttgacttctttcactgcatgcagtgtaattgttgcatgtcaaagaaattggttgatcacatatgccgggaaaagggtttagaaacaaactgccccatctgctgtgattttttgttcacatccagtgaatctgtcagagctctcccttgtggacatttcatgcattctgcttgttttcaggcatacacatgtagccactacatctgtccaatttgtagcaaatctatgggagatatgtcggtttactttggcatgcttgatgctctactggcttctgaggaactcccagaagaatatcggaatcaatgtcaggtgaaaaatatttacagtagtactactagtacagctcttgaagctgaaagtaaattactcaaacctttttaa

SEQ ID NO: 69885 - DNA, 1272 bp, Glycine max
  Peptide Sequence Number=SeqID_161570
atgatggacaatgaaccactccaacaactccaagcccgcatcgtagagatagaaagatgccataaggaagaacatagaaaaatgaagaccgatcatgatgaattgaaagctcacattagacgtccccaagaagacgagcactgcgctcacatgattaacaaatacacccaggcggatgactcatcgacatcctttcatagaccgaatcatggaggtcgacccacctctaggttggaaaccgctcaacctgatgggaaattggcaagattcaagggttggacaatggttaatttcttgggccttaataaggtggatcttggcataaaagggatgaatgagatggtaaaaacagcttcctttgctttccttgctctagcccttgtcataggtcctccaagtccttcaagtggatccttgcccttgctcttggtcatgtcctcatcaaccgacttggacgagcacttagatgcattcctcaccaaggccaacctctacactaatggcgacatgatcttatatcaattcttccctatgtccctcaagagagctgcattgacatggtatggagggatccttccccgtgctaaagttgatgtctcgctaagcgagctcaatgcgcttagcgagtgtcatccgctaagcgagacatcaacgcgcttagcggatatgaggaatctggaagggaatctatcatacaggcatgcgctcattgcgtcatcagcttgctcagcgagtcgtttgtctccttccaggcttagtgcgagtttggtgctgagtgaaaattcacttactcacgctaagcgtgacatcgagaggtctgaagagtctcacgagaaagcgctgaatagccgtaagagcttgaagagtgaaatacacaaaggcaaagaacagagcaaaagagcaagttttgatcttttaggaagatttgagcttccttgctatggaaggctaaaccctcagttggggattcttgctgacattgaaagatgtattgtctccttagaacttgatagagcaggattaggttatcgtatgtctggacacggagtgcgcctcctagtagcatggacaagtaacgggaatgagctaagggctacattcagatggaagaaatgtcgagattccgaaacgaagttcaacaagctggacaaaagcacaagaaaggagaaagtagcccaaggaccgacctacataagtcagataagcgacacaaactggaaaaacgtcaaccccttcaaagaggatcaaggtatgattgcaatacacccttga

SEQ ID NO: 69886 - DNA, 261 bp, Glycine max
  Peptide Sequence Number=SeqID_161571
atgtacaggctcaaggttcaatcaatcaaacatactttcagctcaaactgggtgcaagggattaattcatttatacacaagacttatcaaggtaatccttgtggcgtctactctgacttatcttccttcaccggaagtggcatctaccctgacttatcttccttcactggaagtggcgtcatccaaaaaactctacagcctatatcaaacgttccgtcccgtaaggttcacatcatctggtatcagagcttcggctcttga

SEQ ID NO: 69887 - DNA, 156 bp, Glycine max
  Peptide Sequence Number=SeqID_161572
atggttgaaaatcttcgcgagatcacccatggaaacgagaaggaaggagatgtttgccaccaagctcgcccaggtgagctaggttgcttcctccagaagcaaccgccttctggaggaacatcctggaaggcccaagtgggcctggttgctatttga

SEQ ID NO: 69888 - DNA, 1110 bp, Glycine max
  Peptide Sequence Number=SeqID_161573
atggcttcaagtaagaggaaggaaacagcttcggtaccccaggcccgttatgacagatctaaattttcatcccaaaaggcctgggaccgctactcaagcaatgcactcggttggaagatacttccggagagaaatgttcagttatatttcacagaatttgatgaatttaggagagagcttgaaagaagaaattggcataaggagcttacaaattttgcagatggaagcatagacgtagcaatagtcaaggagttctacgcaaatctctatgaccccgaagataaatcaccgaagcaagaaggggagagcctcctagcctactccaggtttgccttgctgaggccagtttcgcaagagctggcagcccgtctaggtctccctggaaagggatttgagttaaatgcagacgggctgcctctgaagattctgaggaagaatctgactgggctagcccaaacttggagtgtcctttccttttctaacttggcccctacctctcacacttcagacatcactttagacagggctaagctaggctttcctgccctcatcactgccttgtgcaaggcccggggagtcacttttgattctttgactctcgagagcctgagcccaaccattaatttggcgtatgttaaaaagaactgctggaacctggatgacccctcggtcacttttccaggaacccgcaagtctagggacaaaggatccgaggtaccatcttcttttgttcccccttcttcagctccttcttcatcagctccatttgcatctgtatctgctctcccacctacagcaccatctccagttctcccagagcctgcatcaaggtcagatcctaatcatgcaaagcttgcagaactcaatccatcagaggccagagcccagccttctcctttgggagggggtgaggcctctgcgtcccaggagcctcagcaggatcagcaagaggacattccagaggccgcagagcccactacacctcctgagccattgacatttgagactgatccacgtgttgtacaggttcaagaggatgtcacagcatcaaagccatctcctcagcctgagcctaaacctgggccatctacaccagtgcaggatatatga

SEQ ID NO: 69889 - DNA, 270 bp, Glycine max
  Peptide Sequence Number=SeqID_161574
atggcttatactcacattctagtgaaagttagaataagcaaagatgtagaattcactagcgattctcctcaaatttcagccagcccgcatcaattagactctgcaccttatgcttcagggtcatacaatgctcaagggaatgccccgggactcctccatgataagcacatgttgcattcgagtcgtatcctcgaaaaaatggaggttgaggaaccttggctagggttatggctaccattgcattatcgagtagatatgggagtaagttag

SEQ ID NO: 69890 - DNA, 1485 bp, Glycine max
  Peptide Sequence Number=SeqID_161575
atgaagagctcaaataatcaacacccattaaattctgtttcaaagcattttaatctccagcttgttcgcttccttccctatctcctctttttggcctttggtgtgaccattggtatcatcatcagcttctacctcaaaagctttagtcttcagcacactcaattcttacactcttcatcatcacagattaatgcaccaccaccaaatacaatgcccccaccaattgaaaaaccagaagtatctgattctaacctcaatcaagaggggccggaagaatttactccaccttctaatgttgtgcataatacacaagagtctattcagccttccatcgttgtgcatgataccaaaaagtttattcagccttctaatcatgttgtgcataacatgaaagagtttattcatccttctaatgttgtgcatgatatgagtgatgaagaactattatggagagcttcaatgacccctaagatcagagaatacccctttgatcgagtcgccaaggtggccttcatgttcttggtaaggggtcctgtgcctttggctattttttgggaaaggttcttcaaagggcatgaaggatactactctatttatgtacattccaatccttcttacaatggatcagacccggagagttcagtgtttcatggaaggagaattcctagtaagtcaggactcacggcggtagtcacagtcaggactcgcgacggtaatcgcagccgtgccttgcgatggttgtcgcagtcgtggcacacggtgctgttgtcagacttcgacattggcagcaccaaactcgtcaccatagatggaggtgcggttgccgctggagaagaatcgatgatagtggaatggggaaaattcaacatgattgaagcagagcgtcgccttctggcgaatgcccttcttgatttctcaaaccaacgttttattctgatatcagaatcatgcatccctctattcaacttctcaacaatctactcatatttgatgaactccacccaaagctatgtgatggcttatgatgaagatagtctagttggacgtggacgttacaaccctcgcatgtcccctatggtcaccctcaagcaatggagaaaagggtctcaatggttcgaaatggacagagaacttgccctagaagtggtgtcagacaaaacctacttcccaatttttcaagagcactgcacgagaccatgctatgctgatgaacactacttgccaacatttgttaacataatgtttccggagaagaattctaataggagtttgacttgggttgactggtcaaagggtggcttgcacccaactaaatatgtgagaccagaggtcactgtggcgtttttggagaatttgaggaaccagaaatgtgagtataatggacaagcttacacaaatgcttgttttctctttgcgaggaaattcttgcccacttctttgacaaggctcatgaggttttctccaagtgtcatgcacatacaatga

SEQ ID NO: 69891 - DNA, 102 bp, Glycine max
  Peptide Sequence Number=SeqID_161576
atggcagtgttgtttcgagagtggaatccttggggtgttccagatgattacagatgtgagctgattgagaatgatttcccaagcatgttcctctccctatag

SEQ ID NO: 69892 - DNA, 850 bp, Glycine max
  Peptide Sequence Number=SeqID_161577
ttccaacagtgagaaagatgctgaaaacttcaatttgatggtaagaaaatttggaaagtttctcaagaaatcaaaggatagaaagttctccaaatcctccaagaaggttgacaacttcaacaacaacaactacacatgttttgaatgtggtaagcaaggccacattaaatctgagtatcctatctatcttagaaaacatggtggtgaaaagaaggggaagaaggacaggaaacaaaagaaagcttacataacatgggaagatagtgcatcaacaacttccaactctttaagtgatgaagaaattgctaacgtgtgcttaatggcaaagtccatggatgatctgtcaacaagtgaagaaattgaggtgttcctaaaagcaagggattccctatggtacttggataatggctgctctaggcacatgaccggtgacaagtccaaactctccgactttgtgtcaaaggatggtggatacatcacttcgtctttgttgcaaattggcctgcgcttccatgactgcaaccacattgtggagttcgtctttgtggtgttcgtctttgtggtgttcgtctctgccacttatcgattgagttcgtctttgtcgcaaactgggctgcatttccgtgactgcaaccacattgtggagttcgtctttgtggagttcgtgactgccacttatcgtttgaggttgaagaaaactaggaaaggaaagagtcccggaaagggtgggactcaattttggaagtccattgtgcttggctttaagactcccagggaagccatcgaaggaatgtctctgttgtatgttattgataaaaatccattgttcaatggtctgtctctattgtga

SEQ ID NO: 69893 - DNA, 327 bp, Glycine max
  Peptide Sequence Number=SeqID_161578
atgacatgcggatatacccaagtggttatccgtacaaaacgatttctgttaatcctgacccgtgaagtcaggtggcatgcggagatacccaagtggttttaccttttgttgtccagagacggcgagtctgaagacatgctggggtaccttatggttttacttttgtcatccagagacattcaagtccgacgacgtgcaagattcttctctactaggcagggacgatcgagttcgatggcatgtggaaacgtcatggttatcccgtgttatttgatcgaggccgtacccgaatcaaataaacatgaaaatgcagtaactaggaagtga

SEQ ID NO: 69894 - DNA, 606 bp, Glycine max
  Peptide Sequence Number=SeqID_161579
atgaccatcacaccccctcgtgcaaaagggattgtgattgggtcttccaagaaaagaagctctatgaaagttgagaagtctgggaagaagaagcaaagaactgagtatcaaaccccttctttgtttcaagacatgaagtttaaagataagtttgatgttggatggttcaacaagcaagttgtaaatggaaggtatattgaccttttagacatcaaagaatgtgaacaccttttggcagacattatgagggttcctaaggacagttcaaggctgtatgaagattggcttgagggcaagggacttagaaagacaaaagttcaaaagaagtttctggagaacaagagagatgacttcaaatccaaatctctaaaatcttttggaaggattatccattggatgtgcatgcactatgtgctgcccaaagttggtacctttcaagaactaatgactcttgtgtgcaagcattttgaagtctccttggaaggtgaacttcttgatgatgatgtcttatcttggggtgccaagaatgtttatgctccaaagttgtctcgacaacttggtatggagaagcttgtattgttagagatagggggagcaacaacatga

SEQ ID NO: 69895 - DNA, 1626 bp, Glycine max
  Peptide Sequence Number=SeqID_161580
atgcagaatcttgccgctgcaaagagaaaggaaaacattgctaccacagtcatggttaagaaacaaaactgcgaaaagcaacgagttgtgttggtggcgccatggtggaaaggcgtggcgggtttcgaatggcgacgccatggtggccaccatagccatggcgcacaaccctcccctctcaatcagaacgcagccctcctccaactaaaagctcaaccccttcacccagccgcgaccccccgtacgcagaactcagccagcagcgatgaccccacggcgacgacaagcactggcacgaagggcggcgacgtgcaccggcacgaacggcggcgacaagcaccggcacgaacggcggcgacgacgcgcacgaaggtagtgaacatcgcggcctttgcgaagtgtcaactgcataaccgattcgcaagcctacttgatccggccatagctccagtttctggtccaaccagtttgaccagtttttataacattgatcaagatgctggcaatgtctctgaagcctatcttgattgggaacaagatcaatctattatttctggtgaaatgcttacaagagtgattggttgcaagttcacatggcatctatgcgataaaatccattcagattttcactctctcacttgcgccaaagcttgtcagatcagaaatgagcttcgaagcctttctctcaagaatcacccaatttttgagaattttcttcagatccaaacacttgtaaactcgcatacttctattggtgattctatctctcctggggagcatttggaaatgattctcaatggtcttccagaagaatatgagtccactgtttggcttgtttgtaacaagttcgagcctttcactgttgacgaggttgaaactcttcttttggagcaaaaacttccttcaagagacataataagagatctctggtttcaatcaatcttactgaagccctcctccactgatatgaattacaatgattaccacattacaccagtggttgcggtggctggagttttaaccgtggtggtcgtggcagtggccggaactttggtggccgttactctaatgtgcagtgccaaattttatgagaactatgtttcgattgctcctcaaggtctgaacatgcagcctcaatggtacccactcttctggactatacctccagtaccttacattcgatcctctcagcagcaaatgccaccaccatctcaatttggttttcctcaactatattctcattcatatcctcaaccatacactcaacctaactacacctacaatagacctgcaagacctatctctcgagcacctcctcaagcttttcatatgagtgctcctgcatcatcatcaactccctctactagccggtatccagatttgggggattgggtgtgccttgaagagcgcgactcacccctggaagtcacgtggccagaatcccagccacgtgccgccaccaacccgcgcgaatttcggagcgtgaggtccatgcgccgccctccggaagttcactggaccagtaccagctgcttcaccttctcctgggcacgtttcagcccttgttatccggtattgacaacttgctcgttccagcccttgtgtttccttctccttctccgttag

SEQ ID NO: 69896 - DNA, 360 bp, Glycine max
  Peptide Sequence Number=SeqID_161581
atgcttcatgttcaattcaacgtgtctaccacacaaccaacatgtgtcagccttttatgttttaaaattctcattttagttacttatgattgcgatgttgctcaagataattcttctgtcaattttaaactaacacgtgagatgattaaacctgattgcggtggcgtctcagaggtgtgcggctgcgccgtggtgctgattgcagcaagggttttgcgtcccagcgcaatgcagagaaccttctctgcccgacgcgaactccaaaagcgatgggaaccctgtcctccgccacaggtcgctaccgtcgatgaagcacccactgtgcagaccgtcgacgcttctcttttgccgagtgagtga

SEQ ID NO: 69897 - DNA, 144 bp, Glycine max
  Peptide Sequence Number=SeqID_161582
atggtgaaactcaataagcaaggcattgatgaaggagcagttggaggcttctcaaagaagcctcttgagaaagcttctcgaagaagccacgaggaagcttctagaggaagcctcttaatgaagcttctagagaaagctacatga

SEQ ID NO: 69898 - DNA, 549 bp, Glycine max
  Peptide Sequence Number=SeqID_161583
atgggaccagttgcctataagctggcattaccagagaattctcgcatccatctcgtattccattgctctatcttaaaacctttcatcggatctccgacatcagaacaggctatgcaccttccgcccttggccatggacaaccaaccaatcccagctcccttagctatcttggctcacaagaccggtcttcatcctgatgaagcatcgtgggaagaatggtcaaccattaagtcccttcatcaccttgaggacaagcttcccggtcttcacgatggcatcagccactgcgggatggtcgatctgaacctcgacgactttggtttcttccttgataccgatgttgatggccttgtggaaagcctgggtgagggctttggttttccacatctcgagggagaagatttcgctagcggtgatcatggtgaaaggggtttcgagctcgagggacttggccatgcccatggcaatggcggtcttgccggtgctgggcttgccgaccaggaagactgtgtggctggcaatttttctgtctttgatcatctctcttaa

SEQ ID NO: 69899 - DNA, 279 bp, Glycine max
  Peptide Sequence Number=SeqID_161584
atgatgacaaaggtgatgacaaaaaagctcaaaggtcaatcaaagaatgagttcaagatagaatcaagaacacttcaagactcaagaggaaagttgaagaacacttcaagattcaagaggaaaagggtacatctacttgggttattgactgagaacaagagagggtacatctcttgtggatcagttctagtggagggtacatccactaggttcaaagagaacaagggagggtacatcccttgtggatctttgcttgtaaaaggatttttacaaggttga

SEQ ID NO: 69900 - DNA, 441 bp, Glycine max
  Peptide Sequence Number=SeqID_161585
atgtcagctataggattgtacatagaaaaggatgttgttggtggttctatgtttcattctgcaaattttgttacatgtggaaataatttatctaataatgactcagaactgccaagaaatgtaagcgctctagatgatgatgatgattatcttgtgtctaactcatatgttgaaaactctttagatgaagatgatagtgttgatggtatatctgatacagatgatgaagtcatccacatgattcaaccactattaggtgtagaaggaattcaaaatccattttggaatgatgctttgtattataaaaatatcaattggagtcatcctgatgaggaggacatttgcggtttggagatgccatcgagttttaatgttgggcgagaattatatgttggtatggattttgatagtaaagatgcagaaaaaaatgcactgaaataa

SEQ ID NO: 69901 - DNA, 162 bp, Glycine max
  Peptide Sequence Number=SeqID_161586
atgggggactcatggtggttgggggacaaaggaaatggaagggggtcatggtggttgagggcaaaggaagaggaggggtgtagtggaaacatgaagggagaggaagagaggaggaaacgtgaaggggaggagaagaggaaagagaaatgtgaagaggcatga

SEQ ID NO: 69902 - DNA, 1116 bp, Glycine max
  Peptide Sequence Number=SeqID_161587
atggcaggagctggtgacggtggtggtgaatatcatcagctggacggatctcagtgcttgttattagataatgttggacgacattatggtgggaagagagggggcaatgatggacccaggaaaaatagaatggaggggaagaacaaaattgagggagtaaagctcaatgtacctcatttcaaaggcaagagtgacctagacacataccttgattgggagatgatgattgagcatgtattctcctacaatgattatattgaagagcagaaggtgaagctagtagtagctgaattctcagactatgcccttcggaaccttgcgataaaaactccagaggttgtcctagggaagtttgactatggaggagtactacaaagagatggaaatgcactagtgagggcaaacattgaagaggaaactgaggacacaatgactcgttttctgagtggcctaaatcctaacattagagatgttgttgaattacaggagtacatggaattggatgacttgctgcataaggcagtccagtctccacatggaaagttagcagcacctagtgctggaaccaaacataattctgcctcatcatccaacaccgatggagaaatcaccagtgaatctgaaattagtgaagaagaagaggtggaagaagagcttgaggaggaagttatgcagggtgatatgctaatgaatcctgaacacaagggagaggaatccctaggtggttcagaagttgtagaagagttttacaaggatagtggaaatctcaagtgggttgaggtgtgtctcaccattggaagatacaatgatagggtgttgtgtgatatggttccaatggagggcgacgcgaggctcacagcatcctctaagcgcaacattcttgggctaagcgtgaggaagaatccagaagaagatgaggtgtacagcacgaacaaggccacctatttaagcttgaaatcagattttgtgaagagagtttggactgggattcagagctttgcatgtctagggtttctagagagagaaaggtccaagttccaagagtttagagagattttgctgtgtgaagatctacagagaccagagcttgaagcaggagccggtttgagagcttga

SEQ ID NO: 69903 - DNA, 204 bp, Glycine max
  Peptide Sequence Number=SeqID_161588
ttcccccttagaccttgaatcatgttctatacaatccaagctggaccacaattcatgccaggaacatgttcctgaaaaaccccatatagctaataatttgaatcaacaagttttgttggatatgcttgaggagttagtgagaaaccttagtgatttagttgcaagattggaatcaaagctacttgaacctccaaaagaaaaagg

SEQ ID NO: 69904 - DNA, 999 bp, Glycine max
  Peptide Sequence Number=SeqID_161589
atggagatcatggttagaacacgaggtttaggtcatgctttagctatggttataggcagaggtagacaggatgagcatgatgttccccagaggcgtaggcctactgcatcagcccgtaggcgacgagtacatattacggttgatgagggtgctcctcaggtgactgaggatgtccctcatatggctaatgatgttgctcagatgagtgaagatgtgcctcagatgactgcggacgtagatgcgactgttgcagaggacttaggtcgtgatggtgctgaggggtcacatgctgatgagggattccctagtgggccccgtgacccatcagttctgacttcatttgtagagtatgtcgcacatgccatttggactggacaatgtcctgagctgaagttggtgtcgcacgagaggaaggtggcgttaattgggaggccagtgcctgcgattgaagggctggttgtcgccacaggattaagtccattgattgagtgttcagttgtaaccagcgatcctggacttatatccgcatttatggagaggtggcatagggagaccagcaccttccaccttccagtaggagagttgacgatcacactagatgatttgctcgaggtgtctgatgaggaggctagagtcgagacaatacgagcgtgcgaggcatatggacccctctcatgggttcgggagatctatgagatgagatgccagtgtgtcaccgatgatgcatatgaggagatgtcccctcgtacctcccggtggctgatgatgaaggctcatatgaagggaattacaggagcgatgtacagggcatgttgtgatgctttgacggtcacagacgtgtgttggtttccttacagtgaccatcgagggctgagatggggtcctacggtggtcacagttcgatcagagagggtgatacgccaatttgggtacattcagagcatccctccaccgcctattagcgcttcgttgtcatatgacgatatagatgacaggtga

SEQ ID NO: 69905 - DNA, 141 bp, Glycine max
  Peptide Sequence Number=SeqID_161590
atggaaggttcaagctatttgagagtgaatgacaatgagaaaaatctcatagaaatggtggtaattagaggcaatggtgtggttactgttgaggtgcttcaaattcaagtatttaaatgtaaattaacaattgttaagtga

SEQ ID NO: 69906 - DNA, 201 bp, Glycine max
  Peptide Sequence Number=SeqID_161591
atggtgcagaatgaccataatttgtctctgcgcgccattggacacgactgtgtctggatggcaaaagggcatagattgactataatttgtctctacgtgccatcgaacacgactgtgtctggatggcaaaagggtcagtatgatagagattgtggagcggccgacaaaagcgaggctcttgctcctacgtatcctcaatga

SEQ ID NO: 69907 - DNA, 585 bp, Glycine max
  Peptide Sequence Number=SeqID_161592
atgaaacagtatctggatttgatgaacaaggtgctcgccgagggcacccctaaagccgaccgtaccggcactggcacgctgtcgattttcggccatcagatgcgtttcaacttgcaggaaggtttcccgttggtgaccaccaagaaatgtcatcttcgttcgatcattcatgagctgttgtggttcctgaacggcgataccaacatcgcctacctgcgtgacaacaaggtcaccatttgggacgagtgggctgatgaaaacggcgatctcggcccggtgtacggcaaacagtggcgcgcctggggcgcggcggacggccgtcagatcgatcagctgagcaacgtgctccaacagctgaagcaggatccggattcgcgccgcatcatcgtttccgcctggaacgtcggcgagctggatcagatggcgttggcgccgtgccacgcgttcttccagttctacgtcgcggacggcaagctctcttgccagctgtaccagcgttcctgcgacgtgttcctcggcctgccgttcaacatcgccagctacgcgctactggtgcatatgatggcgcagcagtgcgatctggaa

SEQ ID NO: 69908 - DNA, 138 bp, Glycine max
  Peptide Sequence Number=SeqID_161593
atggacagcagagaagccagtacgcgcacttgttatggccacgaccaggtggaggatagtgttagtagatatggtaaaatgggtcggcccaagttagttagcccaccatcgatcaatatggtaggacggggtggataa

SEQ ID NO: 69909 - DNA, 941 bp, Glycine max
  Peptide Sequence Number=SeqID_161594
atggcagaaccttcgaagaagcgaaagggcactttgagtcgaagtcaacggcattccgggtcactggaaatgccaattccttcctccattccctctggatcattgttttcatcagaggaacaacgtatacagtacacaaacctcttttcctctcattccattatagacccaaaattcatagatatggatttcttctcaaatgagagttttgaatgctttcaagcatttgaaaactccaatcttattccattcatgtctctgaaattacctatttattctgaactagtcaaagctttttattctaatttagaaatccatgaaggtaccctaatttctgaggtttatgggattaagatggtcattgaccagtccctattctatgatttaacccaatttccaagcgaaggtgtaccatttaaaggtgcactgattgatgattggaagtttaatttctctgtacatgatgctcgccggttggtttgtaccaaccaagcggatatgactggaaggcttcttgtcggttcattggcttttgaaagtcgtatcctccattaccttattgttcgcatcttgcttccgagatcttcaaaccttgctcaggtttctgaagaagatctcattgtcatgtgggcctttcataaaggtttacaaattgattgggcacatcttgttagatatcacatgtataaggcattgcgattgaatgctccattgccttatcctcatcttgttacccttttccttcaacacttcaacatccctcttgattttgaaccctatgttccaatcaagagatccttccttataggcgcttcagtcatagcatcctttggttatcaaaaagagcatgatggctcttgggtgaagaagggtgctcgaaatattggtgaagaaggacatgatggagaagattcatctcttctttcaaagataatggacag

SEQ ID NO: 69910 - DNA, 179 bp, Glycine max
  Peptide Sequence Number=SeqID_161595
tttcttcatatacactcgttgctcactgtcgcaacctacccttcggcgggagggcgacgcgtgactcgcgggatgcgtgttccacgaaaggaatacgcgcggagtcgccaccaacgtttatttgaggaaaacgtcgggaaaaccggaaaagacgcgatctacgaactttttagtgaaag

SEQ ID NO: 69911 - DNA, 1311 bp, Glycine max
  Peptide Sequence Number=SeqID_161596
atgtcatccgctgtacccgcgttagatttcggctcaatgacccaggtcatccagttcctgatggaaatcgataagttgaaaggcgtgcaacgccgcaccaaagtgctgggcacccagcgccaggaaaactccgccgaacacagttggcacttcgccatcgccgccatgagcctggcgccctacgccggtgatgacgtagacattcagcgcgtgatccagatggcgctgctgcatgacattgtggaaatcgacgccggcgacgtgctggtctacgatctggcggcccgcgcggcgatccacgatcaggaagtggcagcggcgcgccgcctgttcggcatgttgccggaggctcagcgcgagtatttcaccgctttatggcaggaatatgaagatggcgaaagcgccgatgcacgcttcgccttgctgctggatcgcaccatgccgatgctgatgaacctgcacaatgaaggccagagctgggtagagaacggcatcagcctggagcaggtgctggcgcgcaatgcatcgatcgccgacgtgcaccccgagctgtggcaccacatggagcaacacctgcgggatgcgcagcgcaaaggctggttgaacctgtttatttcacccgacggcggctccatacttgcttttagacgtcatcgcagcggtcagttcaagcaaacccagccccggcacgggatatgtgtctcatacttgcttaaccccagtgaaaaaatacagtttatttaccataatcttcatggtgccgacgcatcggaggaaatactcgcttaccttctcagccaattggaaaaaagtggcgatctcggaagccttgcggcttacatgaacaacgaacttttgcactactccgggcaagaagtcattttaaaagaacaacaagccgcgttgattgaaaccgtcaatcaaacgctattcccctcttttaacggctcagtatcagacggagccgaatgggtgcagggtttttattatgcagtgaaatcaacgatgacatccgatggtataaactattggggcaacgtgataaataagcaccctgaacagttaaatctgattgcacaaaaatttgtcgatgcccccgataacaaccaactacaaaaatatactgccgggttaactatcaatacggaaaaccgtggcgatgttatagtacgaatgattaatgacatccgcaatgatgacaccagcgaacatgctgatgccaaagcaatttttttggctcacacgcatgtttatgctgccggagagttaccggcaccggagtatcaagaggccataactgcatatacttga

SEQ ID NO: 69912 - DNA, 249 bp, Glycine max
  Peptide Sequence Number=SeqID_161597
atgtggaagttcggcccgagaccgacaccttgtcacccagatttgtttcgccccagatatcaagattgggttcccacgataaaagaccccattgaaacacaacctcggactttttttgaaccttggcctgtaaaagagggatcctcattctttcccccgaagcaaaggacagtgaaatctcctcaaggaagagcgaatggaatgttaaaactcgatttcccaaagaaagggatggggaaggaaaagtga

SEQ ID NO: 69913 - DNA, 152 bp, Glycine max
  Peptide Sequence Number=SeqID_161598
ggcgaggatggaaattctcatcctgggtcaaggtttatggtgagttgggattttggctcaaggcttgtagaacggctggacatgatatttgtcagggtgttggtttggccaacagttcagggataaaggaatgtcccacattatttccttga

SEQ ID NO: 69914 - DNA, 318 bp, Glycine max
  Peptide Sequence Number=SeqID_161599
atggaatttaatggaaatcacctaattgaattagggttcagacccgcaaaatggtttaaagaagccatagaatatatcaacgaaaataatctggatgaagctcagatcaaaacgtatctggagcaatataaacaaccggaccagattcctttgcatgaaaccccaaaagatttcatcatcaacatcagagctgagcacgaaagtgaaaatgataacgtggaaaaggaccagaaggtcatataccggtgggtggtgtggttattgctaaaaatgcaatccatcccgggtttcatagcgcagatatctgctgttccgtga

SEQ ID NO: 69915 - DNA, 516 bp, Glycine max
  Peptide Sequence Number=SeqID_161600
atgtttaaacaagcagttttactagctggaattttaacagcaggtgtagcaagtgcacagagcgtacagatgaacaacatgcttaaagtaggagcgaatgtaggattagctgttccttctgataatctttctgctgctgtgggtgtggatgtggcttaccagaatctgattactccgggagttggattaggtatcgcaactggttattcccattatttcggaaaagaaaacaacggatataaaaataatgatgtaggggtaattcctgtagcagcattattgagaatttatccaaagcaaacaggggatgataaagtagcttcgaatacttcggttgacagaccaagcggaggtttttatatcaaacctgaaatcgggtaccataatcaggactggaatttcttcgtacaatatcagaaggtatttacaggaagtaaaggtgatttagtaaatcaggactacaatgtgggtaacattggtgtcggattttcttacaatattccattaggaaagtag

SEQ ID NO: 69916 - DNA, 447 bp, Glycine max
  Peptide Sequence Number=SeqID_161601
atgccaatctccccctgcagatgtaccggttgggatcgcgcccacaagacgccagtgggcccgaagaagtccaacagggccctggggtttccagctctggaatcacacctacaaagacacccagtggacccggagaagtccaacagggccatggagtttccagctctgggatcgcgtctgcaaaacacccagtggacccgaagaagtccaacagggtcttggaattgtcaagctctaattacgggtctctgtcagttctacggagtgcatgtcacctccagcaagggcatcaggccccctactaatcgagctttcatcaagaagaattgcatccccaggcaggcgcagggcgaaacaccacagcagcctggggatggccagcagcgggcaacagacgcaccgccgtcacctctagagttcacctcagctcatccacaaaaaggttag

SEQ ID NO: 69917 - DNA, 378 bp, Glycine max
  Peptide Sequence Number=SeqID_161602
atgtcattgcctagcactgttcatctgttctccaccgtcgagtctggagcctcgcgaatgtcattgcctagcgctgttcgccaattctccattctccactttcattcggagccccatgaatgtcattgcctagcgctgttcattcatcctccacccaaagagtttggagctatgcttcaagattgcctaagtgtggaccctctagtgcaatcctccattctccacttttttgcggagccccatgaatgtcattgcctagcgctgttcatgtgtcctccacgttcgagtctggagccccgcgaatgtgattgtctagcgctatttgccaattctccattctccacttctattcggagccccatgaatgtcattgcctag

SEQ ID NO: 69918 - DNA, 441 bp, Glycine max
  Peptide Sequence Number=SeqID_161603
atgaaagatgatgagaaaagaaaagtgcaagatgaccaaaaagctaaaaacattttaccttctagtttatcttctgatgaattctttcacactacaaggtgcaaacgtgcaaaggaaatatggaaaatgaatgaagtcactcatgacagaagaacggataacagagaaaccattttagatcttcaaacaagattcacccatattgtgaatcaccttattggtcttggaaaaatgtttgaagatgatgagctaaacatcaaaatcctcaattgtcctacaagaacttgggaaccaaagatcacaacaatcaaggaatccaaggacttggcatcaatgtcgccggaagctctcttgggaaaattggttgcatatgaacatgagttgattcaacaatctcatgcagaagaaatagaaaagaaaagaaaaggaattgcactcaaa

SEQ ID NO: 69919 - DNA, 1641 bp, Glycine max
  Peptide Sequence Number=SeqID_161604
atggagctgacgctggcgcagtttctcagtcgctttgtgctgcagccgccgctggcgaccgcgcacagcgtgatcagcggacgccgtgccgcggtgctggtaccggtgattgatggcgaccagcccgaactgctgctgacccgccgctccgcgctgctgcgcaaacatgccgggcaggtggcgttccccggcggcatgatggatgccactgacgattcgctgatcgccaccgcgctgcgtgaagcgcaggaagaagtgggcatcgcaccgcagcaggtgcgggtggtcggcgtgctaccgccggtcaccagcagtaccggtttcgccgtcacgcccgtggtcggtatcatcccgccgcacctgccgctgcagctcaacccggatgaagttgaaagcgccttttccatgccgctcgcagaggcgctgcggctggggcgctacagcggactgacgctgcgccgcggtcatcgccagcaccagctgctcgctgccgcccgctggcgattactattagccgcattaacggcctgcgccgtagaaaagaagatttgtgaggagcgtcaccgttcgcataccgttggcccgatgaaagcgggcaaacagtttgttgacctgctgatcgaacagggcaagctgcaggacgtgacgcgcgtggcggtggatgtctacggctcactgtcgctcaccgggaaaggacaccacaccgacattgccatcatcatgggtctggccggctttgagcctgccagcgtcgacatcgacagcattccggcgtttatcaaagatgtcgaaacgcgtgagcggctgctgctggcacagggcgcgcgcgaggtcgacttcccgcgtgacggcggcatggtattccgcagcgaaaacctgtcgctgcatgaaaacggcatgaccctgtacgcttttgccggcgatcggctgcttgagcgcaaaacctattactcgattggcggcggctttattgtcgacgaagcgcattttggtcagtcagtgctggatgaggtcgccgtgccctacccgttccattcagccaaagagttgctcagtcattgccgcgataccggcatgtcgctttccgggctggcgtgtatcgatcgtggcctgaataccgaaggcgttttgccgggcccgctgcgcgtgccgcgtcgggcggcgtcgctgcgacgtctgctggtctcctcaaccaaacattctaacgatccgatgaacgtcatcgactgggtcaatatgtttgcgctggcggtgaatgaagagaatgcggccggtggtcgtgtggtcactgcaccgaccaacggtgcctgcggtatcgtgccggcggtgctggcgtattacgatcacttcatcgaaacggtcacgccggatatctttatccgctacttcctcgcctcgggcgcgattggcgtactgtataaaatgaacgcctcgatctccggtgccgaggtcggctgccagggtgaagtgggcgtggcctgctcaatggccgccgccggcctcgctgaactgctgggagccagcccggagcaggtgtgcgttgccgctgaaatcggcatggaacacaacctcggtctgacctgcgatccggtcgctggtcaggtgcaggtgccgtgcattgaacgcaacgccattgcttcg

SEQ ID NO: 69920 - DNA, 351 bp, Glycine max
  Peptide Sequence Number=SeqID_161605
atgtaccctctattgttctcagtcacaacaacccaagtagatgtaccctctacttgtaccacaaaggatgtaccctccaatgtgttaagacaaagttctcaggctgttagtcctttgaaactttgtgaatggggaaacaaaagaattctcaagcgggaagaatcaaaagaattctcagactgtgtcgttttgaattctttgacatgggagaagggagacacaaaagaattcaggcggttagtccttcgttcttttggaaaagggagaagagagacacaaaaagaattcaggtggttagttcttggcgaattctttttggcaaagggagaagggaatgaaaaagatgaatag

SEQ ID NO: 69921 - DNA, 449 bp, Glycine max
  Peptide Sequence Number=SeqID_161606
ctggtgctgagagaccagtggtccatgttgatcctgctactggcaaggccgacggtccccacaggaagaaattaagaacatatttagggattgtggtgcgtgataaggtggacatgacgtacgagaactggaaggaggtccctactgctcagaaggacttgatttgggaggatattcaggacggtgtggacgacactgtctgtgagaaatacgacataagcaaggaaaaatggacccagttttgccagactcgtagagacccttcttgggagaagctcctggctaagaagacgaagaagaagctggaggaagctacacagtcaggaagcgttgatggcatgaccgaccctccatcccccgtcagacgccacgtgaagtggaagatggcccacatgaagaaaacagaggagatgaagactaaggccgcaaaggaaaccgttgagaagatc

SEQ ID NO: 69922 - DNA, 563 bp, Glycine max
  Peptide Sequence Number=SeqID_161607
ggaggcttatatgggtacccccttcaactagagagttgttctacatgaggatgatgctttcctccgttaaagggtcacaatcttacaaagatatcagaacaatagacaatgtcgtctaccatacatttagagaagcatgctttgcaaaaggtttcctagtaagtgatcaagaatttgttggtgctttaggagaggctaacacttggggaactccacacttccttagaaagttatttgtcaagctgctatttatgaataccatggatagaccagaatatgtgtgggaacaaacttggcaatggatggcagatgatattgtatttaatcatagaagacaagggggagtttattttctctatggatatggtggaactggcaagacctttatgtggaaaactttatcatctgctatacggtttaatggaggcattgttttaacagtggcatcaagtgggattgcttcattattgcttcccggagcacttgacaaaagcttaaaagacatcatgcacaatgatagaccttttgggggaaaggttattgttttcggtggtgatttctag

SEQ ID NO: 69923 - DNA, 138 bp, Glycine max
  Peptide Sequence Number=SeqID_161608
aatcgtcttaggcagtggtcaaatgttgggataggtctaaaggcaaaaactaatcaagaggctagggtcacgatcgatagatcatcatctcatgcccagcactggaccaacaggaagcgcagctgggggacagcctag

SEQ ID NO: 69924 - DNA, 274 bp, Glycine max
  Peptide Sequence Number=SeqID_161609
gagcaacaagttgagtgataaacgcgcagagacaaattatggtcattctgcaccctttgtcattcgggagcagcaagtcgagctcgatcgtgtccgagggcacgcagagacaaattatggtcattctgcgccttgtgtcaaccaagaggaacgaattcgacaatatcaggatgatgttggttgtcggaagtcaaaagcaagcactgtttcacaatccgtgaagttccgtaacataccggaagtcaaaaggaagcattgttgcacaatccgtgag

SEQ ID NO: 69925 - DNA, 147 bp, Glycine max
  Peptide Sequence Number=SeqID_161610
atggatgtgaaaacaacctttcttaatggtgatttagaggaggaggtttatataaaaaacctgaaggcttctcctctagcagtggcgagcatttggtatgtgatattttacttgcagccaatgatcggggtttgctacatgaggtga

SEQ ID NO: 69926 - DNA, 315 bp, Glycine max
  Peptide Sequence Number=SeqID_161611
tgccccatgtgtacagttaagaaagtgatatggaccttccagcttcccgtgacaaaagatgagaccaacatgcaccgtatgcgtgatgacatgatgcacatgcgcaaaagcgcaacagggggatgtacacaacatggtatcatccccttcgaaaaacatattgcggcagtagggactactagcaacaatatgttatcaaagagaaaaactctagatgaggggttccaaaagaaggcgatgccttctggtggaagcaaccctgctcgcctgggcgagctaggcggcaaccacctccctcttttctcctataaatag

SEQ ID NO: 69927 - DNA, 561 bp, Glycine max
  Peptide Sequence Number=SeqID_161612
atggcatccttcagccagcttcagtcacagatgcaatctcaggcacctcctgagcctcttgttggtcctggtccctccattcctcgggtgagcacaaaggggagttgtgttgatccctcaggaaatgattctgagacgggtgactctgacaggtacggcttgtacatagaagcagatcctgcccgcctggttgccgtggggagagtttatgagggatccactcttgttcataacactcctttgttgcctagccaagtaaagttgagtgtggacgaggttaaagatgcagatgctccagttcatgtacccactgctgaggtagctgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccatatttccccctatacataaagcacgaagacctctccaaaatcgcacacggtggtcaatgtctcagcatatcaatgttacagttgtggattctgtaa

SEQ ID NO: 69928 - DNA, 1053 bp, Glycine max
  Peptide Sequence Number=SeqID_161613
atggagccatctgtgactctcagattccgatcacacaccctctccctcttccctcacgcaccaatctcttccatagaccacccacacaatcatcttctcatacccatttcacccaaattcagttcaaacactacgctgtcggtggcagcaacagcgaagaaaaagccaagcatcgaaggtgtgagcgaagagttgaacgccatggcctctcagaaccttgacttcgcaccctcccggagacgggtccgtgcagctttcaccgaggtgcaccagcagctcgaccatttcttgttcaagactgctcctcctgggatcagaaccgaagaagggtatgaaaggaattccaggggattggaaattttctgcaaaagctggatgcctgaatcgggcgtcccactcaaggctgctttgtgtttctgccatggttatggcagcacttgcactttcttctttgaaggtattgccaaaagaatagctgcttctgggtatggtgtttatgctatggactatccaggttttggtctatctgaaggtttacatggttacataccaaattttgatgatttggttgatgacgttatagaacattttacaaaaatcaaagcaaggcctgaggtgagagggttgccacgattcatattggggcagtcaatgggtggagcaattgctcttaaggttcatttgaaggaacaaaacacttgggatggagtaatccttgttgcaccaatgtgtaaagctggttacaatgttatttcttatgatcatccaacacgattgaaaactggcatggagcttttaagtgctactcaagaaatcgagtcacaattacacaaggtttctgctccattattgattctccatggagcagcagatcaggtgacagatccattagtgagccaatttctttatgagaaagcttctagtaaagataagacactaaagatctatgaaggaagttaccacggcattttggaaggggaacctgatgacagaatttttgctgtgcacaatgacatcatctcatggcttgattttaggtgctcacttaaatga

SEQ ID NO: 69929 - DNA, 714 bp, Glycine max
  Peptide Sequence Number=SeqID_161614
atggaggagttcctcaactttgggcctcctgtaagactgttcaatagctccaaggctcagatagatgttcctcaaaacactaattcagttagaaatgtgacactcaatggtttccgctgggtgttaaacttcatgtggctaaaatttttactgatctggcgctttttccgcttctggtcactgataaacggaattgagactccagagaatatgccaaaatgtattaataattgtcacaacttggaaggcttttggaaaaactggcatgcttccttcaacaagtggcttgtgaggtatatatacattcctcttgggggatctaagaaaaagctactaaatgtgtgggttgttttcacatttgttgcaatctggcatgatttagagtggaagcttctttcatgggcatggttgacgtgtttattcttcatccctgagttggttttaaaatcagcagcaaaagcatttcaggctcaaagttcttttggagaatgcatatttcgtgaactcagtgctgttgctggtgcagtgacaattacttgtcttatggtggctaatctggttggatttgtggttggaccaactggcattaactggttgctttcttctttccttaacaataatggtttgcctgtccttggtggcatgcttatgacattttacgttggaacaaagattatgttccacatagatgaggcaaagcaaaggtcgccctga

SEQ ID NO: 69930 - DNA, 981 bp, Glycine max
  Peptide Sequence Number=SeqID_161615
atgccggcgaaggacgacggctccgacaaggagaagtgcctcgatctctttctcaagatcggcttagacgagcgcacggctaaaaacacggtcgccaacaacaaagtcactgccaatctcacttccgtcatcgacgaggccggtgctactgatggatgcagccgaacggtcggaaattttctttacacggttgcgacgaagtaccctgcaaatgccttgccgcatcgcccaacattactacagtacattgtctcgttaaaggtgaaaacaactgcccagttagatgcagcattatcatttcttgctaccacaggctccgagaatcttgatttggaccggtttgaagaagcttgtggtgttggtgttgaggtttcagaagaagatatcaaacaagctgttagtgaagttgttgaggagaacaaggctacaattttggagctacgttatcgaacaaatgtgggtgagttgctggggcatgtgcgcaagaggctgccatggggtgatgcaaaagttgccaagcaacttgttgatgcaaaactatatgaactacttggtgatcggacagcagcagatgatgaaaagccttctagaaagaagaaggagaaacctgctaaagtagaggataaggcagctcctgtttctacccctgaaaagtcacctgaagaagacgttaatccatttttaatattccctaatccagaggaaaatttcaaggtgcatactgaagtgccttttagtgatggtagtattttgagatgttgcaatacaagagatctgcttgacaaacacttaaaagcaacaggtggaaaagtcttgacccggtttccacccgaacctaatggatatttgcatattggccatgcaaaagcaatgtttattgattttgggttggcgaaagacagggatggaggttgctatctgaggattttctggtcatttgtaacagttcagtgcaattccgtattgtataaatgcgcatag

SEQ ID NO: 69931 - DNA, 1405 bp, Glycine max
  Peptide Sequence Number=SeqID_161616
atggcggaggagcaagctgaattcaggatttacaattcgatgagtcagcagaaagagatcttcaaaaccaaagtccccggcaaggtttccatgtacgtttgcggagtcactgcctacgacttcagccatctcggtcacgctcgcgccgccgtttccttcgatatcctcttcaggtaccttaagcacttggactatgagattacatatgtgcggaatttcactgatgttgatgacaagatggctacatgggttgaatgcttccagtatctagcagatcatgtcaagataataaagcgagcaaatgagaccggggaggatccattgatgttgagcaaccgtttttgtgatgaatacaatgctgatatggctgatcttcagtgcaagacaccatctaaggaacctcgtgtttctgaacaccttaacgagataaaggacatgataacccagattatcagcaatggctatgcgtacgaagttgatggcgatgttttctatgctgttgataaatgcccaaattatggtatgctatctggacaaaggctagaacataatagagctggagaacgagtagctgtggactcaagaaagcgtcacccagctgattttgcattgtggaaggctgctaaaccaggtgagcctagctgggacagcccttggggtcctggaagacctgggtggcacattgaatgcagtgcaatgagtgcttgttatttaactcataaatttgatatccatggtggtggaattgatttaatctttcctcatcatgaaaatgagattgcacagagctgggctgcagaccatgagagccatgtcagttattggatgcataatgggcatgtcactaataacaatgaaaagatgtcaaaatccttaggcaactttttcactattcgccagatcactgagcgttaccatccacttgctttgaggcactttttgattagtgcccattacagatctccactaaattactcaatctcacagctggagaactcatcagatgctatttactatatatttcagactcttcaagattgtaaagatgctgtatcaccattacttcaaggggaaactgagaagaatgaaaaggtacctcaaattaatgaggctgccaaggaatgcattaagaagttgaatgttgagtttcaaacaaaaatgtcagatgacttgcagacaccagtgatactaactggtgctcttcaagaggccttaaaatttgtgaacacttctttaaagatgttgaagaagaaaatgcagaaaagagctcagttgcaattgattcaatccttattggaagtggagaaagaagttggaaaagttttggacgtcctaggattattgtcctctaaatcttatgccgaggttctgcatcagttaaaagataaggcattgaacagagcag

SEQ ID NO: 69932 - DNA, 618 bp, Glycine max
  Peptide Sequence Number=SeqID_161617
atggaatcacaattccattatagacaaatctacaatgaatcgtcgaggggacacataggaagggagagcagaaggggaggaggaaggagaatgagaatgagaaggaaaaggaagaaggagaaagaaaaaggacgagtattaggaagaaggaagaagcaagaacaagaaagggaaagggaatgtggtgccaagaaggggaagagggaagagggatgggtggagaattttgaaattaggggtagaaggtcaaggaattcggtgaagttagtagcttattattcattaaaattccaacttgacccgagtgctgtgaagctggttggggtggtgttagcccatattttcgatgagctaaaatgtgctataagtatgcattggatgtcgtctcgaggttcgaagcatattacagagcaagagcctggttcaaaggagtatttacgaagtacaaagctaagacaagaaagaggacttcgagctattgggcaattcgaactggtgtatggacgagtcgaagtcgaggcagcaagagttctggacttagccaatgtggataaccgttctaaggagcagttatgtgcatatgagatgtacgtggcaggacacttggcattaggatag

SEQ ID NO: 69933 - DNA, 741 bp, Glycine max
  Peptide Sequence Number=SeqID_161618
atgtgggctcttctgtcgggaacccacaagacaaggggtcgaggaccttctgtcgcctccacttctacccctgctccaacttctacatcagcaccaccaccaccagctctcattcctgcacctccagcaccctcaagcactttcgctaaaacctcagacgccattgtgccaatgctgcagagccttcaccatggcatatgcctggtgatgcaaagcattcacgacctggctcagcatcggcccatcatcagtatggaggatttcatggcccaggtggcctggccaggagtccaatcttcccctgtggggggaggtgaggctcctacagcccaggagctgcatccagagctggaggtgacacctgaggccacacctgaagagacatcagaagctactgaagagggagatggcattgtagatgccgattacgttgcagacatgacaacaacgagagaattacggttcaaagcaaatttgttccaaatttgggggaatgtattgggtgatgttgattatggcaagaaaagcagtagccacaggaaattgtataaagaagcatttcaggccaaaagaagagaaagctcaagtgcggcatatccgcttaacgagtggcatccgttaagtgaggcatacagcttgcttagcgggttggaaaatcctagaagaggatcagtcagagatgtgctcgcccagcgtgtcgtcagcccacccaacgaggtcgttgtcctttcttgcgcttag

SEQ ID NO: 69934 - DNA, 132 bp, Glycine max
  Peptide Sequence Number=SeqID_161619
atgtcgacaagtgtaccgatttgcacaataagtgaattttggcttagtgagctaggtgcgctaagtgcgaaaagggacaacaacctcgctaggcgggctaacggtgcgttgggtgagcacatctctgactga

SEQ ID NO: 69935 - DNA, 81 bp, Glycine max
  Peptide Sequence Number=SeqID_161620
atgtggaaaggcggcgtggaagggggaataggaggtgcatgcggcgtaggagaaaagaaaaaagaagttatgttaagttag

SEQ ID NO: 69936 - DNA, 599 bp, Glycine max
  Peptide Sequence Number=SeqID_161621
gtggattttctggatttaagcatggacaacaatacaaccaacaacaaggacaatggaggaaccatcctgggaatcaattcaatagagaccaggggggatcattcataatatcgcaaccacaagggcccagtctctatgatcacaccatgaagctggaagagactctagatcaatttatgcagctggttgatgaactggcgttgaaaccagttgatgatttagttgaacttgaagaaattgttgaggaagcagaaggtgatgaagaaggagagatatcaataaaagactatcaagagagaataaagaaggaagaaaaagaagaagaaacaaaagaaaaggaggaaaaagtaaaaaaattgaaaaatgaaaaacaaaaagagaaggttgttgagattgaaaagaagaagggcaagagtaaggctaactcagaaaagaagaaaaaggttactcccattgaatgcatggaggtaccttatccattggtaccctccatgaaagataaagagcgacatttggccagatttcttgatatcttcaagaaactggaaattactttgccattcggagaagtacttcagaaaatgcctcttctatgctaa

SEQ ID NO: 69937 - DNA, 77 bp, Glycine max
  Peptide Sequence Number=SeqID_161622
atgggtttttcgcgaagatcttcagccgttcttcgacgttcttcgttcgttcgtcatcgttcttcggtcttcaacgg

SEQ ID NO: 69938 - DNA, 105 bp, Glycine max
  Peptide Sequence Number=SeqID_161623
atggagaagatgcatggagaagaagatgaagaacaaggaattaaactccatgtggagcttgtaggccttgtatcttcttcatcaatggagtcctttgcttcttga

SEQ ID NO: 69939 - DNA, 158 bp, Glycine max
  Peptide Sequence Number=SeqID_161624
atgacggagacgcgacatgcaaccgtaatggagacgcaagatgcgaccatggtcggagacgtgaccatggccagagatgagaccatggctggagactcgaccatgtgcttcatagttgacaccagcgaaggtggcgcaagacgctaccatggacagag

SEQ ID NO: 69940 - DNA, 633 bp, Glycine max
  Peptide Sequence Number=SeqID_161625
atggcacatgttgctgataaaataaaattgatagatggatcaagggaagctcttaagctttctataaggatcactgatctttggttcattgggattcccggaaagactgaacaagccgaaatggtggttgttgattctgatgatcagctgaagtctcgcaagactgatttgaaagagaatttgacttatgtgatgcataattttaaagttatcaagaatgatgggaaattcagagtttgtgatcatgaatataaattatgttttactggagttactgttgttaggcaatgtgatatggagcagttaccttttaggaaattcagatttgttgctttttccagtgtcattgctggtgattttaaaattagactcttggttgatgttattagtgtggttgatgaagtggtattccgacatgtgtcatccaaaaatacgagggttgttttgaatttaaaggatttgagtggccaggtactatcttgtacactctgggaaaattattgcttacagtttttgtcttatttgaatgatattgaagatgaaaggccgatcgttattctcttgactcatgctaggattaaggaagcacagggccagtgtaatgttagatttctcaatttccatgctttctag

SEQ ID NO: 69941 - DNA, 331 bp, Glycine max
  Peptide Sequence Number=SeqID_161626
ggctcttccggaaagtgcttccggaaccactgaaaggtcatccggaagaccagttcttccgaaagacgtttcagtggttccggaacaactactcttccggaaatcttccggaagaccttcttccggaagttccggaagaacccctaacgggtcttccggaagccgccaccgtcaccaagctgccattttttccggcgtcttctaccctaatgttccgtcttctaccctaaggttccatcttctaccaaaagggctgccggagaagctcgcggagaagaagttcgtcggggaagagagaacaaaagaagcttttgcggaagagactcagtga

SEQ ID NO: 69942 - DNA, 258 bp, Glycine max
  Peptide Sequence Number=SeqID_161627
atgaaagtaggtgcatcttataggatgccgtccatcgagggaaagataggtataaatgaaatggctccgaagaaactctccacgacgaggtctagaagagacgccacaggagaagggtccagtgccgctcccgagtttgatagtcatcgtttccagagtgccgagcaccagcagcgcttcgaggccatcaaaggatggtcgttctatagggagaggcgtgttcagctcagagaggatgagtatatggactttcagtag

SEQ ID NO: 69943 - DNA, 252 bp, Glycine max
  Peptide Sequence Number=SeqID_161628
atggatgagttcatgccacaggtggcctggccaggagtccaaccttctcctttagggggaggtgaggcttccgtagcccaggagcctcaaccagagccagaggttgctcatgaggccactctagaggcggcgcagagtacctgggatccttggcctacagcagcactggagacacctcagccagcccaggatactccttcttcaccttatggtgagcctgcaccagctcaggacgagcccattacttcttag

SEQ ID NO: 69944 - DNA, 330 bp, Glycine max
  Peptide Sequence Number=SeqID_161629
atgaagggaagaaggcataaatatgggtttaacaacaataaacgtgagaagccagagaagatcatgggttctccacctgcctcccctcctcctcctcctcctcctcctcctcctcctgctcctgctccttcgaacgcatcggcttcgtcgtctgccgtgaagtggacacgcaaagcctcacgtctacgatcgttgtccactagaccacctagtgctgagagaccagtggtccatgttgatcctgctaccgacaaggccgacaatccccacaggaagaaattaagaacatatttggggattgtggtgcgtgataaggtgtacgtcacctaa

SEQ ID NO: 69945 - DNA, 342 bp, Glycine max
  Peptide Sequence Number=SeqID_161630
atggtagccataaccctagccaaggttcatcaacctccatttctccgagaatacgactcgaacgcaacgtgtgcttgtcatggagaagccccggggcgttccattgagcatggtagggctctgaagcataaggtgcaagctacaatgttaaatgaaatggataaagttgatatctttgtccctcatcctctcacaaacgcatgtttgcttattcaactttcaccggaatgtgggtgtaagccattggtctgtttgctcaagcaacctgcgctcctaagtgttgacttccaagaccgttcaatcagagattactcatctcgcacgttggtgggggtgccgtaa

SEQ ID NO: 69946 - DNA, 289 bp, Glycine max
  Peptide Sequence Number=SeqID_161631
atgtcttcatctggggactccaaatgcatggtgttgcaacctacccttttgtgggcgagcgaggcgaggctcgcgggtgcgtcttccaaaggaggaaaatgcgcggagtcgccaccaatgtttatttgtggaaaacgtcggaaaaaccgaacgaaaccggtcatgaagaatattccaaattcgggagttgtatttacgtttgaggaaggtattagcacctgtcacgtcgacaaaaacggggctcttgctcctacgtaccctccatcgaagaggaaatcagacctacgta

SEQ ID NO: 69947 - DNA, 720 bp, Glycine max
  Peptide Sequence Number=SeqID_161632
atggctacctcaccaaaagaaacttcagctcctggttcaccctctgtaccatcatctccatcatccaccaaagcaccatcaaaccaggaacaacctgaattcaatatccaacccatacaaatgattcctggtcgtattgtgagtagcattctgaaaaatgcttctgtccctgatgctgataaagatgttccaacatcttccaccccaaatgctgaagtcctctcttcatccagcaaagaggaatcaacagaggaagaggatcaagccacagaggagacccctgcaccaagggcaccagaacctgctccaggtgacctcattgacctagaagaagtagaatctgatgaggaacccattgccaacaagttggcacccggcattgcagaaagattacaaagcagaaagggaagaacccccattactaggtctggacgaatcaaaactatggcacagaagaagagcacaccaatcactcctaccacatccagatggagcaaagttgcaatcccttccaagaagaggaaagaaatttcctcatctgattctgatgatgatgtcgaactagatgttcccgacatcaagagggccaagaaatcagggaaaaagacttgccttagaaagagaactgggaagagatgccttggattgcaaggagatcatggacctcatcaaggctgctggactgctgaaaacagtcaccaagttgggagactgttatga

SEQ ID NO: 69948 - DNA, 1067 bp, Glycine max
  Peptide Sequence Number=SeqID_161633
agcgtgatcatcaggcccggccaggctgtgcgaggcgtcgagcgcgatcggcagcgagaagcgcaggaaacgtaggcgcccagcttcagcatgatcgccgccagcacgatggagccgccggtgggcgcctcgacgtgggcgtccggcagccaggtgtgcaccggccacatcggcaccttgaccgcgaaggccgccagcagcgccacgaagatcaggatctgcggggtgtagcccagcttggtctgctgccaggtcaggatgtcgaacgaaccgcccgaggcattccacaggtagacgaacgccacaagcgtcagcagcgagcccatcagggtgtagaggaagaacttgaaggccgcgtacacccggttcggtccgccccagacgccgatgatgatgtacatcgggatcagcgtggcttcgaagaacacgtagaacagcatgccgtccagcgcgcagaacacgcccaccatcagacccgacaggatcaggaaggcggccatgtactgcgacacgcggctggtgatgacttcccagccggccagcaccacgatgatggtgatgaacgcggtcaggagcacgaaccacagcgaaatgccgtccacgcccaggtggtagttgacgttgaaggcttcgatccaggaggtcttctcgacgaactgcatggcagccgtcttggagtcgaacccggtgtacagcgggatcgtgacgaggaagccggcgatcgagccgatcagcgacaggccgcgcgtcaggccgggacggtcgtcacggcccaccgccagcaccagcaggccgaatacgatcgggacaaagatcgcaagcatgaagccggactgcaggtggcggctgatcgccgacacccagcccaccacgcgggcgctgccgttgatcagcaggccgtcgatgatgccgcggtcgccggtctgccacaggccacgacccaggcagcgcaggccgcgggcgatgatctgctcgttgacccagtcgacgtagtacttgttctcaagcaccttgttgacgcccgacaggctcgacttgatcgcggccgggaccttcgggttgatcag

SEQ ID NO: 69949 - DNA, 554 bp, Glycine max
  misc_feature (428)..(428): n is a, c, g, or t
  Peptide Sequence Number=SeqID_161634
atgtcctctcccctcggcggggatttcctcttcagcgaaggtgaggtagttgttggctgtgatgttattgacgatccccccaaagccttctacggagatgtcttgggctacttgtttaatgactttgaactcgctttgttggataatgcggaggaactcgccggcctcctcgagctagggggtgcgaacacacgaccgttgcgggttatgccactcagcccggtgatattggtcactctgggcgatagtgacctgatatcggtagcttcttccttcctaccgcccagaggggcatacctccacggaactgcacgactgttcttgtctttggggagccgtgtccctgttcacccagatgcattaagcaagaatcttttctgcgcccgccgtggggaatcatgcccaccttttgcaaggctttgtagatnaaccttctggaggtcgttatgtccttcaaatgtttgggccctcaaccacctggcttctaccaagctttggaccttgcttttcaaggccaagcactgttcgatcgactggcctgggattcccccatg

SEQ ID NO: 69950 - DNA, 244 bp, Glycine max
  Peptide Sequence Number=SeqID_161635
gcgaaagataaagatgtttgttgacccacaaaatgcaaacacaactacattgggtgaagttgcggagacattacaatacatggtgtctcctcaagggaggaatacatggacagttgacgatctcgtgccttatgtggagaaaattacaattttatccgaagagcaagaaagagtcactgagcctgtgtcacatggtccagcatcaaagcgtcaatttccagcgcaagagtttcacattctttag

SEQ ID NO: 69951 - DNA, 237 bp, Glycine max
  Peptide Sequence Number=SeqID_161636
atggagttaaggcagcgagtcgctgtgactgcggatcacgtcgatgagccagtcatccctgacccagatgttcaggatgacccgatggaggcaccagctgctgtggaggacattcctacggacgcaggtgcagaggcggctgaggatcagcctcaggaatttccgggtggtccgagcgacccatttgtgttgacagcgtatgcggatcacgttgcttgcaacgtatggacgggagag

SEQ ID NO: 69952 - DNA, 717 bp, Glycine max
  Peptide Sequence Number=SeqID_161637
atgtactcgaccttcgagaacaccttcatgatgtacctgccgcgcctgtgcgaacactgcctgaacccggcctgtgtcgccagctgcccgtcgggctcgatctacaagcgcgaggacgacggcatcgtgctggtcgaccaggacaagtgccgcggctggcgcatgtgcatctcgggctgcccgtacaagaagatctactacaactggcacagcggcaaggccgagaagtgcaccttctgctatccgcgcatcgaggccggccagccgaccgtgtgctcggaaacctgcgtcggccgcatccgctacctgggcgtcatgctgtacgacgccgaccagatcgagcgcgccgccgccgtcggcaacgagcaggacctgtacgaatcgcagctggacctgttcctggatccgcactcgcccgaggtgatcgccgcggcgcgcgagcagggcatcccggaatcctggctggaagccgcgcgccagtcgccggtctacaagatggcggtgcaatggcgcgtcgccttcccgctgcatccggaataccgcacgctgccgatggtctggtacatcccgccgctgtcgccgatccagaccgcggccgaggccggcaagatgccgcagcgcacgctcggcaccagcgccatgatcccggacgtggccagcctgcgcatcccggtgcgctacctggccaacctgctgaccgcgggcaaggaagccccg

SEQ ID NO: 69953 - DNA, 414 bp, Glycine max
  Peptide Sequence Number=SeqID_161638
gaagatgaagaagtccaagctctgaaattagagctagggaaggcaagacttgccaaagaaaagttcaagtcagccgctacaaacatccgaaaagagtgcaccgagttacgagaggaaaacgtggccactgcaagagcccttgaacaagaaaccaaaagggcccgcaaggaggaacgtggccgagataaattccgaggagctttgtggggtagcaacaatgagctcgagctccggagagaggaaagagaccagtcacgggtgcatggcatgatcttaaaagaagagttagctgcttgcgcaaggtccaagaggagtttggctcaacacttggaagccatggagcaaagcatgctagctatcatagggcagtacaaggaagagttaaaccagtctgtgacccatgaacaaagctag

SEQ ID NO: 69954 - DNA, 303 bp, Glycine max
  Peptide Sequence Number=SeqID_161639
atgccagtgtcggtcagaacgtacctgatgagaatcatgaaactggccaaatacaggctaaaggcccaagtggagaaggacgaaggcccaagtggagaaggacaaagcccccgcgtggagaaggatgaaggcccaagtaatccttgtggcgtctaccttgacttatcttccttcactggaagtggcgtctacccggacttatcttccttcaccggaagtggcgtctaccctgacttatcttccttcaccggaagtggcgtcatccaaatatccgtagcctgtatcaagcgatccgccccgtaa

SEQ ID NO: 69955 - DNA, 498 bp, Glycine max
  Peptide Sequence Number=SeqID_161640
atgctttgtgctcaatatccactggaagatgacatgcctttccaaagacaacccgataaggagacattcctatgggtgctttgtaggcagtccgatgtgcccaaagagaatcatcaagcctggggtggtatggtgtggataccctgtgtacaacctgtagaagcaaagcttcatgatgaatcaagattgattcaaagatgttttgatgataacaaaggtgatgacaaaaagctcaaagatgttcaagatgcttcaaggttcaagaggaaatttgatttcaagaatcaagaatcaagattcgaggttcaagcttccaagaatcaagatcaagattcaagactcaagattcaagaatcaagaaaagacttaatcaagataagtatgaaaaggttttttcaaaaactgagtagcacatggttttttctcaaaacatgtttaccaaagagtttttactctctggtaatcgattaccagattgttgcaatcgtttaccagtaa

SEQ ID NO: 69956 - DNA, 273 bp, Glycine max
  Peptide Sequence Number=SeqID_161641
atggccggcagcgggcaacaaacgcaccgccgccacctccagagcccctcagctcatctacaaaggctggagcgttgcctacgacccgtggccgaccaacaggtgaccaagtccaaagataaagctcaagacgttaaagaagcgctactaggaggcaacatagaattggctacgaagaagctccctgcgaagcggtccaggaagggcaccattgaagaggattccagtgtggcctcacaagctgacacaagctttgacaaacaccaattctag

SEQ ID NO: 69957 - DNA, 973 bp, Glycine max
  Peptide Sequence Number=SeqID_161642
acgatcctaagtcagcctttgtgcaatgaaggttcatatctcctcaccttcaaaggactacatgtcttcaccttcaaaggactacatgtcctcgccttcaaaggactacatgtcctcgccttcagagggctgcgtaccctcacctttagaggactacacatcgtcacctttagaggactacacgtcctcgccttcagaggactacatgtcctcgcctttagaggactacacgtcctcgccttcagaggactacacgtcctcacctttagaggacgacacgtcctcggcttaagaggactacacgtcctcaccttcagagggctgcacgccctcgccttcagaggactacacgtcctcacctttggtggactacacgtcctctccttaagaggactacacgtcctcaccttcagaggactacacgacctcggcttcaaaggactacatgtcctcacctttatagggctacacgccctcgccttcagaggactacacgtccttgccttcagaggactagacgtcctcaccttcagagggctacacgtcctcgcctttagagggctacacgtcctcaccttcagaggactacacgttgtccccttcaaaggactacacgtcctcaccttcaaagactacacatccacgcctttcagagggttgtgtaccctcaacgtcaaaggactacacgtcctcgccttcagaggactacatgtcctcgccttcaaaggaccgcacgtcctcccctttagagggctacacgccctccctttcagagggctacacgccctccccttcagagggctacacatcctcagctttcgaggactacacatcctgaccttcagagggctgcacgcccttaccttcagagggccgcacgtcctcgccttcattaggatacacgccttgatgagaataatgaaactggccaattacaggctaaaggcccaagtggagaaggacgaaggcccat

SEQ ID NO: 69958 - DNA, 162 bp, Glycine max
  Peptide Sequence Number=SeqID_161643
atggatacctcagagccctacactggggcaatgaaaggcaccatgcataaacctcaagcgaacctaggggaaccttacactagggcaatgaggggcactgtgcatgagcctcaagcgaaacaaaaaaagcgggggacaaaccctgggatttcaatggattga

SEQ ID NO: 69959 - DNA, 318 bp, Glycine max
  Peptide Sequence Number=SeqID_161644
atggaaacgtgtccaacggtaagagatctattacaacaaatgatagaccaagatcggcttaaggtcagcaataagggggaagaggaacaacatatatgcatgcaatcggcagataaggaaggtcctaaaaggcctaaacccttgataatacacttcaccaaggacatggctccccaaaggccccgacaccccttaacagtgtcgggtgtttggcctattctgtttccttacaagaacagtcacgcagttccgtggaggtacgcccctccgggcggtatgaaggaagaagctatcgacgtcgcctctctatcgaccaaa

SEQ ID NO: 69960 - DNA, 1200 bp, Glycine max
  Peptide Sequence Number=SeqID_161645
atggcatttttagtagaacaaggtggacttttaggtaataattggtatttgatatcattgtcttcattgattgtctttcagggaagagatgacttccaaataacccttcttcgaattttcgagtctctcacagaggaatctcctgtgattcttggtaatcctgacattttcatacgtgaaatcctccctagttcgacagttctctacaaggggaacaaggacggtgatgccagatttttgtgccttaaaattctttttgatgtgatgatcattcttttgagtgaaccaattgaagaagagcatagattgaaggatctgaaattcgtatcaaatacccattttcttcctctctacccaaccttgattgaagatgaagatcctattcctatctatgcacagaagcttcttgtcatgctaatggagttcagttttattacaattcctgacattctacatctgaagacaatttcacaatgctttgagttcttgctgggtgatctctcaaatgcaaatgtgaataatgttaagctgtgtcttgctctggcttctgctcctgagatggagtccaaattactctctcagttaaaggtggttaggaggattggcaactttcttgagtttgtatatgcaaagggtatggaagatttgctggatccaactcttgggctgtgtaaggcttttctagcacgttcagtcagctgcacaaaaggcttcagctacacaacagaaccaattctcttaggtgactgtcctcctgagttgagtggtggtgctgttgatccccagcaatgcataaaagatatagcagactttggaagcaatgtcggtgtcttactagagttgagtgcctctgcagaaaccagtattgctgatatagcttctgaatgtgttgtcttactgctcaaggcagctcctagagaagccacgactggtatactaaccaatctccccaaggtgactgtgatcctagagagctggaatagaggcattcctcacttgatggtccagcgaatgcttcacgctttaggttatgcttgcaagcaatacttactgcatgcaatgatattatcaatatccaaacctgagatttcaagaactgaagtcatagtttctgaactcaaaagttcaggtggatcagctttagccaaaacagctgggctggcagccttggaattgcagcggttgcctcgctgcatttga

SEQ ID NO: 69961 - DNA, 828 bp, Glycine max
  Peptide Sequence Number=SeqID_161646
atgtctgtgagcatcttggatgggaaaatccaacgaaaaaaggtgaaagacattctggctaagcaagtgatgaatgaactaattcagcgaacgtcttcttctctgtacaaccatgctctgtacaaccatgatcatacgggaacaggaagcataaatagtagtaataatgatcaaagtaaggagaaaggagggtttcagaaaataagaagaacggattcacctattttgattgcaacaaagatgggagtgaccgaaatggttgagaagattcttgagatagacccggtggcaatccttgacgtggacgctgataacaagaatgttgttctttcggccatagagaataggcaacctcatgtttacagcctgttgaataagaggagcatgattaaggagactgcatttcgtcaagtggacaaccaaggaacagtgcattgcaccttgctgccacctataggagttataaaccttggcgtgtccctggtgctgcaatgcaattgcagtgggaatacaagtggtataaggacatcctctatgcttgttaagaactccatgccaccaaatttctatgaacgttacaacaagaacgggcaaacagcaaagcaggtattcaatagtacacacgaaaagctcgcaaaagaaggtggtaaatggctgaccaaaacctcagaatcatgctcgttggtagcagcacttgttgcaaccgttgcattcacaacctcaacagctataccaggtggtccggatcaaaacacaggctatccattgtttcaaggaagacctgctttcaacatcttcgctgtagcatcactagcttgttgcacttag

SEQ ID NO: 69962 - DNA, 1614 bp, Glycine max
  Peptide Sequence Number=SeqID_161647
atggaaccccaatctctccctcctcctcccaccatggacgacgcccaagacccttcctcaatttgggacttctcttacctcctcgacttcaacctcgacgaccaagatggtatttttactagcagtaactctctccctcttcccttaaacgacgacgacgacgccgccgctcccgagatttctcaaaacgacagggtccgaaagcgcgacccgaggatgacatgctccaacttcctcgcgggtcgggtcccctgcgcctgccccgaactcgacgcgaaactcgaggacgagggtttgcccgtcaagaaacgcgcccgcaccgcgcgtgcatctgcgtccgcacgctgccaggtccctggctgcgaagccgatatctcagagctcaaggggtatcaccgccgacacagggtttgcttgcgctgcgctaatgccgccaccgttatgctcaacgacgaggccaagagatactgccaacagtgtggaaagtttcacgttttgtcggatttcgacgaaggtaaacggagctgcagaaggaagttggagcggcataataccagaaggagaagaaagcctccggcggattctggaggtgctgctcatagtgaactacttcaacctgttgctcaaaatgaggaacacaattatcatgtggaagctggaaaagataaagttggttttttgtgttgcaagaatgctcactggctgtgtacgaatcgtgcagattgttcaaatttgagtaccgatgtcaatgacgtaggagtgtctccagatcatgaagatgaaccggtctccattcccagcttggctccagatcatgaagatgaaccggtctccattcccagcttggctcccgaagcacagaatattaatagtgacagtgttgtgtctttggctgtttctggtgaaatgcgggtgaatagtgggaacacttctaattcaccttcgtattgcaacaataagaatgcctattcgtctgtggtcggatttcttttaagctttatgattggaatcctgcagaatttcctagaaggctacgacaccaagcagccaattgcatttgtgcagatattccaatggttggcaaatatgcctgtagaattggaaggatatatccgccctgggtgtacgatcctgacagtttttattgcaatgcctaacattatgtggataactgtaagggttcaacttgatgttctttacattatgtggttcttgtgtcatgactctttggagtatgtgcacgattttgttgctcctggaaagatgctgtctggaagaggcaccgcattagttcatctgaatgacatgatcttccgtgttatgaaagatggaacttctgtgacaaaagttgaagttaacatgctggcaccgaggcttcactatgttcatcccacatactttgaggctggcaaacctatggagtttgttgcttgtggaagtaacttactgcagcctaagtttcgcaagcaaaacgagagagatgggagttgcagcagcagcaaacaacaaacagaacaagagaaaccacaagctttgcagttgcagcaaacagagaatgagagagatgaaagagagagaacgagatggagtgggtttgagatgaagtgtgagtga

SEQ ID NO: 69963 - DNA, 819 bp, Glycine max
  Peptide Sequence Number=SeqID_161648
atggcaattgagcagcacaaggatgtggagagtggatatttgcaacagcccttcattcaaccagaggaggctgctgcttgtgaagaagttggatcagataagagtgtggaaaatggatccattggaatggtttttcttagcacacttgttgctgtttgtggttctttcacatttggaacttgtgtgggatattcagcacccactcaagcggctatcagagcagatcttaatctatctcttgctgagttttccatgtttggttcattagtgaccattggtgcaatgcttggagctataacaagcgggcggattacagatttcattggccggaaaggggctatgaggatttcaacaggattctgcattactggatggttagccgtcttcttctcaaagggttcttactcccttgacatgggaagatttttcacagggtacggcataggagttatctcttacgtggttcctgtatatatagcagaaatagcacccaaaaatcttcgaggaggactagcaacaacaaatcagcttttgattgttactggagggtcagtctcattcttactaggaagtgtaataaattggagagaactagcactagcggaaaggtataacaattggcttggtttgaattttgaagggctagtgccttgcatttgcttgctggttggtttgtgctttatccccgaatcccccagatggctggcaaaggttggccgcgaaaaagaatttcaactagctttaagtagacttcggggtaaacatgctgatatttctgatgaagctgctgaaattctggtactttccaagctctcttaa

SEQ ID NO: 69964 - DNA, 99 bp, Glycine max
  Peptide Sequence Number=SeqID_161649
atgttaggcatgacatcattctcaacgcagtttgtgaaaaggcagaacctacctcctagttttcatcatcatgtccaggttctaaggaagggaacttga

SEQ ID NO: 69965 - DNA, 882 bp, Glycine max
  Peptide Sequence Number=SeqID_161650
atggcatcagcgctggcgttgatgttgcaatggcacgaagcattcagctcctacgctggctccgcaagtgcgatcatcgacccttccaaggtcaaacaagtttcgtggaaaccgagagctttcgtttacgagggtttcctgacggaattggaatgcgatcacctgatttccatcgccaaatcggagctgaagagatccgcggtggccgataatttgtccggcgagagcaagctgagcgaagtcagaacgagctccggcatgttcattcccaagaacaaggctggtgcaaaatcaataggtgccggagctgctataattgcttcgatgggagttgctgtagaaaatggagaagacatacaagtattaagatatgagcacgggcaaaaatatgatcctcattatgattactttgctgataaagttaatatagctcggggtggacaccgagttgccacagttctcatgtatctcactgatgtaaccaaaggtggtgaaacagtgttccctaatgcagaggaatctccacgtcacagaggttctgaaacaaaggaagatctctctgagtgtgcccaaaaaggaatagcagtgaaaccgcgaagaggggatgcacttcttttctttagtctctacccaaatgctatcccagacacaatgagtctacatgcaggatgccctgtaattgaaggtgagaaatggtcagcaacaaaatggattcatgtggactcatttgataagatggtggcagatgggggggattgcaatgataagcaagaaaactgtgatagatgggctacccttggagaatgcactagtaatcccaattatatggttggatcaccaggccttcctggctactgcatgaaaagttgcaaggcatgttag

SEQ ID NO: 69966 - DNA, 687 bp, Glycine max
  Peptide Sequence Number=SeqID_161651
atgaataccatattagacctggaagctttagagattgaagagggctctcctaggagtcaagggtctgaaaccccaagttcaagggccagcacttctgattcggagagtcagggatcttttgctgggacacctaataacaataaccagtggcgtggtttctttaaactactcaagaaaggatcccaaatgcctttccaaacttttcacccacttaaaaatgttccaaaactgacaagaagaaaaagcaagagaatcagggaggacctcattccatcactgaatgcagcatctcttgacactgagtttggctgcttcaaatcttcctggaaaaacttcaccctcgcggagatccaggctgcaactgatgactttagccatgaaaatttgattggggagggaggctatgctgaggtttacttgggcaaattggaggatggaaactttgttgccattaaacggttgacaagagggtgccaagaagaaatgactgcagatttcttgtctgagcttggcattatagtgcacgtggaccaccccaacatagctagattgattggatatggtgttgaaggaggaatgtttcttgttcttcaattgtctccacatggtagcctgtcatccatactttatggtatatatactaaccattttgagagtttctggaatgccatgcaaattttgggataa

SEQ ID NO: 69967 - DNA, 1335 bp, Glycine max
  Peptide Sequence Number=SeqID_161652
atgggttgtgtccatggcaagtgctgtacccgttacccttcaccctcagtgggtggctccagagacttcagagaacttggcccttactgtgcccaaaggaagcacattctcactcagagttcactgcaatttgttcctgtcccttcccataacttcactttggaatactctgtgctcactcagagagggtactatcctgattcacctgataaagagaaccaagatagttttggcattaggacacagtttcaaggcaaccccagtgtccatttctttggtgtctatgatgggcatggcgaatttggtggccagtgttcaaattttgttaaggataggttggtggaaaatttgtcaagtgacattgcattgctggaggaccctgttaaggcctacacttctgcattcctgaccacaaatgatgacttgcataagaacgagattgatgattcgttgagcggcaccactgcaattacggtgctggttattgggaacaccctttatgttgctaatgttggtgattctagagccgtgctggctgttaaggatggaaaccgcgttgttgctgaggacttgtcctctgatcagacaccatttaggagagatgagtatgagagagtgaagctttgtggggcgagggtgttaagtgttgatcaggtggaagggcacaaggatccagatattcagacatggggtgatgaagagaatcagggtgatgatcctcctaggttgtgggttcagaatggaaagcttcctggagctgcttttacaaggagtgtaggggataagttggctgagactattggtgtcattgctgttcctgaggtgtcaacggttcagcttacacctaaccatcttttctttgttgttgcaagtgatggtgtatttgagttcctatcaagccaaactgttgttgatatggcagcaagttattcagatccccgcgatgcatgtgctgccattgctggagagtcttataaactatggttagaacatgagggtcgaacagatgatataacaattatcattgttcagatcaaaggcctgtctaatccccttaagaagttagctcgggctgttcctattcaggtgtcagttacatctggacttggagcaggtgagatcaatgtcagtactgtaacaaggacaaagagcaagagggtaaagggagcatccgaaatatctgccactactgggttagatgtgtgtcgttcagtcaggaatggtttctctgatttacagtcctgtccacagcatgtggtctcaactagaagcccagccatagtggtcccctctccggcatgtcaaacaccagttgtattggtacagtcacactag

SEQ ID NO: 69968 - DNA, 327 bp, Glycine max
  Peptide Sequence Number=SeqID_161653
atggtatgcactcatcaagatgagggtgggctagcttatagctattcagaatggagcaactggggtgatgcggaagccacccgggtagggcttatcaagcggtctagatcatatccacctcatccaaaagcggacttgaaaatcccaaatatatgttccgaaatacccagaaccctcaacaaaaccaagcactcacaccacagtagaccacaaccatattaccttcttcgtgatcaagggaagcaacaatgttgcatgggagaggaaagcagtgacaacgtcatgtgggagaaggaaagagtggcaaaccatgggagagggaagtga

SEQ ID NO: 69969 - DNA, 294 bp, Glycine max
  Peptide Sequence Number=SeqID_161654
atgggtcgagaaggaaagtgtttcgtgctattcagaagcttgggaaaggcttctcctgagttttgtgtaaagaatttggctcaatgggtagtgttaggtcgatatgctcctgtcttcaaaattcacaaggttgatgatgaggttttgcccttgttaatgctagaggatctcaaggatgtggggataaatgctgttgggtcgagaaggaaaatatgttttgtccaattcaaaagcttgggaagggcttctcctgagttgggtttttttcttcttttagcatgggagaattcttag

SEQ ID NO: 69970 - DNA, 1242 bp, Glycine max
  Peptide Sequence Number=SeqID_161655
atgactaaatcaacccctgcgacgtcgtatttgcactgcttcttcttttcttcaaattattattgttacgactctttgacttctccttcatctctttggctggagaaaacccttttcgccggaaaacccaccgcaaccttcgcggttcgcgattccgcttccgagcatatgggaaaaactagttggttgataatattggttacttgtttgtgcctgcttgccttttctgatggtagagaactcaaggttagacataaaaagcctcattaccaatacaatcatacgcttgctacaatattagtggaatatgcttctgcggtatacttgtcagatttaactgaactttttacttggacgtgctctaggtgtaatggcttgaccaagggatttgaaatgatagagttagttgttgacgtcgagcattgcttacaggcatttgttggagtggctgatgatccttgtgccattatcattgcattcagaggaacaaatgaacacagcttacagaattggattgaagatttatattggaagcagcatgatataaattatccaggcatggatgatgcaatggtacaccgtggtttttataccgcataccacaatacaacaatacgtcctgcaattttagatgctgttgaaagagcaaagaagttttatggagatattgaaattatagcaacagggcattcaatgggaggggcaatggcttcattttgtggacttgatttaacggtaaatcaaaatgaaaaaaatgttcaagttatgacatttggacaacctcgtgttggaaatgctgcttttgcatctctctataccaaactagttccaaataccatccgagtcacaaatgaccatgatattgtacctcatttgcctccatattattattatttaccgcagaagacataccaccacttcccaagagaggtttggctttataacatcggattaggtagtcttgtgtacaacgttgagaagatttgtgatgaatctggtgaggatccggattgcagcaggtcggtgactgggaatagcattgctgatcacttagtctattatggcgtagacatgggatcagatgagcctagttcatgcagaattgttatggattctcatgttcagaatactagcatcagagattcaagaggaaacttaatcttgtccagagatcctgcaacccccctcatcaaattgggtggagagggtgacaatcaggaaaatcccattaatgttgattga

SEQ ID NO: 69971 - DNA, 1110 bp, Glycine max
  Peptide Sequence Number=SeqID_161656
atggaactgggaatcagaagccctgtccatgcaacactctttcaccatttctccaattctcttctcttccctgcacgtctcaccctcttaaacactacctcttcatctttcatggctacccatttgcacgtctccagtgaagaattcgacccttctccttctcttgcaattggacaacacgacctcttaatcgttggtcctgggattcttggtcgtttagtggctcacaattggcgccaggaatattctggttgtcaagtttttggacaaacagcaaccactaatcatcaccgagagttaactgaaatcggtatcaatccgtctttgaagtggaccaaagcctccctcaaatttccctatgtcattttctgtgctcccccttaccaatcctcagactaccttggtgatcttaggctggctgcatcatgctggaatggtgaaggtgctttgctgtttacatcaagctctgctccttatgattgtaatgataatggattgtgtcacgaggatagtccagtggtgccaacagggaggagtcccaggactgatgtccttctaaaagctgaaaaaatagtgctggagtttggtggttctgttttaagactgtctggactttatatatccttttcaaaattcagtttactaggattccaactattcattcatctgggtgtgtctgcttccaaccttgacattttaaacaaagtagataaaggtgcacatgcttattggttagagaaggggatagtcgaatctcgtcctgatcacattctgaatcttatacactatgaggatgcagcttcactctctgtcgcaattttaaagaaacaatttcgtgggagaattttcttgggatgtgataatcatcccttatccaggcaagaagtgatggatctagtttacaaaagtgggaaatttagtaaaaagtttgagaaatttacaggatgctatcactgcgtaactcatcattgtaaaagcatgcctttgtatatttccttagcaggaaccgatgatcctctaggcaagagattgaacaactccagaacacgccaggaagtagggtgggagcccaagtactctagctttgctcatttccttgagaccatctga

SEQ ID NO: 69972 - DNA, 1150 bp, Glycine max
  Peptide Sequence Number=SeqID_161657
cactcctcttcataaagccgtgaccttaggtggaattggaattggagatctagatgtgcctaatcagaagcatgagatcgcagtcgcagccatgcgacagagttgttgggccaacatgccccaagagcttctccgagaggtcctcttcagaatcgaggcctccgaggacgcgtggccgccgcggaagagcgttgtcgcctgcgccggcgtttgccgcagctggagacaaatcaccatagacattgtcaaaacacccgaactctcctccaagatcaccttccccatttctgttaaacagattgttttatggttaaaaaatattgatgctgcggttagtcggttaccgttgcgtgaaggcaagggtgaagcactagctgaagatgggaagttccttcttgctgcacgcaaatgcagacgtccaacctgcacagattatatcatctctcttgatgcagatgatatgtcaaagggaagcaactcctatgttgggaaactaagatcaaattttcttggaacaaagttcacaatctatgatggccagccacctcatgcaggagcaaagattatgaaaagtcgctccacaaggctggtgaatctaaagcaagtttcacccaaggtccctacaggaaactatccagtggcccatatttcatatgaattgaatgtgcttggctcaagggggcctaggagaatgcattgtgtcatggattccattcctgccgctgcaattgaacctggaggtgtagctcctgtacagactgagttttctcttaacaacatagacatgtttccttcattccccttttttcgatcaaaatcaaatcgtgtggaaaattccgtgtctggaccattggttgatcaaaaggatgggatgctagtgttgaaaaacaaggcccctaggtggcatgagcagctgcaatgttggtgcctgaactttcatggacgggtgacaattgcctcagttaaaaactttcagctggtggcttctgcagaaaacagacctgctggaccagaacatgataagatcatcctccaatttggaaaagttgggaaggatttgtttacaatggattaccggttccctatctcagcatttcaggcatttgcaatctgcctcagcagttttgataccaagattgcttgtgaatga

SEQ ID NO: 69973 - DNA, 885 bp, Glycine max
  Peptide Sequence Number=SeqID_161658
atggccacggagcttctccaaattgatccccctcagctcacttttacctttgaattgaagaaacagagttcctgcttggttcatctcatcaacaacaactcttctcaccatgtcgccttcaaggttccttccttcgcctctcccacctcattcactctcctaactttgctgaatataaggtcaaaaccacgtcgcccaagaaatactgcgtcagaccaactgtcggcatcgtcaagccacacggaacatgtgatttcaccggctcagcgcacagccccacctgatctgcactgcaaagacaagttcctcgttcaaagcgcggttgtcccaaaaggaacaaccgaggatgaaatctcctctgacctgtttgtcaaagatagtggaaggcttgttgatgagaagaagctaagggtggtcctcattaactcaccttcttcccctgtaaatggagatctcaagcaggatccacccagtcaaatgcttccctcccttacagctgaaaaaggtatggaagcagctcaggatatggaggaggatggagctgataagggaacttttccaagtacaaggagtgttgagaaggtgggggacatgaagcaagtaaatgatgctgtgaatttgagttttgctactaaggattccgaggaattgaagtcaaggttgagtataatggatgcaaagctaagagaggctgaaggaaccatcatgaagttgaatgaagagaggcgcaggaacatccgagaaaaagatttgctgaagcaagagttggtagtagccacttttcatccccagaactctttccaacacaaattctcgcttgtaaacgcaatagaactacaggaactagcaaattatcactccctttcaatggacaatagaatttaa

SEQ ID NO: 69974 - DNA, 990 bp, Glycine max
  Peptide Sequence Number=SeqID_161659
atgtgttcggtagacactggcgatcagggacttttgtcctcatttgtcgagcggtggcaccgggagacgtctagtttccatctccctgtgggagaggtgacgatcacgctggacgacgtctcgtcacttctgcatatgcccgtagttggcgacttgcacgcctttcagcccttgcacgtggatgatgcggttcagatgctggtggacttattgatggcccttcgtgacctcagtcagaccggaaggtacgcctggggagtagttgcgctgatatatgagcactttccctcagtcacggagtccactgttgatcaggactatgacgaggattcaccgcgtgcctgtaggtggattgctacgaggaagaccatgaagagcatacatacactggcgtatagggagcgcctggaccgactccggattttggatgtctgttggatcctatatggggagcaccgaccggtccgggacttctatatgatttcatgctattccggtctcttgcgctgggggcccattgttttgtattaccgaccagagagggtcatgtggcagtttggatacacccataccatttatgctctgcctgtcgattcatggatgtcgtatgataaggtggatgcactattccttataggtggatgcactattcggatcatatggttccaggaggtgaggccaggcatcagatcctctgccagatggtcatgctccgtagccccgagtcgtccctcaggccccagagacagatatccctcatgtgccggagccaggagcatcgtcaacatctatgaggagcctagacatgcagtggaagtttgccatgggattgctgagaggttggagcgccatctgagcctagggttggtcacgcctggctcatcgacacataaggtgatcgaagaatgccacaggatggccaggagtgtcacacaagaccagctagtatatgttaggtctcgacgtaggcagcacacggatcaggcgtag

SEQ ID NO: 69975 - DNA, 270 bp, Glycine max
  Peptide Sequence Number=SeqID_161660
atgaccaaacttggtctctgcttgtcatcggctctggatgacaaaagggtgcgaataaccataagaatgaccaaacttggtctctgcttgtcatcggctctggatgacaaaagggtgcggataaccgtaagaatgaccaaacttggtctctgcttgtcatcggctctggatgacaaaagggtgcggataaccgtaaggtatctccgcgtatcatgggtgcagaatgaccaaacttggtctctgcttgtcatcgggcccctctctggatga

SEQ ID NO: 69976 - DNA, 348 bp, Glycine max
  Peptide Sequence Number=SeqID_161661
atggattcactcggtgggagtcgtcccctcaatgctccaccaaaaattgaaattcatggtggaggggtacttagtcattgttttgggggaggaagatgttctgaatccctcccgatgcagccccacatgtctggcgcggcaatgatggtggcttgtgtgatgttagggcacgactatgagcttggaatgggcttgggaaagaataatgatggcatggccagcttagtggacatcaaggaaaattgtggaaagtttgggcttagctataagcccacgcagactaatgtgagaagaactgtaacatcctggaaatttctacccggaatttttggaaacgatgcattttga

SEQ ID NO: 69977 - DNA, 387 bp, Glycine max
  Peptide Sequence Number=SeqID_161662
atgaccttcagagggccaaggaaggcctggggcaagagatcagaggtccccactacttcagcaccaccagagacagcagctccttcttcttccacagctccagtacctctcattcagactctagctattccttcagcatctacacatataccacttccagctcctttatctccaggactttcagatttttcatttacaccacagatgctgcactccatgctccagagcttacacaaggttcagtccattatcatacagagccttcagggcttaggcttgccatccatcatgagcatggatgagtttgatgtgcaagtggcctggccaggagcccagccttctccttctggagagggtggggcctccacatctcaggatcagcagtag

SEQ ID NO: 69978 - DNA, 205 bp, Glycine max
  Peptide Sequence Number=SeqID_161663
gcacagcccaacacgcgcactaagcgcgcgtcacgcgctaagcgagcaaagcagcacaggcactaagcgaggcgttatgctcgaaaatgcagaatccgttacgcgcgctaagcgcgagccacatgctaagcacgcgatccaacagaaacacatgctaagcctgcagcacgcgctaagcgaacaatctgaacgcgctaagcgcgag

SEQ ID NO: 69979 - DNA, 571 bp, Glycine max
  Peptide Sequence Number=SeqID_161664
gaacgctttaaatgagattgctgctgaggttgagcatctatgttatctcggcaacaatcctttttcttgtggttgtgtgatgagaagcacacacggtcttcctcgtggatggttatgtgaggccgaagtgagcatcaaggaagaggttgagaccatatctaaaagatttgaggaacttgatgtcaacactaaaggtgcaccaaagaaatcgatgaaaagaaggcaaatatccacaaagcatgatctgtcttactgggagtatgttgatgcttttcattctgttcaaagcagcaactcttcagtgaaacatagtgcatcatcttctaaaccgccgaagccaacaaggatcatcccgatgttggatcaatttgcaccatttatacagggtttcattcacaacgttgtggatgtgaaagcggacggtaactgtgaatatcggtccattgccgctttattagggatgagggaagattcttggtcgttggtgcgcaacaagttgattaaagaacttggcagatggttgcatgactacaccaacctcttcgtggcacagagagatttgaacaattaa

SEQ ID NO: 69980 - DNA, 727 bp, Glycine max
  Peptide Sequence Number=SeqID_161665
gactaatcctcaggagattgaagctaggctctgtattccccgcaaggggtttgttttgaatgctaagggccagccatggaagcttctcataaatgatctgacgacactggcccaaacatggagtgtcttttcttactccaacctggctcccacatcccacacctcagatctgaatatggatagagctaggttggtctatggcttggtgactaacatggacataaacatcggagcccttatctcaggtcagatctcttctattgctcagagtagctcctctaggctcggatttccagccttgatcactgccctatgcagagctagaggagttacctctaacaagggcgcgaggaaggcaagggtgagactagctgatgttccttcttcttctactctaccagctccttccacttctgctactcctacaccagctcctccaggctcatctactcaggactctcagtgctttgagtcaatgcttcagaagaaggtatcttggccaggaactctgccttcttttgtgagggaaggtggaggtcccagtgctcagatacctcagcaggcaagcaggtcacagccagcagacccgtctactccagtacttgagattccaaaggaccctgccacaccagtcctgggactgactaccactcttccagccactcctatgctacatttgacagatgaggagggcactcaggatcaggagacccagcaggatgattag

SEQ ID NO: 69981 - DNA, 246 bp, Glycine max
  Peptide Sequence Number=SeqID_161666
atggtgagaaaaagaataaaggagttgaaaaagaaaaaagagaaaaatgatgaagtggtgactaacgaaaaagtggaagagaaagggttaagtaaagaagagaagcaaaaatcaaagaaacaagccactaacaaaggtaaagttgtagtaaaccatccaccaattgagtatcttccttatccgtgtaacgacccgcctcgccactacaatatcaccactctaaacagcaagaatttcaatttttaa

SEQ ID NO: 69982 - DNA, 177 bp, Glycine max
  Peptide Sequence Number=SeqID_161667
atgggaagcaggaatggttcaggttatgaagctgaaatggtattgagcaacattgtggaaccgacactgctatctcaagatggctctgatttggataagcctgtttctcaagagacatttttggaggaatttaagatagtcagaatgagtgtggctaatcgtgttaatgtaaattaa

SEQ ID NO: 69983 - DNA, 255 bp, Glycine max
  Peptide Sequence Number=SeqID_161668
atggagcagtattacggcatttggttcgccagcaggcggccaaccactgggcacatcatgcagagccagggcgtcgcttctttttcatgccctactccagaccagttcagggcagaggtcgcatggcccggggattggcctgaggcccaagcaggagaggcacccccagaggctcctgacgatggagaggaggcccacgaggacgaggagatggccgatttgcttgacttcttgggagggagtggagctacatga

SEQ ID NO: 69984 - DNA, 186 bp, Glycine max
  Peptide Sequence Number=SeqID_161669
atggggagaccaaggttaagatgttttgcgagaatgctccaaccatgtgggatcggcacaggcttaaaagagctctcaaactgggtgacccccaaggcctacactccaaagagtttgttagggcctctccctcctgattcaggtccaacccctaaaatcatttttgcatgcagacactgctcatga

SEQ ID NO: 69985 - DNA, 684 bp, Glycine max
  Peptide Sequence Number=SeqID_161670
atgttagctactggtaatcgattactaccttctggtaatcgattaccagagagtaaaactctttgctctgagggtccttcaccaaagcaagtcagggtcaaaggccacctagtgaagattgatgccgacagcctcaaaacattcttagagacacctgtggtgttggcagagggtgagactttgcccacatactccagatactgcaagctgtccacatattacagagagattgaagctgccttatgcatactaggccgagggttcatcttgaacactgagggccatcctgggaagattctcatgaaggatttgactactctagctcaagtgtcgagcgttctctcaaactccaacctggcccccacatcacatacctctgatctgacagtggatagagctaggctgatcgttggcctatctaactcttctagacttgggtttcctgctctgatcaccgccctttgtagagccagaggggttgattctgacagcctagttttcgagcgcttgagcccgatcattaacttggcctacataaggaagaactgttggaatcctgatgatctgacagttactatccgaggggctaggagggcgagggtgagaccaactgagcttccttccacatctgtagctcctactccagcatccacttcagcaactccttctatcctagcttattga

SEQ ID NO: 69986 - DNA, 222 bp, Glycine max
  Peptide Sequence Number=SeqID_161671
atgggagaagttctcaatagtagaaaacaatcaagaagttctttcgctaagcgcaagccttgctctaagcacatctttggtcatgcactaagccgagagtctcaagcactaagcgcccaacccttgcatctgagggtgatttggtccgctaagctggccaaggctgagctaagccaacttcaattcgatctgaattcggctaatggtcgacgggatcgataa

SEQ ID NO: 69987 - DNA, 300 bp, Glycine max
  Peptide Sequence Number=SeqID_161672
atgcgaaggttgactgccaaaagcttagatcaaccacgaccaactgtccacgtcaacccttctactggtagaggatctggccctcataaagaaaaatttcatagttacctgggggtagtggcacgggagaatatccctatcgttcatactacttggaaggatgtcccaaaaactctaaaagttcttgtatgggatgacactttgaaaagtgatgtaattgagtctatgcaattcaaggcacccaacttcattgatatggcttggaactggtcaagattcattaagaggtcatcaccatga

SEQ ID NO: 69988 - DNA, 210 bp, Glycine max
  Peptide Sequence Number=SeqID_161673
atggggtggtttcttgatcaaggtgctgaggttttggataaagatcatgaaaagcacagggagacagcagtttgggactacacgtatccatggtttcaactaggaaagggaagaatcaaaagaattcccaggcggggtcctttgaattctcttggaaacggagaagggagacacaaaagaattcaggcggttagtcctttgttcttttga

SEQ ID NO: 69989 - DNA, 150 bp, Glycine max
  Peptide Sequence Number=SeqID_161674
atgagcaagaggctccaagaagattgggctagagctgctgaagaaggccctagggttctcatgaaccttaggggggctccatattgtagggtagggtaccctagaaatataggatttttcagcccttgtatttttgggcacctagactag

SEQ ID NO: 69990 - DNA, 648 bp, Glycine max
  Peptide Sequence Number=SeqID_161675
atgtctactgtggaagaagctttcctaattgccacctatgtcataagtaggctacccacttgtgtcttgcaaggtattagtccagttgaacacatgttgtcattctctcctttacccctactgtcaagtctctcatgttatgtgtttgggtgtattgcatttgtccattctcatagtccccatcgtggtaagttagacccaagagttgtaaagatgtccaagacactaatcttgaggaagcaccacaatgaagatgttgaaaaagataataatgaagcagaagagcaagatcaattctttggacaaaaatatcaaaggggagtgaagcaaaacccacttttatcccacagcaaattcaattgtctaaaccagagtctaggaagcattgaaagacagaaattgggttcaagacatgaatcaagagatgaggcattagagagaaactcaatgtgggacattgttgataaacccaaagataagaaagttgtacggtgcagagggatattcatagtgaagtcgatggaagagttcatgtcgtgtttcagaatgattcagacatctaagaaggtcattcagatgttgttgaagacatatacagttagaaatgaccctctcattttgtgccataaccgtctatttcttcaatga

SEQ ID NO: 69991 - DNA, 213 bp, Glycine max
  Peptide Sequence Number=SeqID_161676
atgatgtttgaaaaagtatcttattgcgacattggagtgacaaggtatgacgatggtgatgactatggagatgaaaatgatattaaggcagacattgaagatgatgacaatgatgaagaggaggaggatgacgaggttgagtttaagggagatgatgaatttgaaaatgttggtgtcaaccaccataatcacaccatagtgtttgcattgtaa

SEQ ID NO: 69992 - DNA, 465 bp, Glycine max
  Peptide Sequence Number=SeqID_161677
atgattcatggattatttaagagtaaaagggtggatgaggccatgaatctcctaagagaaatgctgcataaaaatatggttcctaatgcagtgacgtataattctcttattgatgatttgtgtaaatcagggagacttacttatgctttagatcttatggagaaggagatgcacccgagaggtcaagcagctgaggtagtcataaaaaaaaaagaaaaggccatttgttccaagtgggagaaacaattgaggaggatgtttaaagtaacaagatctggctcaattcctttgacttccatttgtttagaaagggaaatgggcttcatcttcacaaggggtcctaaaatcttgttaaattggaagatgggcaggcatcatcaacaacattatccatggatggaggctgagagtgaaagcaaagagggaaagtggggtttggaagaaaaggaggaaagttgggaatga

SEQ ID NO: 69993 - DNA, 933 bp, Glycine max
  Peptide Sequence Number=SeqID_161678
atggatcaaaatcaagcacgagaagacgaggttggctttcaagctctaatccagtatcaatcccgtcaaagtgctgttactgccagaagtactcttcaggttgttttacgtttacatggagcttgtggcattacttgccttgatgaactacaagtgaactacaataatgatcgttcaagggacttcacaaaccctaatctgcctacagagcagaaaggtcgatcttcacaacctggatatggtgatgcagcaggcatgtattcaggagccagggcaggtgggttctctcagatggccaatgctgcggcaattgcagctgcctttgggggaggtttgcctcctggcataactggaacaaatgaaaggtgtacagttcttgttgcaaatctcaatcctgatagaatagatgaggataaactgttcaacttgttctccatttatgggaacattgtcagaattaaacttctccgaaataagccagatcatgcacttatccaaatgggagatggtttccaagctgaattggcagtacattttctgaagggagccatgttgtttggaaagcgattggaggtcaactattcgaagcatgcgaacataacccaaggtgctgatacacatgagtatgtcaattcaaatctcaatcgattcaatcgtaatgctgccaagaactatcggtactgctgctcaccgacaaaaatggtccacttgtccaccctcccgcaagacataactgaagaggaggttgtaagccttttggaggagcatggaaccattgtcaacagcaaggtctttgagatgaatggaaaaaaacaggcacttgttcagtttgagactgaggagcaggctactgaagcccttgtgtgcaagcatgcaagtccactttctggatcagttgttcgcatctccttttcccagttgcagaatatatga

SEQ ID NO: 69994 - DNA, 855 bp, Glycine max
  Peptide Sequence Number=SeqID_161679
atgatgaaaacgccacctgttcaagattatattggaaacggggatttaccccctgataggataagatctgcattagtagggaacgatttcaagaaactatacaagcagggaagatttgaagaggctttggctttgtatgaccgagccattgctattgactccaagaaagcaacatatcattgcaacaagagtgcggctttgataagcttgggaaggtttctgcaggtaattgttgagtgtgaggaagctatcaggttggagccttcttatggcagagcccacacccatttagcaacaatttatttcagattgagagaggctgaaaaggcactgaattgcaatgaaacaagcccatgtgttgattccgtacttgctttccaagctcaggctcttcaaaatcaccttagcaaatacactgaagctcggaaagtcaaagattggaaagttatattaaaggaatcacaggctgcaatatccttgggtgctgattcagctccactggttagttggtttgaggatgcagtgacaacatctcagcaagcatctaagttagatccaagtagctttgaggtgaatgcagtggtaaggagggccagagcagtggcatcagccagaatgagtggtaacttactcttcaaggcatcaaaattcacggaagcatctgctgtatacaatgaaggactagagcatgatccatacaactcagttctgctatgcaatagagcaacatgtcattctaagctaggtcaattcaagaaagcaattgaagattgtaatgtggcacttatagttcagccaagttatagcaaggtaaggttgaggaggacagattacaatgtcaaggtgcatccctag

SEQ ID NO: 69995 - DNA, 1365 bp, Glycine max
  Peptide Sequence Number=SeqID_161680
atggccaaaagaacaagtccgatttacataggattcgtgattgtattgtgtgcctcaagcatgtttgtaatttgtatgggagaatgggaatcaacttggagcacaagagctgcagaagaagctgaggctgtggcagcaataccatgctcaggacatggaagagcctacttagatggtcttattctaaaagggcatgagcctgtttgtgagtgcaatccatgttatggtggatctgattgctccaacttattatctgattgtgctgccaatgctggaagtggagacccatattttttggagccattttggatgcaacatgcagcaagtagcgcgattttagtatcaggatggcacagaatgggatattcttatagtgatgaatcatacatctcacaactattggttgagtacataaaaaaacttcacgccatcgttgggaatgcagccactgaaggcaggtacattgtttttggaagtggctcaacgcaactcctcaatgctgctgttcatgccttgtctcccagttcttcagtgtctccggcaaaagtggtagccacagcaccatattatcccgtgtatagagcacagacacaatttttcaattctagagattttagttatgaaggagacacgtccttgtggaaaaacagcacagatagcaactctagatttattgagtttgtgacttcaccaaacaatcccgatggaaagttgaacaagggagttctcaaaggccctaatgtcaaaaccatttatgatcgagcctattattggccacatttcactgctattccttcaccagctgatgatgatctaatgctgtttacaatttccaagctcacaggccatgctgggagtagatttggatgggcaataataaaggatgaggcagtatatcaaacgatgttgacatatttgcaattgaacacctttggagtttcccgtgacgctcagctgagagctttaaagcttttggacgtggttcttgaaggagatggaaaagaattattccagtttgcatattcaaccttgaaagatcgttggaggaggttgaaacaaatcatatctgaatcaaaacggttttctctacagaatttgtctccccaatactgtacctttttcaagagggtcaaagatccttcgccagcatacgcttggttaaagtgtgagagacaacaagacaagaattgctatgaaatccttgaagctgctggcatcattggccgtcaaggcagtgactatagtgctgataatcgttacctgcgtctcagtctcattaggagcgaagatgattttgagatactaataaacaagcttaaaaatctagttccaacggaaaaggaaaccaaggattttaacaactag

SEQ ID NO: 69996 - DNA, 1344 bp, Glycine max
  Peptide Sequence Number=SeqID_161681
atgggtcacttcatttcacagaaatctcaaagttcaaccgaaaaattgcttgaatattactatttcataagaaaaactacgggagaatgggagccaacttggagcagtagagctgcagaagaagcagaggctgtggcagccataccatgctcaggacatggaagagtctacttagatggtcttattctaaaaggccatgaacctgtttgtgagtgcaatccatgctatggtggatctgattgctccaagttgttatctgattgtgctgctaatgctgcaggtggagatccatattttatggagccattttggatgcgacatgcagcaagtagtgccattttagtatcaggatggcatagaatgggttattcttatagtgataaatcatacatctcacaactattggttgagtacataaaaaaacttcatgccatcgttgggaatgcaatcaccaaaggaaagtacatcgtatttggaagtggctcaactcaacttctcaatgctgctgtttatgccttgtctcccaactcttcaatgtctccagcaaaagtggtagccacagcaccatattaccccgtctatcgaacgcagacacaatttttcaattctagggattttagttatgaaggagaaacatcctcgtggaaaaacaagacagataaaaactctatatttattgagtttgttacttcaccgaacaatccagatggaaaattgactaaggaagttcttgaaggtcctaatgtaaaatccatttatgatcgagcctactattggccacatttcactgctattccttcaccagcagacgatgatcttatgatatttacaatttctaagctcacaggccatgctgggagtagatttggatgggcaattgtaaaagatgaggcagtatatgaaaagatgttgacatatatggatatgaacaccatgggagtttcccgtgaggctcagctgagagctttaaagcttttggacgtggctcttgaaggagatggaaaagaaatattccaatttgcatattcgaccatgagagatcgttggataagattgaaagaaatcatatctaaaacaaaacggttttctctacagaaaatttcttcccaatactgcacctttttcaagaggggaagagacgcttcaccagcttacgcttggttaatgtgtgagagacaacaagacaagaactgctatgaaatccttgaagctgctggcattaatggccgtgaaggaagtctctatagtgccgataatcgttacgtgcgtctcagtctcattaggagccaagatgatttcgagatactcataaacaagctcaaaattcttgtttctaaggaatag

SEQ ID NO: 69997 - DNA, 375 bp, Glycine max
  Peptide Sequence Number=SeqID_161682
atgcggccacagctgtcaccctcacagcatgaaagattgcttgcatgtgcggctggtggtggtgccgccgccgccgccagtcgcagcgccggtggaggcgtcgggctcggggtcgtcgtcgagcatatccccgccaccttgatggtggaggaaggccatgccattgtggtgagcgttgatcggatccatgatcgcagaggaagaggaagaagagaatggagatggagaatgaagggtggttcattttttctttggaggaggggaagtgtaggaaagagaagattggatagaagggtttttagaatgattgttcttgggtggcttaggggcatcatcttttctgatgttattgctgtatccaattctcttacctag

SEQ ID NO: 69998 - DNA, 972 bp, Glycine max
  Peptide Sequence Number=SeqID_161683
ggtactcctcctcctcctcctcctcctcctcctcctcccacgcgtctaccaccaccaccaccaccaccagacaccttcgctgctaccttggagcgtcacctccctccctccgcctcctcctcctccccgtcccgcctcgccggcctcctctccaatcgcgatatcctcacctccctcgctgtcgacgacgacgtttcggagagaatcagcgtcggtgccggcgccatggcagaagcgatcgcgaagcagtgcggcgtccccaacgacgacgtcattttggaggaattaagccacgattgccctcagcgtggtgccttcgttctccctactgaaatccccgacgaaacccttagccccaacgccatccccgatcctaaccaagaccaagattctaccatgcaagccccgatccccaccatcctcactgtcatcgacgacgaccccgagcccgactcctccaccggcgctgcgacttgcggcggcggcaccaccaccagacgcacgacgaagcggaagaaaggcccgaagagaaccgcgctagagagaaggtctcgcaagaagctccaggtaatcgtcacaaccctaaatcccattcctttcacaccagcaaaaaccctcgatttcgagaggcaccagagtctcttacggcggctggggctctggtacttcgtccacgtcgagtttgattcggcgctccgcggcgatctcctcgctcagctcatcacgagctacgtccccaccaatcggtgcagctacgtcaacggggttaggatcaatgtgaaccgcgccgatctaggccgcaccttgaagcttccggtgaagaagactggttgcggtggtggtgccaccgcagattcgatagactccgcggaatctatagcgtttgctgaggaggtggtgtatagttggatgcttctgcatgatggatatattaggaagccaaacttggaatcgctgcacacatacaactga

SEQ ID NO: 69999 - DNA, 1281 bp, Glycine max
  Peptide Sequence Number=SeqID_161684
atgcttgcaaacaacttggaaaacttccttttcaggcttaaatttcaacatcaagttagttcgaaagatcaacctagtatgctatcaaaattaagagctcgtaaggcttgccaagattggaagccacctagagatgccccaaaaagtgtaaacttccatgaggagtaccacaaagctctaaggacaaaatcctacgttgatttctttgacaaagctcaattacttgcaaaccagccttctatttattccaaccacaataaattctcagaaatcctccttgaaccagaccaagaaactatatattccgttattgatcatatttcaaagacaccagaactaaagaatctcatgctcagttactttgacatcagtgctgaggcttctttcatttgcagccatcttctccaaagcatcaaccaagtccagtgtaattaccaattcattgaaagagctctaggtatcatggatgatgatgattctctagaaaaattcaaactaatcagttttgagctaaactcattcatcttctcaaaaaacccactttcaaaccttaacattaatcatgacttattcaagctcattagtgatgagaactcatcagtgttgttgcatcgtttgaaatcaatgagaaagaagttgggaaggaaagttaagctaatgacatatttgaagaaagcatcagaaatttgtgttgcagtgtatgacttagtggctatcactgccaatgttacagcagcacatactttaagcacactaatcatggggccaacaattctcaactttccatgcaagagtcttaataagagagagcttccacacttgaggttttcaagaagaaggtttcttagtaatgtttgtgatcagcttgatatagcagccaagggaacttatatattgaataaagactttgatacaatgactagagttgtggctcggctttatgatgaaattgaacataaaaggacaatggtgcaattctttttggacaagaaggatgataaattctctttgcaaatggtgaaggagcttaagaaaagtggtgatgggtttaggaaacaagtggaagaacttaaagagcatgtgtacttgtgccttgtgacaattaaccgagcaagatgtttggttactgaggaaatgacaaaaatgtgtacagaaggcattgggagtgtagacatgttgcttgctagttctgaacaagaaaaagtgaagaactccacaaggaaaatggtgggcaactcaaactccccggagtccaaagttagaagatatatggatagttag

SEQ ID NO: 70000 - DNA, 1740 bp, Glycine max
  Peptide Sequence Number=SeqID_161685
atgcaagaaagtgaagatgtcaaagaagaaatggccaaaaggaaaggcaaagagattgagtattttgtgaataagggaaaaggtgaagaacccaaaaggatggatatggaatcaaagaatgacctaaccacagagacaatgcaagaaactaaagatgtcatagaagtaatggtcaaaagaaaagacaaggagattaaaaattttgcagataaaagtgaaggtaaagaacccaaaagaatgcatacagaaccaaagaaggacttaataaaagagacaatgcaagaaaatgaagatgtcaaagaagcaatgttcaaagaaaaaagtaaagaaactgaatattttgttgttaacggtgaaggaggggaacccaaaaggatgcatatggaagaaaataaggacttaacaacagagacaatgcaagaaagtgaatatgttaaagaagcaatgagcaaaagaaaaggtgaagaagagattggctattttttgaatgagggtgaaggtgaaaaccccaaggggacgcatatggaggcaaaggacacaacagagataatgcaagaaagtgaagatatcaaagaagcaaccattaaaaaaaaaggcaaagagactgaatattttgtggatcaaggtgaaggtagagaacccaaaaggattcacacgaaagaaattgaatatgatagtgaaccaattgtcaaaagaaaagacaaagaaattgattattttgtggataagagagaaggtgaagaactcaaaatgacgcatatggaagcaaagaaagacatagcagaagaaacaatgcaagaggaaattaaaaagaataagaatggaactaaggatattgatcaagaaaatgtactagagaaaactgataaaggaaaatttgaagtaccaactgaagagttgcccaagctggttgggaggcaggatggaagtagaggactaaaggttgcaaagatggaagaacaaaaagaaattatcaaagaagcaatggcagaaaccgaatgttcaatggaaaaagtgaaaggagaaaagtccaatacaacaggcagggttactgagaaaaacatagcaagtgagatcttacagaaggaaactgaggagtccaacattgaaagaaaatctagagatggaccatatgtaccaaacaatatggtcaaagtagtatttgaagtgttggggactttccaggcaaagcttcccaagcaggtgatggaagcaatttcccaaaataaaagggataaaaatgaatatgttattgtgaacttgagaggagaaggctctataaagatgcatgttgaaccaaatgatgcttttgatgagtatgaaactgaggacataaatcagaaagaaatcggaacgccaaaactcaattctagtgaccaaataagtgagaaagataatgttgatgtttgggtatttgatggaagcaaaaaaccaaagtttccaaagataggacaaacaaactatgtcaaagatagtgccaaaatcgaggagtttgtgaagaaagtaaatgaagacaaatatgagaagacacaagttgaagaaaaaaggggtttgataaaagccattacaggggagtcaactcagacagaaagagaaggttctaagatccaaacaatagaaaaagatcaacatcgtttaccagaaaaaaggaacaaacgaagatttgaagcaagcacaactgcaaaagaagagtttcctgtgaaaacggtggattcactagctgataaagagagggactaa

SEQ ID NO: 70001 - DNA, 1046 bp, Glycine max
  Peptide Sequence Number=SeqID_161686
atgcgtgctacagcagaatttcaaggttctgttctgaatcttcgtggggttcaggttcactccatggagggttcaagcatggagcaagagcttgatttgtttcagaagcatgtcacggagcgattcctggagctatcttctgttgaaagtggtgaattgctctctctttcatgggttaggaagctgctagattcgttcctgtgttgccaagaggagttcagggtgattctccacaaccacagggatcaggtgatgaagcaccctcccttggatcgcatggtgggcgagtttttcgagcgtagcgtgaaggcacttgatgtgtgcaatgcaatccgtgatggaattgagcagattaggcagtggcagaagctgttggagattgttctctgtgctttggatcacaagaggagcattggtgagggccaatttcgccgtgccaagaaggcccttgtcgatttggccattgggatgcttgatgataaggactctagctccagtggctctatagcacataggaacaggaattggtctgctgctaggcagcttcaagcacttgggaacaacttgtcccctcccaaggccactgatattgttgccaccaatggccttgcattgcctatttttacaatgagttatgttatggtgtttgtgatgtgggcacttgtggcggcgattccctgccaggaccgcgggctggggctccatttctcggtgccaaagcagttctcgtgggcggctccggtggtggcgctgcacgagcggatcatggaggagtcgaagaagagggagaggaagaacacctgtggcttgctgaaggagattcaccagattgagaagtgtgctagggtgatcaatgatttggctgattctgtgcagtttcctttgagtgaggagaagggagaagaggtcaggcagagagtgcaagatgtttcgaaggtttgtgaagccttgaaagatggattggaccctctagaacgccaagtgagggaggtgttccatagaattgtgcgcagcagaaccgaggggcttgattctcatggtagagg

SEQ ID NO: 70002 - DNA, 3201 bp, Glycine max
  Peptide Sequence Number=SeqID_161687
atggaaaggcaatattgtgaaccagaagtaagcagtggcaaaagtcatgcaacgactaatgattctgtagatggggagtctggccataattctttgatgcagcaggagaagaaacctataagacccttgtccccttggattactgatatattacgagctgcacctttaggcattagaagtgactattttcggtggtgcagtggtgttatgggtaaatatgctgcaggagaactcaagccacctactattgtttctgctcgcggttctgggaagcatcctcaactcgtgccatcaactccaagatgggcagttgctaatggtgctggtgttatattaagtgtttgtgatgatgaagttgctcgttatgagactgctactttaacagcagctgctgtcccggcactcctacttcctcctccaacaacagctttggatgagcatctcgttgctggattaccggctctagaaccatatgcacgtttatttcacagatattatgccattgcgactcctagtgcaactcaaagactacttcttggacttttagaagcacccccatcatgggctccggatgcccttgatgctgctgtgcagcttgtagagcttcttcgagctgctgaagattatgcttgtggaataaggcttcctagaaattggatgcattttcatttcttgcgtgctatagggactgcaatgtccatgagatctggtgtagctgctgatgctgcagctgcattgcttttccggatactttctcagcctgctttacttttccctccactaaggcaagttgatggagtcgaagttcaacatgaacctttgggtggatacatttcttccaatagaaagcagattgaagctgcttcagccgaagccactattgaagctacggcccaaggcattgcctcagtgctttgcgctcatggtccagaggtagagtggagaatttgtaccatttgggaagctgcttatgggttgattccattaaattcctcagctgttgatcttccagaaattgttgttgcaacaccacttcaacctcccatactctcatggaatttgtacatacccctactcaaggttctggaatatcttcctcgtggtagtccgtctgaagcatgtctcatgaaaatatttgttgctacagtggaagctattcttcagaggacatttccagctgagtccactagtgatcacaaaataaaaacaagatactattgtgtggggtctgcctccaaaaaccttgctgtggcagaacttcgtaccatggtgcattcgcttttcttagaatcatgtgcatctgttgagcttgcttcgcgcctactatttgttgtcttaacagtttgtgttagtcatgaggtccaattcaatggaagcaagaaaccaagaggtgaaaataattatttagtggaggaaattattgaggatttacaagcagtatctgaaagccagaaagaaacaaaaaataggaaaatgaagaagcaaggtcctgtagcggcatttgattcctatgttctggctgccgtttgtgctcttgcctgtgagcttcagctgttccctatgatctcacgaggagacaatcactcagtccccaacaatgtacaaaatatagccaagcctgtcaaaatagatggatcttcccatgcattgcagaatggcatagattcagcaatacgccatactcacagaattttagcaattttagaggcgctgttttcattgaagccatcttctgttggtacctcatggagttacagctcaaatgaaatagttgcagctgctatggttgctgcacatatttctgaactatttagacggtcaaaagcttgcatgcgtgctctgtctgttttgatgcgttacaaatgggatgatgaaattcactctagggcttcgtcattgtacactctcatagatattcacagaaaagcagttgcatccatagttaacaaggcagagccattgggagcaacctttattcatacccctatttgtaaagacccctgtgatagaagtaaaagaaaaaatcagtgtgaaaatagtaggtgccttgatcctgggcagacatctacttcgacttctgaggattcatcccgctcaaaattcagcaaaaaaagtgagagaacttcatattcaaatgaagcatcaggatgtacctttgaaaaagctaccacaagtctcccatttgatgcttctgatctagccaatttcttaactatggacaggcatataggatttaattgcagtgcccaaatttttctgagatcgaggcttgcagagaagcaacagttatgtttctctgtagtatcactactatggcagaagttgattggatctcctgaaactcaaccttgtgcagaaagcacttctgctcaacaggggtggagacagtttttttaccttgatctgtcatattttctcttcccttctccttatctaaaccttgttgctgatgcattatgcaaggttgtatctgcatctcctacgaaagcagctatggcagttgttcttcaggccgagaaggaattgcagccatggattgccaaagatgacaatctaggtcagaagttgtggagaatcaatcagcggattgtaaaattgataactgaactattgaggaatcatgataatttggaatcattagtaattgtggcaagtgcatcagatttactactacgagccacagatggaatgctggtggatggagaagcttgcactttaccacagctgaagatgcacacccacccacatatctattcatcaattccttgctcctttttcttcatgtctttatatgagaaattaaagattttggagcagctattggaagcaacggcgaaagcggttcaaccagtgattgagttgggagaatctggacttggagtggcagatgggctttcaaacctgttaaagtgtcgcctaccagctacaatcagatgcctttctcatccaagtgcacatgtccgtgctctgagcagttcggttattcgtgacattttgcatactagttcaattggatcgagtcctaagccactgcaaaagaatggcatccatgatcagtacttaaattttgatgtcattgactggcgagctgacgtagaaaactgcttgacatgggaagctcacagccggctttcaaatggattgtctattgaatatcttaacacagctgcggatgatttaggctttgctatttctatctga

SEQ ID NO: 70003 - DNA, 1083 bp, Glycine max
  Peptide Sequence Number=SeqID_161688
atgtccttccgcagtattgttcgtgatgttagggacggatttggaagcttatcaaggcggagttttgatgtaaggctttctggtgggggcaagtcgaatagtttggtccatgaggagcacgaatgcctgccagttgtacagaacagccggtgggctagccttccgcctgagcttcttcgtgatgttattaaaagattggaagaaagtgagactacatggcctgctcgtaagcacgtggttgcgtgtgctgctgtgtgcaggtcctggagaggaatgtgcaaagaaattgttaccagtcctgagttctgtgggaagattactttccctgtctccctgaagcagcctggttcaagggatggaaccatccagtgtttcatcaagagagacaaatctaatctgacgtaccacctattcctttgtcttagtcctggccgaagccgtaggttttattcaaaaaaggtttctccaaaggtccctagtggcagctacaatattgcccagatcacctatgagttgaatgtccttggtactaggggcccgcgcagaatgaactgcaccatgcactcaatccctatgtcagcccttgagcctggttgcactgtcccgggccagccagagctccttccccgctcccttgaggattccttccgaagcatatcctttgctagatcgatcgataactcaaccgagtttagcagctccaggttctcggacatatttctggcaggcaaagaagaggagcagggaaaggataggcctttagttctcaagaacaaatctccaagatggcacgagcagctgcagtgttggtgcctcaactttaggggaagggtgactgttgcgtccgtcaagaattttcagctgattgctgcaacgcagccacctgcaactggtgctcctacgccatcatcgcagcctgctcagtctgatcatgacaagatcattcttcagtttggcaagggtcttgtcacgagagttttcattgctaaaagtgctctcactgtagttgtagaaaatattagtgggagctaccaaacaaatagcaatgggggagaaaaaggaataggatcaagtgatggataa

SEQ ID NO: 70004 - DNA, 135 bp, Glycine max
  Peptide Sequence Number=SeqID_161689
atggagtgtgaacatgatgcaaagaaaaggatgattgagagagagagggagaagctcaccgattatggatgtgacactgtgttgatgctgataacgagtgacacacgctatgcacccaaggttcatacttcataa

SEQ ID NO: 70005 - DNA, 249 bp, Glycine max
  Peptide Sequence Number=SeqID_161690
atgtgttctctactcactgacttcaacattttgaaggatctctccattgaacattttgaaggacttcccttagctgaaacaaaagttcagtataaagttatccaggtagccctttcagagatattgacaaccaactgtgtcagaaagaattgggtgggaattgtatttctgaaatgtaaacaatacaaaggcaccgagtctctgttctcagaaccctatatatacagagagtcagttaaagttgtctaa

SEQ ID NO: 70006 - DNA, 369 bp, Glycine max
  Peptide Sequence Number=SeqID_161691
atggttagggcaaatggcttggtgagacgtgtaaggcaatggcctaactggccttaccactgccacggttctgcctccctcccccgcgccgccagctccgccgtcgagcctacgccggacttcgattgtaccgccgccgcctactacaccagcctctgcgtcggtcgccacaccttcgacgactgtcgcgccttccgatccatcctcagcgtcgacgagcgcttacgcgagagcgcgccgctgcggagcgtctacgtcgccgtcgtctacaccggcggcgccgcggaggtgaggaagtcacagagtgttcggagagaagagtggaagattcagaagttgttcgtctggcaactccaacggtttggttag

SEQ ID NO: 70007 - DNA, 186 bp, Glycine max
  Peptide Sequence Number=SeqID_161692
atgaagaaaaagaataccgaaagtagacgagataaagatgaaaacatacaaagcatgaatggacccctaaggggttctgaacccttcatactcagcctccctcccctatttatagcaaaaataggggaggtgtttgccatccagctcgtcggggcaagctggtttcttcctaatgaagctttctga

SEQ ID NO: 70008 - DNA, 432 bp, Glycine max
  Peptide Sequence Number=SeqID_161693
atggcggcgcagctaatccatgatcgagtggagatggagtgcctagaggcaacttgggagaccctcgaaggcaacatgaggtgccgatttcggggcacgatccgattcacggctacttcattggagcatccagatgaacccgcgcgtacgcttcagcgcactgtggagtggatactacccacgcctaccccatatcgtctagtggagccagtccaagtgatcgaggtaacgtcgtccgaggaaggccctgaggaggatcttgaggagctaccttcgaagcctgctgtggatgctcttgactttctagagggtgatgaggatccccttcctgaggtggattctcccgaggaagtcacatcggcatctgaggcagactctacggaggatagtggcccgggagagatggcgatcagcggaggctcttcatcctag

SEQ ID NO: 70009 - DNA, 408 bp, Glycine max
  Peptide Sequence Number=SeqID_161694
atgaaaatacagaaaaaaggggttcccacagaccctaagagaataaaggtaattcctgattggcctactccaccaagtataagggaaatctggggctgccatgacttaataaacttttacaaaaggtgtcaagggaaggagcccaaagtatcaagaacctcgggatttgagggcaaatcctttccaaggggggagaggatgatgcaatcctatcccccaaggggggtgtgtgtagctaaggctctagcttctcatctcaaggagcttcctctcaaagcttcttatccaagacactctcttggtggtgaagctccttcttccatggcttattccctagtggatgacgcctcctctcacctcttctcctttatcttctgttgcacctccatggtggaaaatcaccattga

SEQ ID NO: 70010 - DNA, 774 bp, Glycine max
  Peptide Sequence Number=SeqID_161695
atgggaggcttgagcattttaagtgcccttccaaatttaactgccatcacagaggcaactgctgctgtcactcgccttttcgaaatgattgatcgagtgccgactatagattctgaagataagaaaggaaaggccttatcatatgtgaggggagaaattgaatttcaagacgtctacttctgttacccatctaggccagacacaccagtcttgcagggattcaatctcactgtcccagcaggcaagagtgtaggccttgtgggagggagtggttcaggtaaatccactgtcatacaactgtttgaaaggttttatgaccctgttgagggagtaatactcttggatggtcacaagactaataggcttcagctcaagtggttgagatctcaaattggcctagtaaatcaagagcctgttctctttgccacttccataaaagagaatatattatttggaaaagaaggagcctcaatggaaaatgtgattagtgcggctaaagcagctaatgcacatgatttcatagtcaagttgccagatggatatgaaactcaacctaataaccacaataacaagttacataagcagtataacactcaactgcgtgctggagaacatttatcttatgattctattcgtgaccaaaatcaattgcaaacaatgaacatgcccgaacaacaaggagaaaaacagaagatcaacctcaacaccaggaataacatacagcatttccagctgccactatcaatttctcttctgacttctcagcacttttga

SEQ ID NO: 70011 - DNA, 168 bp, Glycine max
  Peptide Sequence Number=SeqID_161696
atgcgtaaggagaaaataccgcatcaggcgccattcgccattcaggctgcgcaactgttgggaagggcgatcgggttttcccagtcacgacgttgtaaaacgacggccagtgccaagcttgcatgcctgcaggtcgactctagaggatccccccagtaccctgattag

SEQ ID NO: 70012 - DNA, 1159 bp, Glycine max
  Peptide Sequence Number=SeqID_161697
atggacgttgttgaactggtttccgctatggaagaaaaattcggcgtttctgctgctgctgctgtagctgtagctgctggcccggctgaagctgctgaagagaaaactgaattcgacgttatcctgaaagctgctggcgctaacaaagttgctgttatcaaagcagtacgtggcgctaccggcctgggtctgaaagaagctaaagacctggttgaatctgctccagccgctctgaaagaaggcgtgagcaaagatgacgcagaagctctgaaaaaatctctggaagaagctggcgctgaagttgaaggcgccagtagcgtttcacactgtttggctgctggagttctgggggaagacgcgatgaaatggtttaagcgtgatagcaagagacattgcggaaacgagctgaggaaccctatggtttactcctataccgagaaaaaacgtattcgtaaggattttggtaaacgtccacaagtgctggacataccatatctcctttctatccagcttgactcgttccagaagtttatcgagcaagatccagaagggcagtacggccttgaagccgcattccgttctgttttccctatccagagctacagtggcaattcggagctgcaatacgttagctaccgtcttggtgagccggtcttcgacgtcaaagagtgccagatccgtggtgtgacgttctctgcaccgctgcgcgtaaaactgcgcctggttatctatgagcgcgaagcgcctgaaggtacggtcaaagacatcaaggaacaagaagtctacatgggcgaaattccgctcatgaccgaaaacggcacctttgtgatcaacggtactgagagggttatcgtatctcagttgcaccgtagtcctggcgtattcttcgacagcgataagggcaaaacccactcttcgggtaaagtgctgtacaacgcacgcatcatcccttaccgcggttcatggttggacttcgagttcgatccgaaggacaacctgttcgtgcgtattgaccgtcgccgcaaactgcctgcgaccatcattctgcgcgcgctgaactacaccactgaacagatcctcgacctgttctttgacaagatcgtcttcgaaatccgtgacaacaagctgcagatggagctggtgccagagcgcctgcgtg

SEQ ID NO: 70013 - DNA, 447 bp, Glycine max
  Peptide Sequence Number=SeqID_161698
atggacagcctcattaccttcgaaaaattgacggcgcaacacctgccttacctgtatgagatccgcttttccgttgaggaaaacctgctgcatccgcatcagatccagtatctgcagcgcaaacaggcgctggaggacatcaaccagggcggcggctggatctgcaagcatggcgacgactatgccggcgttggcttcgggctattcatccctgaaccgctgatcggcggcctgttcgtgaagccggaataccagtcgaaggggatcggctccgccttgctggcacggatcactcactggatgtttgaacacggcgccgaagcgatccacttaaccaccgatcccggctccaaagccgaaggcttttatcaacatcacggctgggccgtggtcgggcaggatgaattcggccaggtcgaactggtgaaacgccaagagggtgactga

SEQ ID NO: 70014 - DNA, 717 bp, Glycine max
  Peptide Sequence Number=SeqID_161699
atgggggcggtggcgatcaacagcgtcagcgccggatccaagacgcagcccggcggctatgccgacgacgtgccgccggagttggaacagttcgagccgcacgacggccgcacgccacagcaggtcgccgaggccatcagcaacgccgggctgcagccggtgtggaaagactgggacgaaaacgctggagcggccgcgcaatgccgaacgccggcgctggcgccggtaacctccccggctatagtgaccttgccgaccgccaaacccggcgtcggccggggccgtcaccctctcgatggccccgccttatcccatcccggatcgcgccggagcttctcttgcgcgacgccgggccctcgtccgcggcaacgcgcatatggcgtatcgcggccggtaagggcgtacgggcagattgccttgtcggctaatgggcagtcagaaagatggcataacgatgtgcggcactcactcaggagtgatactcatagagcgctgtggcggcagaaaagtgggaacgaggataagaaggtacagcgacgaagagagattcgagtggtcatccccggtgctgccattggccctggtgttggccgcggatctttttgccgcctgctccctgcttacggacaagagcaggcggtttattttgtgagactggcacccccccaggacgcgaatcacacagtatgtgcgctaattaaccatacaaacgattaa

SEQ ID NO: 70015 - DNA, 300 bp, Glycine max
  Peptide Sequence Number=SeqID_161700
atgaccggccctctcgatgagtcaatctcttgctttctcataagggtggacccatgggtactagtacctattgacttcagaggattgcacgtcctcgccttaagagggctggacgcccttgccttcagaggactactcgtccttgacttcagagggctacacgtcctcgcctttagaaggctgcacgccctcgtcttcagagggctacacgtcctcgcctttggagggctacacgtcctcgacttcagaggactacacgttcttgacttaagagggctacacgtcctgtatatctattga

SEQ ID NO: 70016 - DNA, 303 bp, Glycine max
  Peptide Sequence Number=SeqID_161701
atgttacggaaccttgcggattacataatcatcccttttttgacttccggaatgttacggaacctcacgaattgtgcaacgatgcttccttttttatttccggtgtgtcacggaaccttacggattgtgcatcaatatttctttgttttcggcatgtcccggaatttcacaaattgcctaatgatgggtgccaagcacctcacaaggaccaaacaaaggtcgcatgtcatcaagcaaaggtccccagacgaaattagggtgttgaggaaagaatccatgagtttcaagaacctctggatttga

SEQ ID NO: 70017 - DNA, 225 bp, Glycine max
  Peptide Sequence Number=SeqID_161702
atggggtttttcttggtgggaaatttggctttgagtgtttttggcctttttcttttctgtttttgtttagcgcgaggcgaacaagtcaccgatgcacaagattttggcaaggtttatggtaaattgggattttggctcaaggcttgcagcacgcctggacatgatatatgtcaaggtttggttcggttcaaggataaaaggggatgtcccacatcatttctatga

SEQ ID NO: 70018 - DNA, 144 bp, Glycine max
  Peptide Sequence Number=SeqID_161703
atgcaacaaggacatgcatacatcctcatagttaggttccctgaccccaacaatggaattaatgaaacattgggcttaatccggattttggttgtggacttgaagagggcaaataaagcagcgcttaccttagttaatttctaa

SEQ ID NO: 70019 - DNA, 225 bp, Glycine max
  Peptide Sequence Number=SeqID_161704
atggttacctcaaaggaaatgaaagtttcaacggagaacaacaacggtttgtggtggctaatggtggctgtgggtgatggagaaagtgcttgggacaccaaatttggagacgatccaacggttaacgaaggctgggcagcgtttataccgaggcagcttcatgtggcttccttgagaagcttcattaagaggcttcctcaagaagattcctcgtggcttctttga

SEQ ID NO: 70020 - DNA, 243 bp, Glycine max
  Peptide Sequence Number=SeqID_161705
gctcatgagaaccctagggccttcccttggatctctggcccaatctacttggagtcttctatccaatgcccttgcggggattgaagtggatctgagaagagggaaatttgattatacttctactatgacttctggtaataggaggccagaggcaaatggaacaaagaaaaaagagggagaaacccataacgtgactatagtgcctacatggtcgagctccccgaaaacccctcacaaccccat

SEQ ID NO: 70021 - DNA, 264 bp, Glycine max
  Peptide Sequence Number=SeqID_161706
atggtttccggggctttcgtcgcttccgtaaaattttcaaaaaccttgggaggaagcaactgggcggcagactcctccacgtttttgaaaaatggtttccagggcttccgtggcttccgtaaaatttctgaaaatcttggaaaaatcgagtcgaagtgcttccgtaacgcctccgtaagcgattctgtggaaattcttcatcgttcttcgttcgttcttcgttcttcaacggctttcttttcttccatttttaacgtgctttag

SEQ ID NO: 70022 - DNA, 200 bp, Glycine max
  Peptide Sequence Number=SeqID_161707
ctattgattctattagaatccttacattagtacaagaagccttaaaggatgagaattgggttctagccatgaatgatgaaataggtgcattggaaaggaatgagaccttggagattgtagagagaccgaaagacaaaaaggcagtgggttgtaggtggatatatattgttaaatatcaggctgattgcatattggattga

SEQ ID NO: 70023 - DNA, 380 bp, Glycine max
  Peptide Sequence Number=SeqID_161708
tgactctcttccttcaacactttaacatccctcttgattctgaaccttatgttccaatcaagagatcctttttgattggtgctgctgtgattgcatcttttggttaccgcaaagagcatgatggatcttgggcaaaaaagggtgctcaacccattgatgatgaaggacacttaccagttggagaggattcctctctccttcaaaaatttttggataggttcgatggtcttcaaacctatgttggtgaaaggtttgatgctttggaactacaagtggacatgcgattcgacgagatggactcaaggatcaccaaggttgaaggagatgtcacttgcatccgcatatgctttgatctaccaccaccaccaccatcatcttag

SEQ ID NO: 70024 - DNA, 1224 bp, Glycine max
  Peptide Sequence Number=SeqID_161709
atgtcacttggtttaaccatcgtgtcggaaattgcgctgccgatgattctcggcgcgtcgagcattggtttgattgtgctgctggtgcagagcgtcgaaggggaaaaggaggcgattgccgcgcgtcaggccaagctggcgctggagattgccaacaaaaccctgccgctgtttcgtcaggttaatagcgactcgctgcgcaaagtgtgcgccatcattcgcagcgacatccatgccgatgcggtggcgatcactaacaccaaacagattctggcttacgtcggctacggcgagcagaactaccacaacggcgacgacggcatcagtccgaccaccgcgcaggcgatcgccagcggtaaaattatcattaagaataatgatgaggcacaccgcaccaaagacattcactcaatgctggtgattcccctttgggaaaaaggggaagtgaccggcacgctgaaaatttactatcgccgcgcccatcgtattactggttcactgaaagagatggcggtcggtctgtcgcaaatcatctcgacgcagctggaagtctcgcgtgccgagcagctgcgcgaaatggccaataaagccgaactgcgcgcgctgcaaagcaaaatcaacccgcacttcctgtttaacgcgctgaatgccatctcctcatcgattcgcctgaacccggacacggcgcgccagctggtgattaatttgtcgcgctacctgcgttacaacctggaactcaacgacgatgaacccatcgacatcaaaaaagagctgtggcaggtgaaagattacatcgccattgagcaggcgcggtttggcgacaagctgtcgatgatttacgacatcgatgaggatctgcacttttcgctgcccagcctgctgatccagccgctggtggagaatgccatcgtgcacggtattcagccctgccgtggcaaaggcgtggtcacgctgagcgtgaaagatctgggcgatcgcgtgcgcgtggcggtgcgcgataccggtgccggcatcagcgaagaggtggtcagccgggtggcgcgcaacgaaatgccgggcaacaaaattggcctgctgaatgtgcatcaccgggtgaaactgctgtccggccacggcttaaccatcacccgtcatctgcccggtacggaaatcgcctttaccctcagcaaaagtggtcagcggctgtccggcccgctcaccccgttagcggaaacctcagcgtga

SEQ ID NO: 70025 - DNA, 1317 bp, Glycine max
  Peptide Sequence Number=SeqID_161710
atgcctgttcatgtgacgacatccgcgctgcgcttaagcaagggcgcaatgccattcataccggtttcacagcagttcattccgtctcccgctccgttcacgcccgtccgcgccacccgcgcccgcgtgaggcttattatcgctgcagattccgtattcccggatgggagagagaaaatgacaacagccgttacccctaatcatcagcgtgtccgtatccttaccctcgcaggcaccatcattacccagttcgcgctcggctcggtttatacctggagcctgtttaacggccagctggcgcaaaagctggatgcgccggtcagccaggtggctttttcctttggtctgctcagtcttggtctggcgattgcctcctcgctggccggcaagctgcaggaacgctttggcgtgcgcaacgtcactatcggtgcaggcattctgatggcgattggcttctggctgaccgcccatgctgacaacctgatgatgctgtacctgagcgccggcattctggtcgggctggccgatggcgcgggctatctgatgacgctctctaactgcgtgaagtggtttccggagcgcaaagggctgatttcggcctgttcgatcggcgcttacggcctcggcagtctcggctttaaatttatctgtggcgcgctgctcagcactcaggggctggaaaatacctttgtgatttggggtgtgctggcgatgacgatgattattgccggggcactgatgatgcgcgatgcgccgctgcagcaggccggttcacgtcagcaacaggccacacaggagtttacgctggcgcagtcggtgcgcctgccgcagtactggatgctggcgctgatgttcctgacggcctgcatgagtggtttgtatgtgattggtgtcgcgaaagacattggtgaaggcctggtgcatctgagcacgcaaacggcggccaatgcggtgacgataattgccattgccaacctgagcggacgactgattctcggcgtgctgtcggacaaaatggcgcgcatccgggtcatttcgctggcacagctggtttcgctgagcggtatgagcatcctgctattcacccacatgaatgaaaccaccttcttcctgtcgctggcctgcgtggcattcagctttggcggcaccatcaccgtcttcccgtcactgcgtgcttggctcgctggtagcttcggtattcggcggcttcaccgtgaccttcagtctgattatgacgctgctggtgatctcgctggtgctgtcgctcagtatccgtctgccaaatcgtcaaaacctggtcgcgccggtactgcataa

SEQ ID NO: 70026 - DNA, 222 bp, Glycine max
  Peptide Sequence Number=SeqID_161711
atgtctcagaacttcacgaaatgcctaacgatgggtgccaagtaccttgaagtggccaaacgagggtcgcatcccaacaatgggtggtccccggacgaaattaggggaagtaaagataagacattaatttggttcaagcgaaacaacattcagccagtgaatcaccctgtcagtggaacctgcaaaaatttgaaaatgatcagtaccgacacatcatcctga

SEQ ID NO: 70027 - DNA, 681 bp, Glycine max
  Peptide Sequence Number=SeqID_161712
atggctcgcaaaacccaagctcatctcttggtgagtttcacaggctcatcaaacccaaggtccacccttggtaagtctcacttctccaaaggctcgcaaaacccaaggtccatccttagtgattcttgcttctccaaaggttcgtcaaagtcaaggtccacccatggtgagtcttatttctccaaaggctcacaaaacccaaggttttccctcggtgagtcttgcatctccaaaggctcatcaaatctaaggtctgccctttgtgaatctcacttctccaaatggtcatcaaaaccaaggtccatccttggtgagtctcgtatcttcaaagcctcgacaacccctaaggtctgtccttggaactcaaggtacacaaggtctaccattgacaatcttttctatccctattattcacttttatatgtgcaagaaaacaagtttgcaggaacaccacaaacccaaggtttgcccttggtacaaaaacccaaggtccatccttggtatgcactcctacaaaacccaaggcccaaggcacacccttggtcagctcacttcttgggaacttcgacaaccatagtcaaatgtccaggtttcgtaagtctaaacaaactaccaccagacttgtcagcaagaccttcaaccaggtggaagtctgatccaggccgtacccgaatcaaataa

SEQ ID NO: 70028 - DNA, 789 bp, Glycine max
  Peptide Sequence Number=SeqID_161713
atgaaggccgaaaacacatacttttcacatgagatgcggagagtgcactattactcttcgggatgtctctattttattccgtatggatgggtcaccgttaattggtggctgggacgtggaaatcaacatatcggcaatgatgatttgatagtttttcgtcacaaattagatattatgaaacgacatgagtttgtgtgggagccttacacagcaaatattatgttagtgttgcctccaatttgtttagttggaagtgtagcgtgggttgaaagttatcctcgacaagaaggcctactgagctttaactccgactatatggtctgctataggcgaaaaatgaagatatttgttgaccctaaaaatgcaaacacaactacattgcaaaagagaatcattgagcctgtgtcacatcgttcagcaacagaacatcaatttgctgcacaagagtttcatattctcccgtcaagtgttgaaactcaagacatggtaagacggagggaggttgttgaagcggaaccatatttgtatccacagatggtaaagcgtggccatgaaataaacatatcccaatttttcatgacctactatgacccttcacaacaacatgatgctccaattccaacacctaatgcctcattaggtgctgatttacgtcaccaattttctgctgaggctgaccaagttgaagcggggagacattggcctagaaaaaatcctgatagacaagcacgaagatgggaacgacaatgcggcacattctcacgtcatcacggacatcataacgattga

SEQ ID NO: 70029 - DNA, 708 bp, Glycine max
  Peptide Sequence Number=SeqID_161714
atgtccaatcctgaaaagttcacacttcaaattcgagtcaaagtggcaagccttcttcatgatgacgtattggatgatgcggataccagacgtggtattggttcattgaattttgtaatgggcaataagttggcagtgttggctggagattttttgctttctcgggcttgtgttgctctcgcctctttgaaaaatacagaggtaagcatggaatattatatgcaaaagacctactacaagactgcatctttaatatcaaatagttgcaaggcaatagccatccttgcagggcaaacagcagaagttgcaatgcttgcttttgagtatggaaaaaatctgggtttggcatttcaattgatagatgatgttcttgatttcacaggcacatcagcttcccttggaaagggttctttatcagacattcgtcatggaattgttactgctccaatattgtttgctatggaggagttccctcagttgcgtgcaattgttgatgagggcttcgaaaaccctgcaaatgttgatcttgctctggagtatctaggaaaaagccgaggtatacagaggacacgggagctagctgtggagcatgctaaccttgcagcagcagcaatcgattccttaccggagaacgacgatgaagatgtaagaaaatcaaggaaagccctgatagatctaactcacagagtcattacacgaacaaagtaa

SEQ ID NO: 70030 - DNA, 226 bp, Glycine max
  Peptide Sequence Number=SeqID_161715
atggatgaaatggaaaccttcaatgacatgaaattcaacctaccaatgcaagagttggacattgtacctgagattaaaatagataaggaagccttggaaaagacaggccaatccaataaggagtacaaccatgtgaggtctagccaagaacatgttggggccaccatagtcgaggccatgccatgccactcggccatggcacttggcaaaaactcagacatgcgag

SEQ ID NO: 70031 - DNA, 876 bp, Glycine max
  Peptide Sequence Number=SeqID_161716
atgacagaaccatcaaagaagcgaaagagggcttcaacctctaccgtggccatcagaactcgacgccatggagcctctggagcacagccaacatcaattgttccttctatatcatcttctacgttgttctcttcggaagaacaatgtatccgatacacttcccttttctcttctcgttccatcatagaccctaagtttatatacttggcattctttgatgatgaaatgtttgattgttttcaagcatttcagaactccgggataatccattttatgtctttaaaacttccttattatcttgatttaattgtgcgaatcctccttccccgatcatctaatcttgctcaggtctctgaggaagacctgatagttatgtgggctttcttaaccgatcgtcaaatcgaatgggcccaccttgtcagatatcgcatgcataaggcattgcgatcaaatgcttttcttccttatccccatttgattactctattcttgcatcatttcgatgttcctcttggctctgagacattttttcaagtcaagagatcattttctattgggacgggggtagttacttccttcggataccgcaaagagcgtgatggctcttgggtgaagaagggcgctcctgcacaggcagcagatgaccgctctccatcaccacctcctcagagagatgactcttcatcccttatgcaaagcgttcttgacaaactggatggactacacaccttcgtcggtgagcgttttgactccttggacagctgcattgatgccattgatgcatggtttgcaggaatggatacacgcatcactcagcttgaggaggatgtgagtttcatctgtcagtgctttgaccttccaccaccactttcatag

SEQ ID NO: 70032 - DNA, 642 bp, Glycine max
  Peptide Sequence Number=SeqID_161717
atggtggcatttctcttgctgttggcgttgagcaatgaagtcagagttaatggtgatggtggtggtagacaatgtgagattaatccagctctaaagccaagaccgtacattgtctccatcttggagtttggtgcagttggggatgtccttaacttcaacaagggtggtgctcaattatatgtgccaccgggaacatggttgactcaaagtttcaatcttactagccatctcacacttttgttggaaaaaggtgttgtaattcttggatctcaggatccatttcactgggaagtcgttgacccattaccttcttatggccgaggagttgaagttcctaggggaagatatcagagtttgattaacggatacatgttacatgatatggtgataacaggtaatgatggaaacattgatggcatgggattggcttggtgggaattgtttagctctcattccctgaactacagccgtccacatctgattgaattagtggcatctgatcacgtggtagtttcaaatcttacattcttgaacgctcctgcatatagcattcacccagtttattgcagcaatctctactatagcaaattgttgtccaaaccttgtcagtctgaagctagaatgttgagatatggtgactga

SEQ ID NO: 70033 - DNA, 856 bp, Glycine max
  Peptide Sequence Number=SeqID_161718
atggatggaggggtaagggaacctgacacaaacaaaggtcctgctgctaacggtggattcacatataacatctcagaaaaagagctgtgggaggtgttccaaaaatgggaaaggaataacatgcaacaactgtcgacaagttccaagcctgtgctagtaagaagggacaatcacgacgaaatggaaggcaaaagcgtaacagacaaagacatcttaatggttgacaagctacaagagtctaccattattcaggatctcaaagaggttagatttcaatacctcgaggaggactttgttatgatttcaggggtaaatgaggataacgtacaagaagaaatgttagaggaaggggatggttgggcaaatatgtttgagtgtattgtcaaatggaagaaggggcagaattttgggagcagattagtatgggtaaacatctatgggataccaatgaaactgtggaatgaggcttgtttgaggagcgtgattagtgaactggggaaccttgtctctaacaatgaagctacacagaacttggactgtggggatcgtgcaagggtgttactcaaagcattgttgattaccttggccaaactgataaaaatggttaaaatcaatggccatgtatatcaagttagggtggaagaggaagatggagcttggaagaatggatgcaaaactcaactgagactcaaaggtgatgaaaatggtctcgaggacggcaccaaaagcctccaatatggtcgttggaacaaagatgggactaagctatatttgggccaaaagactggcccactaaaagccaatgaccaccggtctggcccgtcaggtggagaaaaatacaacttggaagttgcac

SEQ ID NO: 70034 - DNA, 138 bp, Glycine max
  Peptide Sequence Number=SeqID_161719
atgaaagttatgccaagcaagccaacaagaacaggaaggaagtggctaaaggcccaagtggagaaggacgaaggccctagtggagaaggacaaagcccccgagtggagaaggatgaaggcccaagtggagaaggatga

SEQ ID NO: 70035 - DNA, 312 bp, Glycine max
  Peptide Sequence Number=SeqID_161720
atggctaccgtagatattactggctcgaacaacaatgacctcaacaaaccttttaggtttgaagggtatcatttcaaacgttggcaacaaaagatgatgttttctttaactatgaggaaaattgtctatgttttgaacactgatattccagtggtacctgaagatgctgagaaggaagtgaaggataaaatgactatggaattaactctctggaatgaaaatgattacctatgcaagaatttcattctaaatgggttagctgatgatctctatgattattatagcccatataagtctgccaaattagtttga

SEQ ID NO: 70036 - DNA, 546 bp, Glycine max
  Peptide Sequence Number=SeqID_161721
atggttagaactagaggtttaggttgtgccttaggaagagttataggaaaagccttggggagaaaggataatcatcatttagatgatgttccccaatggcaaaggcccacagcatcgacaagtaggcaacgggaagttgccgctgttgctgaggatgttcctcacgtggatgacgcagctgaagaggtattccaacatgttgaagaagctgttgatgatgccgagggttttccaggagggccgcgtgacctatcagtgttgactgcctatgttgatcatgttgcagtcattgtttggaatggagagggacttatatcggctcttgtcgagagatggcataaggatacgagcagtttccatcttccaataggagaggtcaccatcaccctcaatgatgtggcctctttgcttcatcttcccatcataggtgcattccatagctttgagactcttcatgtcgacgaagtagtgtgggtgttagtcgagttacttgaagtccctagagatgaagctacagctgagacagtaccatgtcatggggcatac

SEQ ID NO: 70037 - DNA, 108 bp, Glycine max
  Peptide Sequence Number=SeqID_161722
atgggtgccaagcacctcacgaggaccaaagaatggtcgcacgtcatcgagcaaaggtccccggacgaaattaggatttgtgtctatgatgataagctcaaatggtag

SEQ ID NO: 70038 - DNA, 483 bp, Glycine max
  Peptide Sequence Number=SeqID_161723
atgactgtctattacatttgcaaattcaaaaccaggatgtttccatctaatatttctttcttgttgcagagtggtcctttaggaggagtgacatcaaaggatataggagtcaattgtctagcacttcatgatttgtttcaaatgtctaatgaaaggaatgacatcataagctatcatatttatgtgcaaatggttgagatttacaatgaacaagttagagacctacttgcagaggacaaaacaaacaacaaatattcttttgatagggtcaaacattttcacactactaataagagattaggaagagaaagctttatttctaaaatctggagctgcaatggtgatgggttcaaccttcctcatgctagattgcatttgctaaagtctccaactgatgttatgaccctcatgaaactaggtcaggttaaccgtgttgtttgttcgacttcaatgaacaataggagtagttgttcccacaggtga

SEQ ID NO: 70039 - DNA, 885 bp, Glycine max
  Peptide Sequence Number=SeqID_161724
atgtctcttgccactctttttggaaaacttcaagaacatgaaatggaacttatgagactccatcaacacgaagagaatgatataaagagaaaaggaatagcagtcagtgcctcatcatcttctattcaagaagaaagtgacaaagaggacttgactggaatagaagaagatgatgatttcagattctttatgaagaggatcatcttagaccctaagtacctagacaaagacttcttcgatggtgagacatttgactgctatcaagtgtttcaaaattctggattagttgattttatgtccttaaaattgtcttattatcctgaactagttagagtcttttacagtaatttaaaaattcaggatggtacgattcactctgagggcaccattgttgatgactggaagtttgattattctagtcatgatactcgttgtatggtctgtaatgaccaggctgatatgactggtagattgcttgccggatcattaacctttgattgccgcatcatgcattacatcatagttagaatttcatttccccgttcttctaacctggctcaagcttccgaggaggacttgattttgatttgggctttccttgccggtcgtcagatcgactgggttcacttggttaggtaccaaatgcataaggcattacaaaccaatgcacctcttccgtatcctcagctagtcactcatttccttcatcattttcaaatttctcttgatgatgaaccttttgttcaagttaagagatcttttgccattggtgctagtgcggtagcgacttttgggtaccataaggatatggatggacagtggcttaggaaacaagatgtacaacaatcaatccctaatgagtgcactccgtcacctccgccatag

SEQ ID NO: 70040 - DNA, 197 bp, Glycine max
  Peptide Sequence Number=SeqID_161725
atgaggattggaatcgtgtcacgtgctgaattattcataaaattctgtttacatgagcaggagtttgttggaggcgtggaatcggtgaaggtgaaggtggaggagtgtgtgcagcacgcaatatatgctactatgctagtgcgcgcgggccatgccagccgagacacgtcagctttcgggaaattagcagttgcgtt

SEQ ID NO: 70041 - DNA, 195 bp, Glycine max
  Peptide Sequence Number=SeqID_161726
atggttagaacacaaggtttaggtcgcgcgttaggggctagtagaggtagaggcattagtgaggatacgcatgaggctgatgttcctctgcgtcgcaaacctactgcttcaacacgtaggcaacgggttcgtctgtgtgaggacgtgacagagagacctgaggatgtgcctcagttgcataaggatgttcctcat

SEQ ID NO: 70042 - DNA, 708 bp, Glycine max
  Peptide Sequence Number=SeqID_161727
atgcgcgcgggaatcccaagggaaaaggagaacgcagcatgcgcgctgctaagactctcgcgggtggaggagagcaaggtggtgatcgggcggtctagcgcgattccactgctggtgagcctcttggagagtggggggttccgcacgaagaaagatgcatcgacagtgctgtactcattatgcatggtgaaggagaacaagatcaaggcggtgaaggtggggatcatgaaggtgctggtggagctgatggcagacttcgagtcgaacatggtggacaagtcggcgtacgtggtgagcgtgctggtggcggtaccagaggcgagggcgatgctggtggaggaaggaggcgtgccggtgctggtggagatcgtcgaggttgggacgcagcggcaaaaggaaatcgcggtggttattctcttacaggtttgcgaggactttgatggagaagagcatcgccgtgaagatgccgccgactccggcgccggcagccacatcgaagaagtctgcaatggttgcgctctggtcgctagctttcttcttcagcgtggcttccaggtaggcaatggcttttccggcgagaatctcgtgcatgtttccgccgtcgatggcgagaatgcatatcttgccccattggttcttgattgtggagacgcagtccacggcggcagtagccgcgggagtatgagaaacttgctttcgagaatttga

SEQ ID NO: 70043 - DNA, 150 bp, Glycine max
  Peptide Sequence Number=SeqID_161728
gcgtctagggtcgcgcctggtgcaggggcgccaccagtcgcgtccagtgtcagggcgctaccagtcgcgcctggtgcaggggcgctacctccctgtgccacgtgtcacgtgcacagtggaggcgccggggtgggaggcgctttgcaataa

SEQ ID NO: 70044 - DNA, 165 bp, Glycine max
  Peptide Sequence Number=SeqID_161729
atggggatgacggtcatggcggaagaggtggtggtgacaataacaacggtcataccgacagagggggttttccacattggtgctcacttaagcatcgtcaacaccgtcttagaaataagagatttctacatcggtgcttatgtcaccaccgatgttaaatattaa

SEQ ID NO: 70045 - DNA, 471 bp, Glycine max
  Peptide Sequence Number=SeqID_161730
atggtactagagaaaggctatacaccagctcaagtcatgagacctgaagttcttcctctagtagtatcacattcacctcccgaagtctcattccttctccttgtttatcttaacaagcctgaaatcccagagttagtcctagggactctagcagccatagtaactggggcaatactgccccttatggggtttcttatctccaacatgataaatgctttccttgagcctgcagatgaactccgtaaagactcaaagttttgggcattaatgtttattgcccttggtgtggctggcaccatatatcatccaataaggtcatacttttttgatgtagttggctctaagttgataaaaaggattgggctgatgtgttacaagaaaattgttcacatggaagtaggctggtttgacaaagttgggataagaagtgagatatacaagttgcggttgtttaccatcaacttcccatag

SEQ ID NO: 70046 - DNA, 726 bp, Glycine max
  Peptide Sequence Number=SeqID_161731
atgccatgtcaccatttgatagatgaacaaggaaataccaaaaaggtttcgctaacaaaaccaagtgtatttgtgatgcctcgtggtgaacgtctagtcgtgccatttgatagtcaactaagagtctatggagaagcagctacacttctttcatcagcttgtggacgtattgccatggattcaaaaaacatcccaaataactttgatagttggtcaaatgttccaaaatcatacaaggatggttgctttaatattgtaaagtggtcttcattcgttgattatcatctaagaccagaatataaggaagtaaatcttggacgtgctgtgggtcgaggagaactgtacattgcgactcacaagaagaaaaatggatcatatgtcaatgaggaggcaaggtctattggggacaagatgacacaagaaatgagtaaaagtgacaactttacaaaaattttagctaatgatagtgtgggtaaagtgctaggaaaggaccatgatgggcgtgtgcgttgcttaggactaggaggtcttcacagtgttgcatttcggtccactacaagctttagtggttcatggtctagtttttcaaattttgattcagtcgagagctctagattgaaagaggaggatgaaggaagtggacaagatgggccaacaccaagaagaggatcatcattagatagtaatttccatgcaacttcacatatgttgcttaattccttttga

SEQ ID NO: 70047 - DNA, 852 bp, Glycine max
  Peptide Sequence Number=SeqID_161732
atggggatagtggaagaagctcacaacgtgaaggttttaggatccggcacgcggcacatagttctggctcacgggttcggcacggaccaatccgtgtggaaacacctcgtacctcatctcctcgacgagtttcgtgtcgtgctctacgacaacatgggagctggcaccaccaaccccgattacttcgattttgagcgctattcaaccttggaaggctatgcctatgacttgcttgctatcttagaagagcttcgagttgattcgtgtatctttgttggtcattcagtgtctgctatgatcggtactgttgcttctatttctcgccccgaactgttcgccaaaatcatcatgatctccgcttcacctaggtatgtgaacgacatggaatactttggagggtttgagcaagaagatttggaccaactattcaatgctatggcggcgaattacaaggcatggtgctcagggtttgctccgatggccattggcggggatatggagtcggtggcggtgcaggaattcagccgaaccttgttcaacatgagacccgacattgcgctgagcgtgttgcagaccatttttcgaagcgacatgagacaaatcttgaacctcgtcactgtcccatgccacatcatccagagcatgaaggacttagcggttcccgtcgtggtcgcggagtacctccaccaacacattggaggtgcgtccatcgttgaggtcatgtccacggagggtcatttgccgcaactgagttcccctgatatctttattcccaagtctaaacaaatggagtcatctatgattgatggtgcggtgtggtgtggtgtggtgtggggagtccattattggtag

SEQ ID NO: 70048 - DNA, 369 bp, Glycine max
  Peptide Sequence Number=SeqID_161733
atgaccttttcatcatggcagaataaactaaacaggcccatggctactccacctggcttgcctcctcctcctcttgtagtagcatcacaaactccgtctacctttaagcggacacgtaaagccacacgactacgatccttggccactagaccacctggggcagagagaccggtggtccacgtcgatcctgcgactgggaatgctgacaatccccacaagaagaaattaagaatatatttggggattgtcactcgtgataaggtcgacatgacatacgagacttggaaggaagtccctactactcagaaggatttgatatgggagattattcaggctgaatttgatatccctgaagcatctctgttatag

SEQ ID NO: 70049 - DNA, 276 bp, Glycine max
  Peptide Sequence Number=SeqID_161734
atggatttccttgcactggcagtggacaacttgcttctcctccaatatactatttatgtatgcatatcacttatcacaacaccactaggcatagccaaagaagaagaatggtatatgggaatcgtgaaaaagaagtgcacaactgctctttgtatattggcttatggcttatctgctgatagtgtggatgaatatgttcgaattggtgaaacaactataatggaatgcttggagcgatttgtatcaagcatctgcaccatatttgggaatacttga

SEQ ID NO: 70050 - DNA, 1794 bp, Glycine max
  Peptide Sequence Number=SeqID_161735
atggactatgtgggctcggtggagagtttggatgcaactgagatctttcttggtcaatttcttactgttgttcaccacttgaaggagacatcgattaaggttgagtttgggaaggccaaggaacttgacctagaattggccaaaagtaaagaggtggcaaaaaagttgcaagaggaattagataagcatattgggtgtctatccaataaagccaaagagaacaaaatgttgaacggtcgagtctccaaccttgagaagcaagtaaaagatgtggggaggaaaatggatgagttgtcttcgaagaagaagactgtggacgagaatgctctgatggtcgagttagatgtggctaagaggttgattgtgctaaaccatcgagagggtgttaagaaggcgcaacgccaagttaaggtgttggtcccgagcatcaactctgcacaacataacgtgaatggcgacatcgtggatggttcaaactcgaccttctgggaactgcttgaaaaagccgaggttcagattcggcctcctgagagttacttgaaaaaatcgtggcttagacctaacctccttagagtcctagggatgacctttcctgtgacatcttcaagcctatacgcatcgttttgcatggactcggtgatgcggaatgggccttctcagtttggtgagagctttccttctgagctatccttcccggcatctccttggagcctccaaaccaagttattgggcttaaagctacatttcttgagcttcgagttatatttccaagttattctttgtttacatccttcctcctctaggagggtcaagcttattacggagttcgaaatggatagatatagtaacaactcagctctagacgtgagtcgagtaaagatgggtagagtgaaatcgagacagatctgccaatctattggtcaacttatgtatttccttcaagctttgtgggctgcacatggcaatgaggtcttcacatttgtttgggttgccctcgatccccatacaggtgatcatgaaaccaaggaacttacccctttcgaccccaaagacgcatttttctgggctcaaccgcatgttgtgcttttagagtttggcgaatatctccaccaagtctttcgaatgattgttgagaccgaagggcatgactttgtaacagaagttggcatctttagtgatgaatgtcgtcttgctttcatctgctcatcgatgctccttgccgagcttttgtcgttgttgtgccataggtttggcttcaggaaaaatggagagtttgtggcatatgaaattaggatctatgcctggcatgtcaatgacgcttcatgcgaagagatcaacattctgtgtcagcacgtccttgattcgtttctgaaggtgctcattaagtcattcccctatcttagtgcattggtgtggctcctttctgagttggaaataatgcaactcctcagttggtgttggccttttgtcttccttatctctctttcgttcgagatcgacccagcttggtatagcgttttccacatgattgacatctgctgcatcgacatgcttcgcggaggcatgtgtgtagggcttgacgagtggtcacctactctactgcaccatgggtgtggacttcccccttgcaaaaccgatcaagggtttgggatgaggactttcctgacgtcccaattgataatgacaatcataattaccattgggtcttcttgctcaagatcgaatcttgtgaagtcgacatcggtgaacgtatttggtgggattgatctcctcaagcccgctgcaattgggaag

SEQ ID NO: 70051 - DNA, 828 bp, Glycine max
  Peptide Sequence Number=SeqID_161736
atgttcgtacctcaccaatggaacttaccttcttctccttctcgtcctccctcactccaaacgcaatccaaatctcccccaaaaaactcaatcccgcatttccgcagtaaccatagacccaccgcaggagcttcccaagaacagcccccagcgcctcctaagggagctcaccgagcgcaagcgcccttcaccccgaactccacgcgcgccccgcggaggttcatcctcacgcgcccgctagacgacaaaagagtcgcggacaggttcctcagcagcccccagctagcgctcaacacattcccgttcctaagctcatgccttcccttcgccccgctcggccacgtggacaacatctggatggagaagcacgcactggggtaccctctggagccctcggtgacgctcagggacgatagcaaacccgccagggagctcgacacgctgttgtacttggcgttccagcatgaagtgtgcgagaagagtagggcgcggcacgtgcggttcgggcactcgaggctgttctttctcgggcagtatgtgttggagttggctttcaccgattattttttgcagaggtctgtattttgggctttgtttggggcaatctatctttgttttggtatgccagaagtgtatcgtgttctttttgaagtctttggaatggatccaaatgctgaggattgccagcccaaattgtgtaggcaacttgaagatatagatcatgtatctgccgagtttgaaggcaagataagctggcaagatatggttgcatataaggcaagctccacttatattctgtcatcgtattatttgtttcaaaaaccatag

SEQ ID NO: 70052 - DNA, 795 bp, Glycine max
  Peptide Sequence Number=SeqID_161737
atgaaagcgaaagcggtgaaaggaaattggagcttgaggacgaacaagctcagcttcccttacgttttcctcgtctgcatcttcttctttctcgctggattcttcggtttcactctcttctctcactctcagggcgatggagatggcttgaggccgaggcagaggctgcttgattcgacgaacgaggcggagtacaatttgatgcctgttggagagcttggtgatgattccattacttcgattcctttccaggttttgagctggagacctcgagctgtatattttcctaattttgcaactgcggaacaatgtgaaagcataattgatgtggcaaaggatggcctcaaaccatcaaccttggcgttacgccagggagaaacagaggacaataccaagggaattagaacaagctctggcgtgtttgttagtgcttctgaggataaaacaaggactttagatgtcattgaggagaaaattgctagagcaacaatgattcccagaagtcacggagagatggcatcatttttgctatatttaactgatgttgaggaaggtggggaaactatgtttccatttgagaatggcttgaacatggatggtaactatggttatgaggattgcattggtttaaaagttaagccacgccaaggagatggtcttctattttattcattgctcactaatggtacaattgatccggtatctttggcagacatcactccatgggagctgccccgtgataaaaggggagaagtgggtggctacaaagtggataagagatcaagaattggatga

SEQ ID NO: 70053 - DNA, 969 bp, Glycine max
  Peptide Sequence Number=SeqID_161738
atgtccaaggcacgcgtctacaccgatgtcaatgttcttcgccccaaagagtactgggattacgagtccctcaccgttcaatggggtgatcaagatgattatgaggttgtgcgcaaagtgggaaggggaaagtacagtgaggtttttgaaggcataaatgttaatagcaatgagcgttgtgtaatcaagattctcaagcctgtcaagaaaaagaaggacagtgtggttcttggtgcactgcagcaacctgtttctgcaaattctagtttggaaattgttattgttattggtagccaaaccttaattctaatcggtgatcttcttgatattgtcagagatcagcactctaaaactcctagcttaatatttgagtatgtcaacagtacagattttaaagttttgtatccaaccttgactgattatgacatacgctattacatatatgagcttcttaaggccttagattactgtcattctcaaggcataatgcatagagatgtcaagcctcataatgttatgatagatcatgaattacggaaacttcgcttgatagattggggtcttgctgaattttatcatcctggaaaggaatacaatgttcgtgtggcttcaagtgatagcaacaatgatggtgatggaaaccaatggcggttgtggcagcagcagaactatggtggtaacgaccaatgtgaggcaatagttggtgttggttgtagtggcaacaatagtttattggtggtggttgcaacaatgatgatggcagcagtcagtggtagttgtggtgacagtggcaataatgatttactggcaatgtttacagtattaacagtagtggtggtgggtgggggaacaatgaaggtggcaaaggcaatcaattatgatggttgtggtagtgacggtggcagcagcatcaagagtggcaatggtggtggctttggtggcaattgtagcaacaatagtggtggttga

SEQ ID NO: 70054 - DNA, 441 bp, Glycine max
  Peptide Sequence Number=SeqID_161739
atgcagataatggttagaactagaggtcttggccggactttaggccgagcaataggaaaagccttggggaggagagattcgagtgacgatgatgccccccagcggcgaaagcctactgcatcagcccgtagacagcgacaaccagagcatgttgtcgaggacccttctatggccgcggaggaattgaacaaagagcagccagaagcacctgttgaagaagttgttactgatgttgaagcagaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaagttaatattcaaatgatcaaagtttaa

SEQ ID NO: 70055 - DNA, 396 bp, Glycine max
  Peptide Sequence Number=SeqID_161740
atggcctctcacgctaagcgagtttcctctcgggttaggatttacactaagcacgcatgtctcgctaagcaagttgtccaaaaatgttatctagataatcccaacggtaaaaacatgcatattgaaattgataactttatcttcaatcataattcatctcaaggatgcatcaatctcattgtctatgtggatgacactgtcatcacatgcagtgatcaacatggcattatcaacttgaaacaatatctctcacgccaattccagggtgatgaccttggaaaaggccttgtttatgaaaatagtggacatgctcgggtagttgactactcagatgttaattggactggctcacctaatgataagcgatccacatttggtattgtttatgctaattag

SEQ ID NO: 70056 - DNA, 1137 bp, Glycine max
  Peptide Sequence Number=SeqID_161741
atgggtcttgctggcataccttttgttgagagtgtcccatgcctacttggaagtctggacattcctaagcaatctgaaataacttggggaagcattatgccagcggcacggtatttttctcctgcagacacgatagagcaaaagttacaaattgaaaggaggcttggtagtgtgaaaacacgcaagtactttaatcttctggagagatttctgagtttcaaaattagcaaacatgagtttgatagggtctgcatcgcaactattgggagagaaaatgtccctcttcataatcattttctcaagtcaatcttgagaaaagcatgtctctccaagacagccgggtcaagagaaagcaaagtagaaagttctttgaacgtgaaaacaccaaatgggtgtagcaaccttcagatactgtgcaaggattttcctcaatctcctcgaaaaggcaggactccaaatttgcgtgatcgcagatccagggaccgtccgagccctcttggtcctaatgggaagaacaacagcattgggtgtgaggattcagtcccaaaaattcatgaacagcaaagtattcttaatcttcaatctgcaggtagtagacttcctctctctgtggaagatggggaggaggttgatcaggattatgaaatcctgaaccttttcaaaaagagtcctattcaagcacctcttgctattcccacttacaacagaagaccacagccaaaatatttatcccaaggattatcatctggtactgttagtgatacctgtcaaagcattgctcagctacctgatacatgttctttgacaaaaaggttggagcagaaattggaaatagaaggacttaagatctcaacggatgctgccagcttgttaaataatgcacttgatgtttacctcaaaagattgataaagccctgtttggatttagctgcttcaaagtctgtaaataagttcagtggtccaatacaacctggtttgaatgaactaccactgagaagatgtgtgcaaaagcctattagatctgcttctgtatctatatcagactttagaacagcagtagagttgaatcctactatattaggggaagattggccactaaatttagagaaggtttgtctatgtgcattagaagaatga

SEQ ID NO: 70057 - DNA, 480 bp, Glycine max
  Peptide Sequence Number=SeqID_161742
aatactcccacagagaataaaacacctaaggagagtgacagtgagcgtgtagcaaaagatgctgcattgatagaggttgtgaagaaacacatcgagatagggataggacttgaagcattgccattggttgaagaagaaccaccaaataagaacaatagccaatcaaattacaatgttgatgccaatgagttcccctctgagggattgcatcattccctcccccttgaaaaggatttgacctcaaatccagaggttcttgaaactctgggcttcttccctcaacacctagatgaagatgctctcataccacatgatgtagctccatatggagcttatacaccttggatcttcttcatgaatgatgtcctttgcttcttgaagttcatggcagcggaatggagaatgaagaaagacaattggagacatcacttcaaggagaagatgagtcaagaagaagctcaccaccataggaagccatag

SEQ ID NO: 70058 - DNA, 486 bp, Glycine max
  Peptide Sequence Number=SeqID_161743
atgacagaacaagctaaacaggtattttatgttcaatatccttatgatgaaagatggcacatggctacaccacccaactcccctcctcctcctcttgagtcaacaacaccttcaccatctacatcgaagaagacaagaaaagcaacacgactcaaatcattggctactagaccagctagggtggagagaccagtggttcatgttaatcctgtcacggggagaggcgatggtccccacagaaagaaattaagaaaatattggtggattgtcactcacgatatggtggatgttacatttgataattggaaacaagtccctatagctcaaaaggatttgatctgggaggatattcaggccttggcacatgacaaggagggcgaggatgacaaagtatgtgagaagtacgacataagcaaagaaaagtggacccaattttgtcaaagtcgtagagacccttcatgggaggatcttcaaaagaaggcgtag

SEQ ID NO: 70059 - DNA, 321 bp, Glycine max
  Peptide Sequence Number=SeqID_161744
atgggtcatgaagatgaggaggatgatgatgataacaacaataacgatgatgataatgatggtggtaatcatggcacctcgcaccgcatcgcacgacaccttacacggcatcgcatggcacctcgtacgacacctcgcaccgcacctcacacggcatcgcacgacacctcgcaccgcacgatagctcgccctgcacctcgcatgacaccgcacgacacctcgcacggcaccgcaccgcacctcgcaatttttgttgttgttaagtattattttctgttgcaggtagttcgtgccaactcgattgagattaccaactgttag

SEQ ID NO: 70060 - DNA, 126 bp, Glycine max
  Peptide Sequence Number=SeqID_161745
atgggtcatgaagatgaggagaaggatgatgataacaataataacgatgatgataatgatggcgatgatgatgatgacaaggtggtgatcatgttcctcaataaaacacaattgcacattatctaa

SEQ ID NO: 70061 - DNA, 495 bp, Glycine max
  Peptide Sequence Number=SeqID_161746
atgaaagagattaaacctgtttctaagacatcaaaatcgtcttcgtcagacctcgagattgagatagctgagcttctgtatgagaagaagaaaatggaagacaacgacaattcttccacccttgttccaaataattcaactaaagagttaagcaggattcagattgagcaacatgctgatgtggattatcatgtttgtccatcattagaggcaccaaaagaggacattggggaagacagaatgaattcaagtgctgggtttggggatgcttcagcagatggaagatcggtttctcctactaaggaatcgccatcatgctctatgttggatgctgagaaaccatattcatcttcaaacagagtgatgtctgcttttccagaggccaacacccaacgagtaggcaagtttgagacagatctgatggctcctcctcctatggggctgtccccagaagtggatgacttgtcaatgggtgatttcatatcagaaacttaa

SEQ ID NO: 70062 - DNA, 84 bp, Glycine max
  Peptide Sequence Number=SeqID_161747
atgaccatggctgctagtgcaaggatcacattcagcgaaatcattgagacaacttgtggtactctatatctgctgtattcttag

SEQ ID NO: 70063 - DNA, 429 bp, Glycine max
  Peptide Sequence Number=SeqID_161748
atggggcggggtaggtacgggtattgtctccccaatcccttaccccgactccccaacatatccccatacccgtacccgatacccgacgggttacagtttattatctcatccccgtactcgtcgggtacccgttgggtatcgggtatccccgatctcgttccatactgtggaagcaatgtcttccaaggttattttgatgatgtcaaagaatcaagagttaagcaaagtttcaagcaaagattcaagaatcaaaacaagagaaggtacatctcttgtggatcagttcaagtggatggtacatccacttggttattcaaagagaacaagggagggtacatcccttgtggatctttggcttgtaaaggattttacaaggttgaaaagaaatctcaagaaccgcaggttgctggggaactggatgtaggcacg

SEQ ID NO: 70064 - DNA, 184 bp, Glycine max
  Peptide Sequence Number=SeqID_161749
gtatctccgcatgtcacctgatttcacgggtcaggatgacaaaaaccgtttgtacggacaaccgcttgggtatctccgcatgtcacctgacttcacgggtcaggatgacaaaggtgcagaagacgacggtgcagaagacgacgttagtctctgcatgctaccggactttgagtctgacggatag

SEQ ID NO: 70065 - DNA, 192 bp, Glycine max
  Peptide Sequence Number=SeqID_161750
atggtgggttacacaccttcaagctttgcgaatttggtcttcgccggcgaaaggatcaaagtgggtctggaaaaaggcaaatatgatcgtcctgctttgatgaatgcaaaaactagggcaaatgaagaagatgagaatgagggagaaacccttgctatgactgccattcctatacgccataacccctgctag

SEQ ID NO: 70066 - DNA, 162 bp, Glycine max
  Peptide Sequence Number=SeqID_161751
atggctgagaaaacaaagaaaagactggaggaaactgctcagtccggaagcactaagggcgtcattgaccctccatcttccattagacgacacatgaagattctttggaagagcaggcgtcacagggttcgtttgtcccccatggacgtcaagatctcctga

SEQ ID NO: 70067 - DNA, 1108 bp, Glycine max
  Peptide Sequence Number=SeqID_161752
gttcacttctcctaaggcctgggaaaggtacactaatattgtggtacccagaaaattactccctaagcgaaatgtggtaatctaccacactgagtttgatgagttcaaggaagaactggagagaagaaaatgggatgaggaattgactagttttgatgaaggcagcattgatgttgccattatgaaagaattctatgctaacctctatgaccccgaggataaatcacctaagcaagtgagggtgagaggtcatttagtgaaatttgatgcagacaccttgaatactttcctgaagacccctgtgataattgaagaggaggaagagttatctgcttattccaggttttcactcctaaggcctgaccctcaggaattggtagccaagctctgcatcccagggaggggatttgagcttaatgctgacggcttgccactgaagatcctcaggaagaacctgacgacccttgctcagacatggagcgttctctctttctccaacttgatccctacctcacacacatcagatatcactatggatagggccaagttgatttatggtataattcagaagatggacatgaatcacgaatcctctaggcttgggtttccagccttaatcactgctttatgcaaagctagaggagtcacttctgattccaggaccttggagagtctcatccctgccattaatgtggcatatgtaaagaagaactattggaatctggatgatccaacagtgactttcagagggtcccagaagaccaagggtaagaggtatgaggctccttcatcttctgctctcccatcttctgagattcatcctttatcagctccttcttctacagctccatcagctccatctttatctactcatttaccagctcttattacagctccagctccttcaggatctttcatttttactttggagactttatttggcatgctgcagagcctacacagaggccaggtggcttggccaggagtccagccttctccttctggagggggtgggacttccgcagcccaagagcctgagacaacagcagaggatgagctgatccctcctgagccatttgttccaaagccagatgcagagattgattag

SEQ ID NO: 70068 - DNA, 729 bp, Glycine max
  Peptide Sequence Number=SeqID_161753
atggccacttggtgcggaagaatgacatgtggaagcaatgccttcaacgattatttcgatgatgccaaagattcaagaatgaagttttcaggaatcaagtttcaagaatcaagattcaagaataatcaagatcaagattcaagactcaagattcaagaatcaagagaagagtcaatcaagataagtattaaaaagtttttcaaaacattgagtagcacatggagttttcacaaaatcttttaccaaagagttttactctttggtaatcgattaccagaagagggtacatctacttgggttgttgtgactgagaacaagagagggtacatctcttgtggatcagttcaagtggagggtacatccacttggttgttagaaagagaacaagggagggtacatcccttgtggatctttgcttgtaaaggattttacaaggttgaaaagaaatctcaaggaccgaacaggtcaaatctaaaatcatttcaagattatgatgaagaccaagccaacttgtgtctcatgacaaaatctcatgaaaacaacaaagaagaatctgtaaggaagaagtggtacatcgacagtggatgttccaagcatatgatgggagatgtatccaaatttacaaccatttcccccaagaaaagtggacatgttacatacggcgacaacaatatcagtaaaatctcaaaagaggtaacatctaagccatctctattaattaaggtatga

SEQ ID NO: 70069 - DNA, 237 bp, Glycine max
  Peptide Sequence Number=SeqID_161754
atggggaataagtgggaagggaacataggctcaaaggggctatcaaaggaattaattcaaggttggctcatttggctagaggcttataagaacaaaatgcctaaatcatctcccaacatgcatgtgaagcaagaagtatcaataagagtcaagccaaggctattgtgcaagcaatcaatggggcaaaacacaccgaataaaatagatgatgatggctcaaattctcaccaagggtaa

SEQ ID NO: 70070 - DNA, 774 bp, Glycine max
  Peptide Sequence Number=SeqID_161755
atggacaaagctaggttggtctatggcttggtaaccaacatggatatgaacattggagcccttatctcagttaacttcagaggggcaaggaaggcaagggttcgaccagctgatgttccttcttcttctactttaccagctctttccacttatgctactcctacaccagctcctccaaactcatctactcaggactctcagcactttgagtccatgcttcagagtctttataaaggacatattttgttaatgcagagcttgcaggttgtagctcctccaggatccattctgacagtggagcaatttttagagaaggtatcctggccaggaaccctgccttctcttgagagagaaggtgggggtcctagtgctcaggtacctcagcaggtacaagatgcatcatttgaggccaccatccttgagccattcatttttgaagccggtgagacactggtaaggcaagaggatgctactccagagagatcaccacagatttcaccagatccaccctctctagtggtggatcaatcttctcttcaacagccagcagaccctcctacaccaatgcataagatgtcagcaaacacgtctacaccaatgcataagatgtcagcagacacgtctacaccattacttgatcttccaaaggacccttctacaccagtcctgggattgactactattcatccggccactcttgtgctacatcttacagatgaggagggcactcaggataaggatactcagtcgcaggacctatcacaggaattttaa

SEQ ID NO: 70071 - DNA, 1005 bp, Glycine max
  Peptide Sequence Number=SeqID_161756
atgaaagatagaagaaagacaagtagtggagatgtatcctccacctctagaaacctcacaatctctcaaaatctcatccaaagttctgcaagacggcttcctcttcaagctcagctctctcccacgccagtcacactcgctcagcctgaaggtgaagacggtgcgcttagcgggttagcctttgctcaatgcctctatgaagctaatccttcttccagaattgtccatgcgcttagccatcaggtggggcgcttagcggatgatgcacttagccaaaagataagtgtcttagcgattgaagagaaagaagagcttgctacagtagtggtcaagtatgctatggtgattgctgacctgcaagccaagctaaaggagttagagcccgaggtggtgaaggagaaggaagcgaacaaagagcttgaggaggagttgttggcatttaagaaggaggccgtgaagcagcatgagaagggattttacaaggccgatgtgaaggacaatgaattgcttgatgaggaagacattgttgttagggaggaagatgttggcgaagaagagaatgatggggaaatagaaaatgagataatgtttgatcatctcgggtttgatctaaacctggttaaaggtcttgtcaatcagcttggtgatgtcttgccaattaacctggcgatgctccttttttgcattgtgaagctttttacccaagatcatagggacttacttgagctgtttaccaaggacagaaggctcaccaacgatgaaccttggagttgtcgaggctcaccaagggcggaccttaggtttgatgagcctttggagattcgtcgaggctcaccaaaggtggaccttaggtttgattatcctttggagattcatcgaggctcacaaagggcagaccttgggtttgacaagcctttggagatttgtcgaagctcaccaagggcagaccttgggtttaacgagcctttggaggttcgtcgatgctcaccaaggggtggaccttag

SEQ ID NO: 70072 - DNA, 765 bp, Glycine max
  Peptide Sequence Number=SeqID_161757
atgccgatgccttatgccggcctactaccatctttgctcagcaaccaaatggctatgtgggtggccttcaagcacaaagtacaaagcttgattgatgcaggatggctgacgtttcaagaggatagtccgaatgtgaggaccaatccattcgccagtcgtggaggctcaacggctagtatgatccgccttgatggtgacaaaggagatttatgtttaatggatccaggggcatcgcacgatatggagacgtgtccaatgggaatgatgaacaagggccagattgaagtctatagtgcgaagaaagggaagggggatccctttactgctaagaagcgtgtgcccttcccttacaaaagtgataaagcggtgccatggaagtacactgcacaagggcctgacagaaggaaaggcgcgtttgtcatacatgttaaggatgatatacctttcgctaatgttacaaatatatctagtatgagtgacatgactcatagtggatggatcttcatggcgcccgagctaccaatgtggtccaaagacaaagggaaggcaaaggtggatataggcgagaaagataaggtgggcctgacctcgaatgatgaggtcccaattggaaagattgcagaggaaggggatgactttagcaagaagggaatatcagctgaggaggagttgttggtcatgattctgaatggccaatgtgatggacttcttgtaaaggcaggggtagggcccccagaggccccaggagatgaagatggagcttag

SEQ ID NO: 70073 - DNA, 243 bp, Glycine max
  Peptide Sequence Number=SeqID_161758
atggcggaatggcatcgaggaattttgaaaaaacgccaccaaatagaagtggcgttgcgggttgcgtatgacgacgccatggcggaattgcgaaaatggcataatagcgcctttttctgttttttgggcgataggtgttgggctgacccaacccaaccctatccaatattctattgcaaaagtgcagcccacaatagcaagcacccacaaaatagagcacgaacagaaaagtctcctgcatga

SEQ ID NO: 70074 - DNA, 378 bp, Glycine max
  Peptide Sequence Number=SeqID_161759
atgatgatcatgaagttgaacgttctacaagaaacatttgcttcaatatactttcttgccgtatattttgatgtgaagtcattgtacaagatgagtgatgatttagagataggtagtggaaattatatggagatcatgagtatgagtgcatctaatcaatgctccatctatctccgagtcttcactcataagattgcctattactatcagcaagaatacgggtcactggggaaaggtttccattggaagcaagaatataatgtccctcccacatacatcagccccttaaatggttttataattatctcctctataattgttgttaggttatggaagctggagtctggagacggaatttttaatagagaccattattaa

SEQ ID NO: 70075 - DNA, 804 bp, Glycine max
  Peptide Sequence Number=SeqID_161760
atggcttcatccgctcagcctcagggaacaacaccaagctctggctctacctctatattggcactggattattgccattcacaaggaatcatgcatcgtgatgtgaaaccacataatgtaatgattgatcatgagcagcgtaagcttcgccttatagattgggggcttgcagagttctatcatcctgggaaagaatataatgttcgtgtggcatcaagatatttcaaaggtcccgagcttcttgttgatcttcaagactatgattactctctagatttatggagtcttggttgtatgtttgctgggatgatattccgtaaggagccattcttttatggacatgataactatgatcaactggtcaaaatagctaaggtacttgggacagatgaattaagtgtatatttagataagtatcgaatagagttggaccctcatcttgcagcacttatcgggaggcatagccgcaagccatgggcgaagttcattaatgtagaaaatcatcacttggctgttcctgaggccgttgactttgttgacaagttattacgctatgatcaccaagaacgtcctactgcaaaagaagccatggtgattgtaggtagaacctggatttttatttgtttgtttgcctttttaacctattggttttggcccatccatacttcaatccagttagaaatgcagaaagtagtagaactcgagcacattgagttgttggtgcttgttgagatatggtgttcgttcttgacaggggggcaacagtctgaactgttatttctggtggaacttgcttttaggtga

SEQ ID NO: 70076 - DNA, 225 bp, Glycine max
  Peptide Sequence Number=SeqID_161761
atggtgagggttgtgatatgcgatgtgatagcaatggtgacgatgatgaaaacaagatgtggtggtagtggtggtgtcgcaatacattttcaatggtttggagaggagagaaagaagaagtttggaaggaaatttgtatggttgtggtggtggcaagatgtgatggcggtaacaataaaaataagatgtggtgttggtggtgtcgcgatagtgtttgaggagtga

SEQ ID NO: 70077 - DNA, 1269 bp, Glycine max
  Peptide Sequence Number=SeqID_161762
atggcgccagcaactccaagatttgttgtgccaatagacttgaagaagaatccatgggaacaaaacgctcctctccataaccgatggcaccctcacataccgcacgtggcggctgttaataccggtgaagtcttcagggtagagatggtagattggacaggaggtgctattaaagacaacgattcagcactagacataaaatttctagacctctcaactgtccattatcttagtgggccaatcagaattctggataatgatggggtcccagcccagcctggagatctgcttgctgttgaaatatgcaacttaggtcctctaccaggagatgaatggggttttacagcaacatttgacagagaaaatggtggtggcttcttgacagaccattttccttgtgccacaaaagctatatggtactttgagggaatatatgctcattcgcctcagataccaggtttaacacaccccgggataattggaactgcaccatcgatggaactcctgaacatatggaatgaaagggagagagatgtggaagaaaatggcattaagtctttcaaactttgtgagattcgaaaaggcactagtgaatgggataagattgcaaaggaagccgcaagaacaataccaggacgagaaaacggtggaaattgtgacataaaaaaccttagcagaggtgccaaggtataccttccagtttttgtagaaggagcaaatctcagcactggagacatgcatttttcacagggtgatggcgaggtctcattttgtggtgcaatagagatgagtggtttcctagaactcaagggtggaatgaaagagtaccttacaccaatggggccaactccccttcatgtcaacccaatatttgagataggtcctgttgaaccaagattctcagagtggttggtttttgagggcatcagtgttgatgaaagtgggaggcaacactacctagatgcaagtgttgcatacaaacgagcagtgctcaatgccattgactacatatccaagtttggatactccaaagaacaggtgtacctccttctgtcttgcatcccttgtgaaggaagaatatctggaatagtcgatgcccccaatgctgtagcaactctggccattccaacaactatatttgaccaggatattcgtcctaaaaataacaaggtgccagttggaccccgccttgtaaggaaaccagatgtcttcaaatgcacttatgacgggaacttgcccattacaaggaatccaagtgccacgtcatga

SEQ ID NO: 70078 - DNA, 231 bp, Glycine max
  Peptide Sequence Number=SeqID_161763
atgactatgtcagttgccaactcagctgcgacatacctgacaaaaatatgctggcacatggttaagagaatgcgtaaacctcttattaccaaagtgtatgttaggcgccagcctgacatgttagctgattctgaggattggtttcaagaggtgcaaccggaaccaaaatggcagaaggttattcaggatctggctggggatcctaattctcaccctggattccagttttaa

SEQ ID NO: 70079 - DNA, 933 bp, Glycine max
  Peptide Sequence Number=SeqID_161764
atgaccaccgcgaaggctctgcgacagccctgctacgccggaatctttcgcaacatcgaatgcggcccgtcgccggcggcggagtcgctagggtttccgaagctccgcggaatcaacgtcactggattgcactgcggccgccgaggcctcgtcctcgtcctccgtgcaaaatcaaagccgattagggcgaaggagaacgcaagcgtaagtgcttctctgatcgatgactggttcaagccaattacggcgaaggaggattctaacgcagaggaccgtacatcttcgttttctggtaaaaatctcacccagatgtcaaatgttgggaactcgacaaacattatgtggcatgactgtccaattcagaaacaagatagacagcagctgcttcagcaacaaggctgtgttatatggctaactggcctcagcggatcaggaaaaagcactattgcatgtgctctgagtcaaagcttgcactccaaaggaaaactgtcttacatccttgatggtgacaatattcggcatggtctaaaccaggatcttagttttagagcagaagatcgttctgaaaacattagaaggattggtgaggtggcaaaactctttgcagatgctggtgttatttgcatcactagtttaatatcaccataccaaaaggatagagatgcatgcagagcactactttcaaaaggagattttattgaggttttcatagatgttccactacatgtgtgtgaagctagggacccaaagggactctacaagcttgctcgagctggaaagatcaaaggtttcactggtatagatgatccatatgaaccaccgtgtagttgtgagatagtattacaacagaaaggaagtgactgtaagtctcccagtgatatggctgaagaagtgatatcctacttggaggagaacggatacctgcgggcttga

SEQ ID NO: 70080 - DNA, 1002 bp, Glycine max
  Peptide Sequence Number=SeqID_161765
atggaatgcaccactgtctgtatcttactcttccatggcaatagaaccagcccaaatggtgtcagacaaaatcctccacctcacaatgaacacagtcaccaaaccaagacagaaatatctgtcaaggcccgtgtgactgcaagcatgatggtggacattataggagttggttgctattcttctaaggacttgtggtcctggaaaaatgaaggtattgtattggcagcagaggaatcgaatgtaacccatgacctgtacaagactaatgtgcttgagaggccaaaagtaatttacaacgagaaaatcagaaagtatgtgatgtggatgcacatcgacgatgccaattatacaaaagcttctgttggcacagcaattagtgacacacctgatggtccatttgaatatcttggtagccaaaggccccacggatatgaaagcagggatatgacagttttcaaagatgaggatggtgtggcataccttatctactcttctgaagaaaacaacgtactgcacattggacccctgaccgaagattatctgaatgtgattcctgtcatgagaagactttttgtgggacagcgcagagaagcaccagctgtgttcaagcaccagggcacatattacatgatcacatccggctgcacgggatgggccccgaatgaagcactggttcatgcagctgagtcaatcctggggccttgggaaacaatgggaaatccatgtgttggagggaacaaaatgtttcgaattgctacctttctcgctcaaagcacttttgtgcttcctctacctgggttccccggttcatttattttcatggctgatagatggaatccagccaacttaagagactcaagatatgtttggttgcctttgatagtggaaggacctgctgatcatgcattggagtacagttctggattaccactgtggtcaagagtttctatctattggcatagaaaatggaggctgcctcaggggtggagcacattcaagtaa

SEQ ID NO: 70081 - DNA, 1317 bp, Glycine max
  Peptide Sequence Number=SeqID_161766
atgccagaacgagaatccaccaatggttactgcagcagtggcgaagaagacggtgacgccgcttggagagcagcaatcgattccattgctcaaaccaccacctatgtcgcttccaccaccaaacacaatcacccaaatcatcatattgatgatgatgaccacaaacccaacacacaacagcttaagcactaccaactcaaggcacaaaagcttctgaatgaaatattggaaaattcaatagagatagtgagaaaacctgtccctgtcgtggatgaggatcccgagagcaatgaatgcggcattcgcttgtttaaacatgctcagccaggaatagtgtttgatcacttttgtttgcttttactttgctatggtaacttggctttatgtggtaattttgttggtggtggcagtaggtcactagtcaccattgttcttgacttgaacatgaaaaatttgagaactactctgaaatatgaaaaagctgcattgtgcatgcttggggcctctgccatgacttgtggtaatggtctttctcagctggttggccaacttaaccagaattactggtccaggcttttacattatatggctgcagatgaactccaaccaccaaggaaacggcctagactacttcctggaggagatattgatgagaaatcaaagaagcagtttagaaaacagattagatctgttgctgttaacgggatagatataatagctgcagcaaatgatgcatacaagaagtcattagctagactagaagctaaagatgccgcagcaaaagctaaagccaagagagaagaggaaagaattgaaaatttgaaaaagattaggggagaaaggtggctaccttccatggccaaggagatgcaggggtacataccaagctttatgtggtctagcattttcaatgccaaatggataattgacgaaggcacatactggagagttgacaatggacgtgatataatgctcaacttacctgggtgcaaaattccaccacatgaaagcaatttcgtagaggagaatatgaggatggcgcatgtgctggcaatggtggtggacggtgttggaggcttcgtcaaaacgctttgggctctgcaagagcggcgatggtcttacactttcgacgctgtggcctctgctgcggtgtccgtaaccatggcattggtgctctgcttgttggctattcgtgctagttatagacatagacgaggcgatatcagatgcacaggaaacgatgatttccttactgctggaagggagaaattattacatgatttgggactaccatggtcccagctaatctctacatga

SEQ ID NO: 70082 - DNA, 847 bp, Glycine max
  Peptide Sequence Number=SeqID_161767
atgggtgctcctaagcagaaatggactgcggaagaagaagcggcactgaaagctggtgtactcaagcatggggcaggaaaatggcgcaccatacttacagatcctgagttcagtgccattttgcatatgcgttcgaatgtagatcttaaggataaatggaggaatataaacgtgacagcgatatggggatcccggcagaaggcaaagcttgctcttaaaaggaacctgccagcccccaaaattgacaataaccatatggccttgagtaccgtagttcgacatgatgaagttcttgatactaaacccttggcagtttctgcgcaaatttgggctaagaaggtggagctgccagcattcatggggacaaacccaattggttggattgctagggctgaaaattctttgagccaaaacaacccagattcagattgggaatcattttccccagctttgatcaaaagatttggagatcgccatggtaaccacatctttgaaagattgagtatcttgaagcaagaaaagccaactgagacagaaacccacatcaaaaaatgggagacttctacagagttcttgaaagggaggaccaacatttcagagcggaaacacatgttgcgcaagatattgaatgaagaagttgattcccatgcctctcaacaagacaaaaatagcatggagggaagtgggtcagaatttagtgaagcaaaggctagttcttgggcaagaaaggtggaactacctagctttgatagaagcatagaagggggaactaatttaaagggtagcagttttgagtgtgacagtgacccattgcagttcttgaaatcagaaaacagaagtaaagaag

SEQ ID NO: 70083 - DNA, 651 bp, Glycine max
  Peptide Sequence Number=SeqID_161768
atggcgttttggttggccaaaagcgccagcaccagcagcgatttgcgttgcttgagctgcttaaatccccccttccccgtagaccattcacgtgagaaaaaaaaaaacagaaaagagaagcttgctggtgttgtgtttgagcaaaaacgaagaaggattgttgttgtggtgtttgtgtttgagcaaacttcttcatttaatatgtttggaatggggaagcagacagaaaactacacatcagacgagcagtgccgacgtatcaagtgcagcacgtatgcgtggggacctgctgtgcttgtgcatttatatagagagatgtgtagtgccatcgattacaaagttaaatcaatcggaggtggttgcgatgtggaaatcagcatattgtttgtctgggagccatacacaacaactgtgatggcagcgttgcctccaatttgtgtggttggaagtgtagcctggtttgcggtggtgccactgatttgtttccatgttgttgagtggcaccaacccgatagagttttacgacaatttggattgcaacaacctattctcgggtttccttcgcaaccgcagaatctccatggcttaacgctcaaaggcaaacaagatgagaattggttccacctgttggctccaatcattagtcagtag

SEQ ID NO: 70084 - DNA, 243 bp, Glycine max
  Peptide Sequence Number=SeqID_161769
atgtcacctacaaatacattatcaaaagctaagagaattgtaatcgattacttcgttcttaaaggtgttcccgttgtgtctctctttgactcagctccattggagcttgtaggcctaggatcttcttcatcaatggattcctttgcttcttggaagatgaatggcagcggaatggagaaggaagagagagaggagatgccacttcaaggagaagatgagtctagaagaagctcaccaccatag

SEQ ID NO: 70085 - DNA, 720 bp, Glycine max
  Peptide Sequence Number=SeqID_161770
atggcaatggagacgaccatagggtcgttcaagtttatggggttgatgcctttgaaatctctctcggtgattgttatgggaggaaggcttctcggtggttgttcgtcttcttgctctattggggttgttgctcatgcctttgcaggtgacgcctctgcctctctctctcctccgttcggtccctccttctatcagcatctctgctcctacaatggtcctaacggtctaggaggaggtatggaggaggggggtaattgtatgggtacctccacattaaaagcttcttcgaggattgtggctcaatttgttgtcaaggggatgcgattcactctgggtgcactcgttgattgtgtgagcagagtgttcgtcctcttgagggtatctcatgagcctccaactcgtcgtgaagggattggaattttatgggggtggctctcgcctgagaccggatcgtgtgctgaccataagtacgagtggctgcaggggaagttttactgcgaccccacgatgggtgccaaatgtaattatcgaaatttggagcggagtaatgccaggtggactgtcatcagaataggctccacgatctctcgtgtcgaacttgcaagtatcctgtgccgaagggataaggggggtacctgcaaaaaggactctgacactcaagatggactcgttggtggagatgggaggggaggttaccaaggtactcatcgtcacgggtag

SEQ ID NO: 70086 - DNA, 357 bp, Glycine max
  Peptide Sequence Number=SeqID_161771
atgtcgatcaatctagcgtggcgtggtgaacaatttggagttttcctcgatgatgctggagttgttggacacgtcgaaggccacaagtggcacatgcaaatcgcaggaggcaatggcgcgttccgtctcgacgcgccacctagcagtggtgtcgccagcttcaatgacgttttgcaggcttggactcgccagtttgactggcgagttgagagtaggggactgttatcctcagactacgtgcagcagcgttgcaggagggagggacaacttttttgcagtggaaagcgccagtgctactggcaatttgcactgcagttgggagtagccagtagcactggcgatttgagcttgaagtag

SEQ ID NO: 70087 - DNA, 825 bp, Glycine max
  Peptide Sequence Number=SeqID_161772
atggataaaaggaagcatggctcaaattttttgcagggagtgactcaatgttgggatgagtggcaagttgctggatgcctggatgtagctctaattcagctggacgaaattgataagatggccatggtgcttgattttgttcttctgcaacagggttggaatattgagaagcttcgagaggccatccctagaatgcatgcccccgtctttcgcaacggcgaggactgcggctcctctcccttcgccaccattaacgtagccatgaccctcgacaccaactacctccgcagcaccatggccacggtgttctccatgcttcaacattcgacatgccccgagaacctagccttccacttcctctccgcccatgacgacgctcccgaactcttctccagcatcaattccaccttcttttaccttaagatgaagatttatcggtttgactccaacagggtccgcaacaagatatccaagtccattcgacaggccttggaccaacccttgaattacgccaaaatatacctggccgataccataccagaagacgtgaaacgcgtgatatatttagactctgacttggtggtggttgacgacatagccaagctttatggtgttgatatgaagagccaaggtgcagtgcgagttggtgtcgagggtcatggctacgttaatggtggtggagggaaaggggtcgcagtcctcatcgttgcggaaggcgggggcctcccgaaagagagggagcttcagggaaggacggctggtaacaataatttaacggtgttaaataattttaacggtagagacctattgggaattaaagggtaa

SEQ ID NO: 70088 - DNA, 282 bp, Glycine max
  Peptide Sequence Number=SeqID_161773
atgagaaagatgagtcactcttccatcaatgaagacttcaaaggcttagacgttcaccaagaatctcaatatgcaaagatttatcgccaggcgacagaagatgcaacttttcttaagaaatttatagagaagaatgaagacaagaagttcatagggaagaaaataaacaagttgttcatcggaatgaacttaaagaagaagaacacaaaatctactgaacccacatccaacaaggacaaggcatcattagctcctggttttcttgagagtatgtgttcttag

SEQ ID NO: 70089 - DNA, 246 bp, Glycine max
  Peptide Sequence Number=SeqID_161774
atgaaccggaagcagagaagggtgagtgagggagaagaaatagaaatgggagcgctgataacggcaagtgtgagggtggatttgatggaatcaagattgaacactgcgattggagattgtagcgaaacgaaggtggctcgagaaggcacaaagaggaagaagaagacacaaacgtggattgaaccattgccacacaaagaagagaagaagcaaagtggccatgaaggaagagtgaaagggagttga

SEQ ID NO: 70090 - DNA, 380 bp, Glycine max
  Peptide Sequence Number=SeqID_161775
cagggattgaaggtagacattcgcgctgaaaacacaacggggctactatcaaaggtaacacgtgtgattcgtgagaatggactatccataaccaaggttcagataggagtagagggtgatgagatggctgtaggatcattccatgttgcaaattcttcaggtcaagaattgaacccaaatatagcagagttggtgagaagacaaattggtgggtctgtagttgcaaataacaattcgccctacagggtccctaaatccttatcaaccagtaaaaccatgcatgaaaccaagagtagcagagacgttagaccaaggttttctactggaagcatgctatggtctcagattaagtgcctttccaataatttccgtcccattag

SEQ ID NO: 70091 - DNA, 630 bp, Glycine max
  Peptide Sequence Number=SeqID_161776
atgacctttcatttggtcttgccaaaagttaggtatgcactgcagtgggagtctaagaatctgattgctgtgagcactgcaattcaagattggcttacttcaagacttgcgatggagctgatgaaacgaggggcaatgatgactgttttgagctcactcttaactgctttggcttggcaagctgcgttacttgcagcaactgactttataaacagtaaatggacaatagctattaacagatcaaacaaagctggtaagttgcttgctgaagtattgttaagaggataccagggaaataggcctgagacactcataggttactcacttggggcaagagttattttcaagtgtctacagtatttggctaaaactgaaaacggtgctgaactagtagaaaaagttgtgcttcttggagcacccatcccaatcaaggatgagaacggggaagcagctagaaagatggtagcaggaagatttgttaatgcttattcaaggaatgactggatgcttggagttgccttccgggccagccgtctactcactaaaggattagctggaatccaacctgtcgatattcccgggatccaaaatgccattcgtctaatccgtgggccacacaaaagatcttag

SEQ ID NO: 70092 - DNA, 885 bp, Glycine max
  Peptide Sequence Number=SeqID_161777
atggccgcagttcggaggcgggtgtggcagttatcttcaattccaggtttcggggcttcgaaattggaagtgtcgtcgtcgttccaaagagcaattctcgatccatttcctgtttcggggaccagacacttttcccaagtggtgaaatccaacggcaaacactcgttccaaagagcaattcttgattcatttcctgtttcggggaccagacacttttcccaagtggtgaaatccaacggcaaacacctgttcctcgttgacaccttggcccttgttaggagactggaaggcgaaggagtgccctcaaagcaagccgaggcgataaccgctgccataactgaggttttgaatgacagtctcgaaaatgtgtctcagtcgttggtatcaaatggtgagatgcagaaaattgaaatgatgcaagaatccaacctgtctaagtttaaagcggaggtgcagagctcacaggtattccgtagtcatgtggatgttatgttatgtgtcgagtttgagttggttgcgcacatggacgtcgtggtggtcttcggcaatgatgataggcacgattcacccatgaaaaagcagaaagggtcaacgaaaaggcgttgggagtctgccaaacaaggacagagcagctgtgcggtactattcaccccgaagaagggctgcacggaaaaggaaaacaaaggagaaccgccaaataaacatgaaatgacccctaacttttgggggcgcgcctggtgtccgatggtggtgccatcgatgacattgggtggattgtttgtgggtgctcctgatggtgggtttgtcggccagagaggtcacttgagctctgacggtggccggtggcagtgcctggaaagtgactggcgatgggaaactcattga

SEQ ID NO: 70093 - DNA, 258 bp, Glycine max
  Peptide Sequence Number=SeqID_161778
atgccaccattctgcaccagctctcctcaatatttttccgttaaaccattgcctcaaattccaatagccaccataagagtcgcattacagatccacaaagtaaccttcctaggtttggaggtgtttggtagaggcttaataatgaaactaaaaatgcaaagagatattcttactttgatgaagagacacgaagtaccagcggcgatagcagaggagtacaacgaccaattccaaaaccagttcactaaagggggttga

SEQ ID NO: 70094 - DNA, 495 bp, Glycine max
  Peptide Sequence Number=SeqID_161779
atgacaacggatatctcggctcttgcatcgatgaagaacgtagcgaaatgcgatacttggtgtgaattgcagaatcctgtgaaccatcgagtctttgaacgcaagttgcatccgaatttcccctggaagggggcgccagagagggtgagaaccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggatatataaatagtagactactcttaaatccttggctctctcaagggatggaccctattgcttcgatgcatgttagggacgcggtggggaagggtggcgcagtcaactgtgggcggaggaagaagatgcaaaatgaatatggacgtaagaaaggaaagatacaccccttattcgagaaagggaaaactccttatcgtaactga

SEQ ID NO: 70095 - DNA, 1548 bp, Glycine max
  Peptide Sequence Number=SeqID_161780
atggctctcttagcggaagttgtagaccaatcagaactggagaactcgctaagcgcacatttgcgcgctaagcccaaaaacctcttagcccaaattctgggttatgcgatgaactcgctaagcaagcctgcctcgctaagcgagttcatatgttttgatgaatttctgggtttcaggatgaactcgctaagcgcaccctattctgctaagcaagttcgtcaattaagcgcgctaagcgcaaatagctctctgtcatggaataaggctaagcgagcttgtctcgctaagccactagtgttatcagtagtgagtctcgctaagcgcccactggcgctaagcctagatacgagatggtctcgcttagccattgtgttgtttttctattttctcgctaagcgcaccctgtgcgctaagccacttgcttttatttctattgcctccaagaagagacgcgcttcatcctctagacctcaagagccctatgacacatccagatttgtgtctaaggtcgcatgggagagatacgagacaaacatccacaacaaaaacatcctccctgagagaaatgtggagttggcgtactcacattgtgatgagttcctcagggagctggagaaacggcagtggcacaggaacttgacaaggcacatggagaatcacattgacctcgtcttggtcaaagagttctattctaacctctatgacccagaggatcgatcccccaggaaatgcaaggtgtgggtgaagacgatcaagttcgatgtcgccacgcttaacaccttcctagagactctaatggtactcgagcctggggagaggtactcagcttactctcatttttgtcatactcaccctgaccctcaggagatcgcaacaaaactatgtataccagggctaggtgtcctttcctactccaacctcgcccctacttttcacacctctgatcttaatatggacagggcgaggttgatgcatagccttgttatgaagatggatatggatctgggctcgatcatctcaggccaaatctcccagatgacccaatccaactcctctaggcttggctttcctacccttatcatagctttttgcatagccagaggggttgtgtctgattcattgactttcgagtccctcagcccaaccattaatttggcctatattaggaagaattgttggaacctagaggacccctccatcatattccctggatcccgcaaggtcaggaccagggcccctttagatgctcaagcttcaactccagcaccaacaccagtacctccacctccagcacctatctcaacgccagccgatccctccacatcgagcagtgatgccatcatgcccattatgaaggacttcttggcacaggctgcagaagacactctagaggctgaggataccccagaggcagaggtagaggctcaggacacaccgatggaggttgctgaggagggagtctcaggcgcagcagaggcaggcattgatgatgactacgtagcatatgtcgctacggcgcaggggacttgggatccatggcccacttaa

SEQ ID NO: 70096 - DNA, 243 bp, Glycine max
  Peptide Sequence Number=SeqID_161781
atggtctcgcttagcataattgccattctagagagactttcgggcttagcgagatggtctcgcttagcccaattaccattaaagcccggacagagagggtttagcgtcgcatgtgctcgcttagcgagaccccatcagccactagatgaggggttggtgcgcttagcgagagtattgctcgctcagcacataggctatgtctcgcttagcgcgggtgtcacgctgagcgggttggatgactga

SEQ ID NO: 70097 - DNA, 2046 bp, Glycine max
  Peptide Sequence Number=SeqID_161782
atgaagagtatggaaaatgatgacactgttgaccttaataatcaaaacaacaactggttgggtttctcactctctcctcaaatgaataataataatataggagtttctacacacacacaaccttcctctgctgccgctgaagtggttcctacaagcttctaccacactactccacttagtagctatggtttctactatggacttgaagcggaaaatgttggattgtattcagctttgcctatcatgcccctcaaatctgatggctctctctatggaatggaagctgtgagcaggtcacaagcacaagcaatggctactacttcaacaccaaaactggagaacttcttaggtggggaagcaatggggacccctcatcatcactatgaatgtagtgccacagaaacaatgcctctgagcttagacagtgttttttacaaccaaccctcacgccgtgaccaaaataataaccaaacttaccaaaaccatgtccaacacattagcactcaacaacaacagcaacaagaacttcaagcatattactctaccttgagaaaccatgatatgatgttagaagggtccaagcaaagccaaacttcagaaaacaacaacaacaatcttcaggttcaaaacatgggtgatgatgctgtttctgttcctgttgctggccttaagagttggggagtgaggaacttccaagctagccatgcacatgagtcaaagatgattgttcctcatcatgtggaggaaaatggtggtgaatcagggtccattggatcaatggcttatggtgacttgcaatctttgagcttgtccatgagtcctagctctcagtctagctgcgtcacaagttcacaccgtgcttcatctgctgtcattgattctgctgccatggatacaaagaagaggggatctgaaaaagttgaccagaagcaaattgttcataggaagtccattgacacctttggacaaagaacctctcaatatagaggtgtaacacggcataggtggactgggagatatgaagctcatctttgggacaacagctgcaagaaagaggggcaaagcaggaaaggaagacaagggggttatgatatggaagaaaaagctgcaagagcttatgatctagctgcactcaagtattggggaccctccactcacataaactttcctttggaaaattatcaaaatgaacttgaggaaatgaagaacatgactagacaagagtatgttgctcatttgagaagaaaaagcagtggattctcaagaggggcttccatgtacagaggagtaacaaggtctcataggccaacaaccactcaacaccaccaacatggaaggtggcaagctcgaattggtagagtggctggaaacaaagatctatatcttggaaccttcagtacacaagaggaagcagctgaagcctatgacattgctgctataaaattccgaggagcgaatgctgtaaccaactttgacataacaagatatgatgttgagaaaatcatggcaagcagcaaccttcttagcagcgagctcgctaggcgcaaccaagagacgacggacaatggaactcagtacattgatcaaaatcacaataagccttctgcatatgaggacactcaagaagctgcaattctgatgcatcagaagagctgtgagacccaaaatgatcagtggaagatggttctctaccaacaatcctctcagcaacttgagcagaatattccaccgagaattgagagtgacagaactaaccagtccttctcagtggctttggaaaacatgtttcatcaagaagtagaggaatcaagtaaggtgagaacacatgtgtcaaatccttcttcattggccacaagtttgagcagctcaagagaatgtagccctgataggacaagcttgccaatgctctctggagtgccttcaacttcatcaaaactattggctactaatccaaataacgtgaattcttgggacccttcaccccatttgaggccagcacttactttgcctcaaatgccagtttttgcagcttggacagatgcatag

SEQ ID NO: 70098 - DNA, 984 bp, Glycine max
  Peptide Sequence Number=SeqID_161783
atgaatgtttctgatcctccaacacctctatctccgcctatttatgccacctctataccttcttcctttgcaccagcctctcccactcctgcctctgccgcactcgctcccacttcttctactacaccgctgctacttagtgttggggtgacgacgacaggtgtcttgacaagcatgcctcctccttcttctactttgtcaccctcagctcctattatcctgcctcttgccatgccttcttcctcttcacgcccaagcatttctttggaccaggttaagaatttggctgacactacaaaggtctttctccagagaagcctagctatcttaaagaaaaatgtgaataggcataaggagactaggggcgggattacttccttggaggttgaggttgccaaatggagagccactacccggacagtgtggcgagtggagttccctaaggtggaaaatgctactgtcgcccttgctgaagtcgttaggtccaaccatcgattgttgtccaaggttaacaatatatttaccaagttagtaagcacaagactggaaggcgacaaggtgtccagacgttacaaagatttattaaaagaaaagaatgacttggagtgtgaggcttggctgagagattcagagctcattgtgtccaacttccagactaagctgaaggagtccaagctcaaagtggagaatgagaaagaggtgaataaggagctagaggatgagctcttaatgtttaaaaagaagtccatggagcaatacgagatgggatttttcaaggtcatcaggatgagccttaggggtagagaggctcaccaagggaaaaccttgggtttaatgagcctttggagatttaaccaaggacatggacgtgttcatcctgagtttggcgagactcaccaagggtggatcttgggtttgacgagcctttggagattcaaccagggacacattcatcttgggttttgcaagactcaccaaggatag

SEQ ID NO: 70099 - DNA, 412 bp, Glycine max
  Peptide Sequence Number=SeqID_161784
atggcagcgcagttgatccatgatcgcgaggtgatggagtgcctagagggtgtttgggagaccctcgaaggcaatgagaggtgccgattccgtggcacaattcgactcactgctacttcattaatacatctggaggaacccgcatgcacacttcagcagcctgtggaatggatactacctacacctactccatatcgactagtggagccagttcaagtgatagaggtgtcatcctctgaagaagatcttgaagaggacccagaagagttacctcctagacctgctgtggatgcccttgacttacctgaggatgatgaggacccactccctgatgttgattctccagaggatatcatgtcagcatctgagggagactctacagaggagagcggccctagagggacagcgaata

SEQ ID NO: 70100 - DNA, 261 bp, Glycine max
  Peptide Sequence Number=SeqID_161785
atggaggtacccctcggtatgaatctgttgaagggtacattctttgtggtacaagtagagggtacatctacttgggctgttgtaactgagaacaagagagggtacatctcttgtggatcagttcaagtggagggtacatccacttggttgttcaaagagaacaagggatggtacataccttgtggatctttgcttgtaaaggcttttataaggttgaaaagaaatctcaaggaccgcaggtcgcttggggactggatgtag

SEQ ID NO: 70101 - DNA, 888 bp, Glycine max
  Peptide Sequence Number=SeqID_161786
atgggagacgacatggtgttgattttgggatgctctgaggattgggtgcggtgtactggagttccgttggatgcgtggggagaggaatgctttggagcgatcgccggaaattttggaaaattggtgaaaatggacgcgacgtttgccatgttggtaaatgtgagctatgccaaattactggtgttggtggcatcaccaatgcttgtaaattttagcgcacaaattaagattaaaggagaggtatatctcgtacgagcgatagaagaaaatccgatatcatcagaagagtcaaacatcttgtcatcagattctgaaaatgagaatgtgagtctcaatggtttttctgatgaggttggtggagaggatggcgagggaaaaggaactagaagggagagccagcatagaggaagcggagaagagcatcggtccacgaagttggaattttcaaaattcaacaatgtggacattatccatgagacaaacactttgcctaatggattcaacatggaagacacaccgggtaaagatggcgaagaggtagcatgttcacctgttgaggatgacagtctcgtgactaggttgagcagggcagatgtcgacatgtcaaagaaggtcccacaaggagaacacaaagaacgtgaagctctgaaactaacattaaaaggtatgaattgtcatgatgaggatgccaacgggaagtgtgtagacgagaaaagggaagcgaaacgtcatggggcgattatgaattctgcaagtcttaaagcagaccctaccaccaataaaaactctgattgtggaaaatttttggagaagacggaggtgttgggcctgctcaatcagaggaagacattgtatcttgttgctaagtgcacccagcaaatttcataa

SEQ ID NO: 70102 - DNA, 880 bp, Glycine max
  Peptide Sequence Number=SeqID_161787
tgttcctcttggtgtgagggtccaactgcaagcaacagcggcttatggcggccaccggtggtcttgggtggtggaaaataaggttttagggtttgggagacgtttttgggagaagaggagagtgaaaatcatgtttttcacgctgaggatcgcacctttgggccgctcagcgcaattcccctcgattggaattgggcttagcgcagctttgggccatttagcacaattcccctcggttggaattgcgcttagcgcgcgattctcgcttagcgggacatcaaaggttatggttttcaagatcccaacgggtgttacactttggggtagtaaaggggataataggaaaacgtgttgggtgggagctcatggagtaaaaggagggtatgaggttgggagtgaacctcttgcctctaaatatccttgtttgtatgcaacatctacacagaggggacataagtttgagtggcgtagagaacactttatgtgggaattggaattggtaaacaagcttacatcttatgtgaatggttataatctgagtcaatttatggaggactcttggctttggcgaggtgaaacaaatggatgtttctctgttaagtcagcttactgtggaatgtttgaacagcacaaagatagttttgaatgtgaaatattggcagttacttggaaacttaaagttcagtcgaagattcgttttctaccagggatggtgtttaggaataagattcttgctggtgacaatctgatacacaggaacattgatgtgcccgattattactatagtgtggaactcgtgttacgggtagttttagttatctgtggtgcttccttggacgactactggccacttctatcaacatcacctatagggagttag

SEQ ID NO: 70103 - DNA, 153 bp, Glycine max
  Peptide Sequence Number=SeqID_161788
atgaagatgaagagacatcttaagaaatctcgggttttttcgattgaggacgaggatatggttaagccgaagcaacagaagaagctataccagaagaagcaaccacacccacaaagtgagataagcatagggtctgtgtttctactgaaataa

SEQ ID NO: 70104 - DNA, 255 bp, Glycine max
  Peptide Sequence Number=SeqID_161789
atggatcttagcaatgcatgtggtagtggtgggtggttaggtgatggcatgatggtgaatttggtgtgttgtggaggttgcgttgggtggtggtgtttgagtgcgacattggtgttgtgtggttgggtggaggttggatgcagtggtcatggggggtttgagggagagatgacttggtttgattgggagaggaagggtaaggaggcaatattaggaattttgggagtgcatcaagcaaaaactgatgtgggttaa

SEQ ID NO: 70105 - DNA, 279 bp, Glycine max
  Peptide Sequence Number=SeqID_161790
atgttgatgcatcatgcacagatgactagccctggcatttgccaaccagagttgcacaaagtgatggagggtgctagtgttttctgcacgatcaaaagatttttaaggaatgacttttattacaaaaattacaatttttattacaaaaattacaatcattgtaacgacgcctatcaccttgtggaatttcgagcaactcgtgaaagtccaaacctgaagattaacatggcaaaaacatcagtaaaaagtaaaaccaatgatccattatgcgagttttag

SEQ ID NO: 70106 - DNA, 225 bp, Glycine max
  Peptide Sequence Number=SeqID_161791
atggagaagaagacaacgagaaggagaagacagcgcaaaggagacaaaacatacctaggtatggtggcgaaggagaagaagcaaagacttgtgatgatgctcgagtgcgacgaacacgatgctcagatgcagacaaggacctttaaggttaacatcggttttctggaaaaaaccgatgttaacatatcaaacgttaacatcggttttctcaaaacccgatgttaa

SEQ ID NO: 70107 - DNA, 177 bp, Glycine max
  Peptide Sequence Number=SeqID_161792
atgggtgccaagtacctcgaagcggtcaagcaaaggttgcatgccatcaaacaatggtccctggacgaaattaggcgcgccctgtgcgctaagcgaatctttgttcatgtgtcaagcgagtcacttttcgcgctaagcgcattaacccctactcattggctgaaagggcctcaatga

SEQ ID NO: 70108 - DNA, 621 bp, Glycine max
  Peptide Sequence Number=SeqID_161793
atggaggaggggtttcctctctgttgtagatctcttgtgggaagggaggttaagggtataggggagtctaatagtaagggagattttttggtgtcgtctccctccttgatcttagattcaaagaaaacaaaggatatgtctgtgggtggtagtgatgaggtggagattcatgcacaaaagaataaaagagatgagaaggtattggagagggcgaatgggaaggctaagaggcagaaaggagacaatgttggcatggttggtgaaaaagttaggaagggtagggaaggcaagttttgccagttattattcctagttacaagtgggtttctatcaaggttgaagaagaggattaacataacgatctccaatgatgttgagttgttgatagtggagtcatgtagcgctaatgaatgcatttttatgagggcgggcaaaggtgaggtagacctcgaaaagacaaagaagagaaagcaggttaacattcctccaagtttgacgtgcaaaagagatgttgaggttaaaaagaggctatgtcatgaagtgctaaaaatgacagttgagctcaactcatcagttgggctaagcgtgcatccatcgctaagcacagcttcagcgcgctaa

SEQ ID NO: 70109 - DNA, 771 bp, Glycine max
  Peptide Sequence Number=SeqID_161794
atggagatatgtacaaaggtggctagcaaaaacaacatggaaggaagacaagtggggttagtagaatcactcttcaaaacacaactgaggataagtgaaagggggatgaaaactcttagagtaaggaggacgaaggacaacatgtttctcctaacaagggaggaggggcaagactttgaggagatccttggaagcaactcagagtgtgtgcctttgcaattctggaataacgagtgtttcaccaaaatccttaacattattggctcactggtgtctgttgacaaacaaactagttcctttgtgaatctggatagggcgaggatcttggtgcgtaccatgtggatggagtttattaatcaacatagaagaattcagatcaataagaaggtgtgcaacatcatggtgttagaggaaaatggtgggtacgatgagggtagagagatgtgcgtaaaaggagggtggtggggcaagatggtaaccagtgaggagccatttccagtggtggatggaaagggactatcaaactctatggtcaacctagtcattagggtatgtgatagtgggcaaggatacaagggtacaaacaatgaatttgaatccttcagtagtcaacagggggagcagaatgaaaaggcagacaaatctgatgagggaggagatacatcaaagaagaacgataatgttgggaactcagtagaggctcagagagaccctttgccaaaaggtggtagaccgggtaaagaaagaaacctaaagagtaggggaagttga

SEQ ID NO: 70110 - DNA, 327 bp, Glycine max
  Peptide Sequence Number=SeqID_161795
atggctgataggttcgcacgcttggtcaaattggacctcgttcagtccatctctcgttccttctatcttggtgtcaccgattccaacctcgctgtcatcggcactgccttcacttgtttttatggcaccaatagtgaaggtgtggtggaggttgggaactctatttgggtcaaaggaggttgggagaattctgatatgggtgagaaaaaggaatctcatgaagacagtacaagtgaaggtttcaatctcttctccgtctctctaacgtttgagaattctatcggagcagtcggaggaataactgaaggaatctcagggaaccgctaa

SEQ ID NO: 70111 - DNA, 1077 bp, Glycine max
  Peptide Sequence Number=SeqID_161796
atggggtgggagttctgtaacaggactgctcctatggcggtgccggaggcgtcggtttcaatgaatcctatgaggctcatgaaacttctcaattttgagggtgatgccggaattggccaatctaccatagcctgtattttatctgggtctagggctactccagatgcacttagaaagacaaaggaagaaagctccgcacaattgtttcaaggtgttctagggggcattacacagcctgaatggcataaccttgaactcgtagtgtccatgcaactcatcgatcgtaggcatgggaaaacgatcattgatggtaacggcgttcaaggctctgtaggggaagttactgtggctcctggaaaatggtatcgaattgatgaagaagatggttcagggatgggtgtgtatggagtcggggggagcttcaacaactgtactccgagaactatattggcgcctctgatgggtaaggtgtacaaatcgacagagaaggttgatttgggggacacccgaagggtcctcgtggtgaagattagcgctcgaattgaggtacagagtcgaaggggtgaaaatgggacaatcatcttcatcatttgcaataagaagatgaagtcacagttgacacctgtgaccgagaacccatttctcgtcacagtggtggacgcgatgatgaaggtaaggccaacggacccaccagagacgaaagggacggggacggaggaggccgtgagtgacatcagttcaggatatagccccaagatgaaacaactcaataatgtcggcggagcgaggccaacaattcgattggcgagtcgttcatactcggtgggggcaaatcgcaatttgagagcttgtaacatggccggccaggacgtgatgaactcattgcaggtcatccattggtaccaagacaaggcgggtccatccatggatggtgggggatttgggggaagtggggttgatggtaagagcatcaagatgattaaggatggaatccatcttactgtttattgcggtttgggtttgcgcgagggaggcatggttctgtgtaagggtagcttagccttgagtcagtcatga

SEQ ID NO: 70112 - DNA, 342 bp, Glycine max
  Peptide Sequence Number=SeqID_161797
atgatgacaacaaaagatgatgacaaaagtgatgaacaaaaagctcaagtgaatcaaagaacatccatctcaagaatcaagattcaagattcaagttcaagaatcaagaagaattcaagactcaagaagaaagcctacaaacaaagattcaagatctcaagaatcaagatcaagattcaagaatcaagaatcaagactcaagatctcaagaatcaagatcaagattcaagaatcaagaatcaagactcaagatctcaagaatcaagaatcaagactcaagatctcaagaatcaagatcaagattcaagaatgaagaaaagactcaatcaagataagtattaa

SEQ ID NO: 70113 - DNA, 228 bp, Glycine max
  Peptide Sequence Number=SeqID_161798
atggcggcgactccgcgcgtattcctttcgtggaacacgcatcccgcgagtctcgcgtcgccctcccgccgaagggtaggttgcgacagaatggatatgagtttttccccatcaaacaaatttacaaattcaaaggttttaatttgcttggatgtttttcccatgaaatttgtgacccacgagaaaaccattaaaacagtagcaattgcccacggtgtgtccctttga

SEQ ID NO: 70114 - DNA, 585 bp, Glycine max
  Peptide Sequence Number=SeqID_161799
atggaaatatttattcagtcaattgatcctggtgcatgtaatgctattgctaaaggtctatttataccaactaaagaagtaaatagtgaatcggtacctaaagaatgggatgatataaaagatgatgagaaaagaaaaatgcaagatgatcaaaaagctaaaaacattttaacttcaggtttatcttctgatgaattctttcgtactgcaaggtgtaaaagtgcaaaggaaatatggaaaatgcttgaagtcactcatgaaggaactgcgaatggaagaaaagcaagaaagtacactcttaagaaacaaaaaacaaaaggaattacactcaagggtagttcttcaaaggaagactacaaagatagctctagtgatgatgaagatgcggagaatattagcttgatgatgaagaagtttggaaaatttctcaaaagatctaaagatagaaaattctctaaaccttcaaagaagatagaaagcaacaacaacacctttacatgcttcgaatgtggaaaacaaggtctcatcaaatttaaatgtcctatctaccttagaaaacaacttgctaaaaaaaggaaagaatga

SEQ ID NO: 70115 - DNA, 1971 bp, Glycine max
  Peptide Sequence Number=SeqID_161800
atggttaccttttccccagcttgcattagtcctgctgatatcaatgctgaggaaactctcaatactctcaagtatgcaaaccgtgctcgtaatattcaaaataagcctgtagttaatcgagatttaatctccaatgagatgcagcaattgcgccagcagttgaagtatttgcaggctgaactttgttctcgggtaggagctcctgctgatgaagtgcgggttctcaaggaaaggattgcttggcttgagtctactaatgaggacctctacagagaacttcataaatatcgcagtagatgtgcttttgtagagagatgtgaaattgatgaacctaatggacacattattctcatgaaaaccgatgggcttgagaggcactttcagagcttagattcatctgaccatcccatggttggaagtatatcaggtgaggattctaaggaaactgatgaagcagctaaagagttggagcatgtactattgcaaaataccatggataaagaaatgaatgaattgaataagcgcttggagcagaaagagtctgagatgaaggtcattgcagttgatactgaaacactcaaacaacactttgggaagaaaattttggaacttgaggaggagaaaagaaaagtgcaggaagagagggaccgtttattgcacgaggtagagaatcttgcttctaattcagatgggctagcacacaaaactcaagatgttcgtggccaaaaattgaaggcattggaagcacaggttcagttgcagcataaaatgaagcaagaggcagaacaatttcgacaatggaaggcttctcgtgagaaggagctactccagttgaaaaaggagggaagaaaaaatgagtacgaaagacataagcttgaggctctaaaccaacgtcagaaaatggttcttcaaaggaagacagaggaagcaacaatggctacgaaaaggctaaaagaattgttggaggcccgcaaatcttctccccgtgataactctgtttattcaaatggacatctacagcctgggctggtcaatgaaaaatccctccaaaggtggcttgatcaggagctggaggtcatggtacatgtgcatgaagttcgtgctgaatatgacaaacaaaatcaagtccaagctgcactggaagaggagttggctttactaaaacaggatcggttttcagatgggcagactattcccaaaggaaagagcaaatatttgaggctgttatccatgtcaccagatgcaaaagttgagagaatagcttctcttgagaacatgttgtgcatgtcctcagttgctttgaaagccatggcttcacaactcactgaggcagaagaaagggaacgaacattaaataaccgaggtcgttggaaccagctacgctcaatgggagatgcaaagaatgtgcttcaatatttgttcaatgctactgcagaagcaaggtgcaaattgtgggaaaagaatatggaacttcaggatttgaaagaacaactaaatgagcttgtagcactgctacaacaaagtgaagcacagagaaaagaacttgtaaaggagcaaaaaataaaagaacaagctgttgccatcacattggatacaccagcattggaaaactcacggtccttaaaacaccttgcggatgaaatgagtggtccgttatctccaatgtcgcttcctgcaccaaagcaactcaaattcactcctggagttgttaattggtcaggcagggagtcagctacatttttagatgaagcacgaaagatgatacccattggagagttgtcaacgaagaggctagcagctataggacaagccggaaaactttggaagtggaagagaagtcatcatcaatggctgctacagtttaaatggaagtggcagaagccctggaaactctcagaatggatcaaacacagtgatgagacaattatgaggtcaaggcctcgagcacaagctttgattaatgtgatgtga

SEQ ID NO: 70116 - DNA, 421 bp, Glycine max
  Peptide Sequence Number=SeqID_161801
atggaaaaaccccgtcatcatgcctacttgaatagcagtggctctgctattcaagagacacagggttaccactgttcaaggcttgtcagaaccatttgcactatcatggttagaacacgaggtctacgtcgtgtggtaggcacaggtagaggcagagaccttagtcaggatgtggctgaggatgttcctcggcgtcgtaggcccactgcctcagcacgtaggcaacgggttacccagagagtcgaggatgttcctcagttggctaaggatgttcctcagttggctaaagatgttcctcagttggctaaggatgtgcctcatgcgtctgatggtagcccagagaggacagcagctgctgatgatgctgagatagatcgattgactagtgatgggacagttgatgatgatgaggggttctgtg

SEQ ID NO: 70117 - DNA, 912 bp, Glycine max
  Peptide Sequence Number=SeqID_161802
atggctgaggatcctggtgtgcttgaggttgttaaacaattggataaggcttgtacagaggcagggttcttctacgtgaaaggacatggttttcctgagactctccttaaagaagttagagatgtaacgcgcagattctttgaactttcatatgaagaaaaggcgaagatcaaaatgactccagctgctgggttcagaggttatcaaaggcttggagaaaatataactaaaggtgtacctgacatgcatgaagctattgattgctatagagaagtgaccaaggacatgtatggagatcttggcaaagttatggaaggaagcaatcaatggccacaaaatcctccaacattcaaagttcttatggaggagtatgttagtctctgcagaggcatgccttttcctcctcccctctttttctttccatcataccttgcaaggaaaattatgcgtggaatcgctttagcattaggtggatcgcccaatgaatttgaaggtcaaagagctggggatccattttgggtaatgcggctcattggttacccaggtttattgacattacttaatcaagatgacgatgtaaacgcacttcaggtgagaaacctgtctggtgaatggataacagcacctccagttcctgggacatttgtatgcaacattggtgacatgctaaagatttactccaatggtttgtacgagtccactttgcatcgggtgataaacaacaactcaaaatatagagtcagtgtagtatacttttatgagacaaacttcgatactgcagtagagccattggacacacataaaacgagggcaaatggcaacaaggagttcaaaagagcagtctatggagagcatttaactggcaagctcatcgcatgcatgtctagacctacaagtgctgataatatttga

SEQ ID NO: 70118 - DNA, 1113 bp, Glycine max
  Peptide Sequence Number=SeqID_161803
atggcccaaaccccaacttctctcgatgcagagcaccccgccgccgccgaccagcacgtgggctttccggcccggagcctgagcggagagtcttgggcggagcgggcgtgggcccactgggccaagctgggccggcccaggttcatagtggccccgatggtcgacaactcggagctgccgtttcgcatgctgtgccgcaagtacggtgcccagggcgcgtacacgccaatgctccattcccgcattttcaccgagaccgaaaagtacagaaacgaagaattcaccacttgcaaggaggatcgaccgttatttgttcagttctgtgccaacgatccagatgtgttgttggcagctgcacgcaaggtggagcctttttgcgattatgttgatattaatcttgggtgtcctcagcgcattgctaaacggggatactatggcgccttcttgatggataaccttcctctggtgaaatctctggtagaaaaattggctgttaaccttcaggttcctgtttcatgcaagattaggctctttccaaatttagaggacactttgaagtatgctaggatgcttgaggaggctggttgtatgcttttagctgttcatggcaggacaagagatgagaaggatgggaagaaatttcgagcagactggaacgctatcagggccgtgaagaatgcagtcagaatccctgtccttgcgaatgggaacataaggcatatggatgatgttagagactgcttggaagagactggtgttgaaggggtgctttctgccgagacactgcttgaaaatccagctctctttgatggatttcgaaccgccgaatgggtgtctgaaagtgaaggaaccaatctggatggaaaactggaccaggcagatctgctaatagaatatttgaagctttgtgaaaaatatcccgtgccgtggagaatgattcgttctcatgttcataaattgttgggagactggttcagccttcagcctcacatcagggaggaacttaacaaacaatctaaactgacttttgagtttctttatgacatggcagttacccagattaacacagctgcacaacatttggagttcaaagttaagccagaacctcaatga

SEQ ID NO: 70119 - DNA, 234 bp, Glycine max
  Peptide Sequence Number=SeqID_161804
atggctgaagatatgaatgttgataccaccactctaatgcaaaccccatcagtgctgaatgctaccttttccaagccactcccggacgtgtctaagatcaaggtctttaatggccaaaatttccaacaccggcaagaacgctttaacatgctgcttgacatgtatggggtaggtttttcccttaccaccaaaaagccattttctgttgatgtattcagcatgaaagccaattag

SEQ ID NO: 70120 - DNA, 1449 bp, Glycine max
  Peptide Sequence Number=SeqID_161805
atgtcttctttcttgtctgatttcatcattggactggacagaagtgattctgggggctctattcagcaacccatcatggatcgggaggtcatcttgataagcggtttctcgtctaaggatactcatagaggtgcgtctgatagcgagtcctcctcttcagagagggagaggacgtcatgccaaactagtgggggcatttcttgcccatgcggaagggtacgaccttctgttgctgttggggagccagtctcggttactgtgatcctcccctcttttgcttctgggggtgcgaggagagctggcggtgacagagatgtgaggtcgtctccctgcatacgacctagcgtgagttttgggtcgttgtcgtccaccccggccattgctggctatgagtgggtgagggacgacttgttgaagtacaagttctgtctaactttggccacgagtgtcactgcgcttcagcaccagatgaagctggtgaaccctaaggactctgtaagctggtcgtttaggcttgcgggaggacggggagccctacttcccattctactggcacattcacttcctcccacgactgttgttcaggagactgctcctgctgctgttgaagctgctgggtcagccattcaagctgactttgttgtgttgtcattgtccaccgttgtggcccctttgctaagtgcctatatggtgaccacttgtgctcctacggtgtcatctccttcttcattggctccagttgtcctccttgctattgttttggcggctatggcatcgccttcttcatcttcgtttcctcgtgtttcccttgatcatttgtacacctctagtgatgccgaatcactgtggggtgcaacttacaaactggagcagaagaccccgataggctttgtgttagccttcgacatgaaccttattaggttggctggggtgcaaaatgctactaactctgccaaagtgtttctccaaaagagtttggcaattctagaagataatggactatggcaccaagaggttgtgcaaaaggtggtgtcttgggaggcggaggtcgccaaatggatggctacttcttggactctttggcgagtggagcgccctaaggtggccaatgccatcattgcttttgttgaggttgtaatggctgagaagatggacctgggtgacaaaatggagagcatggcggctgagaaggatgacattgccaagagaattgttgagttagaggcccgacttagggagtcagagttcagattagaagagtctgagctgtgggctgccaaggagaggcagatcggtttctttgcgaaagaccttgacttgggtctcttcgatcccttcaaggatgtgaaggatggtgtcttgcttaatgatgaagagattgatgcagaggaggagactactgatgaagggcagggtgctgtggaggaaggcgatgatgcctgtgtctag

SEQ ID NO: 70121 - DNA, 360 bp, Glycine max
  Peptide Sequence Number=SeqID_161806
atgtcgcctttcagattggggaacttcatcgtgagatgcgtcatcgagatgatcatgcctaaaacgttcaacgtgaacagcctcgacttcagtgctgtgatcatgaaatacagtgcaacaccgtggtcaagatgctcattcggatctgatgtaccgttgtatctttcaatgttcaacgacttccaggttatgggcaaggaacctgagtctgaagtggattgtggtttcctcccaattactataagaggagagttgggtatggattttctgggtacgtgttttgacatgggtgggtggttgagacgacaaagaagtgtggtagagttgggggtgggtgatgaatggcaagccttgctctga

SEQ ID NO: 70122 - DNA, 249 bp, Glycine max
  Peptide Sequence Number=SeqID_161807
atggaaaatctccgtatgcctattaacaccaaaaatggtgaaaagatgaagaataagaaggttgcagcagttggtgtctcgttaagtgagacatatgcgcttagcgagcaacatccgctaagcgagacatcagctcgctcagcgaatgaggagaatcaaccatgcatgcacgcgctcaacgcgccatcagcttgctcagcgagtcgtttgtctcttctggcgcctagcgcgcctgactcactcaactaa

SEQ ID NO: 70123 - DNA, 423 bp, Glycine max
  Peptide Sequence Number=SeqID_161808
atgaagtttattttcagggcacatctcaatcagattcatccaacaaatataacccgatggataatcgaccctcctctggacatcacagtcccatcaaaacgcactccatggccagatgctcctcctcagctcccaatcaatgaaaaagagctacttggcacacaagatcagacgaccaagcattctacaaagactagaacatctagatcgaggcgcactcgaagtaagagaaagcatgatgccaaagtgatagaaatacactgtgccttgtggttacgaaactgctgctcctcgttgacaagaatctggattgaacagatgaagaagctcatgttcttactggataggaataggaataggaataggattcatatactgcgtgtagttactacggtggaccagcatatgtgcattcgagtctga

SEQ ID NO: 70124 - DNA, 294 bp, Glycine max
  Peptide Sequence Number=SeqID_161809
atggaagagagaatgagaatgagaaagggtggagagagtggagtagagagaacggtggtaggaaataacaaaagagagaatgagagagagaatggaatggaaaacgatggagagagaattggtattaattacgggattgctctgtttgcttctggtgccagccagcatcggagaccgaatcaaaatcgacaggacatcaacaatcaagcagacattgacacaactacaaaagaaattgaaataggaatgttggaaacgctgttaccttgtttgcaagggaaagagaaccactga

SEQ ID NO: 70125 - DNA, 408 bp, Glycine max
  Peptide Sequence Number=SeqID_161810
atgcagtttgatagggtcagagagagtgaaaagaatcctgttcattctaaggaaaagccagttcaagcaactacgggatcaaaaactgatcaaggttcaacaccaagcttcacaaccatattatttgacactcgcaaggcttttacaggctctattatagaggatgctgaaaatatacaaaacaactgcaagagaacaaagttcaacttcatcacagtttcatcactgacttgtatatatactaatcacgagtttgaccttcacaggattctggttctcaatcttcaaaaccggtctccagattcaaaatgcagagaagataactacaagaaaatgagaaggttggatctattttgtatttggcgatctaatggtgtagcatccatgattctagcatgtgctgattga

SEQ ID NO: 70126 - DNA, 410 bp, Glycine max
  Peptide Sequence Number=SeqID_161811
tgtcttttgcaagtacccttccattcgctttgtcgaatactcaggcacccgagacctcagcaaggaacatcaagcagacgaccctttggcacagaagacctttcagcacgttcaagaatcccttcatccctagtgttatggaggcgactcttccctccaattggaagaacttaattattgataagtacgattacactatagactcgaacgagcacttggacgtctacattacccaaccgacatctgatcttaacaaactatgcacgagactagccaagtacatgcagatgaaggaattggccgaatattggaaccagacatgggtcgatgtcgtgtcggccaagagagatgatgacaaacccagctccagcaaggcccgtgatgaaggaaggagggattggccaccgtag

SEQ ID NO: 70127 - DNA, 1170 bp, Glycine max
  Peptide Sequence Number=SeqID_161812
atggtgtcgatcgaaggtccgtcgttgaaggagtcggttagaggcgagtctaaggttcgagggtacgatgatgtgctactggccaatacgactgagaatgtgggtaagagcgttgcggctctggtggtggccgctactgccgagtgtccagtgctaaaggagaaatgttcgcctcccctaattacgcttccggagtacacgtgggttgacgaagagatgtgtctagtcattctccgcaccattcggttcgacgccacatcgcccgcgaagttcgtgttcatgaaccgagaggggatgaacattgatttcttctacatgcatgattacttgttccgcgatctacatggaacccattgtttctcttctactagtagcaatgtcctcgacaggataatgactcaagtcaacgctgacatgaatgcttttcaccaagattggaagaaccaacttgttgccgctagtggcaatcccttgccaaatcttgcaacatcggggcctcttgacgcaccggtagatgtggtgtcctctccggaaaggaccctagggggaaataaaaatacaagaggaggaatcatcatgagcattggagcggctcaggggagcactctaaacaccgagagaggacttcgaggagaaaaggctcaagctgccaatgcttgggggcatgaggtgctgagtcgaagcgatattgtcgccaactggggcgaggactcattgaacttgatgcttgaagccaacatgaagctggccggagacaagaacctggaggaccgagttttgacgctgactaccaacgtcaaggggctagagatacgtgcctttaatgctgatgccttggtaaggtctcaagacactgaggttgctaggcttcgagcagccttagctaatgccaacaaggagacagagaaggctaatgttgagaaggaaaggatccaacagaaggcctttgatgatttggtactaatagatgacatcctgaaggatgatgctaccccttcaccccagaggtcggcaaccccagtcgaggagccatcctgtaggatgagtcggatagtaaataatttgattaagttcaaccttagcctaggagggtgctcaagagggaactatttgttaattttcaagttcaacatcggccaaggagggtactcgggagagaactgttcgtga

SEQ ID NO: 70128 - DNA, 297 bp, Glycine max
  Peptide Sequence Number=SeqID_161813
atgcccccaaccctaaccctctgtcacttccctttgagaattgataagggaacctccgtgactgctgtgcctccgttgcaccttcgtgactatcgtgcctccgtggcacctccactgtcagcccacgtcactaacagtgggtgtgacaattttgatgagcttgttcatgtggacaataaaaatactgctgtgagtgctaccctagatcatgaaaattatgcaacattcaattgggttatgttgctacaagttattcagcaacacagccttggtgcacggttaagcattggttcatga

SEQ ID NO: 70129 - DNA, 357 bp, Glycine max
  Peptide Sequence Number=SeqID_161814
atggtttaccaaaaaaatttgttgatgcaaagagcattaaccaaatgtaaattttgtaacaagccccggtaccgtgccaagactgttggaacaagttgcatagactgtttgcatcaatacaaactgcaagctaaatgtcatggcattatgagaattgaagatcttcgggcatgttacgacatccatctgatggtgaagcatggaagcactttgattgggtacatgcagattttgctattgatccaaggaatgtgcgactcagtttatgcacagatggatttgacccatatattcaagcatcctcttcaccttattcttgttggccaatcattgttaccctatacaatcttcctctag

SEQ ID NO: 70130 - DNA, 152 bp, Glycine max
  Peptide Sequence Number=SeqID_161815
atgggttgggccaggcaggaccgtccactagctcgctatcaatttggcgaggcaaggggtaaacacgaccaatgcttagctaagcatatggtcatgcttcaagttcgtagtgctcctcaatttgcataccacgtggatagggttgtgcttag

SEQ ID NO: 70131 - DNA, 729 bp, Glycine max
  Peptide Sequence Number=SeqID_161816
atggataacattttaggaagacacatcttacctgaaaggaaggtggaaatataccacactgagctggacgagtttaaggctgaattggagaggcgtaacttccataaacgcctcaccaatttagttgacagcagcatagacttggctttagtgaaggagttttatgccaacctttactgctttgaagacccttcaccaaagcaagtcagggtcagaggccacctggtgaggattgatgcagaaaacctcaacatattcttagagactttagcagcatattccaaatattgcaggttgcccacaaataataaagagattgaggctgccttatgtataccaggccgagggtttgttttaaactctgagggccatcctgggaagattcttaggaaagatttgacgactcttgctcagatcacatctatagcccagtctaactcttctagacttgggttccctgctttgatcaccgcattatgtagagccagaggggttgcctctgatagcctcacttttgagcgcttgagcccggtcatcaacttggcctatattaggaaaaaatgttggaatcctgatgatctaacagtttctatcagaggggccaagtgggcaaggacgaggccagctgagcctccttccacatctattgctcctattccagcacgtacctcagcagctccttctgtcccagcttctgcagattttcagcgtcttgaagccatgctttag

SEQ ID NO: 70132 - DNA, 390 bp, Glycine max
  Peptide Sequence Number=SeqID_161817
atgtcttccaaggttattttgatgatgccaaagaatcaagagttaagcgcaaagattcaagaatcaagtttcaagtttcaagattcaagattaatcaagatcaagattcaagactcaaagattcaagaatcaagagaagacttaatcaagataagtattaaaaagtttttcaaaatattgagtagcacaagaagttttcacaaaatcattaccaaagagttttactctctgagggtacatctacttgggttgttgactgagaacaagagagggtacatctcttgtggatcaattctagtggagggtacatccactaggttgttcaaagagaacaagggagggtacatcccttgtggatctttgcttgtaaaaggatttttacaaggttga

SEQ ID NO: 70133 - DNA, 693 bp, Glycine max
  Peptide Sequence Number=SeqID_161818
atgggttgtgaggaactgaatcaagctcatttgtacatattgaataacacccaagaggttatcccatacaaagaagctcacaaagaatttgtgaagattagtcactcaaaaatgaccaagaaacaggttaatgggaataccagtgtgaaagtcgatgatatgggatttactttgatagatcttaatagggttgcttattctgatgagcctttcatcatggcagaacaagaaaaacaacactcaggttgcattcatgctgcgagagttggtgttccattagccactactttggacatggatcacgaatggaggagagaagtggataagaagaacaaacatagagaggagagacttctagagaacatgaaagttgtcctcatcaacaattcaagccagagggcatcccaacaaccacgcctagttaaggaaaatgaacttgttttgggtgcccgtgagatcacaaagggaagttgtgttggtactgctactaatcctttaggagaagagcctgacactgatcgatgtgggttatacgttgatgataagtatttgtcgactcgcctaatggcctttggaaaggtatttgtgggggcctttgtacaccaagtgtgtttgatcggtgatttggtcaaggcaagccctcagttccttcatttcaaggctgacacgtcttgtgaagtctgtttcacatga

SEQ ID NO: 70134 - DNA, 567 bp, Glycine max
  Peptide Sequence Number=SeqID_161819
atgcctatttatactgaattagttaaagccttctattctaacctagaaattcaagaaggcactttgatttctgaagtttatgggattaaaatggtcattgaccaatccctattctatgacttgacccaattatccagtgaaggtgtaccatttgaaggtacactgaatgatgattggaaattcgatttctctgtgcttgatgcctgcagcatccctcttgattctgaaccttatgttccaatcaagagatccttcttaatcggtgctgctgtgattgcatcttttggttaccgtaaagagcatgatggctcttgggtgaaaaaaggtgcacaacccattgatgaagaaggacacttaccaattggagaagattcctctcttcttcaaaggattttggacaggttcgatggtcttcaaacctttgttggtgaaaggtttgatgctttggaattacaagtggacatgcgattcgatgacatggattcaaggatcaccaaggtcgaaggagatgtctctcacatccgcacatgctttgatctaacaccaccaccacgaccatcatcttag

SEQ ID NO: 70135 - DNA, 324 bp, Glycine max
  Peptide Sequence Number=SeqID_161820
atggagcttcttcctgacttctttgaggctgaggagaggtcctcttatgaaactcctgaggttttgcacttaatttcaggacgtgatcttttcgggatggtttgcctagccaacaaggttccagagatatcaattactaacattgaaaagttaacatcttttagatccttccattcaggcctgtgccaatctataacagatttgaacgtccacaagaatgcaaaaagatcagatgattttgaaacttaccaaggtcacagctttaaaacttcaagtattgtatcagatgcatatagacatctagaattgcacatctctggatga

SEQ ID NO: 70136 - DNA, 81 bp, Glycine max
  Peptide Sequence Number=SeqID_161821
atggagaaaggtacaagtcttcctatggagaaagggaatgttaggatagggagagggaagggatggctaattctgttttaa

SEQ ID NO: 70137 - DNA, 58 bp, Glycine max
  Peptide Sequence Number=SeqID_161822
atggtgaggtttatacaacaacaacaacaacaacaacaacaacgccttatcccactag

SEQ ID NO: 70138 - DNA, 450 bp, Glycine max
  Peptide Sequence Number=SeqID_161823
atgacattcaagcgcaggaatggaggtcgcaacaaacacggccgtggccacgtcaaattcatccgatgctccaactgtggcaaatgctgccccaagatttgtgcgaggcatttcaattttcaacaactaaccttttgtgctcgctctgtgaaacaggacaaggccatcaagaggtttcttgtgaggaacattgttgaacaggctgcagtcagagatgtgcaggaagcctgtgtctatgaacagtacacgcttccgaaactctatgtgaagatgcagtactgtgtttcctgtgctatccactctcatgttgtgagggttcgatcccgcactgacaggaggaagcgtgaccctccacagcgattcatcaggcgcagggatgatgcacaaaggcccggtcagcctggtcaagcacctcgtcctgctggcacagcagcacctgtccgaacctaa

SEQ ID NO: 70139 - DNA, 393 bp, Glycine max
  Peptide Sequence Number=SeqID_161824
atggcccagatcgtcaaggagctcatcgattgttggaaggggaaagcgatccttaatcagttgctggtgattggaaaagtggggaatatgcctggagaagacgatgtacaggcccaggttcctgaaggtggatgtggaagagggccgctacttgctgtgttgccatcagtcgtcgcacctggccatcgttcagttgtgattgggcctaggaagtggagtcaggctatgcccaacacgacatcagtccctccaagagccatttcatgcaaatctagggtaaaggtggaggaaatgggccagacgatcgtggataaagttgtgggtactgccgccgtcaatgaggacgacgacatcgtgacccgagatcgaacccacgacgcgaagggtggctga

SEQ ID NO: 70140 - DNA, 552 bp, Glycine max
  Peptide Sequence Number=SeqID_161825
atgcaagttcttctatcctctgttgttggctggttcatgggttctattgtgaaggtcgaacatgagacgcgacacgagttcgatggttcaactctgtgtggttgtgatgttaagaatgctttgcctcagaagattactcttgtgatggaagaagaaaagactagtatgttgtttgagtaccatgtcctccaaattagaaggaagagtatgtttgggagtgaggttgtatcaaattcatcagatgagaatacaggcacaaccacaaccacaaccataaccacaagttcaagacctggaagcaaaaggcttcaggaaataggactgatattggcatcatctagatgggattctgaaccttgtccttcagtgccaaaagaatttaagatgtttgtgatgaaaattgttgcaaaggttgctaatgcatcaaagaagaaaagaaaattgaacaatattcatgaagaagatacctcaaacatctcaaaaatagctgacaaagtattgaagatgttggatgatgtagtgaattttgttggagaggagaatgcagtctag

SEQ ID NO: 70141 - DNA, 339 bp, Glycine max
  Peptide Sequence Number=SeqID_161826
atggtaccaggaaatgtaactatagaaaaacccagggaacaatgggatgaagaagaaagggaaatggtacaatataacttaaaggccaaaaatataattacatctgcattaggcatggatgaatattttagagtattaaactgcaagaatgcaaaagaaatgtgggacaccttacaagtaacccatgaaggaacaactgatgaacacaaaatgaaactcatgagactaaatcatcatgaagaaaatgacaggaaaaagaaaggaatcgcagttaaagcttcatcttcaattcaagaagaaattgataaagaagacttgaatgaaatagaaagaacatga

SEQ ID NO: 70142 - DNA, 465 bp, Glycine max
  Peptide Sequence Number=SeqID_161827
atgggtattaagcgtctcaaagtgatcaaccaaggtccacatgccgataacaattgtcctcgaacgaaattagggccgattattttgtcttctctcaccttctccaagttgacccttggccctgtggctccacaatttacaggagtttcaattgttgaagagaatagtgggcctgatggggtgactatggatcttgtgatgcaatgggatggaattgcactttctcgtggatgtaggcacattgccgaaccacgtttaagagttgcagaactcatacaaagaaccaacaagtggcgccgtctgtgggaacaagaatcaagatcaagaaagatgggaacaacaaagtacgatattgagaagttttcaggggaaaatgacttcaggttatggagaatcaagatggaagcaatcttgattcaacatggttgtgcagaagctcttaaaggagaagaaaggatgtcctaa

SEQ ID NO: 70143 - DNA, 228 bp, Glycine max
  Peptide Sequence Number=SeqID_161828
atgtctctcactgatggtgacttggatcttaggccaccttctaaatcttccttcacagttggtgagtacatgtttgccgatgtggagaatttggagcattacgctaagtatcttaaccaatcgctcatcacgtttggtttcccagcttcgcttgatctcttcacaaatgacccttttttagttgcgaggacttgcaattgcatttacttcttgctccagcaaagatag

SEQ ID NO: 70144 - DNA, 914 bp, Glycine max
  Peptide Sequence Number=SeqID_161829
atggtggcattgtcgttggtttggaggacgtttatgggggcagagttgtttgcgctgacggaggcgtcgaaaatggctttgtatgtggttttggggaaattcgggcgaaggaatgacccagggtttcatccaatggcatcgtctccgcaaacttcagccggtctcggttcaccaatatttgacaaacttgaagctgagctggctaaagctgttatgtcattgcttgcaaccaatatactaaaacttgcttatgcatcaccagaaggaaaagaatcagaggggaagttggtggtgaagatgaaggaggaattgaacctatccaaagatgattgggacaaaatcagcgagttgcctgacaacatcttgctccacatgatgaattttatggacacaagagaagctgttcagacttgtgtattgtctaaacgatggaataatctttggaaacgtctcacgtctctactattcaattcctcggaatttgaaagtgttttcaaatttaacaaattcttgtctaagtttctgtccgatcgagatgactccatttctctacttaatgtcgatttggatttcagacctccccatgagattgcttgtctaagtgattgcaccttatattatttaggtttcttaggccgtcctcgctttgagctcgaacccctaaataggctaatggaatatgctgtgtcgcgcaattgtcagcgcttttcaatcaacgtaggttttgattgcagattggatgttgatcctgtctgcttctgtccctcgttgacaattcttcggctttcctttacgccttatggtgcaaattgtaaacttccaaaatctctgcagctgccggtattgaaaactttgtatcttcatcatgtcggttttaccgcaagcgacaatggttgtgctgaaccattctcaac

SEQ ID NO: 70145 - DNA, 156 bp, Glycine max
  Peptide Sequence Number=SeqID_161830
atggtcatggggttagatcggaagctcacacgaccatggggccacaatttgaaccgccacacatgtgtacatgcattgctctactcacatgggcacatgggagaagagagattgggtgcaaggggtgggggggaaaagagaggggcgagtataggg

SEQ ID NO: 70146 - DNA, 255 bp, Glycine max
  Peptide Sequence Number=SeqID_161831
atgatcattgaagaattcacccatgttgcctttgatgaaactatccctataaggccaagaaaggaaacttttgatgatattttagattctttagaaggtatgcatattcatggtgaagagcacgaaggcaaaggaaagggaaatgatgaagactttcaaattgacgaaacaaaaacatgtatagatcttccaagagagtggagaacttcaagataccatcctcttgataacatcatcggtgacatatctaaaggg

SEQ ID NO: 70147 - DNA, 703 bp, Glycine max
  Peptide Sequence Number=SeqID_161832
ccaccttgatgctaccctaacatcaagtgttggacctgagtgtgtagagttgatctctattgttcagagagcaatctctggtgttgggtgcagaaaacagaacatgagtaaaatagaagctcagcctgtgccaatcatggttgtggttgaggcagtggcttcggtggtggtggcagacggagcaaagccaagtcttgatggcgaaaagaatccaaaccaagtgcaaaagaatctgatgctttacggcatcgtcgtcgagcaagatggtgtcattgctgtaaggagttttggggcaatggccatgaagcggggaatcggcagcggagccatgggtgcgactgacgtgggtgctgttgtgggtggtggtggtggttgtgcggaggaggacgaagctgtcggtagaggtgaccgggttgctgcggcagtcttaggagaagggcatccattgaggattcgaggcggtattgagcggcagcaaggttggccaaggccgcctcaaggtgatcctcagtggcggacgacgagtgagggtggtggtaggcagccatggaagcttcgtatgtcatggaaggcggtcatgggagctccgtacggcgagtggcagccatggaagatagccatgggagcttcgtatggtgagtggcagccatggaaggtgggtggtatggcagccatgggcggcaggtcagaccagttgttatga

SEQ ID NO: 70148 - DNA, 1233 bp, Glycine max
  Peptide Sequence Number=SeqID_161833
atggagacatggtacttttgcatacatgtcacttgtgaggtggcacgtactggagacttggtgctagaaggagggctcaccaagggcaattttgggtttgaagagcttatgaagctgcgactatggatgcttgctatgaacctgaatgggccttcccaattgggaccaagcgctcccgctcggggacctagcttcatctcaggctcaccatacgaggtcaccagattgaaaagcttgtggtcgaacctttgtattatatctcatcactattcagagtttggtaacttcttgcctgatcctagccatgtcttggacttcgtgtgttgtctcgagttctaccctcatgttttcttcatttttcttttgctggaacaacaatctccttgtcaatggttccccaacttcaatggagatcatggtgtttgtaccatatgtgagtcgggctttaatgatgactttgttggtctagggatgtttgacagaggtgatgagttcctcatcttctccagccataacttctttagtgtcattggtgggagtttggagtgtctcttggatgacagtcttgaggtgcctggtatttttagttcttgccaacttggagagcaggccaaagggcatgaccctgtagcaaaagttggcatctttagtgataaatgttgttatctcctcgtctggagtgtgcatcctaatctggttgtatccagaggcctaatagtcttctatgatatgactgatgatgcaatggactgtagtgcgattggtcgtcaggggtgtgtaacgcttgtacctggacccttttgggagagtctgacgcttgttcgacttcctttggctcatttgcacaacttgtctatggtactagggatttttttgcacagactatctgcaaacttggcaggccatagagcgaggagcatggagtgtaatgcacctctgggctggccaatgtggccaatgtcatgtgatgtgaccaatgcttgcatattgcacattgaagtgctcaacaagagtgtcgaagatgtcaatgaaccgtggacgaagtccaccgtactagtcaagcaagcatccaaatgttcatcgagattagcggtcccatcataccactccaggttgagtggtttccaacctaaggatatgtcagccttagctttctcaactcctcctcaaggcgtcactccatctccacaatgcggttttggagttgctagagagtatcagtatttgtcatga

SEQ ID NO: 70149 - DNA, 1641 bp, Glycine max
  Peptide Sequence Number=SeqID_161834
atgaagctagacactgtggaatggaaaggaaagaatgggaagtattacttccccccctcaagtggactaaaattcaattccaaggaggtatttcgttatcttgacaatgttcagaacaaaattatagttgagaaagctattgtggaagggttaccaccaggatgggtgaaaaagaccagaatcacaacaaatggagattcagttagaagagatacgttctacattgaccctgtaaatgggtatacattctgctcaatagaagatgttgatcactatcttgaaactgggaagataggaaggaatgaattcacgtcaaaagataaagatggcagtgatatggagttaaaagctgacaaatctccttcaagaagtgtaaccatgaaaccaacattatcagttagcaagggtcaaagctcagatttggacatgatagctaatgaccaacagattccaagatctgcaagttctgaagaatatttggatgtgcccatttctgaatgtgtggtgggggctgaactgaccaatttagttatatcacgggctgaaagttcagatcagaaacaagggaagtttggtttagctcaaagcgcttcagtttcaggttgcactaacaaagatgttgaagaaaagcaacttcaagaaaattcagagacaaaacatggcgctgcaaaggcccaggcccaagatcaccagtggcaaaacaagcacaagaaagagatcaatttgcctcaccgtgcttcaaagcgtcttgctggaattaaggttggtcctgttccagaacttaaaacaagaaatcgagcacgtcgtgttgcaattaaacaatcagataaggaagaaaccatcatcataaatgtggataaatctcccaacagcttgtctggtgatctagcaaaacagaaattaagtggcacagatactgagaagactctagaagtgcaaataagtgacaaggataaaaaatgcttctctttttcacctctggagaacaatgctactgtggaagagtgtgcaagagtccttgaaaatggagataaagttgatgcaaagttagattacacccttgactttccccttggagaactactaacagacccatgtattgcatttgcaattcaaactctcactggagtaacatttgaagcctccaaaaactcgcaaacttcttccaacttaagaaacagccagcattccaaaacttctgctcccaccctcgccagtggcaaaggcgatgataagaaaagcaatgatggattaggtgaccgtgtgttatcatctctagagaaccttgctattccaaaagaacatgccggtgatgacaaaactgattcaaaggccaagaatgagaatgcaggaccatcttctgaaaagacacttgacatgtcatggatggatccatgcattgaatttgcaataaaaacactcactgacaccatcccatcagactctgctgatcaaaatcccaagaactgcatccaattgtcaagtgtctgtttagataacatttaccaaactgactactcttgcagacaatactttggcacacagaaaccaatgtttcataaacagtcttttgtggatccatcactgcagcacactagaaatattggtattgtaaattctgctgctgaagccagactctaa

SEQ ID NO: 70150 - DNA, 762 bp, Glycine max
  Peptide Sequence Number=SeqID_161835
atggcaatgttagaaactggttctggttcaggttcagaggttgataaagatgcaccagtagaagttgacactagtactaaggatattattgaatgtaatgatgaacatgttggaaagtcagtatcaaatgacctggtagatgatagtcaacaaacctctgcccttgaagattcttggtttgaggcctcactttgtggtcatgaacttaaagcgggtatggatttggttgttgctgccgaggtttttgaagcacatcggatatctgcggaagaatttagaagttctgcattatccataattaagaatgaaaatcttgttctgaagttcagagaaaggtatctgctgtgggaaaaggccgctcctcttgtacttggaatgactgtatttggtttagacttacctattgagcccaaagatacaattccagtgggactggatgatgcagtgaaggccaagaatgatgctcttggaccagcttcatatggacattctgagtctgattgccaaacttccgttgtcgagccatctccaacatctgctatgcccatttccaaactcattactatttcacaggtaaccactaccattggatttgcttctccaaacaaggctaattcctacaatgttcatgggagtgcattaggtactaaagaagtggatgctacaaggaagaatcttggatggccatacgagcttttccatgtgctagaagatgtcaagaagtatggatggggagttagagatatctttgtttcatcttag

SEQ ID NO: 70151 - DNA, 828 bp, Glycine max
  Peptide Sequence Number=SeqID_161836
atgtcaactggtttgtgccttggtggaaatttatctggcatgaaccttgttactagatgggtagtggacttgaataaacatgcttgtgaatgtcttaaattaaaccatcctgacaccgagatttctattagtatgggtgataagaacttgcgtccttggttaattgccttgcacgttaaaaatgaagaggatgatgacactagcagtaatgaagaggttaatagtgaagatgacaatgaactgaatgaagatgatgaaatatttgaagtttcggaaatccttgttgtctgctacggtgacccaaataagaaaaaagaacaagggttatacttcaagggttatggatttgccctgaattcttgtgaaccaattgaattttggcacaaggaaaagattaaagaatttttcagtcgaggcttcaagtcacagatattgcctttgcctataaacactgtagcatacaatgaaggacaaaaggttcaactgcaaaagaagcttttatttgaggatgctatttctaaccttcctatggttcagaacaatgaatgtcgtgatgagataaaatatgacaaagttgctcaaactgagttccaacgattcattagattaagcaaacatgtatcaacacttctgtcaaagtctgcttggacacatttgttagtaatgactttgattgctcgttcatgctcgttcataggtggaggcagtttaggcagagtgacttttcaagtcatacaagagggtgtaattctagaaaaggttccctcagtgcagtgggaatcttatacagtgatctgggctgttttatcctggggacgtcgtggttga

SEQ ID NO: 70152 - DNA, 1584 bp, Glycine max
  Peptide Sequence Number=SeqID_161837
atggagaaaaatgaagaaacaacaatggaagagaagctcttgtgctctgattaccacttgatggaagcttgcttgtggggcttctatggaggctggatctttgagcttcaatggggtcctttaatggtgattttccaccatggagatacaacggaagacaaaggaaaggaggagcttcaccaccaagatgacccttggataagaagcttggagaggatgcttcaatggaggaaaagaaagagggagagaaagagggagggggagcacgaaattgaaggaagaaaaagggagagaatctcctctactttagacaccttctcgcatgccgccgccatcgatggcgagaatgcatatcttgtcatgttggttcttgactgcggagatgcagtccacaacagtggtagccgtcggagtctgagattccgatttgggaggttctttagagagagatcgttgaggttcgtcgagataaacgtcgacgttttcgcggagcgggagaaggagctgagaaagagaatagggagcgcgatggtgccgaagattttcttcggcgagagactgatcggaggcttggtggagctgaatgcgccgaggaaggacgacagtggggagttggagaggaggctggcggcggcggtaggcgaggggccatcggcgccgacatacggattcgacgaggcggcagaggtggaagaggcggcgatgacagaggaggaggaggagattgggagggtggttagggttttgaggcagaggttgccaattcaggatcagttgatgaagatgaagattgcgaggaactgcttcgtggggatcgagttggtggagcttctcgttcgacaccatggttgtgctccttccaaggttagtgaggatccacttactgtaaaagtcgatcatctcaaggataaaacttgtaacaaagacaatgatgttataaaggccacgtcttttgagcttatatcaaccctaagagatgttcttaaaacaagttccctttggagagatcatgtccaaacatacagtaagtccagttgcacttgtcatagtagcagcagcactgctggtttagttccttatacaactgggccttatcagcatgtgcctgcaaatccctctgaggctgcagggaatgtgacttctaaccaatttggctattgcttcagcatagttaacaaggctgaaaatgagctagagtttttgcttattgagaatctggttgtacatagacgaatagatgaaccaaatggtgctgatagagggtggtcttttagtactgaaaatgaggaagctgttcttttttatgatgatgaaaatgaaggtactactggaggtggggaatggggatatctacgatccttcactagttttgattctggagaatgtcgtagcagagataaaacaatggagaacctagctacttgtgatgaagatggaaaagagagttggttggatataattactgctttgtcttgggaagctgctatacttttgaagccaggtacgagcagaggtggaggtatggatcctggtggctatgtaaaggttgaatgcatagcttgtggacatcgaaatgaaaggtaa

SEQ ID NO: 70153 - DNA, 384 bp, Glycine max
  Peptide Sequence Number=SeqID_161838
atgtccttccaagctttggaagtggtaagcaacacttatgtcgagtctcccccagtgctaccccgctcatctagtgctgcattgatggtagcccgtgtaatgttagggaatgggtatgatcctggaaggggtttaggtcagaatggcgacgacgtggcgaacttggtggagttcaaaaagaattgtggaagattcgggctaggatataagcctacacgcgccaacgtaaggagaagcaccctagaaagaaggggccaaagcatgggccagcagcaaggaccgcaagtggaagggacttccatatgtcacatcaatgaaagcttaatcagcgcgggctggaagtgtgaagggcagatcgccatgatcaacgatgaagtcccttaa

SEQ ID NO: 70154 - DNA, 198 bp, Glycine max
  Peptide Sequence Number=SeqID_161839
atggttccccgcatgtcattgggcccgctgcctctggatgacaaaggtgcagatgaccataatttgtctctgcgtgtcaacaagctcgcttgcctctggttgacaaaaggggttgtctgggtggaagatgatgtaaatctccgcgtgtcaacgggcttgttggccgcgatagacaaagggtgtagaagacgacgttag

SEQ ID NO: 70155 - DNA, 297 bp, Glycine max
  Peptide Sequence Number=SeqID_161840
atgttgtgcggctaccgcgaagcgaatgaagggaagctcgaagagcttatgcttactctcagcctctttgattgtataagcccttctccggcctgggaaaagcagcgaactctagaagctagggcgttgttctccattacctatgcatgtgcaagaatgcgatacggtagaggtcgatgtgtcattaggacacttggcgtggagagagctgcaatgagactcactgcggaagtagagttagaagaccgtgtcctgttgcgttcacgggcgaagacaggactcaagcttcgtggttag

SEQ ID NO: 70156 - DNA, 972 bp, Glycine max
  Peptide Sequence Number=SeqID_161841
atggacaattcctcgtttccaaacattttggaatttaaaaacaagatgccaccagatcctcaaatcttaaggcttaaggattggttctctagatatgatttttatgtgaaactcataaaagggaagaataatttgattcctgatttcttatccaaaccaaacaacaagaccgttaaggtgataactttcactcactccttcccattgatattcatggcaaaaccattatttgaaacaaccaaaactattaaggttttccctctaggattgattacccatactcttgcacagatccttgaatatgctaaattcaaatacacttcaacacaaatatttgaccctgagataccatttggaggtatatttgaactgttctgtgagattgggtgggatttgtgtgaaccaaccatatgggtcatttggtgtaatacaatacaatatttaattctcatcgccataaaacctttgatgacatacaacctcttgacagatccatataaagatgaatatcttttatggacaatgttagagtggttttctcctttagcatggtggcgaatgaagctgaaacaaattatagacattgagagacaaagaggaatctcagaagatcacataggagaactagtttctattgtgattattcaccatccttactttatggagcaagaacaactctggtttagaaatgaagctcaaatttggagaacttttgaagcatatcccttggaagaaagttatcgcaaccagttggcaagacatctgggtgaagtcaacaattactcatacagacctttggatccaaatctaccaagttcatctcaaaggccaagggatagtaatcctactgataggataatacttcagaatactaatgacggtcggatcgacacagagatttatgttccagaacccgagtttcaaaaggtggaagatttgggtgatgactattctgcattagaacaagactga

SEQ ID NO: 70157 - DNA, 234 bp, Glycine max
  Peptide Sequence Number=SeqID_161842
atggtttttcacttaaggcttgtaatgagcttcaaaacaaagaaagggaaacataggctcaaagggctatcaaagggattaattcaagaagcatcaacaagaatcaagccaaggctattgtgcaagcaatcaatggggcaaaacacaccaaatgattatgatgatgactcaaattctcacaaaggtaaacttatcacttccaaattgagatttcaaaactatcatgacatgtag

SEQ ID NO: 70158 - DNA, 196 bp, Glycine max
  Peptide Sequence Number=SeqID_161843
atggaggccatgaaagagcaaatggccataatgatggaggccatgatgagcataaaggagataatggaggtcaatgcggttgcaatagccactaccagcaccattgctgaggtggacctgaccctcccatatggcctcaaccaaataaatcttccaacctcagatatggtaggtctggaaggcaaagagttgggag

SEQ ID NO: 70159 - DNA, 519 bp, Glycine max
  Peptide Sequence Number=SeqID_161844
atgccatatgtggaagccacggaggagtcattggaaacagctttccaatcttttgaggtagtaagcattgcctctgtagattccctctctggccagccttgcctgtctgatacggcaatgatggtggcccgggtgatgttggggtacggctatgagcccggaatgggtttgggcaagaacaacggcgacagaaccagcctagtaaccaccagaggaaaccgcgggaagtttgggttaggctataaacctacgcaagctgacataaggaaaagtacctcggaaaggaagaatagaggtaaaggctcgcggttaggacaacaagccgaagggtccccgccctgccacattagtagaagctttataagtgtaggtttaagacacgaaggccaagtcgctacgatatgcgaggatgactccccgaggagatcagatttggtatggccatgtcctcctggtttccgactaggaaattggcgagtggaggagcgtccagacgtttatgcgaccagcataatgtaa

SEQ ID NO: 70160 - DNA, 72 bp, Glycine max
  Peptide Sequence Number=SeqID_161845
gcatgttccaaggttcatgctcctatccttgactccaatgatccttctcaacttgaatctaatcttatttaa

SEQ ID NO: 70161 - DNA, 207 bp, Glycine max
  Peptide Sequence Number=SeqID_161846
atggctttcactcttatccaaggaaggaccaagttcaaggaattttgggggttgtaccttcaaaacccaagaaagataagggtaaagatatttatagtagtcaagaagagactacttcttccccttcccctagtggaagtgaagatgaagcaaggggtgaagagtctagtgaggaagtctgcccccatgaagaaggtgacctcttaa

SEQ ID NO: 70162 - DNA, 183 bp, Glycine max
  Peptide Sequence Number=SeqID_161847
atgacgacgcggtcaagatttgccacgcattgttgtttcctactttcaggggatggccttaggcctagggtgcattctgagataatgggggcatgccacattgcccccgttcccatgattttcatgcttaaacatgcgcccaccaagtgttcgttgaaatgcctcaatggcgtttgcgcatga

SEQ ID NO: 70163 - DNA, 270 bp, Glycine max
  Peptide Sequence Number=SeqID_161848
atgctcatgagcaatttcaattgctggctgtcgcaacctacccttttgcgggcgagcgaggcgaggctcacgggtgcgtcttccaaaggaggaaaatgcgcggagtcgcccccaacgtttatttgtggaaaacgtcggaaaaaccgaaggaaaccggtcatgaagaatattctagattcgggagttgtatttacgtttgaggaaggtcgacaaaagcggggcccttgctcctacgtaccctccatcgaagaggaaatcagacctacgtag

SEQ ID NO: 70164 - DNA, 706 bp, Glycine max
  Peptide Sequence Number=SeqID_161849
atgcgattgcgtggccgttggggtcaggaagggttacttcgccagaaacggatagtcggtatagccttcggcgccgccgccgtagaaggtttccggcttaggttcgttcagcggagcgtgctgacggaaacgctctaccagatccgggttggcgatgtagctgcggccgaaggccaccgcgtcgatgaagcctttttcgatcaacgcttcggctttctcggcggtgtaggcgccggcgccgacgatcaccccgttaaagtgggcgcgtaccgagtcgcggaaggcgtcggaatacggtttgccgccggccccagtccgcccgttgaacggccccagcggcgagatgcggatgccgatgtgctcggaaccccattcggcgatggtggcgtcgaccacttccagcgtcaggcgagtgcgattctcgatgctgccgccgtattgatcgccggcttcccgcgcgttggcggtcgcctggcggaaatcgttgacgatgcccgggatctcgctggtttcgagcgcacgcggcgtggaggtcggcacgcgcacccaggcgccggtttcatcacgcacggtggtgcgggtttcggcgttgattgccgaaggggcgaccggtgcttgcccgcccggctgcaggctggcgtgggagatgcggcctacgtgccacagctgcacggcaatatggccgttgttgtcatgcactgcctgc

SEQ ID NO: 70165 - DNA, 376 bp, Glycine max
  Peptide Sequence Number=SeqID_161850
atggcagaattatcaaagaagcgaaagggatcatcctccaccaccgctgctgctggccatcgccgccacggaccatctgaagcacctacagcaccaatccatccttccttatcatctccaagatcatctactctattttcttcagatgatcaacgtctatggtacctttctcaattttcttctaggatcattctagaccctaagtacctagacatagatttctttaatgatgagacatttgactgttatcaagtgtttcaaaactctagattgattgatttcatgtctttaaaattgtcttactatcctgaacttgttaaattcttttacagcaatttaaaaattcaggatggtattatttcttctgaggtgcatg

SEQ ID NO: 70166 - DNA, 296 bp, Glycine max
  Peptide Sequence Number=SeqID_161851
atgcatgtccagcattgcatttcacattggtgttatccattggcaaagttactaaccactgttgatgagaggacgtcctcatctgacgaaatgcgcttacctgaggggcgcttacctgagaaacgcaacacgtgtcgttcgttgcaggtggtggcaggcggtggtgacaggggctggtcgcgccctacaaccaggcgcatacggtcgcgccctgcacgcaggcgcgttgactcgtgccctgcccgaggcgccttggttcgcgccctggccccaggcgcgtccaagcgccttaaatg

SEQ ID NO: 70167 - DNA, 622 bp, Glycine max
  Peptide Sequence Number=SeqID_161852
cgtgcaaccttttcgctttctcattcttacatgctccttcactattcacaatttcaaaatccctaaaacactcaccctaatccatcatttacactccattcttctcaaatctataccaacaatcggaaaaatcgtcaacaacaaccaatccaccccctacggcaccacgtcgcgcaccctatgccgcaacctcacctctgagatgctccacccctcacacgtcagctcggagtttgggttgaacgcactttacgactccgtgaacggcggcggtgatgtttggatcaacgagaactgcttccgcatcaggtatgttcagatcaggagggttgcccaaatcaactacggcaaggaatatggcatgctcgtcgtcattgtcgacgtcattgaccataacagagtaactcccccaccaccacccaagaaactcattgttagaaagagaagggcatccctcaatgattttgataggttcaagataatgttggccaagatcaagaacaaagctaaggataatgattctgatgataacgtggattttgttgctgggaatgtgaaacttattaccaccaaagaagtgtgggaccaatatttggaagaagcaaggagggatggcaaaatt

SEQ ID NO: 70168 - DNA, 351 bp, Glycine max
  Peptide Sequence Number=SeqID_161853
atggtggccttgaaggatcaagtggcttccataatggaagccatgttaagcatgaagagaatgatggaaagcaacacggccgcagttgccaccaccagcaccgccactgaggcgaatcctacccatccctctgccataaaccaagcaaaccaacccgccccgaacatggttggacaaggaggagaagtgttgggcagtaccagtggggggccaccttcggcagtggaagggagagagatacttgatctcatcgaagagagattaagggttgtcaaagggtttggcgattaccctttcgccgacatgacaaaattatctttagtacctgatgtggcacaagtgggagcatga

SEQ ID NO: 70169 - DNA, 243 bp, Glycine max
  Peptide Sequence Number=SeqID_161854
atggcttcaaactcccaacaatttagtgccagaaatgatgttattgtcattagaggagtgcatgaagtagccacgaattcatcttcatcagctgagactaagaagcttgaaggtgaatcttccactagtaattctaatttacagaagcagcatatccctcttccattccctccaagagaaatctccaacaaaaaaatggaacaggcagagaaggagatattggaaacatttagaaaagtagag

SEQ ID NO: 70170 - DNA, 204 bp, Glycine max
  Peptide Sequence Number=SeqID_161855
atggctccgaaaaagctttctgcgaagagatctaggagggacaccgcggctgaagggaccagtgccgctcccgagtttgatagtcatcgtttcagaagcaccgagcaccagcaatgcttcgaggccatcaaggatggtcgttccacagagagagatgcgtccagctcaaggacgatgagtacacagattttcaggaggagatag

SEQ ID NO: 70171 - DNA, 570 bp, Glycine max
  Peptide Sequence Number=SeqID_161856
atgagaaccctaaggccttctttatcaactctagcccaatcctcttggagcctcttgctcatggctctgctaccaccaaggccttggaacaagagaccaagagggctcgtagggaagagcacgaagcttaaactccggagggaggaaagggaccaatcgcgggtagacagtttgatcttgaaggatgagttgaaggcttgctcgaggtccaagagaagtttgtctcagcgtttatgcgagacagagaccaacatgttagccatcatcatcaagtaccaagaggaactaagtctagccacggcccatgagcatagggtggcggacgagtatgcccaagtgtacgcggaaaaggaggctagaggaagggtgatcgactcattacaccaagaggcaaccatgtggatggaccaattttctcttaccttgaacaggagtcaagaacttccccgattgctagccaaggccaaagcaatggcggacacctacttcgcccccgaggagatccacagacttctcaactattgtcagcatatgatagacttaatggcccatataattagaaactgctag

SEQ ID NO: 70172 - DNA, 682 bp, Glycine max
  Peptide Sequence Number=SeqID_161857
aggattacatgtcttcaccatcagaggactacacgtcctcgccatcagaaggctgcatgccttcgccgttagagggctacatatcctcaccatcagagggctacacgtcctcgccttcagaggactacacgtcctcgccttcaaaggactgcatgtcctcgtcttcatagaactacacgtcctcgccttcagaggaacacacatcctcgtcatcagaggactacacgtcctctccttcagaacgctacacatcccaaccttcataggactacacgtcctcatctttagaggttctacacgccctcgccttcagaggactacacgtccctcacaatcagaggactacacgtcctcgccatcagagggctgcatgacctcgcctttagagggcaacatgtcctcaccatcaaggagctacacgtcctcgcttcagaggactacacgtactcgccttcatagaggactacacgtcctcgcctttagaggactacagatcctcgccttcagagggctacacgtcctcaccttcataggactacacgtcctcacctttagagggctacacgccctcgccttcagaggactacatttcctcgccttcagaggattacatgtcctcaccatcagaggactacacgtcctcgccttcagacaggcccttactgcatgccctcgccgttag

SEQ ID NO: 70173 - DNA, 162 bp, Glycine max
  Peptide Sequence Number=SeqID_161858
atgggtgatcaagccacaagcatgcaagaaataagtgcagatataagcaatgaacacgctggagctttgtgtagaagcaagcttcatgatgatgatgaatcaagattgattcaagttgttttgatgataacaaagatgatgacaaaaagcccaagagaatga

SEQ ID NO: 70174 - DNA, 167 bp, Glycine max
  Peptide Sequence Number=SeqID_161859
caccgcttattgagttggtgaggtaccatgttccctcatgggaggatgtccgtgaaaagggtgtccagggaaggagcccaaagtatgaagaacctcaggatttgaggtcaaatcctttccaaggtggaggggatgatgcaatcctaccccctaagggtattggatag

SEQ ID NO: 70175 - DNA, 336 bp, Glycine max
  Peptide Sequence Number=SeqID_161860
gaaatccatctgacttacaaccctttgatcctgagatagataggacatttcatagattagttaggcatagtgtgcatcctgatcattctgtgcattttgaacattctgagtattctgttgctagtgattctgaatattctgattttgagcattccactactaatttttatactgagaacatggctcaacctccccctcgtgagaggactcttagggagatggctgcacctgatttcacttatgaaagcttgtgcattcaatatcctgatgagggtgttccatatgttctcaagactggactaatacatttgatgcccaagtttcatggtcttgcag

SEQ ID NO: 70176 - DNA, 105 bp, Glycine max
  Peptide Sequence Number=SeqID_161861
cgtgactcaaatgtcaatatgacagatcttgtgagcgcggaagatgatgctttctgtcttacagattgcaaaagaatgtttatgaaagtgcggacaaccacttgg

SEQ ID NO: 70177 - DNA, 546 bp, Glycine max
  Peptide Sequence Number=SeqID_161862
atggcgacgactttggctacaccaaaactcagtgaggataaagtcaggcagtgtgttgatacaagactaggaggagaatacccacccaaagctgttgctaagttaggtgttggttgtactaatgcccctcctcacatgggtagtgcttacaccaccatcgccgccgatgccattgctcgcttccaggggcttcttcaggtgtatggtggaaatctaggatggtgctttattgaagaggcctattacaagctcctactggaggccctacttagcaaacaacaaggttctgcagaatataagtttggtaatcttggaactgggcgtgggcttgaaatggttgctgcctttgaaaaagcttccagcaagaaaattccattaaaaatgtgtcccagaagacccggggatgctactgctgtatatgcatctatggacaaggctgagaaagaacttggttggaagtacgcaaaatacggtatagaggaaatgtgcagggatttatggaattggacaagcaaaaatccatggggataccaggggaagcattaa

SEQ ID NO: 70178 - DNA, 495 bp, Glycine max
  Peptide Sequence Number=SeqID_161863
atgaatttatcgtcagaactcattaggaataacttagtgatagaggatgaaaatagtttgcacgagggaaatagcttgaagacttgggaggaggttgtagagaaatttttgaagaaatattttcctgagtctaagatagctgaaggcaaggcagctatctcctcattccatcaattatcagatgaatccttgagtgaagcacttgagagatttcgtagcttgctgcgaaaaacaccaactcatggattctctgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 70179 - DNA, 630 bp, Glycine max
  Peptide Sequence Number=SeqID_161864
atgaggttttcactctccaaggctgtggttccatctcttcataaacggtacttgtctgttatagtggatagggtgttttgtagatgtgctgagagattagtggagaagctacaacctgatgcacttaatggaactgctgttaacatggaggcaaagttttcgcagttgactcttgatgttattggtttatctgtttttaattataactttgactcgctcaacatggacagtcctgttattgaggctgtttacactgcattaaaagaggcagaggctcgatcaactgatcttttaccgtattggaaggcatgttttttccaatcttacattcatgacatggattttctttccttgtttgtgatgtcatgcgctgaagaggctgttagcattatcaggaaaactgttgaagatcttattgaaaagtgtagagagattgtagaatctgagggtgaaagaattgatgtcgaggaatatgtgaatgacagtgaccctagtatccttcggttcttgcttgccagcagagaagaggtttccagtgtgcaattaagggatgatcttttgtcactattagttgctggtcatgagaccaccggttcagtgctgacctggacactttatcttctaagcaag

SEQ ID NO: 70180 - DNA, 303 bp, Glycine max
  Peptide Sequence Number=SeqID_161865
atggaagatattttaaagatgaaagatctttttaagaggtggactgagtattttgatagcacacgatcaagggtcaatcacccaccaccggaattgatatttttattatttatggcttgcaaatatgaaaaagatagattaaaagaggaaaatatcgagaaaatatcaaaaaggaagatttttagcattaggttcaagtccaccacaacgactataaaaaaggagtcgagtcaagcagaaaagatcaccatgacaccacacacacccccggagactcagagcttcctaatgaatacatcttaa

SEQ ID NO: 70181 - DNA, 357 bp, Glycine max
  Peptide Sequence Number=SeqID_161866
atgccattttttttccggaaaagcttcttacctccattttcaaaaagctttacttctcattttctctttttcgtgcgacattgcctctggttcgtgggggtagcaacgttgagcgcagcggtgaaggtgaagtttccggcgtcaagctttgcggtggtcggtggcggcaaacaatgtatgcagatggtgtttgtttgtcgcgaacgtacggatgacttccggatcaagttgatggatgaagatgagtggatgtatgaaataatgtctgaacgagcggatatggattatgaaaatgtagaatcatgtggtgcgaatgaaccacatgttgattgttcggatgcattcaagacttctcaa

SEQ ID NO: 70182 - DNA, 605 bp, Glycine max
  Peptide Sequence Number=SeqID_161867
atgtgtcctggttgccgtacacggagcatcggggtgttagggcgtttcaggagatttcatcgttccagggtcagctcagatggggtcctatgatcgtcgcagttcgaccggagagggtggtacgccagttcggttacatccagagcatccctccgccgcctgttagtgcacgattgtcacaggatcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattatgagggatatgaggcgattgcacagaggttggagcgtgtgctcaacctcaggatagtcactgcaggcacagagttatatgacattatgcaggactgcctgacgattgcgagagggggactcagtgctgatgggacggtcagggctcgtcagagacgccgcacggaccattga

SEQ ID NO: 70183 - DNA, 621 bp, Glycine max
  Peptide Sequence Number=SeqID_161868
atgggaaggggaggcaacgcggtttctgctgttggtggaggcgacgtggtttctgttgttggtggtggcttagcagaggaagaagttgggttgattgtcttaggaagcagaggcggcatgggtggtgacttcgcagaggcagaagatggagagggttgtataagataccatggtattcaatatccgaataatggcatcaagtttggaagtaatggaagtttggtctgcagcagtggaagtttgaattgcagcgagtttggccatggcggcctcgagacgatccacacaggcggtggaaagttcgacagatgcttaaggtcacaagaagccaaagaaaaacttgctaatcctccttgtgctccaaaatccaacctccacaaccaaatattaccaattgacgtggcgtgcttgcccgtgtcgttttcaaaattggagtttattgatccaattccaaagtcctctgtggttgattcatcaagtcatggaggatttgccaaagaaccagcaatgtacatggtgacagatgacttggttgtgacaccaatatcgtccatttctggtgtttcatatctatatagatcaaaagtctccctctttgacttgtcattagcattggtgtga

SEQ ID NO: 70184 - DNA, 204 bp, Glycine max
  Peptide Sequence Number=SeqID_161869
atggatggagaagaagacagagagaaggagaagacaacgcgaaggagacgaaacatacctaggtatggtggcgaaggagaagaagcagagacttgtgacgatgctcgagtgcgacgaacacgatgctcagatgcagatagggacgagaaaaccgatgttaacatatcaaacgttaacatcggttttctaaaaacccgatgttaa

SEQ ID NO: 70185 - DNA, 159 bp, Glycine max
  Peptide Sequence Number=SeqID_161870
atggaagagggttgtgttgagagtgacacgtgtccttcacagaaagcagcacaaggtggagggaagggacatttggcgtgtgtacttgagaggattgagatatttggaaatcggtgtatgggggagaagtcggtcactcggtccctcttgctgccctag

SEQ ID NO: 70186 - DNA, 540 bp, Glycine max
  Peptide Sequence Number=SeqID_161871
atggatgtgaacaccatgttaatgtgtaatgatcaattttcatgtgttggaccgattgagttgttatgcaccgttggtagaacaccagatgcaattttaaacttacttgaatgccacagcatccctactcatgatgcggttctgtattacaacggaaggtggaacatgtcacgccaaaacaactttgtgggttacgcgttcacaggaataaatccccaaaaatttgatattccaaaaggatgtaccatagaggaactgaaggatttgatcaagcaagtagcacctaaagggaatcctcctcatgggattcatgaatcccaacttgtaaggcatttgttttatcgacagcctgctcatttggagtattctgacaaagttttaaaatttgaaattattgagctgaaatctaacgacgacgtgctgaaggtgttggtagagtccaattactggaaacaatttgtgccaatagaaattttggctctctttagtaaagtggttttggaaaatgaggacgaggtggttacgtccttgcatgtttga

SEQ ID NO: 70187 - DNA, 576 bp, Glycine max
  Peptide Sequence Number=SeqID_161872
atgacaggcgttgccgatgctgttcacacagagggaatggctattgatgggagcttgggatcacctgctggagatgagggattccccggtgggccacgcgacccatcgattttgaccggttttgctgaggatgttgcacacagcatctggagtggacaggaacgacccgatctgaagttggtctcccatggtagaaaagtagataaaattgggagaccagcgcctaagatcgaaggcatgattgctgccaccagattgagtccactgatcaggtgttctgttatcaccactgatcctggactcatatccgccttcatcgagaggtggcatcgcgagactagcacgttccacctgccagtaggcgagttgacgatcacgctggatgatgtggcgtcactcctacacgttcctatcactagcgcgctgcataagttcgagccgctggttacttcagacgcgattggtctactgacagagcttcttaaggtgagtcatgaggaggctacaactgagacccgacaggctggtgggcctcatgtccggttagggtggcttcaggacgtgtatgagagctag

SEQ ID NO: 70188 - DNA, 813 bp, Glycine max
  Peptide Sequence Number=SeqID_161873
atgtcagcaaactcttggcatcatctgcatctcctggtgaagtcaagggcgtttgccctgagtgttagccagcagtatcctgctcgtattgttttggtggctagggagcatcctctgctcgccatcaagcatggcatagtagctgtttggttcctcctcttctctgatcataatttcctcaacatctatggtaggagtttggagcgtctcctggatgatggtcttgagagtgatattgttagggccttcgaggataatccctgccccacttccttttatgttggatgcaccatcgacataaaggatccaccgtttgatggaccgggctaccatctttcttgcgagttctggctttctcaaaacctgcttgatgggatagtttgtcttgactaccacttgatgactctggaagtagggcctaagtcattgagccgagatgcgcttctcggcgacatgaagcatgcggctgatgaagtagatagggagctagtgcttccattcctcttgtatgagagggctggctttaatccctcgatgtgtgatcatgaagtcgaggaacttgtcgtgcctaccccgaaagtacatctttcagggttgaggcacatgttgtatttgcatagttccccgaagacttcttctaggcatgaccctgtaccaaaagttggcatcttcagtgataaatgccattttgtcctcatctggaggatgcattctgatctggttgtattcgaaatcagtgtagtcgatgaacaattgtcatttgccattggcattctttaccatgacctctctgatgaagttggcatgaagtag

SEQ ID NO: 70189 - DNA, 447 bp, Glycine max
  Peptide Sequence Number=SeqID_161874
atggtgattcttgatatagtgcagaaattggagaaagaaggacaaaatgtcgttttgaggtctcaaaatgagaagtttaagcctggaactgatatttatgtggtggacactttgggtgaattaagactcttgtacacattaacaccaatagctgtgattgggggttcgctactccctggtttgtctggccacaatatctcagaagctgctgcagcaggctgtgctgttttgacaggttgtcacattgggcatttctcccacatggtactggaaatgcaacgatcaaatcctttgtcggttcatcaggtttctggaaaactggagctcgaaaaagctctcattgagctcttcaccaatgcaacacttctggaagcacgccgtagagccgctaaggaagcgttttgttgtctgcagatgaatccaagagttttagactatgagaaatga

SEQ ID NO: 70190 - DNA, 723 bp, Glycine max
  Peptide Sequence Number=SeqID_161875
atgtggaagcttgagaagaatggcgagagtgtctatgcagggacttgggtgcatgggcatgtcgatcattcttctatgttcctcctaagcctgaaccctgatatgattgatcttatccaccaagcagtcgaatgcggtgtcacatttcttgacacctctgacatctatggccctcataccaacgaagtccttctaggaaaggctttcgacggccaacgtaaaactttgtcgaatctctatgacatggatcaattacgtaataatgtgaatgctaggtcgttgctcggaagcaacacgctgtatggctcgagtacagtgtcaaaagagcaagggccgctgcatcgccgcccggatgtagtgaaaagtaagcaagggttcccacattttcgtgaacgggtgtgggtaaagaagctagttcatgacaggaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcaggatttaagctgtggtatacgggaaaaatcagattgagaaatggggtagggattattgtggacaaggagtggaagaaggatgtcgtggatgacacctttaatgttattagtgggtatgcacctcaggttgcgttagcagaacactttaag

SEQ ID NO: 70191 - DNA, 1461 bp, Glycine max
  Peptide Sequence Number=SeqID_161876
atgagttcccaaacacgcaacctcaactttgttctgtttcctctgatgtcccagggccacatgatccccatgatggacatagcaaaaattctggcacagaacggtgttactgtcacagtggtcacaacccaccaaaacgcatcacgcttcacatcaactttttctaattcccaaatccgattactcgaagttcaattcccataccaagaagcagggttgccagaagggtgtgagaatctcgacatgttaccttcacttggcacaggcttggatttcttcaacgctgcaaacagcaacaccctgaaggagcaagttgaaaaactctttgaagagttaaaccctccaccaagctgcataatttccgacatgactctgcattacacagcaaacattgctagaaaattcaatattcctaggttttcattcctgggacagagttgcttcagtctcttttgtttgtacaacataggagtccacaaagttcggtcaacgattacctcggagacagagtactttgctctgcccggtctgcccgacaaggttgagtttaccatagcacagactccagcacacaattctagtgaagagtggaaggagttttatgccaaaaccggtgctgctgaaggggtttcatttggggtggtgatgaattcatttgaagagttggagccagaatatgccaagggttacaaaaaagcaagaaatggaagagtttggtgcattggtcctgtttcactcagcaacaaggatgaactagacaaggctgagagagggaacaaggcttcaattgatgagcatttttgcttgaagtggcttgattcgcagaaaccaaagggtgtgatctatgtgtgccttggaagcatgtgtaacataacatcacttcagttaatagagcttggtttggccttggaagcctcaaaaagacccttcatttgggtcattagggaagggaatcaattgggggaattggagaagtggattaaggaagaggggtttgaggaaaggaccaaagatcgaagccttgtgattcatggttgggctcctcaggtactgattctttcacacccttcgattggagggtttttgacacactgtggttggaactcaactttggaagctgtatgtgctggtgtgcctttgattacatggcctctatttggagaccagtttttcaatgagaaacttgttgtgcaaatactaagagttggagtgaaggttggggtggaggttcctgtggagtggggtgaggaagatgagaatggtcttttggtgaagaaagaagatgttgggagagctattaatgagttgatggatgagagtagggatagtgaagaaatgagggaaagggttaatggacttgcagagatggctaagagagctgttgaaaaaggtggatcttctcactccaatgtcacactccttatccaagatgtcatgcaacaaaacaagagagatacttaa

SEQ ID NO: 70192 - DNA, 1737 bp, Glycine max
  Peptide Sequence Number=SeqID_161877
atgggtatccttcaatttcttaggttggaaaccatagttcaattggctaacgttgagtggaagctgggattacggcttagggtacatttactaaagattttgaattttggattctatttaatgagttttgatgcatgtaaattgccattcgatgtatggatgttggatgtcttttcttttatcgggttgggttggttttcccgtgacacaacacaagcgcttccaatggagacaacaccagaacgcaaccttcactttgtgttcatccccttgatgttgtcaggttgcatgcgtcctttggtagacatggccaaattaatggcacgacgcaaagtaaaagttaccatagtcaccacagcccgctatgcagtccaattcaaagccagcatcgacagagagatccaatctgggtcatcaatccaaattcaactagttacatttcccaatgcagaggttggagtaccagaggggtttgaaaacatacaactaccttctatagatttgaaggagaaacttttcacagctttaagcatgttgcagccgcaactagaagagcttcttaaaaagctaaacccctttccatgttgcattatacatgacaagcacattttttgtgttgctgacatcgcagtcaagttaaaagtcccaagaataacatatgataggactaattgtttcaatctcttgtgcaatcacaacttgctaacttataaggtctatgagactgtctcttcagattcagatgaaattattatccccggattaccccatagaattgaaatgaggaaatgtaggttgcccacagtatccaagccttactcgcctaactcgagccaaaagatggatgttgtacgtgagagaataaggggatctgaagcagaggcatatgggatagtggtgaatagttttgaagagtttgaagctgaatatgttgaagagtatcaaagggttacagggcataaggtatggtgtgttggtcctttatcactaacaaacaaggatgattgggacaaagttgggagagttagtaaaagcccaaatgctagtgaaattgaaaccaaccaatatatgaagtggcttagttcatggccacaaagctcagtaatttatgttggtagcttttgtccagtagaacctaaggttttgatagagattggtttaggattggaagcaacaaaaagaccattcatttgggatctcaaaggaatatataggagagatgaaatggaaaggtggttgtcagaagaaagatttgaagtgagggtcaaagataaaggaattttgattcgggataactggttgccacaagtgtcgatattgtcacatagagcagttggagcgttcttcacacacgctggatggatatccacattggatgccatttgtgctggtgtgcctttggtgatattacctgtgtctgctgttgaaatgttttacaatgagaagcttctttctcaagtggctgagattggtgtgacgatgagaactgaaattgctattcactgtggagggaaagataagtatggagaatgtgttcgagaggtgaaaaaggacagtgttaaagaggccatagagaaagtgatgcgtaaaggtggagatcatgaaaaaagaagagaaaaagctaaaaagtacgcagacatggcaaagaaaaccatagaagaaggaggttcgtcttaccataatatgtctatgttgattgatgacatagtgcatgcccaatcgctgaatcaaagttaa

SEQ ID NO: 70193 - DNA, 1155 bp, Glycine max
  Peptide Sequence Number=SeqID_161878
atgagaggggcgccgtcagaagaaagtaccacgcctttcatcgcacggggtttcagtgaccccaatgcaatgatattccaaagcgttcaaaaggcatggagcgttgtgcaaagaaaggataacgaacttaggggaagcagcaatgggatcatcagcggatatcacaagtggttgaaggctcggacgcaagagctagattggctctcgaagctaaaggcctcaagtgaggaagaggctgaaaccctggagaagagtgatgaggagtctgaagaactgagagacgtcaatgtggccacagccgaagcgttggaacaggaaacaaagagcaacaacgagcctaagcttcgaagggccgagagagaccggtcaagagtcaaaaacatggtattggaagacaagttaaaggcttgccaaaggtcaaaaaggagtttatccgagcaattgagcaagatggaagagaacatgtgggccatcatcgaccaatacaaagagaagctaagtctagccacaacccatgaacaaaggctagaggacgagtatgcaaaggtgtcagtcctgttcgctttcaccttgaatgggagtcaagagcttccaagactgctaaccaaagctaaggcgatggcggatgtgtactcggctcccgaggaagcagtaaacaccataactaaacatgctttaaggcacccttatcgaacccgttccaaaactagagtcatgggtgacatagaagaggtgcaagaacaaatgaaggccgatatggaggccttgaaggatcaagtggcttccatgatggaagccatgttaagcatgaagagaataatggaaagcaatgcggccacagtttccaccgctgaggcagatcctacccattcgtctgccacgaaccaagcgcaccaacccaccccgaacatggttggacaagacggagagggtcagcaaccccagcctataggagacgcccatgaagaacctcaggagcctgctcaagtggaagggagagagaaacttgatctcctcaaagagagattaagggttgtcgaaaggtttggtgattacccttttgctgacatgacagaattgtgtttggtacctgatgttgtcatccctccaaagttcaaggtaccagattttgataaatacaaggggaccacttga

SEQ ID NO: 70194 - DNA, 228 bp, Glycine max
  Peptide Sequence Number=SeqID_161879
catgaaaaacacgattttcatgcctccctctctcaaaaatccgccaaaccacccctagaaactcctcctccaccacccatcaccatcgttggccaccatgagtcgccgttgcttgctgtcggaccaccacacggagaggaacgtcttaatcagagtggaatcctcagaattcacctcgaggatttggtggagaacaagctctcaatagtgaagaagcaagcttcatga

SEQ ID NO: 70195 - DNA, 111 bp, Glycine max
  Peptide Sequence Number=SeqID_161880
atgaattcgaagaaatgtccaaatgccctaggtgtgggggcattacggtacaaagtgaaggatgatgagactacagttctgatgaaactcaaagaagtgccctccagcaag

SEQ ID NO: 70196 - DNA, 804 bp, Glycine max
  Peptide Sequence Number=SeqID_161881
atggccccgaggaagcttgcctcaaagaggtccaggaaggataaggcggccgaaggaactagttccgctcctgagtatgacagtcaccgctttaggagcgctgtacaccagcagcgcttcgaggtcatcaagggatggtcgtttctccgggagcgacacgtccagctcagggacgacaagtatactaatttccaggaggagatagggcgccggcggtggacatcactggttacccccatggccaagttcgatccagaaatagtcctcgaattttatgccaatgcttggccaacagaggagggcgtgcgtgacataaggtcctgggtaaggggtcagtggatcccgttcgatgcagatgctatcggccagctcctgggatatccgttagtgctggaagagggccaggagtgcgagtatggccagaggaggaaccggtctgatgggttcgatgaggaggccatcgcccagctgctatgtataccggggcaagattttgcccggactgctgcagggaggcgagtgcgaattatgcgcaccaacatgaccaccctgactcagatatggatgactttgctgctcagcaacatcctgcccaccgaccataatccgacctccccctgtcgaagtgtcagctggtgtatggcgcctaccaggcaccctttggacccagataagtccaacagggccctgggatttcccgcactgatcacaggactctgccagtcgtttggagtccccgtggcacctaccaaggtgattcggccgcccatcacccgggtttttattgagaagtactgcacctag

SEQ ID NO: 70197 - DNA, 252 bp, Glycine max
  Peptide Sequence Number=SeqID_161882
atggctgctgtcgaaggagacgggttggatgatgaagggatgtcttcagttctcgctctctttcttgatgccatctgcaagaaaagaatgagagaaacattaaggcattggaccattaacgatctcttggttttagaaagtatagaaatgttaaggcattggaccattaacgatctcttggggtggtcgacaaaagtggggtttttgctcctacgtatcctccataaagatgaggaactcagacctacgtag

SEQ ID NO: 70198 - DNA, 276 bp, Glycine max
  Peptide Sequence Number=SeqID_161883
cagcccgtggagtggatactacctacacctactccatatcgactagtggagccggttcaagtgatagaggtgtcatcctttgaagcggatattgaagaggaccaaaagaagttacctcttgagcctgttgtggatgctcttgacttcccagaggatgatgaggacccactccttgatgttgatttcccagaggatgttatgtcaacatctgaggcagactctacagagaagagtggccctggagggacagcgaatagtgacgactcttcatcgtag

SEQ ID NO: 70199 - DNA, 363 bp, Glycine max
  Peptide Sequence Number=SeqID_161884
atggcattgagaaaaagagctataacggaggacatcccttcatcatccactccagctcctcccttgcaagagttggctcataacagaccaatcatacctatggagcattttcttgagcaagtagcctggcctgaagctcaacttccattggtgagacccaacgaggttgctccgcctgagcccacacctgtgcagatgataacaaaagatgatgacaaaggtgatgacaaaaagctcaaaggtcaatcaaagaatgagttcaagaacacttcaagattcaagaggaaagttgatttcaagaatcaagaatcaagattcaagagatcaagatttcaagattcaagaactcaagagaagacttaa

SEQ ID NO: 70200 - DNA, 345 bp, Glycine max
  Peptide Sequence Number=SeqID_161885
atggtaggtaaaggtgtttgtagatttcacaagccgcgcgcgctcgaaaaccttgccctgcctcttctctttgtcaccgtgaaatcactcttctctttctcgtcccgcctgaaaactgccggaaaccgctccctcgacacccacattgtccttgctcaaacccacagaaccccctacactgccggaaaacccacattctcctcgcttgaacccacagaaccccctacactgttcttggaagtctggctcaaagaaaacccaacatacactgttgctactagggtgctgaaacagtcgtgggtgctcaaagctcaaagctttctctgcgagttgcagtattgctga

SEQ ID NO: 70201 - DNA, 369 bp, Glycine max
  Peptide Sequence Number=SeqID_161886
atggaagaaaagaaaccgaaagtgaacagaataaagatgaaagccaaaaaaataggaaatgaattaaaagtctcggaattggaaacttacccattgaagaatgaagaacggatgaagaacgaacctcacgaattacttaatgatacttgttttctttccgtaaagtcacgaaactttatggattacgcaaccatcccctcttcggcttctggagtgttacggaactttacggattgcgcaataatgtttcctttcgactcccgacatgtcacagaacttcacggattgcttaacgatgagtgtcaagtccctcgaagcggtcaaacgaaggttgcatgccatcaaacaatgatccccggacgaaattag

SEQ ID NO: 70202 - DNA, 204 bp, Glycine max
  Peptide Sequence Number=SeqID_161887
atggcggaaccaataagggtggcaagaagaaattcaacaagaaaggtatctaatgctataattgtccaaagtggggtaattttgaggatgagtgttagggtgaaaaaaaggctaagttttgaattgaaaaaagtagcagttgggctaagcgcttatccaccgctaagcgcagcttcggcgtgcttagtgcaaaggagaatctag

SEQ ID NO: 70203 - DNA, 309 bp, Glycine max
  Peptide Sequence Number=SeqID_161888
atggaatcaagaaatgccaagtttcttgaaaatgacttgatcagtgggagtgatcaattgagggacttaggttttgaaattgattatataaagtctcaaccttccacattaagtgaaagattgattgtaattcatgcccctcaagttcaaagggatgatgaacaacacatgattgacattccaaaacctgttgctgataatccagtagatcaagttgataatcaaattcctaaaaatgatgaacaaccagctaaacaacatgatccccaagaaaatattgatgcaacattaaagagtctactagagtaa

SEQ ID NO: 70204 - DNA, 518 bp, Glycine max
  Peptide Sequence Number=SeqID_161889
atgactagaggcaatccatctgaattacaaccctttgatcctgagatagataggacatttcatagattagttaggcatcattttgtaccttttgagcatcctgagcattttgttactggtgagtctgtgcattctattattggtgattttgaacatcctgattttgagcattataattttgaacattctaattttgaacattctgagaacatggcacaacctccacctcgtgagaggaatctaacggaaatggttgcacctgatttcagttatgaaagcttgtgcatccaataccctgatgaggatgtcccatatgttcttaaacctggactgatccatttgcttccaaagtttcatggccttgcaggtgaagacccactcaaacatctcaaagaattccatattgtctgctccaccatgaaacccccagatgtccaggaggatcacatatttctgaaggcttttcctcattctttagaggaagtggcaaaggactggctatattaccttgctccaag

SEQ ID NO: 70205 - DNA, 484 bp, Glycine max
  Peptide Sequence Number=SeqID_161890
atggctccgagaaagcttttcgccaagagatctaggaaggacgccgcggctgaagggacctgtgccgctcccgagtttgacagacatcgttttaggagcagtgagcaccagcagtgtttcgaggccatcaagggatggtcattccaccgagagagacgcgtccagctcagggacgatgagtacacagatttccaggaagagatagctcaccggcgttggacgtcgctggtcactcccatggcaaagtttgacccagatgtagtcctagagttttacgccaatgcttggcccacgaaggagggagtgcgggacatgcgatcatgggtaaggggccagtggaatccttttgatgcagacgccctcagccagtttttgggagacccgctagtgttagaggagggccagaagtgcgagtttagtcagagaaggaaccgggccgatggatttgacgaggaggccattgcccagctgttatgcattccgg

SEQ ID NO: 70206 - DNA, 312 bp, Glycine max
  Peptide Sequence Number=SeqID_161891
atgatgacgagacgtgaaatcttcgcgaaatcactcacgaaacgttacgaaaacattacggaagcgcctcggcttggatttgcttcacggaaacaatttctctcagcaatttcaagtgaatacgaagtgccaagaaggctgacccctttcctcttcactcctccccctatttatagccaaatagaggaggagcttgccacccagctcgcccaggcgagccaggttgcttcctctagaagcaaccgccttctgggggaagaatctggaaggcccaagtgggtctggttgctatttgcacccctattttactaa

SEQ ID NO: 70207 - DNA, 1497 bp, Glycine max
  Peptide Sequence Number=SeqID_161892
ggtgatggcggtttcgaggctcccggccacgcccgccgtgggctgcagcagaaatcgatcattggccgccggggtgccaccgaccaccagcttgacgccattgatcaccagcggatcggcggcggtgccagtgccggtcaatgcaacggtggcacccgtgtcggcgcgggtggcctgccactgggttccatcgaacttgaggacgatgttctgtgcctcgagcttggacaggtcgccgtaggtcgcgctgaggctgccggttccggtattgcccgcgttgggcgtaacgcgcgggttgccgatgttgaagaagtcgccccccatcttgccgtacaggtcgacgccctggtggtgggcctggttgaacgattcggccaggccgacggcgagcttgccgagttcggcctgggccggggtcagcacggtgtcgcggaactccagcatgccgccgatctttccgcccacagccttggggtcgagcgtgatggtattgccttgtgtctccagcgccagctgcaggcgctcgggctggtacggatcggtcaccgtggtgaccttggacgccgtcgtgcccaccaccagcgcattgccaccagcggtgtagacgttcatcacgccaccgtcctggacaacggcggtgccgccggtgtaaccgatcagctgcgagatcagctggtcgcggcgatcaagcaggtccggcgcagcattggcgatgttggtgccgatcgctccgttgatctgcgcaatctcctgcgccaggcgattgacttccgtggcgccggcgatgagtccgttgttgacctcgctgccgaggttgttcatctgcgtgttgagctgcacgaagcggctcgccaaggccttgccaccatcgagcaggctctgccgatcggccgtgccggccgcgttcgacgacaggccgctgacggcatcgaagaagttggaccaggagccggcgacattcgtggccgggtccgagaacagggcattcacccggtcggccatgccggagagctgcttcaggcgcgccagctcaccgctgctgtcgagcaggcgcgagatggccagctggtcggcagcgcggcggatgtcggtgatgcgggtgccgctgccaacgtccccaaagccgtagttctgcggatcagacgtggcgaagtcgaccttctgccggctgtagccgggggtgttgatgttggcgacgttgtggctggtggtcgccaatgcacgctggaaggcgagcagggcaccggtaccggtggaaagtacgctggacatggggcgcgagccggcatcggcgacggcgctgacggcccgctcgatggtcggtccgccggcgatcgcggcgatcttggccgcatagcgcggatcggtggcatagccggcgcgctgcaggccgcgggcgaagccctgcacgtcggtgccggcctgcagggcctgctggtaacgcgggctggtcttcagcaggcgcacgtagtcggcgaagctctcggccggcgaact

SEQ ID NO: 70208 - DNA, 442 bp, Glycine max
  Peptide Sequence Number=SeqID_161893
atggccataacttttgctccagttatcaaaatgactactattatatatgcagttgggtgcaagactagggacaatccaagtgatttacaaccctttgatcctgaaatagatataacctttcatagattatttaggcatagtgagcatcctgatcattctgtgcactttgagcattttgagcattctgagcattctgtgtattttgtgcattctgagcattttgttgctggtgattctgaacattctgattttgagcattcaactgctaattttcatactgagaacatggctcaatctccacctcgtgagaggactcttagggagatggttgcacctaatttcacttatgaaagcttgtgcattcagtatcctgatgaggatgttccatatgttctcaagaatggactaatacatttgctgcccaagtttcatggtcttgcag

SEQ ID NO: 70209 - DNA, 564 bp, Glycine max
  Peptide Sequence Number=SeqID_161894
atggaagacgcacccgcgagccccacgtcgccctcccgccgaaggggagacgaaatccatgttgtttgcaagcaggatcagctgaagtctcgcaaggctgatttgaaagaaaatttgacttatgtgatgcataattttaaagttatcaagaatgatgggaaattcagagtttgtgatcatgaatataaattatgttttactggagttactgttgttaggcaatgtgatatggaacaattaccttttaggaaattcagatttgttgctttttccagtgtcattgctagtcattttaaaattggcctcttggttgatgttattggcgtggttgatgaagtggtattccgatatgtgtcatccaaaaatacgagggttgttttgaatttaaaggatttgaggccgatcgttattctcttgactcctgctaggattaaggaagcacagggatcatatccaacatcggtcagtaattctttcaaggcatctaaactcatgatcaatgacctggtgctggaaattcaagaatttagagagaggtattttagcaatgtggtgcttatgtga

SEQ ID NO: 70210 - DNA, 231 bp, Glycine max
  Peptide Sequence Number=SeqID_161895
atgaagaccgatatggaggccatgaaggaacaaatgacaatgatgatgcaaccaatgatgagcatgaggatgatgatggaggataactgtcacaacctacccttcggtgggagggcgacgcgagactcacgggtgcatcttccaaggaaggaaaacgcgcggagtcgccaccaacgtttattcgaggaaaacgtcggaaaaatcggaaaaggcgtagtctacgaactttaa

SEQ ID NO: 70211 - DNA, 249 bp, Glycine max
  Peptide Sequence Number=SeqID_161896
atgaggatttacacgcgattctcctcaaatttcagccagcccgtatcaattagacttcacactttatgcttcggggtcataattgctcaatggaacgccccggggcttctccgtgacaagcacacgttgcgttcgagtcgtattctcggagaaatggaggttgatgaaccttggctagggttatggctaccattgaattatcaagtagatatgggagcaagtcagcataggacactggaattggggtga

SEQ ID NO: 70212 - DNA, 772 bp, Glycine max
  Peptide Sequence Number=SeqID_161897
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgggtcgtgcgtttgatgacgatgttgagtttccccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 70213 - DNA, 270 bp, Glycine max
  Peptide Sequence Number=SeqID_161898
atgcagagactaacatcgtctcctgcaccttttgtcgtcctgacccgtgaagttagggacggcgagtcaggtggtaggcggagataccttatggtcatccgcgcctttcgtcaactgaggggaatgaattcgacggtttttactctcgtcgtccggaaacaattaagcccaacgacgcgcgagattcttctttgctggccagggacgatcgagtgcaatggcgaagggaagtgtcatggttttccaactttgtcgttttcaagacactga

SEQ ID NO: 70214 - DNA, 467 bp, Glycine max
  misc_feature (50)..(50): n is a, c, g, or t
  Peptide Sequence Number=SeqID_161899
gactctaccagtcgtttggagtccccgttacacctaccaaggtgattcgnccgcccatcacccgagcttttattgagaagtactgcacccagagacaggctcagggggatgctccacaggccgcgggcgcgccaccaccacctcatcaagctggcccggctgggtcatttgacatggagcagtatttacggcatttggttcgccggcaggcggccaaccaccgggcacatgtacagacccatgattgtctgtaccagatgagcctcagcatgcagagccagggcttcgcttctttttcatgccctactctagaccagttcagggaagaggtcgcatggcccggggattggctcgaggcccaagcaggagaggcgcccccagaagctcccggcgatggagaggaggcccacgaggacgaggagatggccgatttgcttgacttcttgggagggagtggaggtacatga

SEQ ID NO: 70215 - DNA, 267 bp, Glycine max
  Peptide Sequence Number=SeqID_161900
atggcacatcggaatccgacttacaaatcccaggttttcgcaaaaggaaaaccaaatgaaattctgataccaggggacagatgtcgtacaggatgtcacgacatcacgcttcagaacatgcagtttatgtgtgtccgtatgaacagattaaacaacctccatgattatatagccgtgtacgattctggactgcaagttcttgatgctggaggagatctatcttcttctgaaaaatctgcagttaaagaactaaaagataacttttga

SEQ ID NO: 70216 - DNA, 96 bp, Glycine max
  Peptide Sequence Number=SeqID_161901
atgggggtgatgcaatttggtcctaaggtgaggttttctccgaggtctagtcagcatgggggtgtcctataccttctaccatatagagcttcatag

SEQ ID NO: 70217 - DNA, 231 bp, Glycine max
  Peptide Sequence Number=SeqID_161902
atgggacaccttagcgatcaaggggttcccacagaccctaagagaataaagttcattcctgattggcttactccaccaagtataagggaaatctggggctgccatgacttaacttttataaaaggtgtcgagggaaggagcctagagtatgaagaacctcaggatttgaggtcaaatcctttccaaggtggaggggaggatgcaatcctaccccccaagggtattagatag

SEQ ID NO: 70218 - DNA, 121 bp, Glycine max
  Peptide Sequence Number=SeqID_161903
atggataaagaagaagatgctgagattccattgatcttaggtcgtcccttcatttcgatggctaagtgtgtggtggacatgggaaatggtatcctagaaatgagtgtcgatgatccaaaag

SEQ ID NO: 70219 - DNA, 1011 bp, Glycine max
  Peptide Sequence Number=SeqID_161904
atgggcaaagatgatggtcttggaaagcattttgattcttatgtgaaaaatgatcggttggttgacattatagataaagaattgatacataaggtagatgttgagcaactaatatgtgttgctaaaattgcaatagattgtttaagggagagtgggagggaaaggccatacatggaagaagttgtaaaaagacttcaagaattacacttcatggaaaagtaccaaagggaaagaactcatttatcttcagaattgaccaaagaacttgtcaatgcaacaccatttgtttcaaacaatgtttccgtcttgagtgtgctcatcgggagagcaaaatggaggggtgagcttcatggtgttaaccatttgctttttgcggatgactgcttcatcttttgcaaagtggatggtgtggagtgtgaactgcttgcaaatattttggaaaactatgggaagtacctggggttgctatctccattggggcatatcaagaaggtagtgtttagctttgttaaggacaaggtcacaacccaagtgtgtcatgtacaagtatttggagtgcccaagctattctacgggagggttgtagattgcgtgtggggagtggggagaatcttagggtgtggggcgatgcttggcttaggggaaaaacacatgcatctattcaatcagagcctaccccatattttggagatctcactgttagggatcttttcctcccaagggagtagatgttggaataaggacctgctaaaggctttcctggaaaggaaggatgtggaggaggtccttaaatttcctatattgcctcacaatggtaagcataagaggaaagctattctaagggaggtttgtagatggcccattttcaatatgatctacataccatggggcaaggaacatggtggatatgcagcatctgaaggtccttgggaattggaaccaactgtggtttctgttagaattaatgtctcatgtgagagacgtgtgacttatgtagggactaataaataa

SEQ ID NO: 70220 - DNA, 681 bp, Glycine max
  Peptide Sequence Number=SeqID_161905
atggctgatatatttttgaaagagaaaaatagtttggaggttatgagtgatcagaaagaaatgaatccgaatagagtttgctggatttatgagcactttctgtcggtcgcggactccactgctgatcaggagtacgacgaggattctccgcgtgcgtgtaggtggattgcgaccaagaagattgtgaagagaattcgtatgccggcgtacagggagcgcctggatcgactccagattccgaatgtctgttggatcccttatggggagcaccgagaggtccgggacttccatgtcagatcatgctattccggtctcttgcgctgggggcctgttgctatttattaccgaccggagagggtcgtgcggcagtttggctacacgcagaccattcctgctcctccttgttccagtgactacatggactggttcttccgcatctcccatcctttcatgacaccaggccacacattagatcctctgcctcatggtcacgccccgcagccccaagtcgtccctcaggccccgcagacggatatccctcgcgtgccggagccaggagcatcgtcgacatctgcggaggagcctagacatgcagtggaagtttgtgatgacattgctgagaggttggagcgccatctgattctaggggtggtcacgcctggctcatcgacaatgaggtga

SEQ ID NO: 70221 - DNA, 429 bp, Glycine max
  Peptide Sequence Number=SeqID_161906
atgattttaacgaattttgcgttcctttatacttcaattcaggacgctcctgaattgaagctatcctctcatgggaggaaggtccacagtttaggcacgcctatccctgccattgagggacttgttgctgacaccaacgatcggggacttttgtccgcgtttgtggagcggtggcaccgagagacgtctaatttccatctccaggtgggagagctcaccatcacattggacgatgtctcctcgcttctccatcttcccgtgattggcgacttacacacttttgagcccttgcacgtggacgatgcggttcaaatgctggtggacttgttgatggtctctccagagtttgttagggctgagacagcccagtgtcacggaccgtacgtacgcttgcaatgggtacgtgatatatatgagcgccgatgctag

SEQ ID NO: 70222 - DNA, 510 bp, Glycine max
  Peptide Sequence Number=SeqID_161907
atgcctttttccattactatctcgaaagaagagtacaaattagggtcgaaaaactggaagaataatctgcatggccacttcatcctggccaaaggagatcagccttttcattatcaagacttgcatgcaaagttaacgaaactttggaagcctctgggtgattggtgcatgacacctcaggacaaggattctatgaattcagtttcgcctcaacagatgatttgcatagcatttggactgttggagcttggaacgtttagcccaggctcctccacttatataaatggactcttgattttaatcccaacaagcagaaactcacccattctcaataccctcctagagattgtgggtgcccttggtactcctatagggttcacttgtggtgagctaacccaagaatattggcggcccaagaccatcttagagattgcaggctatactgaaaaaagtgatgtagacaagactcacaagaggaagttagttactgctccatgggagacctattga

SEQ ID NO: 70223 - DNA, 570 bp, Glycine max
  Peptide Sequence Number=SeqID_161908
atggatttctgcaattctgcttttaattctctaacctcctccgtctcaatagcttcaatgaagtccttcaatgatgatttttcaccatggagatgcagcggaagacaaaggagaagaggtgagaggaggcgtcattcactagggaataagccatggaagaaaaagcttcaccaccaagatgagccttggataagagcttggagaggatgtttcaatggaggaaaagaaagagggggagaaaaagagaggggggagcacgaaattgaaggaagaaaaaagggaaagaagttgaactttgagttgtgtctcacaagactctcattcatcaaagttacaacaacggactcatacttagtccatgggctcaaaatctaccctaaggctcatgagaaccctaggacctttccttggatctctggctcaatcgacttggagtcttctatccaatgcccttgcggactgagatgttcttcgtccaatcctctagcaatgaacggttggatagctccatttgagggtagtccacggatcgggtatcctaactccctgatccccaacatagggttatag

SEQ ID NO: 70224 - DNA, 735 bp, Glycine max
  Peptide Sequence Number=SeqID_161909
atgtctgcagcagccaataaccacgcccaagccgaaaataccgacacaattaagctgcaaaatattcaacccagcctttgtctcaatggcaaaaaactacctcaaattgtctcactttgtccaaacctttctaaaagggaagggcaaattgaatcatcttattgggaaagatgccccaaaatccacagacaataccttggtgcatgggatgaagcagatgaagtagtgatgtcgtggctgtggaattccatggtgccaaaggtgagtgatgcttgcatgttcatgaagaccgccaaggatgtgtgggagagctgtaaagaaaactattccaaggttggtgatgctgctcaaatttataaaattaagatgaagatcgcgactaccaaacaaggagaccgatccgttagtgaaagccaagacacacccaagactgatgctggaaacttcatggtaagcctccaaatcagaaccgaaattggaccaccaaaggtactcaacgaggagaaccagcacaagttcacctggctcagtcaggtacttcccaagcctatgctcttagcgttctacaatctactacacaagggacgggttgttgattctggagctatagatcacatgacccattcctctactgaatttatctcatataaaccttgtcccaacaataaaaaacttgcaaatgcagatgacacatttattacaattgctggaaagggagacattctcctaagttag

SEQ ID NO: 70225 - DNA, 308 bp, Glycine max
  Peptide Sequence Number=SeqID_161910
atggctagaacacgaggtttaggtcgtgccataggtagacttgtaggtagagatagacctgatgaccaggatgctgctgatgttcccgagaggcgtaggcctactgcctcagcccataggctacgggttcatcagatgactgcggagggacgtgatatggctgaggacgttgctgacatgactgatgatgtccctgagctggctgcggaggcacctgagatgcgtgcgggcgtacatggtgctgatggtggtgaggggtcagatgttgatgatgctgctgagggattccctggtgggccacgtgaccc

SEQ ID NO: 70226 - DNA, 390 bp, Glycine max
  Peptide Sequence Number=SeqID_161911
atgttgattgttcaaatgtgttcaatacttctcaggtgtttgacagccaagaggatgttctgcgatgggcttgatccgttgcttatgaaaatggatttgtggcggagtggcgagtataggtgtaggaacaaagaattcgttataagagacactaggactaggaaatgtaggtgtcccttcaagcttcgtggcaagccagtggttgagggacaaggctgggtgaagttgatttgtgggattcataatcatgaattggccaagtcattagttggacatccatatgtctggcgattgagtaaagctgaaaagacacttattggtgatatgacaaagtcaatggtcaaaccaagaaacattctgctgactctgaggagcacaatgtcaatagtt

SEQ ID NO: 70227 - DNA, 384 bp, Glycine max
  Peptide Sequence Number=SeqID_161912
atggcctctttaaattctctgttttccgaaaataatttcgtgtatagatcaaatctgaaatcatttcaagatcatgatgaagaccaagccaacttatgtctcatgacaaaatctcttgagaacaacgaggaagaatatgtaaggaagaagtggtacatcgatagtggatgttccaagcatatgatgggagatgtatctaaatttacaaccatttcccccaagaaaagtggacatgttacatacgagttcctctacttccatcaaaaatgcgttacttgtagaaggttaattaggcaagtttgtgaagtgctaattttcaccctctcgctaagccagaagattggcatagcgagccatccgctgagcgcaacactcctcgactga

SEQ ID NO: 70228 - DNA, 477 bp, Glycine max
  Peptide Sequence Number=SeqID_161913
atggattcctccaccacattcctcaacgaccttcctcccctcaagagactaagactcttgcaacaacaacagcaacaaaaagaagaacatcagtattatgactcttcttcacctttacccgctaaaaaacgcaaggagtctcgaaccctatctccaccctctcccaccaccaccaaaaccgtttataactattccctccccgccaagaaaagagtgtgggccctacaaccccagagcccaccctcaaatgacgtcgtccccgccttcgacctcaatgtggaatacacacccagccccaacaaccacggagacttagaagaagaccactccgaggacgaggacggggttctatgctgtgtgtgccagagcacggacggcgaccctgcggatccaatagtcttctgcgacgggtgcgacctcatggtgcacgcctcctgctacggcactccctgtcaagttcatcccggatggagactg

SEQ ID NO: 70229 - DNA, 140 bp, Glycine max
  Peptide Sequence Number=SeqID_161914
atgaagtcaggtggcaggcggagatacccaagtggttatccgtataaatactctttcgctatccgtcagactcagagcggagatacccaagtggttatccgtataaacactctttcgctatccatcaaactcagagtccg

SEQ ID NO: 70230 - DNA, 231 bp, Glycine max
  Peptide Sequence Number=SeqID_161915
atgacaacggaatggagatggaagagagagaggagacgccacttcaaggagaagatgagtctagaagaagctcaccatcataggatgccatggataaaagcttggaggaagaaagagatgaatgaagggagatggagagaagagcacaaaattttgtgctctaaaagagctctgaaatctaaacgcactaatccaagatcaagtccaagattctccactaagtgtgcttag

SEQ ID NO: 70231 - DNA, 483 bp, Glycine max
  Peptide Sequence Number=SeqID_161916
atgacactcactgatgcttctaagtctagcatggcattctttaaattgttgttcctaataatgcaaggaattactctaggtggaaatggaagaggaataggaggctgtcgtacattagaattgctagaagaaggtccttcatggtcaggaggctatctcttttgtgcatctatctcattctctctttcagattctgcacagcttgagaatgcagcttgtcagagttttgggactgagcttggttcaactgagtggctcttgtcttttggtgaaactgcatattctgtattgtcatttgcctcactaactcctctaaggaaggttgagaaggggcctcagttgattgttgtctctgttgttgttattgtcgttgctgctgtggctgttgctgttgttgcattggaggaggaacgtatggcctgcttggaccagaagcattttggaaggaaggagcaggttgctgttgttgttgttgagggctag

SEQ ID NO: 70232 - DNA, 213 bp, Glycine max
  Peptide Sequence Number=SeqID_161917
atgctgaaaagtctcgtgtggtatcgtagtgggaaagccgtcaagaagtccaaaatcagaggcgctataaatggtatcaaagcaaacatctcttccaggacggtgtggttcaaggatgaaccaagcgaaaaatggtgggcatgtaacaactcgatcgaatcacatcagaatgaaagggatccagagttgtacatgtatgagactatacagtag

SEQ ID NO: 70233 - DNA, 612 bp, Glycine max
  Peptide Sequence Number=SeqID_161918
atgcctatcatgatgatgggatctgcaacaacatttatagactgtgatgagtgtaggaaattattgctggtaacaataaacaaatatctttatttatgggatttattcaacaaaacctgtctccttcatgactcattggcttctcttattgcttcaagtcctaactcatcttctaaagatgttggcactattaaagttatatatgcaaagctatcaaaatatggttctcctcttgtcatttttgccactcgtcatgctttcctatttgacacgagtctcaagtgttggctaagggttacaaatgactacttccctgcatcaaattttgccagctcttggtgtatgggattaattcaaagtggtgaacttgctgctttgcaagttgatgttagaaaatatttggcatggaagccaagtttgactagcataagtgacaataaagcattagaagggaacttttcagatcattctcagtcacattctgttgcatcaagtgatggttgcctgtcattgttgaagaaaagacattttggaattaggctgcatgctattcaaaaaaggactccccaggaacatggtttagatggtgatgaagatgtgagaatgctttaa

SEQ ID NO: 70234 - DNA, 1041 bp, Glycine max
  Peptide Sequence Number=SeqID_161919
atggtcaagagacagaaccaaacccaaaccacccaagttgaccctgacttcaagaacaacccatcatccgcttcatctgaggatgttcttggcattactgtgaagttgtctgtagagaccattgctcaagctattagttgtaagcgtagaagcaccaagttcatgaacagttggtggaatgaacttaaagaccacattgggcttaaaggacttcttgtccaatgcccacaagttccttttgtaccacttgatggaggacactaccttttgtccaatacccaggtggatgattccattctttctgaacttcaccagaagtttggactcaacactgggcaagatgaccaactggatgcggtgtgggagaaagcaactaaggaagaagatagggtggacgtagacacctctcaagctgagaagagaaccaaaaagaagatgaatgcaaattcatccaaggttgcttctgcaccacaacgtccaccgcccactttggttgctcccaagggaacagatgggtttgagttcagaaaaaggaaagttgcaccaccttcgattgagaacaatgtgactcaagtgaagaaggttaaaccaactccaaaggttctaccttccctaactcaacctcgcaccagaaagaagaggaaagtcactgagtccaatgttgatatggacaatgaagttccacaccaagcacctctatcacccatccaccttgatcgcttcgaacatcaaggaccacctgtcatcgaccctagcctcaatgccgaagacattgcaagagaagtagtcaactatgacaaagacatcattggatggtgtcaaaagattgatgctcaacatattgacccatcttctaatgatttattgccattgttcatgtgtccaaagcatattcaactctacactccttcccagattgcaatgaggttgcctccattggacctcaggaaaaagaaaggcaaggtgcctcctcataccaagccaatgcctcaccttggtcccaaaggcaacactgccctatgtccaactccctatgattga

SEQ ID NO: 70235 - DNA, 609 bp, Glycine max
  Peptide Sequence Number=SeqID_161920
atggcccgcaccaagaaaactgggcaaatgacatatgaggcagtaaaggaaattgctaataagattgatgtactgactgttgctattgggcgactagaacaccctggtcgtgtacgtgctgctggagccggtatcacgatcaagcaatactttggaccagctccaaggacctcccgcatgtcttcgtctgtggctcttgaagacctggagcagatacagtctcagtttcagtcccagatgcaatcacagggactcgcactacctcctgagccagaggttggtcattcaactgctcatgttagcacaaaggagagttgtgttgattccttagggaacaatccagacatgagtgacttagagacatacgggttatacatcaaagaaaatcctctctgcctggttaccctaggaaaactttatgaggagtcgacaactgttcacaacatccctttgcgccatgatcaagtcaaggttggtgttgaggaagttagagatgcagatgcttccattcctgtacccaatgaagaggttcagttagtgagggagttgtgggaccaacaaaacctgcagataggccggatcatgatgttaatgatcccctatatttga

SEQ ID NO: 70236 - DNA, 243 bp, Glycine max
  Peptide Sequence Number=SeqID_161921
atgaccctttcatcatggcagaataagctaaacaggcaaatgactacaccacacaggtctcctcctcctcctcctcctcctcctattgatgcagcatcacattcccctcctaccttgaagcgaacaagaaaagccacacgcctgagatcattgactactagaccagttggggtagagagacccctagtccatgtggatcctacaaccgggaaatgttggatcaactggcctcggaataattaa

SEQ ID NO: 70237 - DNA, 219 bp, Glycine max
  Peptide Sequence Number=SeqID_161922
atggctcaacctccaccttgtgagaggactcttagggagatggctacacttgatttcacttatgaaagcttgtgcattcaatatcctgatgagggtgttccatatgttctcaagactggactaatccatttgctacccaagtttcatggtcttgcagagggagtggcaaaagattggttgtactaccttgctctcaggtccattttcaactggggatga

SEQ ID NO: 70238 - DNA, 876 bp, Glycine max
  Peptide Sequence Number=SeqID_161923
atggatggttgggatttattatgggaaatgaaaggggcacccaaaaagttgggcggtgctttagtcgaaaacggaatgagaaatgtgcaaccttgcggcggcggtggcgacgacgtcaacatcagatgtgtccccggtcatggcgaacacttttacatgcatgggtacgagaataggaagcgagacctccgtgaagacaaggaactggcaggaatcggttgtggcgtggacgagcttgtagagcaaaatggggacaacacgaatgggtgtacggaggttgacaatggtgacacagacaagtttgtggcaaacaacggtgacgttgtgggacagttcagagagcatgacaacattgatggcggtggttgtcttgctgtcaacttcttctctatgggtggttgtgtggactgcacggtagccatagggagggttgaaatattgagtggggtagtgaagagaaggtttgaaacggtagttggtgtaggtgtttggatggaaggagtggagtcacaatggcttgacggagaagaggtgggagtgtgtgatggaggaggagaaaaaacacaggttggtgatgttggaggtaagagtggtattggaactgtgaggataagcaagggggttgcggaggtggcagtggttcagaaggatagtataaatgtggatgtggatgtggggtgtccatggaccacagttgtggcggtgctgactgtgatggttgtggttgtgttggccactgcagtgaagaggtgggggtctgtgaagggtagtattgtggaggtggagacggagacgtggctgttgtggtggccagaaataacaatgatggtatgcatccatgggaggcggagattgaactatggaagcaccaattga

SEQ ID NO: 70239 - DNA, 204 bp, Glycine max
  Peptide Sequence Number=SeqID_161924
atggccataggaagcggattccaagtgtttgcaaagagtgagacccaaatcatcttggatatatcaactatcactatatttctgatgcaatcctaccccgcaagggcattggatagaaaactccaagtagattgggccaaagatgcaagagaaggccctagggttcttatgagccttagggtagatttcgggcccatgggctaa

SEQ ID NO: 70240 - DNA, 183 bp, Glycine max
  Peptide Sequence Number=SeqID_161925
atgcaaaacgttctagacaagttagatggtctccataccttcgtcggtagcgttttgactccttggacagccgcattgatgccattgatgcacgggggagattgtggaagcaaagcttccaagcttattttgatgatgcaaaagactcaagtcaagaatcaagattcaagcaagtttcaataa

SEQ ID NO: 70241 - DNA, 294 bp, Glycine max
  Peptide Sequence Number=SeqID_161926
atgttgcggaactttatggattgcgcaacaatgcttcctttcgacttccggcatgtcgcggaacttcatggattgcctaacgatgggtatcaagtacctcgaagtggtcaagcaaaggtcgcatcccaccaaacagatggtccccagacgaaattaggtgattttggcaaaatgttcgttattcctagtgtccagccattccatgcaatagcatatccacttgacccgatgcttgctttggaaattagctgtaaatatgctgcacactgctcggtagtttatataatcatataa

SEQ ID NO: 70242 - DNA, 284 bp, Glycine max
  Peptide Sequence Number=SeqID_161927
tgggctaagcgcgcatccactgctaagcggagcttcagtgcacttagcgcaatagaagaatctagcatatcatcaatatcaaggctgcatgctaagcacgagatcaatgcactaagcacaacagttgtcttcagccaggctcagcgcacaactgaattagggtaccaccttgtacagaacttttacagcagagttttacaacattccagagcacaccgtagtgcctattttgggaaaagagctctagaggaagcaagaggagcaacttttgcaaagatacctag

SEQ ID NO: 70243 - DNA, 228 bp, Glycine max
  Peptide Sequence Number=SeqID_161928
atgacgaaggatgcgatccatgatcacaactctgcagcacccgggctccactttgtgcttccttcttccttctgtggtgttcctcacattttccttgacatgactatttatagaaaagagccaagaggtgcagacaaattttctcgggcaaatttgttgcttaacgctgaaggcacaaactcgtacaggcaagctgttgtgacatcctttaccccaacatacatataa

SEQ ID NO: 70244 - DNA, 306 bp, Glycine max
  Peptide Sequence Number=SeqID_161929
atgggtgccaagtacctcgaagtggtcaaacaagggtcgcatcccaataatggatggtccccggacgaaattaggtcgcatcctgatactgttgaattcgttcctcctggtttacacaaggcacaaaatgaccataatttgtctctgcttggctttggacgcgatcgaccctgggcggcaagtcgcagaatgaccataatttgtctctgcgtgccatcggacacgatcgcctctggatggcgaaaaggtgtacggaatgaccataatttgtctctgcccacctctcgacttactgtccctgaatga

SEQ ID NO: 70245 - DNA, 203 bp, Glycine max
  Peptide Sequence Number=SeqID_161930
gggcaaacgtgcccgttgacgcaaggagagcaacatcgtcttctgcacgttttgtcgtcctgacccttgaatcaggtgacatgcggggtaaccttatggttatccgcacctttcgtcaaccaggggcaaacgagcccattgacgggcggagactaacatcgtcttctgcaccttttgtcgttctaatccgtgaagtcaagtga

SEQ ID NO: 70246 - DNA, 205 bp, Glycine max
  Peptide Sequence Number=SeqID_161931
gtcgactctagaggatccccttgagccccatggacgtaaggatgtctcaccgctgactataggacgtccagagaaccctagacgtgtctgtgctgctgaagctggtgtcaccatcaagcaatacttcggatcggctccacggatgtcccgcagctcttcttcgctgcctcctgaagaattgcagcagctgacccatcaaatctag

SEQ ID NO: 70247 - DNA, 174 bp, Glycine max
  Peptide Sequence Number=SeqID_161932
atgctccaaccatatgggatcagcataggcttaaaggagtactcaaacccgatgacccccaaggcctacactccgaagagtccgtcagggcctctccctcctgattcagcttacacttttcctccgactgctccggtagagtaccaaacgtcagagaaacggagaagggattaa

SEQ ID NO: 70248 - DNA, 300 bp, Glycine max
  Peptide Sequence Number=SeqID_161933
atggttaaagaattctatgccaaccggtacagatcagaagaccaagttcccaagtgtgccaaagtaagaggttatatgatcaagatagatgcagacaacgtgaatgaatttcttcagaccccagtgttgttagaggaaggggaatcgttacccacttactctagattttgcagattgaggtctgatcccagagagatggaggttatcctgtgcattcgtggcaatggctttgttcagaacgttgaggaccaaccatggaagctcctcaggaaggatctcactacctgtgcccagacatga

SEQ ID NO: 70249 - DNA, 264 bp, Glycine max
  Peptide Sequence Number=SeqID_161934
atgttaagaatcgaatataagaaaactcaagataggtactacttcctgtacgtcacagatgaactacgaactagtactacagaacctgattcattcaatcttgagtacaaggatggaagcacagttcagatccacaatgtctggacataccttgaagcaacacaaaatgccttgttcgaattgaatctgctcatgcagcattcagaggaagtactcaatgcggtaaaggtactcagggcttgcggggtgaaagatgaagattaa

SEQ ID NO: 70250 - DNA, 295 bp, Glycine max
  Peptide Sequence Number=SeqID_161935
atggtagatacgttgcctactatctactacgagaagctgataggatatatgccggctaactttgcagacctcgtcttcgccggagaaagaatcgagtccggactaagaaaaggcaagtttgaatatgcctccaacgttgcccccaacaacaatagaagagccccagtggcgggcacatggaaaaaggaaggagatacccacgttgtcaccactgccccaacatggatgaaaacgccccaaaatgcccaaaactcataccaacacacccacccgaacttttcgatccgagccggaa

SEQ ID NO: 70251 - DNA, 261 bp, Glycine max
  Peptide Sequence Number=SeqID_161936
atggatggcgaggaattgccttcgcccgtgaactctgatggacggatgcaagtggggctagggtcacgaccgactgatcattgccccttcccagcgctaaacaagcggagaacgtcgctgcaaggcagcccagatttgaatgaaaaggccttaggcctaggttgtattctgaagcaatggggcatgccacattgctcccattatcttgcaatttatgtccaaacatgtgcccaccaagtgctcggtgaaatgcctcaatga

SEQ ID NO: 70252 - DNA, 84 bp, Glycine max
  Peptide Sequence Number=SeqID_161937
atgaagaaacaacaatggaggagaagccatggagttgaagcagaagataaaggagaaaaggtgagaggaggcgccatccactag

SEQ ID NO: 70253 - DNA, 198 bp, Glycine max
  Peptide Sequence Number=SeqID_161938
atgcttttgtttggaccaaagtattttggcatctggttatgtgactcagatctagataatcctactggaattgattgggttcttaccgagaaatatctttttgccgattcatactcgaatcttgaggcttctattctagataagaaagagtttctcctattgaaggtctggggactgacggtgtggccttgtccatga

SEQ ID NO: 70254 - DNA, 642 bp, Glycine max
  Peptide Sequence Number=SeqID_161939
atgatacgcggagataccttacggttatccgcatgcacccttgtatcatccagaggcggcgggcccgatgatacgcggagataccttacggttatccacacccttttgtcatccagaggcggcgggcccgatgacaagcacagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 70255 - DNA, 87 bp, Glycine max
  Peptide Sequence Number=SeqID_161940
atgcagagttcatcgagaccacctggttgtgcacgtaattgcccctcacaggtgatcagcctggggtccaaaggagttccctaccag

SEQ ID NO: 70256 - DNA, 850 bp, Glycine max
  Peptide Sequence Number=SeqID_161941
atgaaagcggcaaccgctgtaatcgaccgccgcgctctgcgacataatctgcaacaggtgcgccgccaggcgccgcaaagccgcctgattgccgtcgtgaaagcaaacgcttatggacatggcctgctggaaacagcccacaccttgcaagacgccgactgctacggcgtggcgcgcatcggcgaggcgctgatgctgcgctccggcggcatcgtcaaaccgatcctgctgctggaaggcttcttctgtgccgaagatctgccggtgctggtggcgaacaacatcgaaaccgcggtacacagcatcgaacagctcgaagccctggagcaggccgagctggcgcgcccggtgccggtgtggatgaagctcgataccggcatgcatcggctgggggtgcgccccgaacaggcggaagcgttttatcagcgcctgtgcgcctgccgcaacgtggcgcagccggtcaatatcatgagccacttcagccgcgccgatgagccggagtccgacgccaccctgaaacagatcgcctgcttcgagcagttcgcgcgcggcaaaccgggccagcgctcggtcgccgcgtccggcggcacgctgctgtggccggatgcccacaatgagtgggtgcgtcccggcatcattttgtacggcgtgtcgccgctggataacggcagcggcgccgagcatgggctgcagccggcgatgacgctgaagtccagcctgatcgcggtgcgcgagcacaaggccggcgaagcggtcggctatggcggcacctgggtaagcccgcgcgatacccggctcggggtggtggcgatggggtacggcgacggctacccgcgcagcgcgccgaccg

SEQ ID NO: 70257 - DNA, 1029 bp, Glycine max
  Peptide Sequence Number=SeqID_161942
atgaaccccagctttgccgacaaaacctaccagcgcgagctggcggatcgcggcgtgttcctcgaatacgacatgatcggcatgagctactactacgccgatgaatcggcgcagtcgccgtccgatgaggagaacgcgcgcgccatttgcgcactgatcgacgacggttatctgcagcagattttgctgtcgcaggacgtgttcctgaaaaccatgctgacgcgctacggcggtcacggctatggctacatcctcaaacattttgtgccgcgcctgaaacgtcatggcgtcagcggcgaacaactcgaaaccctcatgatcactaatccgcaacgggctttgatcagtttgctaccgccacctggcacagcggtgcggcggattttctctgctgcgctgcaggatagcacctatgccgtcacgcatatgccggctcacgccgccgccactgattttccgcagacgctggaggatttgcagcgctgggacgtgattattctgtccgatatcggtgccaataccctgctgctgcatccggacacctggctgaaaagccggcgtacgcccaatcgcctggcgctgattcacgactatgttgccgcgggtggcgcattgatgatggtaggcggctattacagttttcaggggattaacggcggcgcacgctatcgcaatacgctggtggagaaagtgctgccggtgcgctgtctggcctgggatgatcgcatcgaaacgccagaaggcagttatgctgaggtgacaacgtcacacaaagtggttaccgatcttcccggcgactggccgtggctgctcggttacaacgaagtagagatgcagccggaaggcacgctgctggccaccgtggcgggcaccggtcatccgctgctggcggtgcgcgaatatcagcaaggccgctcgctggtgtggaccagtgacatgtcagccccactggctgccggaagagttcagccgctggccgggctatcgccagctgtggatcaactgtctcgactggctgacggagcgtga

SEQ ID NO: 70258 - DNA, 342 bp, Glycine max
  Peptide Sequence Number=SeqID_161943
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttgagaggactacacgtcctcgccttgagagggctacacgccctcaccttggttaccctcaccgttgagaggactacacgtcctcgccttgagaggactacacgtcctcaccatcagagggctgcatgccctcaccttcagaggactacttgtcctcgccttgagagggctacacgccctcaccttgggtactag

SEQ ID NO: 70259 - DNA, 162 bp, Glycine max
  Peptide Sequence Number=SeqID_161944
atgcttcattccatgctccagagcttacgtagggggcaggccattatcatgcagagccttcagggcttgggcctgccatccatcatgagcatggatgagtttgacgctcaggtgtacacatggctcaggagtgtagaagcaaagcttccaagattattttga

SEQ ID NO: 70260 - DNA, 426 bp, Glycine max
  Peptide Sequence Number=SeqID_161945
atgctggccataagacaactaggctaccctgtgagaggggcgccatcggaagagattatcatgcctttcatcgcacggggtttcagtgaaggcaatgcaaaaatgcttcagagagtccaaaatgtatggaatgtcgtggaaagaaaagataaggagcatagaggaagcagcaacggtgttatcggcggctatcataaatggttaaaggttcagacgcaagggatagcttggctctcgaagctaaagatttcaagtggggaagaagctgaagtccctgaggagagagaggaagtgcaagccttgaaagcggaactggaaaggacgagagtagtcaaagaaaaattcaagatggcagccagcaggatcaggaatgagtatgacgacttgagggatatcaacatggccacgaccgaagctttagagtga

SEQ ID NO: 70261 - DNA, 771 bp, Glycine max
  Peptide Sequence Number=SeqID_161946
aggtgtaatttccataaacgcctcaccaatttggttgatgagagcatagatttggctttcgtgaaggaattctatgcaaacctatacaactctgatggtctttcactaaagcaagctagggtcagaggccacctagtgaaggtgttggcagagggtgagactttacccacatactccagatactgcaagctgcccacagattacagagagattgaggctgtcttatgcataccaagccgagggttcattttgaacgctgagggccatcttgggaggattctcaggaaagatttgactactttagcccaggtgtggagtgttctctcatactccaacctggcccccacatcacatacctctgatctgacaatggatagagctatgctgatctttggcctagtctctcgcatggacatgaacatagaagctcttatttctggtcagatgacttctatagcccagtctagcacttctagagttgggtttcctgctctgatcaccgccctatgtagagctagaggggttgtctctaacagccttacttttgagcgcctgagcccgatcattaacttggcctacatcaggaagagctgttggaatcctaaggatctaacagtttctatccgaggggctaggagggtgagggtgaggccaaccgagctcccttccacatttgcagctcctactccaacatccacttcagcagccccttcagtcccaactcaaagtgattctcagcgctttgaagccatgcttcagagcattcattag

SEQ ID NO: 70262 - DNA, 810 bp, Glycine max
  Peptide Sequence Number=SeqID_161947
cctcacatatgtagggctacacgcccttaccttcagaggactccatgtcctcgcctttagagggtcatgtagcttcacctttagaggactacacgtcctcgcctccaaaggactacatgtcctcgcctttagaggactacacgtcctcgccattagaggactccatgtcctcaccttcagaggactgcgcgtcctcaccttcagaggactgcgcgtcctcaccttcagaggactgcgcgtcctcaccttcagaggactgcgcgtcctcaccttcagaggactgcacgtcctcacctttagaggactgcacgtcctcaccttcagagggctacacaccctcatcttcagaggactatacgtcttccccttgaaaggactactcgtcctcgccttcagaggttcttgggccacccctgatattggaggagggccaactgtgcgagcacaaccagagagggaggctatcacgcaactactatgcatactagggcaagatttcacccctgccggtgcaaagaggcaagtgcgggtcgcgtccacaagacatccaatggacccggagaagtccaacagggccctggggtttccagctctgattacgggcctctatcagtcctactgggtgcccgtaccccccggcaaggatcgcgcccgcaagacacccagtggacccggagaagtccaacagggtcttaggattttcagctctgattacgggcctctgtcagttctacagagtgctcatcgcccccaacaaggtcctcaggcccctattaacggggctttcatcgagaagtactgtgcccccag

SEQ ID NO: 70263 - DNA, 240 bp, Glycine max
  Peptide Sequence Number=SeqID_161948
atgtctgaagaagttgatatgaatgaagaaaatgaagacgaaactggggtgaatgaagaacatgttgattgttctgatgcgtttaatacttctgagtgggctcgaccagttgcttatgaaattggatttgttgtggtgattatgaggtcaaacacaaacactggtatgagaggaaggacttcatttgtgataattggttgtgaaaggagtggtcagtataggtctgggaagaaagatttt

SEQ ID NO: 70264 - DNA, 318 bp, Glycine max
  Peptide Sequence Number=SeqID_161949
atggcggaggtctccacggaggccattgcatcccttgttcaatattatgaccagcctttgaggtgcttcaccttgggggacttccagttaacacccacgaatttccaaaatagtcagaatcttgatacaggaattggaccagggaaagcaagtcgaaaatggggtggttggagtaccaatgaaatgtttggaagcaaaggcgagagtcttggcaagtcaagacgaatgggccccgttcatggacatcctagcactcttgatctttgggttggtcctctttccaaatgtggatgggttggtggaccgggcagcgattga

SEQ ID NO: 70265 - DNA, 108 bp, Glycine max
  Peptide Sequence Number=SeqID_161950
atggaggcacccacgggtttgagtaaaaaggggccctatacccgggatcatggaaatttaaggagtggaggtggatctatggtcatgctaggtctccgacttgcttga

SEQ ID NO: 70266 - DNA, 174 bp, Glycine max
  Peptide Sequence Number=SeqID_161951
atggttcctgtcgcaacctacccttttgcgggtgagcgaggcaaggctcacaggtcgacaaaagcagggctcttgctcctacgtaccctctatcgaagaggaaatcagacctacgtagttctttcaaaagggcaaatcaagcgattctttttacttggaaggtggtccttttaa

SEQ ID NO: 70267 - DNA, 273 bp, Glycine max
  Peptide Sequence Number=SeqID_161952
atggacattctcaccctgggtcaaggtttatgtcaacccagtgtttccaaaacatgttcttttatcaattcacgcattcatccgagtccattttgggcgttcgggaaaattttcacagcattcacccttcaggtcgtgcggatgagggcacacacggcctacctacgtcaaatcacaaagcaaacggagaagaatgcaatggctcctcccctgcctaggcatcgggccagtctccaggccatgcaacctcagccccaaactgctctggggtag

SEQ ID NO: 70268 - DNA, 297 bp, Glycine max
  Peptide Sequence Number=SeqID_161953
atggagacatttttggggcacaccggtccaatcagtcggtgttgcttctctgcatctggaaacaatattgccagtgcttctctggatggaactgtcatgatatggacatatgatacatcaactccagtgtctagaaatgcaaccatatattgcagcactgaaattttgtcacttgactgggaatgtaaatcagaccgcttggtacatccgatgggtgcattaaggcatggaatgtggatgcaaagagagttgtctgtgacctcaacacaaccgaagcatttccaaggtatttcctaa

SEQ ID NO: 70269 - DNA, 244 bp, Glycine max
  Peptide Sequence Number=SeqID_161954
gagaaaagagggaggtggttgccgcccagctcgcccaggcgaacttggttgcttccaccagaaggcaccaccttctgttggaaccccctggaaggcccaaattgcgcaacagtgtttcttttcgacttctggaatgtcacgaaactttacagattacctaacgattggtgttaagtacctcgaggcggtcaagcgaaagttgtatgccaccaaaaaatggtccccagacgaaattagcgtatga

SEQ ID NO: 70270 - DNA, 575 bp, Glycine max
  Peptide Sequence Number=SeqID_161955
ggtggaccctcaaaggattgcacatcctcgccatcagagggctgcaagccctcaccttcaaaggactacacatcctcaccttcagagggatatacgtcctcaccttcaaaggactacacttcctcaccttcagaggactacacgtcctcgccttcaaagggctacaagtcctcgccattagagagctacaggtcctcgtcttcagaggactacacgtcctcgccatcagaggcctacacgtcctcgccttcagaggactacatgtccttactttcagaggactacacgtcctcacctttagagggttacacatcctcactttcagaggactacacgtcctcgccttcagaggactacacgtcctcgccatcagaaggctgcacgccctcacctctaaaggactgcacctcctcaccttcagaggactgcacgtccttacctttagatggctgcacgccctcgccttcagagggctacacgcccttgcctatagaggactacacgtcctcgcattcatagggctatatgccctcactttcggaggactacatgtcctcgccttcatagggctatag

SEQ ID NO: 70271 - DNA, 441 bp, Glycine max
  Peptide Sequence Number=SeqID_161956
atgttcttactgttagagagtggaccacacacaagacacttgttatctattcacggattcctcgaaaaatcggtgaatatttcaaagtttgaaacatctgagataaagtttttgaagactgactatcaagagtatctccagctaaaagctgccaaggaatctcaaacatcatctgctataagtggtcataactccactgcctgcatttctcaatctgatgcttttgatcacattgctggtaatagttctttattttcacccctttctcctcctaaaattccttattttattactttagctgatggttctagagttgtagcaacaggaatcggccatgaatgtggtacgggttggacgattggcgtaggaattgaatctcatggtctttactacctcaagcctaatctttcttggggttttcttaatgaaagaacgatctga

SEQ ID NO: 70272 - DNA, 213 bp, Glycine max
  Peptide Sequence Number=SeqID_161957
atgccaactgatccacattctccagtggcagatccatcttctcccaaacttgaagtaactcccccatcttcacctattattatcatctctgaagattctacagagtcagcatctagagaagttgttgctctctctgatactctagttttccatctgatagatgaggaggatgctcagacacaggatacccaagacctgtctcaaggattttaa

SEQ ID NO: 70273 - DNA, 462 bp, Glycine max
  Peptide Sequence Number=SeqID_161958
atgcagcacttacatgcatgggaaactgctcttttggataacctgtatagagagatgtgcatcgcaaataatattaaatcaataggcagtttcactctcttgattcaattatgggcatgggaacaatgtccaacgttagcccccgtcgtttattcctccacaacaataaaacgcgccacttgcctaaagatggttgggagtgaaatcgccgaaacactgcattttatgatgtcgcctgttgggagaagggtttgtacttttgacgatttattgtcatgtattgagaagatcactcttttgtctgacgaagaggataagatacttgaggcacatgaagatgctgccccttctcagccacaatttgaacatcaacagtttaatatactacagcgaagtgtggagactcgaggtacagcgaagtgtggagactcgaggtttagcgcgacgtcgggaaactgttga

SEQ ID NO: 70274 - DNA, 831 bp, Glycine max
  Peptide Sequence Number=SeqID_161959
atgggccttgaagtagatctggtagccgacttgggcctgcgcctcttgccagaggcggcggatggtgcgggattcgccgtgggaggagccacagtggtggaggaagtcgaactgttccaggagaagggttttaaggccgcgtttggtggcgtggtaggcggtggagctgcccatgacgccagctccgatgataatcacggttatggttttctcaaactgcaagaacatgggcttcaacattcaacctatgggattcattctatgatcaaggaaggccataaacacctctttgtccttgatgaagcggttctcaagaacattgacgcctgtaaactatcactcgaacttcctccacaagccgtctctatcctattgcttggtgacactgctattgttgtacatcctaatgatgacagatacacccattttcatggaaaatatgctattcatccatttaatggtagaaaacttcctataatttgtgacgctattcttgttgatccaaagtttgggacatgtgctgttaagattacacctgcccatgatccaaatgattttgaagtgggaaaacgtcacaaccttgaattcattaatgttttcacggatgatggaaaaataaattctaatggtggctctgattttttgggcatgtcgtggtttaaagctcaagaggcaatagcatatgcattacaaaagaagggtcataagaaggactttccaaatggtattgatgaatgtggtgttgatgctctacgttttgcactggtttcatacacagctcagtctgacaaaactaacctagatattcaaagggtggttgggtatcgctaa

SEQ ID NO: 70275 - DNA, 312 bp, Glycine max
  Peptide Sequence Number=SeqID_161960
atgacagtgatattgactgctgccggagttctcattgctgcccttggagattttttctcatggcctttgtttccgttttttttccagaccatgtaccttgtgctggtggaaaaatctggtgctgaggacggactttcatccctggaaatcatgttctataacagctttttatctcttccattttttatgtttctcatcatagccactggggaactcccaaattctttatctgtattatttgcaaagaaattcaaggaaaaagagagggggaggggaggggctgtgaggctgaatcacttgatcttatggtag

SEQ ID NO: 70276 - DNA, 1347 bp, Glycine max
  Peptide Sequence Number=SeqID_161961
atgaacccctccacagaatcagacaacgccattatcatcgacatcgattcctctgtcaaaaccccatcatttgtcgaaaaccaccccaacgaagaaaaacaccaactcaatgttcccttcctcctccaaccatcttatgcgacacacgaactgcgaaaccttcgcacgagcctcaaatggtgtgctctcgaccactcttccctcgttggaaaacttatttcctacgttgtcttcatattcctcaccgttgctgtccctctcttcacttctctcttcgttcatgtccctgcctctgcttctcaactctaccctttcaacttcaagaagctccttcaattaccgcaatcagccctcgctattatcgccttcttcactctctaccgtttcttcccaaggtaccaaacaaaagtcacatcatgcatgggcttaggtagcttctgttcctacttcctagatgtgttacaagatgactcaacgtatgttcgacgtgggtacacgcgtgagcttcagaaagcgttcagatacttagcgtgcatgatattaccttcctttttcgtagaacttgttcacaaaaccatcttcttttctagcatggaaatttctgtcccatgtgggacccccctgaactgggctgtgtttgttttagtcttggtttcctgggtttacagaacggggttgttcttgttggcgtgtgtgcttttcaggcttaactgcgagcttcagatactgaggtttgaagggcttcacaagctctttgaaaggtgtgggtctgatgcaaacatgacatttagagagcacgtgagaattaggaggcaattgtggatcacgagtcatgggtacaggttctttataattagttgtttggtgacagtcacggttagccagttgggttctctcttgatggttttggaatccaaatctgacaccaccttcttcaattccgatttttttcggctgtgcaattatgtggattcttctttatgccttatgggtgcggcaagaatcacacacagagcacaagggatagtgtcaattgccacaaagtggcacatggtggtgaccaatgcatctgttgaatctgaacaatggaaaacccaaatgccagagggggtacccagtcctgctgccagtagggattcggattcttcggacatatgcatatcagtaaccccacaacgaccttcttctttccaaaccaggcaagctttagtgacgtatttgcagcacaactatggagggacaacactatttgggtttgtgcttgatcgagggttgcttcatactctctttgcctttgagttctctatggtgctttggattctaagtatggtggctgtctggtcttaa

SEQ ID NO: 70277 - DNA, 330 bp, Glycine max
  Peptide Sequence Number=SeqID_161962
atgtctggagtttgggtattcaagaaagatgggtttcgtttaatggaaaagcgcaaagcggaggggatagcatgcagtagtttaaagaagaaggtgttggttcacttggcaagtggtgaagtggtgtcttcctacagttcgctggagcaaatattgagtaatttagggtgggagaggtattatggaagagaccctcaattgtaccaattccacaagcgttcttccactgacctaatttcccttccaaagaacttctccaagttcacctctgtctatatgtacgacatagtcatcaagaaccccaatgtcttccacgtgcgggatatgtga

SEQ ID NO: 70278 - DNA, 774 bp, Glycine max
  Peptide Sequence Number=SeqID_161963
atgacttcattttcagcttgtggactaatagaccctcattgttctcaaaacctcactcccatgcattccaccatcactgctaccattgattctcagtcaacgatttgcgccaccagtaatgttgggagcccaatctcggcaaataaaccagagggcagagagaatcgtaccaaaggagccacgagtggttcctctgagccgtctgatgaggatgatgaagcaggtgcttgtgaacagagcacaaatccagctgatatgaagcgccttagaaggaaggtttctaatcgcgactctgctagaaggtcaagaagaagaaagcaagcgcaattgtctgagcttgagttgcaggttgaaaaactcaaagtggaaaatgcaaccctatacaagcagttcacggatgctagtcaacattttcgtgaggctgatacgaataatcgagtgctaaaatcagatgtagaagctttgagagccaaggtgaagttagcggaggatatggtcactaggagctcttttactacgttaaactatcagcttcttcagacacaacaacatcaaatgagcacacccccgcaactgaacacgactaatcttcgccgcatggcgcatgtttcgccaaccatcaccgtccatggtaatgatgcctcatacaatggtgtaacagttggtgaacagaattcatcagcacttggaaacttggatatgactttcaacaacatcaacaatggagtcatgaacaatgctatgagttgtgggactatttggccacttgattag

SEQ ID NO: 70279 - DNA, 459 bp, Glycine max
  Peptide Sequence Number=SeqID_161964
atgcagaaagcaagagtggctcctaattgggtaacatttgttggtgttttgtcagcttgtgctcatgaagggttatggaatgaggggattcatcgcaatcttgagattgctgttgttgccatggaacaacttttagagcttgagcctgaagaatttggaaactatgttttgcttgctaacatatatgcggaacttggtaagtgggaaggtgtatcagatgttaggaaactaacaagaagcaagaggataaagaaaacccctgggtgtagcttgattgaggttaacaatttggttcaagaatttgtatcggccatagttgtttttggttggggaaatttgacaccagctatcaggttcttacactatgcggcaggaaggacatgcggcgggcatgcatggactttctcgagcagtattggttctgctttcagattcttaggttatctcgggttggtgtaa

SEQ ID NO: 70280 - DNA, 573 bp, Glycine max
  Peptide Sequence Number=SeqID_161965
atgagatcaattctgcataggtttgctgaggaagatacatcatacatgtcacaaaggactgaagatgtgcgagctcatcctactcatttcttgcatatgtttggatttggaacgcgcaacgggctctgccagtgcccggtgacgaagaattcgaaagaaagcacgtttcgcctccgaaaagggacgacgatcgagagggccattatgtcttcaatcttggcgaaaatctcactcctagatataaaatcctcagcaagatgggtgaagcatattgctagtgctgtaggcacatttggtcgggttttggaatgttgggaccgccaaaccagagaatatgtggctatcaaggtagttagaagcatacggaaataccgggatgcagcgatgcttgagattgatgtgcttcaacaactagccaagaataatagaggaagctcccgatgtgtgcagatcagaaattggtttgattaccgaagccacgtatgcattattcaagtttattttgagaaaattggtactgagttggagatactttattacttctttggaggtggggagtgggggaggggttaa

SEQ ID NO: 70281 - DNA, 690 bp, Glycine max
  Peptide Sequence Number=SeqID_161966
atggagtatcccttcctaccaacttttaccttactcaacctttcgctggtgacaacccatgctgccttacctcctgttcctgtagttggaagaccgtgcttcctactactccaatgccaaaagccatcactggtatcatttaccccaattgagccttcaatttattttcaatgttttattgataaatatagtcaaaagcttgttggtcttgtgaaacctggtttagacaagaaagaagttagcggaaacttcatggaaaataatgaagcggtggctcttttgggccaaaaaaaaagtcaacctttgattgaaaaatcagatggcaaatgttttggcacattagttagagaaaatgctgattctaagtcgttgttgggaaacaaccctacttgtagcactagtgtaaaggaaacaagtaaacctgccaatgctttgcatactatttccaacaagaagactgtgcctcacgctaaagttgaagaaagtaggggtcgtaaggattctttggttaaacaaaaatcatttgctaaactatcacatggttcgacagctggtttggaaatgtgggaaataactaaattggatgatgggagtggaaatggatctattgagaagaacattttgatgtctagggttgatttaaaaaggggtgatcgcgatgatgttggtgtccttgcttggacaaagtaa

SEQ ID NO: 70282 - DNA, 243 bp, Glycine max
  Peptide Sequence Number=SeqID_161967
atgatttattcaatgtggttgcgacaaaattttcaagaacttcctattgatgttgatgatgttgtgattgcacaacatgctagagctcatatcatgatgctcataggcagatgtttgatgcctgagacatcgggagcaagagatgaggaggaagatgatgataacaacaataacaacaacaataatgataatggtgatgatgataatcatggcgatgctcatggtggtgatagtgttcattaa

SEQ ID NO: 70283 - DNA, 375 bp, Glycine max
  Peptide Sequence Number=SeqID_161968
atgattgagatttattattgtgacatccttggccagagtggctttgattgggatgacactaagcacataatcacaattgagaatgaagatgcttgtcgcataaatcggctaaactatttcgtttcaagggtgcctcaaaactgggatgatatagtgaatttgtgtgctaaagatagagccactagtcatggagcaattgttatggatgttgataatgaagcaatgagtagagaaacaaatgaaggggaattcatgggtttaggtgctactactagtatagacttggaagaaccaaactctaatacagaaggaaaaagacaaggttcaacttattttgacacacattctcacaaaaagattggaaaaaagaagtaa

SEQ ID NO: 70284 - DNA, 978 bp, Glycine max
  Peptide Sequence Number=SeqID_161969
aacgagttccagcgcgacaagccctgggccaacgacccccactacttcaagcgcgtgaagatctccgcactcgcgctcctcaagatggtcgtccacgcgcgctccggcggcaccatcgaggtcatgggcctcatgcagggcaagaccgacgccgacgccatcatcgtcatggacgccttcgccctccccgtcgaaggcactgagactcgcgtcaatgcccaggccgatgcgtacgagtacatggtcgattattcacagacaaacaaacaggcagggcggttggagaatgtagtgggatggtatcactctcaccctggttatggttgctggctgtcggggatcgatgtttcgacgcagatgctgaatcagcagtttcaggagccgtttctggcggttgtgattgacccgacgaggaccgtttcggcggggaaagttgagattggggctttcaggacttaccctgaagggtataagcctccggatgagcctgtttctgagtaccagaccattcctcttaataagattgaggactttggtgttcactgtaaacagtattatgcattggacatcacttactttaagtcgtctcttgattcacacctcttggacctgctgtggaacaagtattgggtgaatacactgtcgtcttctcctctgttgggtaatggagattatgttgctggacaaatctctgatttagtatgggtatctcagttggagaattcctttattgcagctgagaagctagaacaagcagagaatcagttggcacactcacgctttgggccactaatagcacccacacctagaaagaaagaggaggaatctccacttgctaagattactcgtgacagtgcaaaaataactgtggagcaagtgcatggtctaatgtcacaggacattctgtttaactccgtccatcaagcaaacagaactcgcacagaagcatctggtcccgaaccaatgattgaaagctga

SEQ ID NO: 70285 - DNA, 1056 bp, Glycine max
  Peptide Sequence Number=SeqID_161970
atggcgggctgtgggagacgaaaaggagcaggaggagcttattcctggcttaccctacgaaattgcagagctgtgtcttcttcacgttccgtacccttaccaagctttgtcgcgctctgttcgtcgacgtggaacagagcaataacgcacccttcttttattttctccaagaagaccctctcccgtcctcacctcttcgttctcgcgtttcattcacaaactgggaaaatccagtggcaggcgctcgacccttcctcggggcgctggttcgttttaccgcagatgcccttgcaggaaaactcctgccccacggagttcgcgtgcgcggcgctgccgcaccaggggaagctcttcgtcatggccggcggcggcggcggttcagacaccctcgtctaccgcgccgccacgaaccagtgggctctggcggcgcccatgccgggagggaggaagaggggcttcttcgcggcggagggagtggagggaaagatcgtagcagtcgggagaagcggcacggacatctacgatccggagagcgacacgtggcgggaggggaagaagcaggggggggagctgaagaggtacgaggttgtggcggcgggagggaaggtgtacgtgagcgaggggtggtggtggccgttcatgtaccgtccacgggggtgggtgtacgaaacggagaaggacacgtggcgggagatgggggttggaatgagggacggttggagcggggtgagtgtggcggtggggggaagggttttcgtgatagcggaatacggggacgcgccggttagggtgtacgacgaggagcaggacacgtggcgctacgtgaaaggagggagctttccgagggacgttataaagagaccgtttttggcgacgggtttggacaacagaatctacgtggcatcgtacaatttaaacgttgcaattggaaagatgaagagtgatagaatccaagggaaaggtgattttgaggttagtgtgacgtgggaggttgtggaggcgccgtctgctttccgcgaattctcaccttgtacttgtcaagtgctctatgcttga

SEQ ID NO: 70286 - DNA, 375 bp, Glycine max
  Peptide Sequence Number=SeqID_161971
atggcacttgacaggctgttgggttatgtgcttgcttttaaggtcaggattcaatcaaaatacaagaatgtcgttgttcttagatactcaaatgaactagatttgatcaatgctatgctcgagatgctggctgatagtgaggcatgttccaaaatagatgcttcgaacgttgattgcaataatgctacccatgctgaatgtcaatctctgtctgtgacagccgatcatgatccagttgcaggattccctttaacgcccaaaaagcggataccatctgatgaagttgatgatgagctaggaagctcacaaatttccacagcccaactatcgtctaacaaattaacaaggcattctgataaaagtgaatttagctga

SEQ ID NO: 70287 - DNA, 165 bp, Glycine max
  Peptide Sequence Number=SeqID_161972
atgccttctataaatgagtctcccgacgttgatgaggtacaagcaactcgtaatgatcgcgatgaaggactatgggagaacattgtgacggtcatgggaacaccaccaccgtcacccccgcagtcagatgttcggtcagagggtatgtactcggatacgagataa

SEQ ID NO: 70288 - DNA, 879 bp, Glycine max
  Peptide Sequence Number=SeqID_161973
atgtcttctcgtaaagagcttgccaacgccatccgcgcactcagcatggacgccgtacaaaaagccaattccggccacccgggtgcccctatgggcatggcggacatcgccgaagtcctgtggcgtgactacctcaaccacaacccgactaacccgcactgggctgaccgcgaccgtttcgtgctctccaacggccacggctccatgttgatttacagcctcctgcacctcaccggctacgacctgccgatgcgcgagctggaaaacttccgtcagctgcattccaaaaccccagggcacccggagtacggctacaccccgggcgttgagaccaccaccggcccgctgggccagggcatcgccaacgccgtcggtttcgccatcgccgaacgcaccctggcggcgcagttcaaccgcccgggccacgacatcgttgaccaccacacctacgccttcatgggcgacggctgcatgatggaaggcatctcgcatgaagtctgctctctggccggtaccctcaagctcggcaagctgaccgctttctacgatgacaacggcatctccatcgacggccacgtcgacggctggttcaccgacgacaccgccctgcgcttcgaagcctacggctggcacgtggtgcgcaacgtcgacggccacaacccggacgccatcaaggccgcgattgaagaagcccgcaaggtgaccgacaagccgtcgctgctgatgtgcaagaccgttatcggcttcggttcgccgaacaaggccgggacccatgacgtgcacggcgccgcgctgggcgccgccgaagtggccgccacccgcgaagcgctgggctggacatacgccggctttgaaatcccggcaggacatctacgccca

SEQ ID NO: 70289 - DNA, 561 bp, Glycine max
  Peptide Sequence Number=SeqID_161974
atgttggaaagttattcaggagtcattaacttgcaattttctgtgcttggccaattgttgttgcagtgtccaccatttcggttaagctaccaggggctgggagagcccttgagctttgcagcatttgggccttttgccacttgtgctttttatttattacatggcagttcaagtcatttccatcaggtggaaggagacagggaggttgggaaaatgtcacctttggttagacttggcactaaaaaaggtgcagaggtagtgaaaggggcaatctttatgctctatgctcttttggttgcttttggtctaatcaaggcacttcctctcacttgtataattttcatggctaagtacttctgtgtgaggcttcatgcattgtttggagttgcactggctttaggactagtgctggctcgaaagagtgtggatgaccctggaagaccccctggcattgttcttagtgctgccacttctttttggcttcctgttcctcctaaacgagtctttgacttcctccgtgatgaaaactctaggaatgaggtatgtgcaacaaaaagctaa

SEQ ID NO: 70290 - DNA, 345 bp, Glycine max
  Peptide Sequence Number=SeqID_161975
atgtttttcctatatgggtatggaggtacaggaaaaacattaatttggaaaacattggcaagttcattaagagcagacaacaaaattgttattatggttgcttttaacggcatagcttctctattgttgcctagaggtagaactacacattccaaattcaagatccctgttccaatttttgaagactcaacatgcaatatgcaccaaggaagtcaactagttgaattactaaatcaaacaagtctaatcacttgggatgaagcacccatgactcacaaattttgttttgaagcacttgataaaagtctaagagatattattaaaggcaaatccagttcaaattag

SEQ ID NO: 70291 - DNA, 135 bp, Glycine max
  Peptide Sequence Number=SeqID_161976
atgggtgtgcaaatagcaatcaagcccacttgggccttccaagatgttccaacagaagctagtgccttctggttttccatcgttcttcatcgttcttcgttcgttcttcgtcgttcttcggtcttcaactggtaa

SEQ ID NO: 70292 - DNA, 654 bp, Glycine max
  Peptide Sequence Number=SeqID_161977
atgattatgaggagccaagacatttatagtagccaatatgaggctactacttcaccttcctctagtgaaagtgaagaagcaaaaggggaagaatctattgaagaaatctacccccaagaagaaggaaaacctttaatgtttaaggaggagtgtaaggaggtaagtgtctcctccaagaggttagctaagaaggaaagacattttgaaataaagacaaatattaaaaaaatttcccttcttagacaacctccacattttctcctttgtaaaaagacacttgttagcattgccacacctcttgggcttgagtttattcctctagtaaaggagttgttggatgagggtttggttcgcaagggcttaaatccttgtgctttgttggtgcccaaaataggtattattaggcaccaaatccctagaataggtggtatgatgaatgttttgagtggtgcaaccctctttagtgaaatcactcgtgcacccaacaacttcatgatttgtcaattggctccaaagaagcttccagctaaaagggtaaggaaggaggccactggagaaggatccagtgcggttccacaaatggatgtggagtttgacaggcatcggtttcgaagcgaggaacaccagggttgttttgaggcaattaagggttag

SEQ ID NO: 70293 - DNA, 484 bp, Glycine max
  Peptide Sequence Number=SeqID_161978
gatccccctctgccagtcgttcggggttcctgtcgtgcccagtaaggtgatccgaccgccgatcacccatgttttcatagagaagtactgcacagctagacaggcacagggtggcgaccctcaggccccagatgcaccgctgccacctcctcaggctgacccgactgggtcatttgacacggagcggtatttacggcatttggttcgccagcaggaggccaaccaccgggtgcacgtgcagacccattactctctatatcagcttagcctcagcctgcagagccagggttttgtttcttttccatgccctactccggatcagttcagggcagaggtcgcatggccaggagattggcctgaggcccaggcaggggaggcacccgcagagacacccgcagaggctctcagcaaggcagataaggcccgcgaggacgaggagatgaccggcttgcttgatttcttgggagggagcggagccacatga

SEQ ID NO: 70294 - DNA, 288 bp, Glycine max
  Peptide Sequence Number=SeqID_161979
atggacgccgcagctgaagggaccagcgccgctccagagtttgacagccatcatttcaggagcgcagagcaccagcagcgtttcgaggccatcagaggatggtcgttccaccgagagagacgcgtccaactcagggacgacgagtacacaaattttcaggaagagatagctcgccggcgtttggcgtcactggtcactcccatggctaagtttgatccggatatagtcctagagttttacgctaattcttggcccacgaaggagggcgtgcgggacatgcggtcatgg

SEQ ID NO: 70295 - DNA, 162 bp, Glycine max
  Peptide Sequence Number=SeqID_161980
atgattgaacatggaaagaacacgctttacagtgcccttatgatgcaatcctaccctgcaagggcattggatagaagactccaagtagattgggccagagatgcaagagaaggcccgaaggttctcatgagccttagggcagatttcgggcccatgggctaa

SEQ ID NO: 70296 - DNA, 204 bp, Glycine max
  Peptide Sequence Number=SeqID_161981
atgccaaaagatagggggacttgtcttaatttcagggattgtcatcatcaaaaagggggagattgtagacaaaggatcaagctgaatgttttgatgatgccaatggatgatcacttgccaatggatgatcacttgtttctcaaagatttattcaagacaaagaaattaaagatattcaagatggatgatcaagacagtttatag

SEQ ID NO: 70297 - DNA, 237 bp, Glycine max
  Peptide Sequence Number=SeqID_161982
atgcggaaaggaccactggaagaaggaggaactaaggccattgacaatacgaaaaaaaagggtacattaagcaaaagtggcaacagaaaggaagaaaaaaaaggaattctgaagcaggcccagcccaacagtggcgctaagcgcgcacaggcgctaagcgagcaactagctgcaggcgctaagcgtggcgttaagcacgaaggagtagaaaccgttacgcgcgctaagcccagctag

SEQ ID NO: 70298 - DNA, 309 bp, Glycine max
  Peptide Sequence Number=SeqID_161983
atgggcgccaagtacctcgaagtggtcaagcgagggtcgcatcccaataaacagatggcgcagaatgaccataatttgtctctgcgtgtcttcggacacgatcgagccagggtagcaaggcgcaaaatgaccataatttgtctctgcgtgctatcggacacgtcgcctctggatgatgaaatggtgtggggagtgaccataatttgtttccgcccacctctcgacttactgtccctgaatgacaaatggcgcagaataaccataatttgtctctccgcgtttatcactcaacttgctgctcctgaatga

SEQ ID NO: 70299 - DNA, 321 bp, Glycine max
  Peptide Sequence Number=SeqID_161984
atgccattgggatatatcaacgctgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 70300 - DNA, 222 bp, Glycine max
  Peptide Sequence Number=SeqID_161985
atggccaaagtactcattgacaatgtctcaagcctgaatgtgatgcccaagagcacgttggagaagttgccgttcaacgccttccatctgaggccaagttccatggtggtccgtgccttcgacggcagcgccgagagctatctgttggggcgtccatggatccactcagtgggagtcgtctcctccacactccaccaaaagttgaagtttgtagtggaatga

SEQ ID NO: 70301 - DNA, 534 bp, Glycine max
  Peptide Sequence Number=SeqID_161986
atgtattcctctatccgtagagtacactgcctgtacagaaatggctataacagagtttctgttattcatattaacagctactctaggaggatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 70302 - DNA, 303 bp, Glycine max
  Peptide Sequence Number=SeqID_161987
atgatgcatgtcgcaacctacccttcggcgggagggcgacgtggggctcacgggcgcgtcttccatgagaggaaaatgcgcggagtcgtcaccaatgtttattcgaggaaaacgtcgaaaaaatcggaaaggtgtagtctacgaactttaagtgtgaaaggttcgggagttatttttacgcacggagaagggggagaaacgttaaggcgttggaccattaacgatctcttggggtggtcgacaaaagtggggcttttgatcctacgtatcctcaattgcgatgaggaaatcagacctacatag

SEQ ID NO: 70303 - DNA, 174 bp, Glycine max
  Peptide Sequence Number=SeqID_161988
atggtgatgatgttggtggtagaggatgggccaggatggaggaatgagaggtataggaagagaagaagtcatagaagatatggaggtaggcaaagagaggaagggattgatggagtaaaggtgaagatccctacttttaaagggactcgtgatccgaaagtgtatctcgagtag

SEQ ID NO: 70304 - DNA, 697 bp, Glycine max
  Peptide Sequence Number=SeqID_161989
aggactacacgtcctcgccttcagaggactacacgtcctcaccttcaaagggcttcatgtcctcgccttcatagggctacatgccctcaccttcagaggactgcacgtcctcacctctagaggactacacgtcctcgccttcagaggactacacgtcctcaccttcaaagggcttcacgtcctcgccttcatagggctacatgccctcaccttaagagggttgcacgcccttgcctttagagggctacacgtcctcacctttagaggactacacgtcctcgccttcataggactatacatcctcacctttagagggctacacatcctcgcctttagaggactacacgtcctccacttcagaggactacatgtcctcgccttcagaggactacacctcttcgccttcaaagggctgcatctcctcgccttcagaggaccaaacatccttatcttcagaggactacacatcctcatcttcagaggactatacgtcctcatcttcagaggactacacgtcctcatcttcagaggactatacgtcctcatcttcagaggactacacgtcctctactttagaggactacacatcctcgccttcagagggcttcatgtcctcaccttcagagggctgcacactccctcgcctttagaggactatgcgtcctcgctttcagagggctccacatctgcaccttaa

SEQ ID NO: 70305 - DNA, 474 bp, Glycine max
  Peptide Sequence Number=SeqID_161990
atggttacaccactcagctcatctcctcctaagccagtggcaccttgttcattgtctgcgtcaagaaagactagaaaagcaacacgactcaaatccttggctactagaccaattggggtggggagactagtgattcatgttgatcttgtcattgggaaagcctatggtccgcacagaaagaaattaagaacatatttggggattgtcgctcgcaacaaggtgaatgttacatatgataattggaaacaagtctctgtcgctcaaaaggatctgatttggggagatattcgggctgaatttgatattcctaaatcatctaatttgaggacaaagaaaaaaatacttcagatcgtaggagagcattggattcagtttaagtcaaatctaacctccaaatgggccccaacaccaaggagggcaaggatgacaaagtttgtgagaagatgttcgaaagaaggcgcatgccattcataa

SEQ ID NO: 70306 - DNA, 195 bp, Glycine max
  Peptide Sequence Number=SeqID_161991
atgtcgcaacgtgcccttcgcgggcgagcgagggcgaggctcacgggtgcgctttccaaaggaggaaagatgcgcggagtcgccaccaacgttgacaaaagcggggctttcgctcctacgtaccctcctttggagaggaaatcagacctacgtagttctttcttaagcgtgaatcaagtgattctttttacttga

SEQ ID NO: 70307 - DNA, 342 bp, Glycine max
  Peptide Sequence Number=SeqID_161992
atggtggcccgggtaatgttggggaatggctacgagcccgtaatgggtttaggcaaggacaacggcggcataactagcctgataagcgccaaaggaaatcgtgggaagtttgggttgggctacaaacccacacaggcagatataaggaaaagcgttgcgggaaggagaagcggaagtcaaggctcacgattaagacaagaagacgaaggaagcccgccctgccatataagtaggagctttataagcgtgggtctaggggacgaaagccaagtcgttgcaatatgcgaagatgatgctccgagtgggtcggatttggtacgaccatgccctcctgatttttga

SEQ ID NO: 70308 - DNA, 480 bp, Glycine max
  Peptide Sequence Number=SeqID_161993
atgaccataatttgtctttgcatgtcatcgggcccgccgcctctggatgacaaaggtaaaaagtgcaggaccaaatggttccctgcatgtcatttggcccgccgcctctggatgacaaaacgtgaaaaagtgcgggaccaaatcgttccccgcatgtcatcgggcctgccgcctctggatgacaaaggaccaaatggttctcgcatgtcatcgggcccaccgcctttggatgacaaaagaggcagaatgaccataatttgtctctgcgtgccatcggacatgactgtgcctgaatggcaaaaggtgagtggaatgaccataatttgtcttcacgtgtcatcgggcccgccgcctctggatgacaaaacacgcagaatgaccataatttgtctctgcatgccatcagacacgactgtgtctgaatggcaaaagaatgaccataatttgtctctgcgtgccatcggacacgactgtgtctga

SEQ ID NO: 70309 - DNA, 222 bp, Glycine max
  Peptide Sequence Number=SeqID_161994
atgttggtgaaggacatgatggagaagattcatctcttctttcaaagattttggacaggtttgatggtcttcaaacctttgttggtgaaaggtgacactttggaattacaagtggacatgcgcttcaatgagatggagtcaagaatcaccaagattgaagaagatgtctcttatattcgttcaagctttgatcttccaccatcgccgccaccatctttttag

SEQ ID NO: 70310 - DNA, 423 bp, Glycine max
  Peptide Sequence Number=SeqID_161995
atggaccaattaaagcacctaagcatccccttaggaatgcttagattctctaaccacgctagttacccacgtttgggccatccgacaagaaaaatcagcatgcaacagggacagacagatatcctcatagctaggttccctgaccctaactacggtgttaaaatgggttttcgttctctacccaaaccgcaagccaagttggaagattccgctttggttgaagggttcctctcggtgtgggttttcaaagatcccaacggtcagatcatggacaagtgtcttgtgaagttgcagacccaatttcgagaagatccaacggttaacgaagactgggcagcgtttttacctaggcagcttcatgtagctttctctagaagcttcattaagaggcttcctccagaagcttcctcgtggcttctttga

SEQ ID NO: 70311 - DNA, 648 bp, Glycine max
  Peptide Sequence Number=SeqID_161996
atgactcagtctaaatacattcgagatctgttgcagaagaccaatatgctagaagcaaagcccattcttcccccttgcactccaacttcaggctctccaaacatgggtctgatttacggcaagatccttctctttagagatctgtttttggagctctgcagtatgttacaatcactcatcctgaactcagttttgcttttaacaaagttcctaaatgagcaagtggctgccaagcagcagttagacagttcaaggggtgtgtatgtcttctcagatttaaatccttatgttggccatccaaatccgttaaaagaaggtcaagatctattcagaaaaggacttttaagtgaagcagttctagcattggaagctgaagtcctaaaaaaccctgagaatgctgaagggtggagactgcttggaatagcacatgcagagaatgatgatgatcaacaggctattgcagcaatgatgcgtgcacaagaggctgacccgacaaacctggaagtgcttcttgctcttggtgttagtcatacaaatgaactggagcaaacagctgctctgaagtatctatatggatggttgcgccatcacccaaaatatggaacacttgccccgcctgagatggctgattctttgtactatgccgat

SEQ ID NO: 70312 - DNA, 294 bp, Glycine max
  Peptide Sequence Number=SeqID_161997
atgtacaacttatccagagaatatgacaaagccattgcatcttttgaaagagcactgaaacttaagccacaggattactctctatggaacaagctgggtgcaacacaagcaaacagtgttcaaagtgctgatgcaataatggcttatcaacaggcgctggatttaaagcctaattatgtccgtgcttgggcaaatatgggcatcagttatgcaaaccagcaagaggcagtacattatagcatgggtgggagtacattaggatatccatctatgcaatgcattgaagcttattag

SEQ ID NO: 70313 - DNA, 321 bp, Glycine max
  Peptide Sequence Number=SeqID_161998
atggcattcttaggagaaacttcctcccagacgatcgtcaattcaaggttggccttcatttttccaaatggaaccgtcattcacaacgagtgtggggtttattttcaaagttctactccagtgcccatgcgagtaccaaacatgtggaacatgccacgccaaaacaactttctaggttacacgttcataggaaaaaatccccaaaaatttgatattccaaaaggatgtaccatagatgaactgaaggatttgatcaagcaagtagtatctaaagggaatcctcctcatgggattcatgaatcccaactgttaaggcgttag

SEQ ID NO: 70314 - DNA, 1527 bp, Glycine max
  Peptide Sequence Number=SeqID_161999
atggttagaacacgaggtttaggtcgtgccttaggaactagtagaggtagagacatgagtcaggatgcgcatcagcctgaagtttctcggcatcgtaggcctactgcttcagtacataggcaatgggttcatgtgactgaggatgttactcagacacctgaggatgtgcctcagttgaatgaggatgttccccatgtgtctgacgctactccggagatgacaggagccgttgatgctgcggatgcagagggagtggctagtgatggtagcttgggttcacctcctactgatgagggattcccttgtgggccacgcgacccatcagttttgactggttttgctgagcacgtcgcacacagcatctggagtggagaggaacgacctaatctgaagtttgtctcccatggtagaaaagtagataaatttgggagactagcgcctgagatggaaggcatgattgcagccaccggattgagtccactgatcctggacttatatccgccttcgtcgagagagttgacaatcactctggatgatgttttgtcactcctacaccttcccatcactggcgcactgcatgccttcgagccactggttacttttgatgcggtggggcttttgacagagctgcttgaggtcacccctgaggaggctacagctgagacccatcaggctgagcatctgaataaggcgtcgcagacccctacacagcagatggccggttacattacactacttcagtgctggatatacgagcactttctgacggtgcatcagtgcatcattgatgatgcttatgctgaggcaagcccacgtgcctccaggtggcttacgagtaaggctcatatgacgaggatcaagagagcccaataccaggcacgtatagaagccctgaccgtgactaacgtgttctggatgccctatgctgagcaccgaggagttaggggctttgacttgatctcggcgtacacgggccagctcagatggggtcagattgtcgtctacgttcgaccagagcgggttgttcgacaattcaggtacattcagaccgtccctccgccgccaattcgtgattcattgacagatgctgatatagacggtcagtggctgcacttttcagaccatctagtacctgcgggggagatctgtgcagttcctgtccaggtggcaccagattacatggattggtttttttggattttgcacccgttcgtcacgccgaccgaggacaatgctgagctgagacatccgcctaccccacatgatgaggagttcgtcaagccacctatcccggaggtttcaattgcatccgatctccctacgtattcagtggttgactaccaaggatgtcaagggatggctgaggatttaggagcgattgctgaggatttggagcgggtcatcaacctcaggatggtcattgaaggcactgacttatatgccatcatggctcgttacatgaggagagttagaggtgacgccgcatatggaaatcttaggccgcgacaaagacgccgcatagattag

SEQ ID NO: 70315 - DNA, 597 bp, Glycine max
  Peptide Sequence Number=SeqID_162000
atgggtgttgggtttttgggagctataatgggtagttcttctaggtgggcaactggggatggtgtgcttatgtctgggcttgtggaagtgggatatttgttttgcgccatcgcccgatcgccacctagtaccacatataacggtggtacctggagatatgtcgcgggggtcaagagaccttgtggacgtcaggtgggttgttattgcccaaaaccaagcttggccaatcctgacctaacccggatcgcgatggcagcacagttgatccatgatcgtgtcgtgatggaatgcctagagggtgtttgggagaccttcgaaggcaatgagaggtgccgattccgtggcacaattcgactcactgccacttcgctaccagttcaagtgatagaggtgtcatcctctaaaaaggatcttgaagaggacccagaggagttacctcctgaacctgctatggatgcccctgacttaccagaggatgatgaggacccactccctgatgttgattctccagaggatattatgtcagcatctgaggcagactctacagaggagagtggccctggagggacagcgattagtgacgactcttcatcgtag

SEQ ID NO: 70316 - DNA, 165 bp, Glycine max
  Peptide Sequence Number=SeqID_162001
atggataagagcttgaaggtaggagaagatgaatggagggaaagggagagaggggggcacaaattttatgcctcaaatgaggtatggtttagcccactaatccaagatcaagtccaagattctccactaagtgtgcataggtgtcatgaggcatataaagcatga

SEQ ID NO: 70317 - DNA, 243 bp, Glycine max
  Peptide Sequence Number=SeqID_162002
atgtgcaagagagaaactaaattcctagcacatccaggtgttttgatgataacaatgatgacaacaaaagatgatgacaaaggtgatgaacaaaaagctcaaagatcaaagaacatctcaagtgaatcaagaacaagtcaagagttcaagaatcaaggagaattcaagactcaagaagaaagcctagaatcaagaatcaagattcaagatctcaagaatcaagatcaagattcaagactctag

SEQ ID NO: 70318 - DNA, 1029 bp, Glycine max
  Peptide Sequence Number=SeqID_162003
atgctccaaccatatgggatcaacataggcttaaaggagcactcaaacccggtgacccccaaggcctacactccgaagagtccgtcagggcctctccctcctgattcagccgtcgacgacacagggagtagcatccacatgcttaccattgtcagttactggatggttacaattcatgaaaactacatgctggaaaagaaggcgtcgccaactgaaatatggacgttgaccggcaaggtatggatccgtcacgttacgatgagttttgctaaaattcaatcgggacaagaagatgcgtggggggaggagcaatttggttctggaactccgggatcagccacttggaaagcttcttcaactggaaatcgacaactgagaaacatggagcaagcagatccatattcagaagatacgatctcctgtccgatttacatgtttgattcagacaacagtgtcctcaaattggatttaacatcctgtaccaagatgtttgacattgttgcgccagtcaaggaattcaaccaacaggataattggttggctttgagatggtccaaaccaaattgtactgagtgtgaagcgaaaggtaagagatgcaaatggaagaacaacaacacaggagacattgaatgttttgactgcaagggcaaacaaaatggaatccagattcccagatcattgatttttgctgctacagattacaggacagaaaagcctgcaagatttacctacgctgatgttaaaagaatcatgggtggtttcaaagaaaagttgggggaaggagctcatggagctgtattcagaggaaaactttcaaacaagattttggtggctgtgaagatcctcaataatacagacaaagaagggaatgagttaatcaatgaagtggaaattatgggcaaaatccaccacatcaacgttgttcgtttgcttggcttctgtgtagaaggacatcatcgtgctcttgtctattgtctatttccaaaaggatccctacaaagctttatatttccaccggaggactgttag

SEQ ID NO: 70319 - DNA, 2565 bp, Glycine max
  Peptide Sequence Number=SeqID_162004
atggggtctagatcttatgctgaattttctgttaagcctaacatggctgtatcaccaaaagtcgtaacgtcatttttactcgaaatgagcaagatggtccaggctaagtctatagaggagcgtaagttagttatgaaattcaagagagaaaaatgcggtcgaagtgatggagatttaaggccatgggatgagacctattacatgacaatgatgaagtcctcttcatataaattggatgcttcggttgtaggttcatatttttctctgtcaaactgtattgagggtttgaaggttctggtgcagtcattgtttggtgcaacctttcgtatcatccctctagcacctggtgaatcttgggatccacatgtacttaaactgtctcttgatcatcctgaagagggagagaagactcagagagagagagcgagagagggtccctgtctgagttcaatcggaattaggaatggacatcaacatggctacacgcgaggtaattggagggatcacaaggatgtagtctcatactacttcacccgttttcccgacaacgttacagagacagacctgtggtacatcttcaagaagttgggtgatctgagggaggtttttatttcgaaaaggagaaacagaaatggaagaagatacggtttcgcaagatttaagggagtagaggatgtacactctctggagaggaagctggacaacatcatccttggggggctaaagcttttagggaagagcaacgggagagcgaaaggaggtggagcacagaggtgggtacctgcgactgcagtcagaaacgaatgcggggacgacggaatctaccgtagaacgcgatccacggtgtatttcgacataccggtaacagcgccgaagtggcttaaggaagcatgggtggggagattgattaatgtggctctgtatgataggattgaagaagaactcccgtgggaaatagctgctacgacatccccaaagtacattggagacgacatgatcttgcttctcggactcacagatgaacaagctcgaaacttgatggatgaccaggttgcaggacaggaatccattttttattcaatggagaagtggaatccgagtttacgtccagggcacaggttaacttgggtacgttgctgggggattccactatcggtattggatattcggcatatcaaacagattacggcagggttaggcgaggcgttgattgttgaagatgacgtagagaatctccggcagctggacgtggcacgggtgttgatcaaaacatcttggagccccctaatcaatcatacagtcagtgtacacatgcaaggggagatcctcaatgtgtacatcattgaggaaagcgcaactctaccagacctatcatattgggggcgcggaagggaggctacctcatcagaggaagtgctctcggaggagagtgacacgggctcaccgtggcccgttacagaatcgccgccggtagcgccagcgatttcagtggacactgctgctatcaatggatcgtcgccgggagagaagaatacagacagcccgcgtcgtacatcggaccccgataacattcaagtcgcggcggtggctcctccacctacgcacgacgacaacggctcgacgctgggaagttcgaacttggatatcgggtgctgctctacggacaacggcggccatgaccctttacccggcggttccaaagaagaccattacccaacgggcactgcatgcacccaaagggtccttttgtcggcccaggctaaattcaaaatcccctgcccagagaagacttctcagaattgcgtgagcctcctgacacctgacccacatatcaaccagtggcctttgcttgaaaatggtcaaaaccagtccgctggtatgcgtaccccagtagatagctacagccccttgcatgaaaggggaaattgttgcgtgaaggagactgttgccttcaaggggaaggagatctgccttttaaccaaatcacgtgaccagcagaggagtgataaggttgggcctatttctgctatccacacccctacctcattaccagcccaccatcccgtaacctttctggaaggaaacacaaacccaaacacttccagtccgccccatacatcaaaacagcactcctgtgcaaccagaccacatgccttgaccccacaaaagcccctaccacaccaaacacccactccaaatgacccggaggcagagaataattctgggcctgtaactgctacccacacccctagcaatacattagccctttaccatggtagcccgctgcgaacccaattggctccacaaaacccattcagttgctattcgaggggaacttggcgaaagaagaaatttcccgaggccataatagcaccaccactaattgagaatgaaacttcagaccataaccagtctagagaggcacaacatttatggaacatggcactggacttaggagtgacttctgggtccatgcaacaggggtacatgcagaagttaatggaaatggaatatagagatgctaaagaggctgagagattggggaacaagagaacaaccccatga

SEQ ID NO: 70320 - DNA, 620 bp, Glycine max
  Peptide Sequence Number=SeqID_162005
atgactttttcctttgtcttattaaggacactaaaatggatttcgatcatcttcaattttttcctccaaccctctccagccgtgatagtggttgttggattatctaacgtttcagttatgggagttgttacgtacacccagcaatattgctggggcacccagcaaacagtgaatgggcaatattgcccttctacgaagcctgttccggaagacccttcttccgaaagaatttctgaaagatgtcactctggaaaacattcggaagaaccttcttccagaagaagaaggtgggcttccggaagaacttcggaatacgttccggaaggatgtgttccgaaatttttccggaaaaagggtctttcggaataccactttcttcttccggaagaagcatatgtccttaagatggacgaagatcaatggacgtatgactatgcgatgtcacaagaagttgatatggattatgattatgataatgaagaagaatgtggtgtgaatgaaccacatgtcgattgttcaaatgcttttaatacgtctcaagtatttggtactcgagatgatgttttacagtgggctcgaacaattgcccatgaaaatggatttgctgcagtgattatgag

SEQ ID NO: 70321 - DNA, 861 bp, Glycine max
  Peptide Sequence Number=SeqID_162006
atggaggtccacatcaacgtcgatggcgacgatgttgaagtcatgattgtggcaaagacattgaatcttggaatggctaacctacaacaaagtctagagaaacaagggattgatatgttctcatatccatgttgggacacctcacctgaagaggagcatcatgcttttgatttctatggtgcagacgaaccagtcaaatgctacaagggcaaagaagtaattcttgatgatgaagaagaggttgtctttgtgtgctttgttaaagcttgtccagggagtttgtttaaacatgagtttgaggtgctcaaacacaagtttgggctcacgtctctagatggccatgtcatacaaaggttttacagattgcaagaatattcctctggcttagaacctgaagagaagccacttgttgatgcttatcatcatgaagttggacaatgttatcagactctgaatcactcctgcttcactcaagaaactcctttcaacatgatctgctcatggcaaatggacttttatgcaacatctgatcgcacattctcttttctggtgatattgctcttctctcgcttcttctttattcatcatgtagacctcaaaattaaagaagttgacttagatattgatgttgcatctggctccatggttgttcaagattgtgcccttactaagaagaagcctcgtaaatggtctttaattggagacttcttttacaagaaagcatctggatggaagcctcctcactctcctacacctcttggtagcccccttaccatctcctctgattttgaggactttggtgataagttcctaaggaagcttaatgaagaagttgccaaacaaagagggagaaaaatgtaa

SEQ ID NO: 70322 - DNA, 282 bp, Glycine max
  Peptide Sequence Number=SeqID_162007
atggcagacaagatcaagagctgctcccttgatagccagcttagcagaaacggttataggaaatctttgagttgtactatcatcaaaattgggattgatccaaaagtccaatttgagaagagaccacacccaagttccatgaaccgcagtagcacaatggaagaacgagctctagtgagccacttgtatggaatcaagaaccgaagtggccagagtgactatatcgactctactaagaagcttagctttccaacttgtcaatctagagtgaacatgatctaa

SEQ ID NO: 70323 - DNA, 279 bp, Glycine max
  Peptide Sequence Number=SeqID_162008
atgatgacaacaaaagatgatgacaaaagtgatgaacaaaaagctcaagtgaatcaaagaacatccatctcaagaatcaagattcaagaatcaagaagaattcaagactcaagaagaaagcctacaaacaaagattcaagatctcaagaatcaagatcaagattcaagatctcaagaatcaagatcaagattcaagaatcaagaatcaagactcaagatttcaagaatcaagatcaagattcaagaataaagaaaagactcaatcaagataagtattaa

SEQ ID NO: 70324 - DNA, 264 bp, Glycine max
  Peptide Sequence Number=SeqID_162009
atgaggcgggtcattatattagttgtattagagcaggttgaacctttcggccatcatagcatgtttggtttcctgatgtctactataccacgagtttcaatgtcgtgtcatgagttatcagactggccatctggagtgatggctggacgaaatgatcatgcgatagaggatgctcttcaagtcttagctcaggctatagagaatccaaataggggagaagctgttggagctgttgagtaccaagggttggaccgctttcaatga

SEQ ID NO: 70325 - DNA, 534 bp, Glycine max
  Peptide Sequence Number=SeqID_162010
atggcttctaggaaaagaaaggcaatatctacacccatccaagttagatttgacaaatcaagattcacttaccaagaggcttgggaaagatacatagacattattgtgcctacgaagcttctgccagagaggaacgtggtggtctactatacagagttcgatgagtttaaggaggaactcgaaagacgccactgggatgaggagttgactaactttggggatggcaacattgatgttgccatagtgaaggaattctatgccaacctctatgaccccgtggacaaatcacctaagcaggtgagggtgagaggtcatctaattaaatttgatgaggatacgcttaatagttttttgaaaacccctgttattgtggaagaggaggaatcactctgtgcttattccagattttcactcctgaggcctgatcctcaggagttggctgctaagctctgtatcccagagaagggattcgagcttaatgctgatggggagcccctgaagattttgaggaagaacatgaccaccttagcttag

SEQ ID NO: 70326 - DNA, 234 bp, Glycine max
  Peptide Sequence Number=SeqID_162011
atggacccggcatcaaagagttatatacaagaacgtaagggaaataaaaggaaaccgacaaaagaggaagtcatgatattgcacgagattagaaggcctaactctctaaaaacagtccccagtggagtcgccaactgtcgcaacctacccttcggcgggagggcgaggcgagggctcacgggtgtgtcttccatgggaggaaaatgcacggagttgccaccaacatttatttga

SEQ ID NO: 70327 - DNA, 948 bp, Glycine max
  Peptide Sequence Number=SeqID_162012
gggcgcgccgcgacaactgacatcctgcgcctgaaaatcgtcgccgacagcagcgcgtttagccagcttgcgcaggctgcagggcaggttcagcgtaccgatctggcgcttgcgctggtcgcgctgtggctgggccgtttgaccgggcgtctggactacgccgccgggtttatctttatgcgccgcatgggctccgtcgcgctgaccgcaaccggaccggtgctcaacgtcctgccgctggcggtgaatatcgatccgcaggagagcctgcctgggctggcgctgcgtctggcgagccagctgaaaaaaatgcgccgccatcagcgctacgacgcggagcaaattctccgcgacagcggtaaggcggcgggtaatgaagccctgtttggcccggtgctgaacgttaaggtgttcgattatcaactggaactcgacggcgtagaggccatcacccacacgctggcgaccggaccggtgaacgatctcgagctggccttgttcccggacgagcagggcggattaagcattgaaattctcgccagcaaacagcgttacgatgaaacaacgctgaagggccacgtcgcgcgcctgaacgcgatgctggtgcagtttgccgctaacccggacctgcgactgtggggaagtggaaaccgtgtcagagcaagagacgccggacgcccccgcgctggcggatgcgcacatcgagctgaactaccgccagatgcgcgagcaggtggtcgcgctggcaaacctgctgcgtgcgcgcggcgtgaagccgggcgacagcgtggcggtggccctcccgcgttcggtattcctgacgctggccctgcacggcattgtggaagccggcgccgcgtggttaccgctggacaccggttacccggacgaccgcctgcggatgatgctggaggacgcaaagccgtccctgctgattaccaccgatga

SEQ ID NO: 70328 - DNA, 201 bp, Glycine max
  Peptide Sequence Number=SeqID_162013
atggaatcttcagatgaagaggagagcactcagcaatgcacttctggtagtcccaaaactaaagttcctctccctgaagatgttgtgaaatctttaatgaatggccaattggtgttgcctttctccgagaagtctccttgctgccagctgttccatgccctggtggatgtggagaagcttactattgcaggattgtgttag

SEQ ID NO: 70329 - DNA, 360 bp, Glycine max
  Peptide Sequence Number=SeqID_162014
atgactaaagcacgtccaaaggggatacggaaaggaaaagagggagaagcttgccacccaactcttgcaggcgagctaggttgcatcctcccgaaggcaccgccttctggaggaacttcctggaaggcccaagtgggcctgaatgctattttcaccccctatttactaaatacacctcctgccctttttgctgattttttttcccaatgttatggaacctcatggattgtgcaagaatccttccttttgattttcgacatgttacagaacttcacggattgtgcaacaatgctttcttttgacttctggcatgtcacggaacttcacggattgcctaacgatgggtgccaagtaccttga

SEQ ID NO: 70330 - DNA, 378 bp, Glycine max
  Peptide Sequence Number=SeqID_162015
atgccaacgtcatcacgtcggctctgcggctcctcaccagaatcttacttcctgtaccctgccactgtcattctgctcccacgaacaaggttcgtgatcatcacagccaggaacataggcaaacatgatgagcatacacaacaatcattattcaacactcatatccaacaaatattcatcatccacatccaacaattactcatcatccatccatggatccaatcaagactgcacaaaggtgtttcgagaccacccggttgtgcatgtaacagcccccctcccataggtgatcagcctgggagtccaaaggtgtgtcgagaccacccggttgtgcacgaaacacttggccacagttgctctatttcctgtgtcgtatga

SEQ ID NO: 70331 - DNA, 120 bp, Glycine max
  Peptide Sequence Number=SeqID_162016
atggcattgatgttgatgatgatattgagacgagatgatgttgatgttgatgatgtcatcatgatggatcttttcatgaggaaaaaatacttgtacttgggagcatgccactcggtttag

SEQ ID NO: 70332 - DNA, 711 bp, Glycine max
  Peptide Sequence Number=SeqID_162017
atgccaccaaacagtggtccccggacgaaattagggtatgacaatgtcctcaccttcgaagggctacacgccctcgcctttagaggactgcacgttctcacctttagagaactacatgtcctccacttcagaggactacacgtcctccactttagaggactacacgtcctccccttcagaggactacacgtcctcgccatcagagggctacaggtcctcgccttcagagggctacacgtcttcaccttccgaggactacacgccctcccctttagaggactacacgtcctcgccttcaaaggacttcacgtcatcgccattagagggctacacgtcctcgccttcagagggcaacacgactacacgttctcaccttcagagaactacacaggacttcacttcctcgccatcagagggctacacgtccttgctttcagaggactacacgtcctcaccttcatagggctacacatcctcaccttcagaggactacacgccctcccctttagaggactacacatcctcaccttcagagggctacatgccctcgccttcagaggactaaacgtcctcgccttcagagggctacatcgcctggccttcagagagctgcatgttctcacctttagaggactacacatcctcgccgttagaggactacacgtcctcaacttcagaggactacatgtcctccctttcagaggactacac

SEQ ID NO: 70333 - DNA, 661 bp, Glycine max
  Peptide Sequence Number=SeqID_162018
atgtcctcactttcagaggactacacgccctcaccttcagagggctacacgttgtcgccattagaagactacacggttacacgtcctcaccttcagaggactacacttcctccccttctgagggttgtatgcccttgccttcaaaggactacacgtcctccttttcagagggctacgcgcccttaccttcaatgggctacacgccccccctttagaggactacacggcctcacctttaaagggctacatgccctcgccatcagaggactacatgccctcgccatcagaggactacacatccttgccttcagaggactacacgacctccccttcagaggactacacgtccacctcttcagagggctacacgccctcgccttcaaaggactacacattttcacctttagaggactacaagtcctcatcttcagagggctacacgccatcaccttcagatggctacacgccctcacctttagaggactacacgtcctcgcctacatagggctacacatcctcgcctttagagggctacacgtcctcgccttcagaggacttcacgtccctgccttcagaggactacatgccctctccttcagaggactacacgccctcgcctttgtagggctgcacgccctctccttcataggacttcatatct

SEQ ID NO: 70334 - DNA, 339 bp, Glycine max
  Peptide Sequence Number=SeqID_162019
atggaggccatgaaagagcaaatggctacaatgatggaggccataatgagcatgaagaagataatggaagccaatgcagctacagttgccgctacaagggctgttgctaaggatttgggaagtacgaatggccccatgatgtgcaaattcaaaacgagcacgccttcacgccatatggcttgccttccaactatacaccacccaatgtggtgtacactcccaatgagaatgtcaataactccgctccgatactcattgagagccaataacctcaagctgatcatgcacatgtctctcaacccatgggggagacacatggaatgccccaccaccatctag

SEQ ID NO: 70335 - DNA, 438 bp, Glycine max
  Peptide Sequence Number=SeqID_162020
atggaaaatataagagattttgaatttggtgaaccaattggatgtgatggaagtgaagatgatgagcttgcggactcttgtaatgctactgcaagtgcaaagacaaattgtcattcaaacaatgttaattggttgaagcttttgtcacagattcatgacacttactatttttttttcacgcattctatgcaccaaaagaagcaagcttgtcagcataagcattgccttcgcggtagatatatagttgtatcagatatgtcaggaaaagctataagagaaatcttagttaggtggttggatgaccttaggcagaacaacaaggaggaggtgaagcaaaagctaaggagaatgaaacccgagacgtcgctgaagatcaaggaggaggtgaaaaagcagtttgacatcgatttcttggtggtggttcgataccccgagtga

SEQ ID NO: 70336 - DNA, 593 bp, Glycine max
  Peptide Sequence Number=SeqID_162021
atggtcattgaccaatccctcttctatgatttgacccaattgtctagtgacggtgtaccatttgaaggtgcattggatgatgattggaagttcaatttttctatacatgatgcccgctggttggtttgcaccaaccaagcggatatgacagaaaggttgcttgccggttcattggctcttgaaagctgcaaccttcactatcttattattcgtatcttactcctaagatcttcaaaccttgcacaagtttctgaagaagatcttatagtcatgtgggcctttcataccggccgacaaactaattgggcacatttagtctggtatcccatgcataaggcattgcgattaaatgctcctttaccatatccacatttagtcactcttttccttcaacattttaacatccctcttgattctgaaccttatgttccaatcaagagatctttcttgatcgatgctgttgtggctgcgtcctttggttaccgcaaagagcgtgatggctcttgggtaaaaaagggtactcaaccaaatgatgatgaaggacaattaccagttgaaggggactcttctatccttcaaagtattttggacag

SEQ ID NO: 70337 - DNA, 450 bp, Glycine max
  Peptide Sequence Number=SeqID_162022
atgaccggccctctcgatgggccgacctcttgttttctcataaaggtggaaccttgggtactggtacctatcttctttagaggactacatgtcctcgccatcagaggactacacgtccttgccttcagagggtcgcacgccctcgccttcagaggactacacgtcttcaacttcagaggactacaagtcctcatcgtcaaagggtcatgtaccttcacctttgtagggctacacgccctcaccttcagaggactacacgtcctcgcctttagaggactacacgtcctcgccatcagggactacatgtcccccattttcaaagggcgacacgccctcacctttagaggactgcacgtcctcgccatcataggactacactccctcgccttcaaaaggcggcacgttctgaacttcagagggctgcacgccctcgcctttagagggccacgc

SEQ ID NO: 70338 - DNA, 1275 bp, Glycine max
  Peptide Sequence Number=SeqID_162023
atggcagaacataacaggaaggcgactggttgcgatagtacaccgcgtgaatcggcaggcgcagttcgcgcgtgtcattttccagcacctggtttcgccgctcgacgcgcaaagcgtgggtttgatgcgcaaaaactcgccttcacgctgccataccggccagacattgtgcgcgtccagctggctgaatcccagcagctggtgcgtcagcagatcttccacgctctgcggcgcgccggctttttccagataggccggactggccagcaggcgaatcgcgctgctgcccagcacgcgcgcgcgcagcgtggagtcgcgcagttcaccaatgcgaatagcgatatcagtttgctgctcaagcaggtcgatgacaatgtcatcggtgttcagctccagctgaatttgcggatagcgcgcgcaaaattcggcaaccagcggcacgataacatgcagggtaaatggcgtattggcgttgacgcgcagccgtccggagggaatgtcgcgccgctgcgcgatatgctcttcggcctgctccaccgacgcgaggatttgccgcgcgtgatcgagaaaaatcagcccctcttcggtcagcgccaggcgacgcgtggtgcggtgcagcagcgtggtttgcagtttgctttcgaggcggctcagcgcccggctgatgccggagctggtttgatccagctgttccgctgcggcgcgcattgctacttcgagaccggtcttagcctcgttctcacggctgctgaggtagattgctccacgttcagcagcggcaggataccacaatgcagcaaaatgcagggattatcgctgacccgggtcagcaggcggcatatgggtgccgcgcacagggcggtttttattcacgggcatgcagcgatgggacagatcgggacgggcagcgatgggacagatcgggacgggcagcgatgggacagatcgggacgggcagcgatgacacgccttgccggcataaaaaagggacgccgcagcgtcccgtttgcatcacacttcgaggtcggcgaggtcgcctttttcctgcagccagttgcggcggtcttccgagcgtttcttcgccagcagcatttgcaccagacgacgggtgttaggatcgagcgtggtttcgcgcagctgcagcgggttcatctcacccagacctttaaagcgctgcacgttcggcttgccttttttccgcttcagttgctccagcacgccctctttttcgtcttcatcgagcgcgtaatacacctctttaccgaggtcgatgcg

SEQ ID NO: 70339 - DNA, 893 bp, Glycine max
  Peptide Sequence Number=SeqID_162024
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggctgaggagcaaaaggaggaatccgcccgaggaggggctcgctggggaattttccgcaatgggcgaaagcctgacggagcaatgccgcgtgaaggtagaaggcctacgggtcatgaacttcttttccggagaagaagcaatgacgttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 70340 - DNA, 132 bp, Glycine max
  Peptide Sequence Number=SeqID_162025
atgactaaagcacgtcaaaaggggtacagaaagggaaaagagggaggtggttgccgcccagctcgcccaggcgagctgggttgcttccaccagaaggtatcgccttctgttggaagatcctggaaggcccaa

SEQ ID NO: 70341 - DNA, 106 bp, Glycine max
  Peptide Sequence Number=SeqID_162026
atgaactcgctgagcactgaaggttcgctgagcgagttcattgcaaatttccagaaaacagcagaaaacgcagttcatattcttctaaaattgaaacctctaacag

SEQ ID NO: 70342 - DNA, 231 bp, Glycine max
  Peptide Sequence Number=SeqID_162027
atggcagaacaagctaaacaagtattttatgttcaagaccattgtgatgcaatatggtcagtggttctacatgggaaaacaataggtgttaatgttgaagatgatgattcatacattgatacttatcaaatggctacaccgcctagctctcttcctcctcctcctactagtgcaaagtcgcattcgccgtctaccttgaagcaaacaagaaaggccacacgcctaagataa

SEQ ID NO: 70343 - DNA, 96 bp, Glycine max
  Peptide Sequence Number=SeqID_162028
atggagggggatatcatctccaatgatttctcagctgagttaccctttagattgaagcaacctatggttaaagcagttgttcaggtttgctcttga

SEQ ID NO: 70344 - DNA, 225 bp, Glycine max
  Peptide Sequence Number=SeqID_162029
atgggtgatttcgcgaagattttcaaccgttcttcgtcgttcgttgttcgttcttcgtcgttcttcggtcttcaaccgatatatcttgcaaaaaaggataaaaacaacttaaccaaatactttgttctcaaagaactacgtaggtctgattttcttatcacaattgaggaatacgtaggagcaaagggaaacacccttgtcgaccacaaaaagataaaaatataa

SEQ ID NO: 70345 - DNA, 327 bp, Glycine max
  Peptide Sequence Number=SeqID_162030
atgaatggggatacaaaagaatccaaagtagttagtcctttgaacacttttgtattagggaaagggaagaatcaaaagaatctcaaactatgtcgttttgaattctttgacaagggagaagggagacataaaagaattcaggcggttagtcctttgttcttttcgaaaagggagaagagagacacaaaaggaattcaggcgggagaagagaatgaaaagatgaatagcacaagttttcaaggtttggaaaaccagaaaacttcagaaatcttttggtacaaagaagaagaagaagttcaaagagattcaaggcttgtaaaggattga

SEQ ID NO: 70346 - DNA, 300 bp, Glycine max
  Peptide Sequence Number=SeqID_162031
atggcatatttttcttcatggcattacaatatttcagagaattataggcaattgaagaaacttgtgcctatcgaagaaaagtctgtttctcagatcagaaattcatccatactgagaaatgaggattatttttcttcatgtgctatgctatctcttaatgccaaggatcctcaagaattgccatggaagaagactgttgttccaggggagtccatttcaactaagactccgagtgatgcacaagaaaagaaatacaaagagcttgctgaattgggaggaataaatattggaagagaatag

SEQ ID NO: 70347 - DNA, 801 bp, Glycine max
  Peptide Sequence Number=SeqID_162032
atggctaattttgagaaagatgaggtgccaattttctcagaagttcatcccaaaccatcaaatgaacctgttgatactaaattcccaaggggggtacctaggactcgaagtgtatcaatttctattccctcgacactcacggagccatacgaaagaggtaataatcttgtgggatacactggtcccctaaggagtcagaggaaaacaccatttgatcatatgagtggtccattgtatgttactaataaacatggaaaccttttccggcataatagagtggcatcagagtaccaaacagcagaaagtaaggcagaaaattttccttcatgctgcggcatgggagaaaatgatttgcagaacaactatgctggcaagaatgaacatttagttaggtccggtccactgggaatgtgtaatgatccatattgtacaacttgcccaacttacttcaaggctactcaacaaatgaattcaaaagcttcgggtatattcaatcctgagacattttatcttatgaatcagtttgacaatatcaacttctgttactcaacaaatttcaacttcgattattttcagtttcgcaataccctctatggggatgccagggattgggcaagaagactttttgctttcttgattccacttgttcctagagttatgaatcctcataatagacttgtacaacaatggaataaattttttgcaatttgttgcttggtggcaatatttgtggatccgttatttttcttcttgctctctgtgcagaagcttttgaaacggccaaacgaccaaacaggataa

SEQ ID NO: 70348 - DNA, 330 bp, Glycine max
  Peptide Sequence Number=SeqID_162033
gcgcctagggtcgcgcctgacccctgggcgctaccggtcgcgcctgacccctgggcgctacccgtcgcgcctggtgcaggggcgctacctccctgtgccacgtgtcgcgtgcacagtggaggcgccggggcaaaccatgtaacaccgatgaaggagaattggcagattgccgatgaaaacaaagagcacttcaaagatagtgaaattgaagaggacgatggatcctcctatggtggcaaggacgaagaaggcggagaaccacatgttgcggcaaaggaaggcgatgaagttgtagtagttgacgaggacaaggaaaaacacgtagtttga

SEQ ID NO: 70349 - DNA, 954 bp, Glycine max
  Peptide Sequence Number=SeqID_162034
atggctaattttgaagaccgtgagctgctgatgatgtcagaaacagatgcacaatcatatgatgaaactttgcactctaaattccaaaggcttttatccaggacacaaagtgcatcagtttctattcccatggagtcatatgagagaaaaactagtattgtgggacatagtggttcactctatgctaatgctacaccaggaactgataatctcttgcagcatagtatagttgtaacaggaaacaaaacagaggagagcaagacagataaatttgctactttcatcagcacagataaatttgatagtaaaaatgaacatttactgatatccggacaactgggaatttgtaatgatccttattgtactacttgtcctacttacttcgaggcttctcagctaagaaatccaaaagcttcaattctatctgatcccaaggtgtctgtctttcttcctataataggttacgtttcagttgccattaattacatgttccacaatgctctttatggggatgccaagggtttcgctagaaaacttttttccttctgttcttcttttgttcctggagttatgaaccctcactctaaattcatacaacattggaacaaggttctcgccactttttgcttggttgcaatttttgtggatccattatttttcttcttactctatgttcgtcaggattttaattgcatagttgtcaactggaaattgacaaaagcacttgttatagttagaagcatgaatgacttcatatattgtcttaacattcttctccagtttaggttggcttttgtttctcctgagtcgagggtggttggtgctggagatttagttgaccatccaaagaaaattgctcttcgttacctgaagggttattttcttattgacttatttgttgtatttcctcttcctcagctaaattatcagttgtattgtatctccgacatataa

SEQ ID NO: 70350 - DNA, 1602 bp, Glycine max
  Peptide Sequence Number=SeqID_162035
atgaacatgaacatatacttgagatcaagcaggcagcaggggaaggaaaggataatgatattatttgtcctaccaaagtacctgggattatcaggagctaattatgctaaaaatcttctgcgtgctgccatccttgtgcagtattttcccagattattcagatttctgcctctgctaattggccagtctcctacaggattcatatttgagtcagcctgggcaaatttcattataaatcttctcatttttatgctatctggccatgttgttggttctggctggtacctctttggtctacagagggttaatcaatgcttgcgaaatgcctgccgtgattctaatattactggatgctcagcattcattgattgtggctatggcgctgacgatgtatctggccgggcagaagtgtggaacaacaatgtaaatgccactgcttgtttgaattcaagttctgatgcttttaagtatgggatctatgtaaatgctgtaccacttactatagaaactagggtggtccacaaatatgtatttgcactgttttggggattccaggattgggactcttgctttttgcacttctcattggaaatatacagaactttctgcaggctcttggacgcaggtcattgcatttgtcttgtactctatgctgatgagattgtcaactctagtgatggtgagactggtagcctagtcacattttggtttgttattactcaacatgagtatgcattggacttcgaggagattagtatgcttggctgttgtcattgtgatactcctatggattgtaatgtcaagcttcttccagaaatcacaactgttaactctagtgatcaaccgactgatatgttcaccaagaggctagaaatgcaacttagaggtcgtgatgttgagcaatggatgagccaccgtcgcttacccgaagatctaagaaggagagtacgtcatgctgaacggtatagttgggcagcaacaagaggagtgaatgaagaaatacttctggagaatatgcaggaagatctccagacagacataagacgtcatctcttcaaatttgttaaaaaagttcgaatcttcgccctgatggatgagcctatcttagatgccatttgtgagagactaaaacaaaagacatacatcaaaggaagtaaagttttgagtcaggggagtcttgtagagaagatggtctttgttgtacgtgggacattggagagctttggggatgatggaactatggttcccttatctgaaggggatgcttgtggtgaagaacttctgacatggtatcttgagcattcttctgtaagcacagatggtaaaaaagtaagggttcaaggacagaggttgctgagcaacaggacagtaagatgcttaacaaacgtggaggcattttcacttcgagctgcagaccttgaggaactgacaattcttttcacaagattcttgcggaaccctcatgttcaaggagcactaaggtatgtatcaccttactggagatcccttgcagcaaaccgtattcaggttgcatggagatacaggaagaagcgtctaagtcgtgctaatacctcgcaatcagatcaaacattgattgcatag

SEQ ID NO: 70351 - DNA, 231 bp, Glycine max
  Peptide Sequence Number=SeqID_162036
atggaacaaatcaccgtcttggaacaagctgttgatgtctataccatggagttggaaaggtttttgacatttatcagtgaggtctttgcaaatgcacctttctttatttcagcagaggttgctggtgcattggaagcaaggaaaaatgatgactacaaagagataaatgttccagctgggaaaacttatgagcaagttacggttatgaccatagttgtcaatctcaaatag

SEQ ID NO: 70352 - DNA, 1395 bp, Glycine max
  Peptide Sequence Number=SeqID_162037
atgacgaaggtacacccaaacgctaacgcatctgtgtgtgtgtcggagacggagacggagaagccaaataaaaatagtgatgcaatggcagtggtgctaacagtgtggaagaagtctctgttgccaaactgcaacggattcaccgttttcgacacccaacgagggaatctggtgtttagggtcgataattacgtcgcgcggaataaggatcagatacttctcatggacgctgctggcacacctctcctcaccatccgccgcaagaggctaagcttggtatcagacacttggctggtgtttgaaggagagggctccgtcaaacagaaactgctttttacagccgcgaggaagaacgtcaacgccaagtgtactttggcacacatcttcaacatcaagaaggaagtagcatatgagatagagggatcatacgcccaacgttgctgcacgttttacaacaacaataagataaaagttgcagagatgaagatgaaagaaacttttggcgcagatatcttccgtctcttcgtacagcctcacatggacaccactctcgccatggcctttgtcatcctccttgatcacatcctgccgtgtctaaagttcactgataaaatgataaaacaggagcgtgtttatactggagacagagactgtagaggaggagaggggctattctactctattaggaaagttcataccaaatctggtatagtggaagcaaaatttataacatgtttggctggtagtgaagtgagtatggggaataaagtggctgatgtcagtcatgtgatcggttggctatatgcaggggcgacctcaaccacactcgtcttctacttgccatcaaccttgctcagaattcttactactacaacaccctcattcatgccttctcctagagccccgaccccaaccatcacttacacctctttccctcttcctctccatgccccacccacactctcccaccccacccgacaacttcacttctatttcacccgtgcggccgaggtcaatgacatgggtgccctcatcgtgcacctccacgagcttgttagattatttcttgatgggtataacgtaggatgtgcatttggacaaaggtctcggtctagcgtagtggtggcatgcgatggcgtcatggttgttagtgatacgacgctcgatgatcgtggtgtggcacgaggtggttttgtgtctgtgaggaagccgacaaggataaatggcactaaagctcctagctggactaatcccagtatccgggatgggtatggtagccaagtgaaccaagaaaacggtaaagccaatgttagaattatgcgaatggagctcttcttgaaggacattaccaacccaacagtgcaaatagcacccaagcacggtgctaccatgtaa

SEQ ID NO: 70353 - DNA, 444 bp, Glycine max
  Peptide Sequence Number=SeqID_162038
atgtcgggcctgtataactccaacttctcaccagtgagagctgcttctcctcagattagaaccaacccagaagtcgacagtcagtaccttacggagttgctggcagagcatcagaagtttggtcccttcatgcaagcccttcccatatgcagtcgtctcttgaatcaagaaatattaagagtttctggaatgctgtccaatcaaggttttggtgactttgacagactgcggcatagaagccctagtcctatggcttcttcaaacctcatgtcaagtgtcactggaacgggattgggtggatggaatagtcttcagcaggaggtgactgctacctccaaactttgtatcatcaatttatgcttgtcatcatctgttcatggagatgtcaattttgtttttgctactttaaaagactgttatatattctcacatatgcttgtttaa

SEQ ID NO: 70354 - DNA, 147 bp, Glycine max
  Peptide Sequence Number=SeqID_162039
atggagggtgaagttttggccattcaggctgttcatggagacgatattttcatgctccaccagagcatgagcttttgggaaccacgggagattattttcgaagcagctaaccaacaggtacttagtttctggggagtttcacactag

SEQ ID NO: 70355 - DNA, 2361 bp, Glycine max
  Peptide Sequence Number=SeqID_162040
atgggaggtggaggcttggctgcaatgtttagtcgtttggcttctagttgtttctattctactctacaccctggaggatttggaatgaaagtgcaagaagaacaatgcctaaaaactaagacaattcgagtttggacttctaaaaatttcaaccctgaaccagaagttgaacatattttcaaggttgatgaaaataaattttttaactgtgtgcctgacagttcaaaaataatatctgaatttgaggcttcaagttcaactatcaatggagaacttgcagaccctgcaaatttggaagatagagaagttggtgcagaactctcttgtgtatctccaagaaatacagagttaaactttgtagaaacaccaacagacttgcaagatttggcctttggccgaagaggtacggtttctgactgcaaattggtcagttcaacagtggaggcaggcaatacaccatcaggagcattcccatctgatgtgttgaaaccattctctactgtgaatagcattagaagggcaaataggatactaaaaaggctaaaggatgaaaggttccttttgaaacctgagataaataggtggcttaatagccttgagaatgataactctacaaaagtggaccacaagactattgaccgaatattaactaaacttcaggaacaagggcaggtcaaacgcataatagtaagttcgcctgttatttctgaatattcccggacaaaaaaatgtgtggtggttgtgcattcatccgtgagtcaatctcctgagttatttgatgaaattcaagatagagtgcgatcatttaatacttgtattcgcagcaaaagtacttcatatcagaaaaatgatgaattcatacctgtaatggaggatattcagaaaaatcaaagtgttatagtttcagctgggcgggctaataaagcagaagccaagcatgctaatggatttgtattagcaaaaatgattcgtgcaaagctactccacagttttctttgggattgtctgcatagggaagcaagctatattgatgatttatcatctaaaaaatgtgtcaatgagcaaactaataatcctcatagtagcatcaaactattttgtctagaagctgctattaaagaaatgtcagttgaactattattacaagttgttggctccactaaaaaatatgaagaaatgattgaaaaatgcaagatgggtttacgtctctctgatcttcctctggaggagtacaagtgtttaatggatgctcatgcaacaggaaggctgtcattagttattgatattttacgacgattaaagttgattcggatgataactgatttgcaatctagagatggagtcaaaacccctcatacttttactcacgtgatggagcttaggccttatattgaggaacccttttcaaatgatgcaccatctttaaattttatctctcttgatctccgaccaagaatcaggcatgattttattctgtctaatagagatgcagttgataaatattggcacatattagagtattgctatgctactgctgatcgaaaagctgcttcttatgcatttcctggatctaaggtcaatgagctttttcgcttccgttcatggacatccacctgtctaatgacagctgaacaacgtgctgagcttttaaagcatgtaacaaaggataatcttagtgaaaaaatttcatataggaattctgagaagattgcaaaagatctgaatcttagcttggagcaggtacttagcatgtattctagtaagcgccgccgccatttccttaatcagttggatgatgaagagaaagaggataattcacctgaatgtaagggtaattcatctcgttgtaggaaaaaaaattccagtgagcccaggcttgcaaaacatgcaagaattgatgcagtaactgatgttgaggacatgcacatagaagaatcacataattttggtgtgcattcaagagagcgtgccacacatatgcaaaaatttgaggatgattatggacttgaggattctcaagactgtatcccccttattaaccagtgtgtcttgacccaaatgaagctaacgtgccaaaggagatttgtttggtcagacaaaattgacaggctacatgttcctcaaataactaaaaatctcattagtgattccaatgaaatccttcttcagggtgatgttggacctgatggcttgtatcagttccctagtctcaaattctggtcagctgtgtcttctccagctgccttttcaactgtttctccttgtataaatgctgcttccattgatgaatgtaatgatgaattgcccaattctgtgtatacttggcaccttaggctaggtcatccaaatcccaagccttaa

SEQ ID NO: 70356 - DNA, 885 bp, Glycine max
  Peptide Sequence Number=SeqID_162041
atggtggcatgccggatcagtggagacaatagaaacatattgatggtaggaaaggctgtcccagaagtggtgttaaactctggccacagcatgcctatgcttggctttggcactgcaggtgtacccctcccaccacttgatgaactcgtccctgtgtttgttgttgccatcgaagctggctaccgccatttcgacactgcaactctgtatggttctgaggaggcccttggtctagctctagcacaagcacagcgccaaggtcttattaagaatcgtggtgagatttttgtcacaaccaagctatggtgttctgattcccatcctgaccttgtcctcctagcactcaagaaatcactgcagaggttgggacttgattatgtggatctttacctaatccattatccagtgaggttgagacaaggaataggaggaagtatttccaagggagatgtgcttccttttgacataaaagggacatgggaagccatggaagagtgttctaaattaggcttaaccaagtctattggtattgaaatgaacgtagcatggcaacagggaaatctgagaaaattctgccaagagaaaggaattcatgtgagtgcatggtcccctttgggagctaatggtgcttcatggggttctcttgctgtgatagatagtccagtcctaaaagacattgcaattgcaacaggcaagagtgtggcacagattgcattgagatggatatttgaacaaggggtcactccagttgtgaagagtttcaacaaagctgatttggagaagatcaagcaaattccacaatttagggccgtcttagcaagagaatttataactgaagatggaccctacaaatccttggaagatctttgggatggggaggtgtga

SEQ ID NO: 70357 - DNA, 156 bp, Glycine max
  Peptide Sequence Number=SeqID_162042
atggccctctacgggtcggcgttcgcttactcgaacccactcaaggatactaggctgccttgcagcggtgttttccgcttgtccagagttgggaagggacaacaatctgtcagtcgagaccctagcctctatttgcgtctgtccctaagtacctga

SEQ ID NO: 70358 - DNA, 438 bp, Glycine max
  Peptide Sequence Number=SeqID_162043
atggtacatcaacttgggtttgactcagaacaagagagggtacatctcttgtggatcagttctagtggagggtacatctcttgtggatcagttctagtggagggccacttgatccaacagacaagaaacaagaagcgtttgatagttgaggatgaggatagggtggctttggagaaacaaattgttgtaaaggatggcactgagaaaaagagagaggaggtaacagatgtgacaagtcaggagagtgaaaaaccaataatggtcgaggagaaagaaataaatgaccaagaaaaaggaatagaggtagaaaaagaaaaagaaaatggagaaaaagttgagaaaaataaagaagggaaagaaaagagtagaagtgagaaagcaagagagaagaataaagaaaaagcttcaaatgaggatacgaaagtaccatatcctgtg

SEQ ID NO: 70359 - DNA, 309 bp, Glycine max
  Peptide Sequence Number=SeqID_162044
tacatccggaggaacccgcatgcacacttcagcagcctgtggagtggatacttacctacacctactccatatcgactagttgagccggttcatgtgatagaggtgtcatcctctgaagagcatcttgaagaggacccagaggagttacctcctgaacctgctatggacgcccttgacttacctgaggatgatgaagacccactccctgatgtcgattctctagaggatattatgtcagcatctgaggcagactctacagaggagagtggccctggagggacagcaaatagtgacgactcttcatcatag

SEQ ID NO: 70360 - DNA, 153 bp, Glycine max
  Peptide Sequence Number=SeqID_162045
atgaagtcgctgagaggaaaggagatcacgttagtgaaattgcagtggggacccgatgagggtgattcaacctgggagttagaggatagggtatattgggggaaagatacgcgggttaggctgattaaggaagagaaatccataactggatag

SEQ ID NO: 70361 - DNA, 465 bp, Glycine max
  Peptide Sequence Number=SeqID_162046
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtggggatccgggcgatccggggggggaccaccacggctccctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 70362 - DNA, 303 bp, Glycine max
  Peptide Sequence Number=SeqID_162047
atggcttcctatggtggatgtgtgaaaaaaggcacaacacaggccatccagaaacaaaacactgcccctcacatgttgtctcgtgggggttatgaatatctagaaatcaagttgatggaggagaagaaaaagaaaaaagtggaggaagttgctcaatctggaagcattgacaccgtgattgatcccctatctcccatcagacgacatgtgaagtggaagatggcccacatcatgaaaactagccaaatgacgtctgaggcagcaaaggaaattgctgacaagattgattcgttggaggagtaa

SEQ ID NO: 70363 - DNA, 243 bp, Glycine max
  Peptide Sequence Number=SeqID_162048
atgatcatgaggggtcaagacatctatagttggcaagaagaggctacttcttctccttcctcaagtggaagtgagggtgatgccaagggtaataagcatattgaagaggtttacccctatgaagaagagcatattttgttgggtagaccatggaaatttgacaagaaagcaatccacaatgataaaataaccctcacccatggaagcaaaaagttcaaacttgttcccttgacaccttcataa

SEQ ID NO: 70364 - DNA, 794 bp, Glycine max
  Peptide Sequence Number=SeqID_162049
attcgttgacatcaattggtgagtctgtttcccttcaagatcaacttgatgtgattcttgaaggtcttcctaatgaatttgaaagtctcgtaaccctaatcaactcaaagatcgaatggttcgatttagaggaaattagggcccttcttctggctcatgagcagcgattggacaaggcgcgtatcactgaagaagctacatccctcaattttactcaatctcagccaaattcaaaaacccccaattctgtgaaccctaattctgcgacagaaacccagattgctcctcaagccaattggacaactggaaactcaaattcaggcaactacgactctcaaaacgacaatttcaagaacaacaatcaatctagaggccgtggaggaagaaatggtcgtggcaatcgtggtggtcgtgggggtcgttccactgttcagtgtcaagtctgtcatcgcacaggccatgatgcttcctactgttatcacaggtttaatgctgcttatggaagtaatcaaccttatgttcatggcaacccttatcagtatgtaaggaacactacaccaaataacaacaattgggctcaaagtaaccctcagtggcagaaagcagcacctcaggccaacttcactggatatgcacctcagaccaatttcactggttatgccatgcaccctaccatgaacaacaatcttgacacaactgctactcagcatgttactctcatgcaacctcctccaggctctgctcctcctccttctcaccttgagcacatattccttggcaatggtcaaggctag

SEQ ID NO: 70365 - DNA, 555 bp, Glycine max
  Peptide Sequence Number=SeqID_162050
atggcaggggacgagggggttattaggaagcaaggacaacaatcccatagtgacaggcaacaacaaatcgaagccaagctagatcaagtcgacacctttgcaaaaggcggcggggggagaggcaaggagtcgatcccgagcaagatgacccaatggtgccaactgggacatcgtgaaagtcttgatagacgaaggcagcttgatggacatcctatttttgtccactttttaaaggggcatgtcctcatagacgatgacacctcttacaatgttctgataagcaaatcattgttgaatgctctaggcataatcgtttcaatgcctcatctcgcaatgaagttccccaaccataagggcaaaatagtcactatcaaagtggaccaggtgttgcaccaagctagaccgatcttgacccaaggaaagatgaggaagacaggaggcatacatcaaccgagtaattatctttattccaactgggcaaggcattgcaccaatgcacctggatgggggaaaaactcaacaaacaccttcaaaaaaggattgaagacatgttga

SEQ ID NO: 70366 - DNA, 719 bp, Glycine max
  Peptide Sequence Number=SeqID_162051
atggctacatcacccagctctcctcctcctcctccttctggtgcagcatcacagtcgccatctatcttgaagtggacaagaaacgtcacacggttaagatcattggtgactagaccagttggggtagagataccgctggtccatgtcgatcctgtgaccgggaaggccgacggtccccacagtaagaagttaagaacatatttggggatcgttgctcgtgataagaaatgggcacttgcagccgacaaggaaagtgtcgatgacactgtatgccaaaagtacaacattagcaaggagaaatgggtccaattttgtcagagccgcagagacccttcatgggaggatgtgcggaaaaaggcacagacaaagaaaaaactagaggaaactgctcaatccagaagcactgacaccgtgattggtcctccttctcccatcagacgacacgtcaaatggaagatgccctgcacgaagaaaactgaccagatgatatttgaggtagcaaagcaaattgctgacaagattgattcgttggaggagcaagcatcacagggttcctttgtcacccatggacgtcaagatgtactgactgctgtcattgggcgaccagaacaccagggttgtgtgcatgctgctggagccggtgtgacgatcaagcaatactttgaaccgactccaaggacctcccgcacgccttcctctatggctcccaaagacctaga

SEQ ID NO: 70367 - DNA, 141 bp, Glycine max
  Peptide Sequence Number=SeqID_162052
atggttaaagcacgtcaaaagggggaaatagggaaaaagagggagttggttgtcgcccaactcgcccaggcgagctgggttgcttccaccagaaggcaccgccttctgttggaacaccctggaaggttcaagtgggcctag

SEQ ID NO: 70368 - DNA, 237 bp, Glycine max
  Peptide Sequence Number=SeqID_162053
atggctaagcagatgtcctttgctggacgggcatcgagttggaggggttttgggagtgggccgaaaagcttggatgatgttgggcatactggtaagcatcatgaggggcgtgctgggatttcggccaagtacgagccgagtcgctctgaatcttctattgcttgtaccggtaggggcaacatagtcaaactttccccttttcaagcctacttcaatcctttcgcccgcaaatactag

SEQ ID NO: 70369 - DNA, 150 bp, Glycine max
  Peptide Sequence Number=SeqID_162054
atggctaccattgcattattgagaagatatgggaggtggtgtttggtatcggatatgcagcaagcgggttttgtggcagatttaggggtggcctttgtggatgattgggtgttcatggctgatagggtggtgggtaatgagaaggattga

SEQ ID NO: 70370 - DNA, 231 bp, Glycine max
  Peptide Sequence Number=SeqID_162055
atgaaaaattgcagaaatacaagtagtggggatgtctcctccacctctaggacctcacaatcactcacaaactcatctcaagctctcaggacggcttccttttcaagctctggaggctttgttcgtgctcatgcgcttagtgcaactctgatccgctcagttcacattagtgaatatcggcttagcatgtgcgtttctcgctcagcggatggactgaagcggtgcgcttag

SEQ ID NO: 70371 - DNA, 197 bp, Glycine max
  Peptide Sequence Number=SeqID_162056
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctcttagaagcctatgagaactccaagatttacaagtag

SEQ ID NO: 70372 - DNA, 607 bp, Glycine max
  Peptide Sequence Number=SeqID_162057
atgcctttcatcacatggggtttcagtgaccctaatgcaaggatatttcaaggagtccgcaaagcatggagcacagtgcaaagaaaagatatggaacttaggggaagcagcaatgggatcatcggtggctatcacaagtggctgaaagctcagacgcaagagttagtttggctcccgaagctaaaggcatcaagtgaggaagaggctgaaacccctaaggagagtgaggaggtgcaagccttgaaagcgaaacttgaaaaggccaacagcgagcttaagcttcgaagggccgagagagaccagtcaagagtcgaaggcatgatattggaagacaagttgaaggcttaccaaaggtcaaagaggagtttgtccgaacaattgagcaagacgaaagagaatatgtgggccatcattgaccaatacaaagagcagctaagtctagctgtaacccatgaacaaaggctagaggagaagtatgcgaaggtatcgatcttgtttgctttcaccttgaatgggagtcaagagcttccaagactactagccaaagccaaggcgatggcagacgtatactcggcccccgaggaagttcatggcctcctcgattatt

SEQ ID NO: 70373 - DNA, 417 bp, Glycine max
  Peptide Sequence Number=SeqID_162058
atgaacactcacctggttcaagatggcgtagaccaactggcacttcagcaagggaagatcaaaattatgatcgctggggaggatgttgctgagaaacagtgtcatccagatccgtgccagggtggtcatgctagtgcgcatgatccgcacctgtctccccgtcacactccgtgtgaagtcttgtcctggaacgcacagcagctggcctatggcctcctcatcaaatcccgaggcctagctccttctctgactgaactcgcaacgttgcccctcttccaagaccaacgaatgccccaaaaactgattaatggcatcttcatcaaaggggacccattggacccgcacccaggagcgcttatccctcactccttcctctgtggaccatgcattagcatagaattgcatgcctatttctga

SEQ ID NO: 70374 - DNA, 339 bp, Glycine max
  Peptide Sequence Number=SeqID_162059
atgttgggacatggattcgagcccagaatgggtttcggctggaacgataatggagttgcaattttggtagagttcacagggaacctcagaaggtttggactgggatatgagcctacgcgcaccgacgtgaggaggattgccctagaaaggaggggaagaagcatgggccggccgcaagagctgcaagtgaaaggggttcccttgtgtcaaatcgacgagagctttgtcagcacgggttggatgtgcgagggatgggtcaccatgatacacaaagaaacccctcaagagcaaccaaattgggtgcggccatgtcctccagagttcgaactgcgaaactag

SEQ ID NO: 70375 - DNA, 801 bp, Glycine max
  Peptide Sequence Number=SeqID_162060
atgtcgcgggggtcaggagaccttgggggcgtcaggtggggtgctattgcccaaaaccaagcttggccaatcccgacccaactcgggcatagtcagtcagtgagaacctgtgacgtacctaagcaggagagctcctggcagtcaaccaataaaagaacaaaagtccacaaagcaaggaggcttgtgtggtggctggccagctatctagtttgtgtcatatctgaaaaatcccctctgggtctaaaaattgaaacaggacattcagtagcctctgttaatcgattaccaatggtgtgtaatcgattacagtgttatatgctattggtaatcgattaccaattgtgtgtaatcgattacacggtgtcatatgctactgagaggaaatcccttgaaaaagacattttgactatgcgtagccgttatgggacgcattgtattggtacctatatcgcgatggcagcgcaattgatccatgatcgcgttgtgatggagtgcctagagggtgtttgggagaccctcgaaggcaatgagaggtgccgatttcgtggcacaattcgactcactactacttcactagtacatccggagcaatccgcacgcacacttcagcagcctgtggagtggatactacctacacctactccatatcgactagttgagccgattcaagtgatagaggtgtcatcctctgaagaggatcttgaagaggtcccagaggagttacctcctgaacctgctgtggatgcccctgacttcccagaggaagatgaggacccactccctgatgttgattctccatag

SEQ ID NO: 70376 - DNA, 747 bp, Glycine max
  Peptide Sequence Number=SeqID_162061
atgggtccttccttcttcatttcctcccctatttatagcaaaataggggaggtggttgccgcccagctcgcccaggcgagctcagctcgcccaggcgagcagggttgcttcctccagaagcaaccgccttctggaggaatcttctggagggcccaaatgggcctgggggaagcaaaaaggtggctacactcctttaagggtaatagcttgcggacttgggaagatgtcgtagaaaagttcctaaagaaatactttccagagccaaagactgctaaaaggacttggccctccatcaatttcttgatgaatccctcagcgaagcgcttgaccgtttccatggactactcagaaagacgcctacacatggatagaggccctaacagaaaccctcagcaagcttccacaacaactacaagcggtaagtccttctcactcttcagttatgcagatagggggatgccacatatgtggaggagcacacgagccaggataatgtatatagtccaagaagatccttccagggacgtgaattacatgggaatacagaatcgccacggattccaaggctacaaccaaggaggaccgccgagattcaatcaagggaggaacttcacacaaggctcaagttggaggaaccatctgggaaatcaattcaacaaggagcaaagaattcagccagcccagaatctcaaccaaggggtagatcttcatgagaaaaccaaagagcttgaggagacactgaactag

SEQ ID NO: 70377 - DNA, 1426 bp, Glycine max
  Peptide Sequence Number=SeqID_162062
atgaatatcaaaaacaaggttatgactgcgccaaaagaagattcgaatggatgggatctggcgcatcttgtgggacagctgatcgatcatcgctggatcatcgtggcggtcaccgctttctttatgctgatggcaacgctctacacactgtttgctacgccaatctatagcgcggacgctatggtgcaggtggagcagaaaaacaccgcctcggtgctgaacgaattacaggatgtgattccgaccacgccagcatcagacaccgagattcagatcatcgaatcccgcatggtgattggtaaaaccgttaacgacctcggtctggacaccgtcattcagcaaaactacttcccggtgatcggtaaaggtctgtcgcgcctgatgggaaacaagccggcgcagattgccatttcacgcctggaaattccgcgcagcatcgacaaacgcaccgttgagctggaagtcaccggtccgcagacctataccgtgagcaaagacggcgacgagctgttcaaaggccgcgtgggtcagctggagcagcacggcgacgtcaccatgctggttagcggcattcaggctgacgaaggcaccagcttcagcgttaccaagctgagcgacctgcaggcgattaaaactgtgctgggcgcgctgaccgtcgccgataaaggcaaaaccaccggcgtgctgggcctggagttccaggatgaagatcaggagcaggcgagccgcgtgctgaaccagatcgtcaacaattatctgctgcagaacgttgagcgcaagtctgagcaggcggagaagagcctcgaattcctgcgcacccagctgcctaacgtgcgtgccaaactggacgatgcggaagacaagctgaacaccttccgtcgtcagaacgagtcggtggacatgtcgctggaagccaaatcggcgctcgactcgtccgttagcgtccagagccagctgaacgagctgaccttccgtgaagccgaagtttcccagctgttcaccaaagaccacccgacgtaccgcgcgctgctggaaaaacgcaaaacgctggaagcggaacaggcgcagctgaacaagaaaatctcggccatgccgcagacccaacaggagattctgcgtctgacgcgtgatgtgcaggccggtcaggaaatctacatgcagctgctgaaccgtcagcaggaactgggcatcagcaaggccagcaccgtgggtgatgtgcgcatcattgaccgtgctgaaaccagcaccagcccggtagcaccgaagaaactgctgattattgtcgcgggtctgattgttggtctgatgctgtcggttggtctggtgctgctgaaagcgctgttccaccacggtatcgacaacccggagcagctggaagagctgggcatgaacgtctacgccagcgtcccgctctccgaatggcagc

SEQ ID NO: 70378 - DNA, 347 bp, Glycine max
  Peptide Sequence Number=SeqID_162063
ccgaggcgcttccgaaacgtttccgtaacgttttccgtgaggaatctcgcaaaggtttcaaccgttcttcgacgttcttcattcgaccgaagccattagaagagaatgagcatgtgattatgactgaaaatgttagtcagtttgttagattgattgtgaaggaatgcattaatcgtatcctgactgaatgcatgaaattgaggatgatgaaggccatgtttgattgtgatagccacttagccaaaaagctgaccatgtgcttgaatgaattatcgcttgagagcatcatccacaggaaacgcggttcaaagcaaatttgtcctaaatttgggggagtaattattaag

SEQ ID NO: 70379 - DNA, 129 bp, Glycine max
  Peptide Sequence Number=SeqID_162064
atggccgctcctatgaacactgcttgctatctagataaagatgaaattgatcagtcaatagacataaagaaatatagagatatcaagcaaatcccaaagaatctcaccttagtgccgttaaaagaataa

SEQ ID NO: 70380 - DNA, 312 bp, Glycine max
  Peptide Sequence Number=SeqID_162065
atgtgtgtaaatcgcttccaggccatcaggggatggtcattccacagggagaggcgtgtccaactcagggaagatgagtacacggacttccaggaggagatagctcgtaggcattggacacctctagtgactcccatggccaagtttgaccctgagatagtcctagagttctacgctattgcctggcccacagaggagggagttcgggacatgcgctcatgggtgaggggtgatgtgaacctgactaggagtggatcgcttgatacaggcaacgaggatttggatgacgccacttccggtgaagaaagataa

SEQ ID NO: 70381 - DNA, 161 bp, Glycine max
  Peptide Sequence Number=SeqID_162066
atggcagaatcgtcgaagaagcgaaagggatcatcctccaccaccgctgctgctggccatcgccgccacggaccacctgaagcacccacaacatttattcatccttccttatcatctccaagatcatccactctgttttcttctgatgatcaacgtctacg

SEQ ID NO: 70382 - DNA, 159 bp, Glycine max
  Peptide Sequence Number=SeqID_162067
atgacacgtgttgcaaggtgtttggtagttgtgcatgccggtacgttaagccatagtactccggctaaagtgccagcgaaaagaaggggaggccaaacaaaagaaagaaaaagggtaaacaacctaggttcaagaaagcacaaaacacatcaaaattaa

SEQ ID NO: 70383 - DNA, 1674 bp, Glycine max
  Peptide Sequence Number=SeqID_162068
atgtcgatgacgatggttatggaggaagatgaagaagacgtagaaatagagcacgtgtttattgctcatgaaattgacctcgattacgagttcgacgctgcaaggttcttcgatttcactcgcccggagactccctcggaagctcacgaagcccaactctggtttcaaaatgccgctggttaccctccttcgccttttgtgagaaggctgctagtggcgagagaggatttgttcttggaagatgttagcgattcgcccaagtccgaacacgtggaatgcgcgagtaatgttgtggatgatgaaaaatctagtgttccgttagggattggattttcggacacggcttttgagaattgtggtatggctcaacaagtttactttgtagaatgccgtttactagttctgttgagttttctccgtcttcatgcaactcacgttctcactgaaagtccaaaaacacttggtgaaaatatctctggcttgttggctggaattcaacaaaatgatggtacaaggtccctacaagtacctacaggacttacctttggcagtaagacaatcagcaacaatttgaattctaaggctaagtctgctgtaccaaagagttcaacactaatgaaacctactgctagtcaattggccaagcaaaatcgcccttctaaaaacatcggttcaagatttcagaagctactaactcggaatgaacataatttatctatctcttctggggtagaaagtcaagctgccaagcggcaaaaattagagggcggtctcttgtgtaagttcctagtttctgatgtgaagcagcaaaccaattttttccacaaggcaccaatgatggctgtcgctgttgagcaaaactctgcatgttcgaagctgaagcttactaatccaagggagcctgaccttagaacagcacgtagaggacaaaggataagacccaaaaatgttagagaggcagagcatgtgacagttccggctcccagattcaaagctcgcccattaaataggaagattcttgaggctccttcattgctacctcacaaaaggagcactccaagattgcctgaatttcaagaatttcacttgaagactttggagagggcaatgcaacacacatctgctatgtcatcttcacttcactatgatgattctgataagggttgggacaagcatactactgtttctgctttagaaaatagaatcaaggatttaagaagacctgctgctgctgctgctgcaccaactgatgatggattgggttttactcatatttttaaagctcagtctcttaataagaagatacttccaagtaaaggaaatggtggtgttttccataacagcaaacatgaaacaacagtcccaatggaatctgatttgcagactgaaaaggaggttcagcatgaccccccaattgaactcttcagcaagttgtctctgacatctgaaggccagccaaacaatggatctcatttcaaactgcctcagcattctgggatgtgtagaaagctgacacatgatgcaggagaaggcttttatgttaagggcaaaccaaacttctcgagggaatggcagttgcatcagtttgatgggtgcaaggaggagctggggaattcggtgacaaaaaaacgagggaaaatgtgcaacctgcttagttatggacatcagacttga

SEQ ID NO: 70384 - DNA, 1038 bp, Glycine max
  Peptide Sequence Number=SeqID_162069
atgagagttccaacagtgctagttttaccatttccaggtgtagggcatgtgaatcccatgatgagcctctcacaaaagttggttgagcgtggatgcagagtcatttttgtgaactcagacttcaaccacaagcgagtgatgagttccatggtgtatgagcaacaaggtagccttgatgataaatcactaatgaagttggtctcgatccccgatggtttaggacccgatgacgacagaatggatcccggagcactatatgatgctgttgtaagaactatgcctacgacacttgagaagctcttagagaatactcatgaggatggtgacaacagaattggcttcattgttgcagatttggccatgctatgggcgttggagcttattgatgatgggatcataaattctgatgaatggtggctttgtaacaccacatatgaacttgaacctggggtattcacttttgctccaaagatcctcccaattggcccattgttgaatacaaataatgcaactgcaagatcattaggaaaatttcatgaagaagatctctcatgcatgagttggctcgatcaacagcctcattgttctgtcacatatgttgcctttggaagtatcagtctttttgaccaaaaccaattcaatgaactagctcttgcactagaccttgccaatggaccttttctttgggttgtgcgtcaagacaataagatggcatacccttatgaattccaaggacaaaaaggtaagatagttggatgggcacctcaacagaaagttctaagtcaccctgccatagcatgcttttttagccattgtggttggaattcaaccatagaaggcttgtctagtgttgggttgggattgaattcaaatgaaagtggatttgtgtcaaggttggagattcgaaacaaattggaccaactacttagtgatgagaacatacgatcaaggtctttgaagctaaaggaggagttaatgaacaacaaagggctatcttcagataacctcaacaagtttgtcaagtggcttaaagaataa

SEQ ID NO: 70385 - DNA, 339 bp, Glycine max
  Peptide Sequence Number=SeqID_162070
atgacgatgatgagagaagggtcacgagaaactcgtggattgaggaatgaggtttcaatttggaagaatgagaacgtgaaattggcagctactttttatgtttctgtttcggttttctctcttttctttcttcacacgcagcacccagataaggaatgtaacgataacgtagcttctgttatgtgcgattttttgtttgagaggagagagaaagatatagtgacattcggaaccgacatctcgccaatgtttgaatgccatccaattgaagttcgacacgtggtcgtgaggtggcaccgttcttatgtggtaggcagtgtgaggaatcaagcacagtaa

SEQ ID NO: 70386 - DNA, 1683 bp, Glycine max
  Peptide Sequence Number=SeqID_162071
atgacttatcgcctagcactaatctttgtgaagattcttgtagacacagggcatgagccagaggatatggaaacaggtaacaaactgtgcaggtcccatgaccgttgcagctactggttattatcttccataactagctacaacatactagtaaaacacataccgaattttgctgctgcgattaatatacatttttctagaaatgctatgaaggaggaaagcatggtaaaagtaaaggaggaaattgattacaaaagtttatgtagaaggctagacagagaattggacaaactcactatggaatatgaaaggcagcagaaggtatttgaggatgatattgaaagattgaccacagaagcacaacattgcatattagaggcccaacagaattattcggattcgttggagaaggaaagattgaaataccagaaagactataaagaatcaattaagaggcttgaagagaaggcctttgttcctgctgaggaagtagtcattttgaaaaaaatacttcagagagagacccttttgagaaatgctgccgaaggggagataaatcatcttaaaaatcaaatggcagaactgaaaatgttggaggcatcaagagaatcagatatcttaaaacttcgtaagatgttggaagatgaggcacatcagaaagagaaattcaaaggagaaatagcaagattgcaaagtcaattgttgcaattaggttttgaagttggcaaaacaaagcaacaacagcaagcttcaggaaatggagagaaggcctcagttgccaagctctttgaacaaggcaggggattgcagaagattttgtcattgcttgaagcagaagctactgatgcacgaattaatgctgtgaaaatagtagcaaatttatcttctgaagccataacatctctcaaccctgatgttgcagaaacaaatcagaagaagattgtagaagcaggcggacttacgtccttgcttacactgcttaagaactcacaagatgaaaccacacagagagttgcagcaagcgccatagcaaatttggcaatgaatgaaacaaatcaagatctcattgtggctcagggaggcattaatatactgtcaatgacagcagccaatgccgaagatcctcagacccttcgaatggttgctggagcaattgctaatctttgtggcaatgattgggattctaactgcggctcagataatgcattcaatctcacgatcacactcatttttaaccttatgctgaaatataaactgcaaataaagctaaggggagaagatggtatcaaggcactgttgggaatggtcagatgcagacatcctgatgtacatattcagattgcccgcggaattgccaactttgcgaagtgcgaatcaaaagcatctacacaagggacacaggttggaaggtcattacttattgaggatggtgtgcttccatggatagtgcaaaacgcaaataatgaagtctcgttggttaggcgtcatattgagcttgcactgtgtcatttagcacaacatgaagcaaatgcaagagacatgattagtggaggtgcaatattagagttggttcgtatatcgagagattgttcacgagaagacataaggattcttgcacgtagaacactaatctccagccccgcattccaagctgaaattaagcgtttgaagatagattattga

SEQ ID NO: 70387 - DNA, 714 bp, Glycine max
  Peptide Sequence Number=SeqID_162072
atgggtgttgccgtgaatttggcgacatatttgacgggtacgatgcatttgggcagtgctaactctgccaacacggtcaccaacttcatgggaacctctttaatgctctgtttgttcggtggttttgtagctgacacttttatcggcagacgctgcatgtcagcaaacaacatgcagctaatggtgctctacatagccctctacaccacatccctcggcattggaggcttgaaatccagcgtctcaggcttcagcacggaccagttcgacgattcggacaagggagagaagaagcagatgctgaaattcttcaactggttcgtgttcttcataagcctggggacactgaccgcggtgacggttcttgtgtacattcaggatcacatagggaggtactggggatacgggataagtgtgtgtgctatgctggtggctcttctggtgttgttgtcgagcacgaggaggtaccgctacaagagactggtgggaagccctttgacgcagattgcgatggtgtttgtggcggcttggaggaagaggcacttggaattgccctctgattcatccttgttgttcaacttggatgatgtggctgatgaaagtctcagaaagaacaagcagatgttgcctcatagcaagcagtttcggtatggcttctcaccttgttatactaattatttagctgaaattaatgatatttcacacacactatga

SEQ ID NO: 70388 - DNA, 510 bp, Glycine max
  Peptide Sequence Number=SeqID_162073
atgccgtcgatcgactccggtgatggccgcaccgtgctcctctctgtggtgggactcaggtcggagccaggtgttaagctgccggcggaggccggtgcgaaagtggactatcgagcccaaagtggcggaaacacaatggatgagccatatttgggtgtagatctaggcaatgttgatgtcttggttcattttgtgggaatgaaagatgaaccatgtgaaatccacaacgtggatcctgacaaaaataaagaagagctttggcatgaacctcaactggctacacctgttgtcaatgaacctatcaataagggtataaatgagcaatctggtgagtatagttcctttgatgaacatgtagagtcaatagatggggatgtcttaagtgactttgatgaatcagtggatgccaatggagctggagttgtgcattcaaattcaaacatggaagaaatttataaggagaacaaattgcataggaaacaatttgacttggacaatgatgacaaatga

SEQ ID NO: 70389 - DNA, 237 bp, Glycine max
  Peptide Sequence Number=SeqID_162074
atgatccccgcatcgccctcccgccgaaggagcagtttctggaaaaaagtggcatggcctgaagctctgctccctctggaaatagcccctaaggttgttcctcctggacctgtaccagctaggactgagccgacattagctgaaccacaacctcctatagtagatccacctgctgctccgaaacttgagacacagtctcctcctgtagtagatccactcgaaggactttacaattag

SEQ ID NO: 70390 - DNA, 561 bp, Glycine max
  Peptide Sequence Number=SeqID_162075
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcgtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataacgttgctggaccacttctgcgctcggcccttccggctggctggtttattgctgataaatctggagccggtgagcgtgggtctcgcggtatcattgcagctactggggccagatggtaa

SEQ ID NO: 70391 - DNA, 468 bp, Glycine max
  Peptide Sequence Number=SeqID_162076
atgaagaggttcttctacgcctataagcaggttgtggcggttatgatggggagctccgaggccgataatgggttcactcagatattccttgaacccacttatttccctagcttagatgctgccaagacctttctcgcttattattgggaaaataataatcaaaatgtggaggagcagtgcttgtgtgtaggatgtggagctgtatctgaaactgctgaacaccttttcttttttaaaggtctgaactggaatggcagaaaaagagatgagggatcgttggtgatatggcagaaagaaaaaggcatacatattggttatcgcgcccttactccagcaggatcaattaatcatatctttaaaagaggacttgactatcaagctattacgatattcgcacctgccctgaagaaacaagaagtaaagcagtgtcctgtaattgggggaaagcagaagaatctaaggatataa

SEQ ID NO: 70392 - DNA, 1671 bp, Glycine max
  Peptide Sequence Number=SeqID_162077
atgacacttgagtttcgtcaggtcacagaagacgaagtggacacttatcaggcgctgatgcatgccgcctatgcgcccacgctggcgctggggatcaaatttgatgcggccaccgctgaccgcgagaaaacgctgcggcatctgcaaagccacggcgtgtatgcgctgtatgcccagggcgtgatggtctcctcggtcaccgtgcgttatccatggggcccgctgccgggtccgttcggcctgccgcatatcggctggtttggcgctcacccggactacgcggggcagcagtttggccgccaggttcaggatcgcctggagcaggaaattttacgcggccagttacgtgcaccggcagtttcgctcggcggcatcacaaggaagccaggcatgagccaactgaatgaaacagcgctgggcgagcagctgatcgcctttcgccacgaactgcaccgttttccggaactctcaaatcaggagtttgaaaccaccgcccgcctgcgccagcagctggaacagcaccagattcgcatcgttgatttgccgctgaaaaccggtctggtggcagaggtcggcccggcacagggaccgctgattgtgctgcgttcggatattgatgcgctgccgattgaggagcagtcggacgtcgcttttcgttcggagcgtcccggcgtgatgcatgcctgcggccacgattttcacgcttccgctgcactcggcgcggcgattctgcttaagcagcaggaggcaacgctgcccggccgcgtgcggattctgttccaggccgccgaagagaccggccagggcgcgccggatgtcatcgccaccggcgcgctgcaggaggcggtggcgattttcggcattcataacgatccgtcgctgccgcctggcgtggtgggtagcaaagccggtgcgctgaccgcggcggtggatcgcttcgatatccgcatcaccggcaccggcagccatgctgccaaaccgcatcagggcaacgatccgatcgttatcgcggcgcagattgtctccgcggcgcaaacgctgattagccgtaacgccccctccgctgacaacgcggtggtgtcgatcacccagctgcacagcggcagcacctggaacgtcattccggacagcgcctggctggaaggcacggtgcgcaccttctctcagtccacgcgtgagcgactggagcagcgcttccgcgaaatcgtgctcggcctcggtgcggcttttgccgcagaggttgagtttaactggcacgccggtccgcctgcggtggtgaatgatgcgcactgggcggattttgctctgcaacaggccaccgccagcggacttgaggcgcgcgtggtggaagccagcccgatcggcgaagattttgctttttatcagcaacagctgcccggcgcctttgtgatgatcggcactggcgaaccttatgcgttgcaccatccggcttttcgcatcaatgatgcggtgttgctgcccacctcacgctacctcgcacagctcgccgtggcggcgctgcgcagattttctggctgtgagctggccggtgttacagcagcaggtcccggacagcggcttaccggcgctgcgacaggtttatggcgacggcagcgtacgctcacaggcgttgctgctgggctatgccggccatgcgctggattacgatga

SEQ ID NO: 70393 - DNA, 402 bp, Glycine max
  Peptide Sequence Number=SeqID_162078
atgagcgatgcactcaaggcattgaacaatcttcgtacgctgcgtgctgaagcacgtaatattgaggttgcggtattaaacgaaatgctggagaagtttgccgtggtggtcgccgaacgtcgcgaagagacggctgcagagagtgctgcacagcgcgaaaaagaagagaagctggcgttatataaagagatgctgcgcaaagacggcattacaattaatgaactggcgcaattaaaccagggtgaaacgaagagcaaagcaaaacgtgcaccgcgtccggcgaagtataaatttaccgacgaacagggtaatgagaaattctggaccggtcagggtcgtactccctcgccgataaagtcagcgattgacgctggcggttcgctggatgattttctgatttaa

SEQ ID NO: 70394 - DNA, 807 bp, Glycine max
  Peptide Sequence Number=SeqID_162079
gataaatcacccaagcaggtgagggtgaaaggccacttaattaagtttgatgaagacgccctcaacaccttcttgaagacgattgtgatcattgaggagagggacagcctacctgcctactccagattctgtcgtctgaggccaaatccacaggaactagcagcccgattatccatccctgggaggggatttgagctaaatgaagatgggctgctcttgaagatcctgaggaagaatctgaccaccctcactcagacatggagcattctttcattctccaacctggcgcctacttctcacacttctgacataacactggacagggccaggttgctccacggcattatccagaagatggacatgaacttgaggtatattatctcaagtcagatttctatgattgcacaacatgactcctcgaggctgggtttccctgccctcatcactactttatgcaaagcctggggactcacttctgattcattatcttttgagagtctcagtccaaccattaatttggcttacatgaagaaaaactgctggaacctcgatgacccctcagtcactttcagagggcctcgcaaggccaaggggaagaggtcagagactctcccatcttctgacattcccccatcagcagctccttccactacagttctaacttcttctaccgcatctgcatctgcacccttaccagctcttattgcagctccttctacaggaccatcttcctttacttcaaagacattatatgctatgttgcagagcctacacagaggacaggtgatcatgatgcagagcttatag

SEQ ID NO: 70395 - DNA, 321 bp, Glycine max
  Peptide Sequence Number=SeqID_162080
atggcttacacccacatttcggattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagctttctcgctgcaaaattcacttcttggttggtgttttttggtttgtgctaaaggtggtgttcgtcattggaagtgcggtagacagactttgtggtag

SEQ ID NO: 70396 - DNA, 435 bp, Glycine max
  Peptide Sequence Number=SeqID_162081
atgtgcccggtacggcgctcctatgatccccctcatgtgagccttcgtagtcagccaccgggaggcacgtggggtcgtctcagcatacgcatcatcagtgacacactgatgcatcctgggaaagtgctcatatatccatgttgcagctccccaagcatagaccccagtctgacacaggtctcagaaaccctccagatgaaccacatgaacatatgttgcactcttgttagaaaaaagggtgcaatccaccaagtgaaggaggtaagcacgagctgctacaatccaccgtcaggcatgacatctactctgatagacctcccaaagccacgaaagtcgtacatatgccctatgcacccgtacgatctcagctctagcctcctcattagagaccttaagcaactccatcaacaagaagactacctcgtccacaagtag

SEQ ID NO: 70397 - DNA, 222 bp, Glycine max
  Peptide Sequence Number=SeqID_162082
atggttcagcataggttgcccttgaatcccggttgttccccagtgaaacaaaaactaagaaggatgaaacccgagatgtccttaaagataaaagaagaggtaaaaatcaatttgatgccagcttcttggcagtcgctcgatacccggaatggcttgccaacattgtgccagtccctaagaaagatgggaaggtatgaatgtgcatggactattggaatctaa

SEQ ID NO: 70398 - DNA, 87 bp, Glycine max
  Peptide Sequence Number=SeqID_162083
atgcctacaagattgacttgcctagtgagtataatatggcggagccttggatttgaggacaaatccttttcaagaaggagggagtga

SEQ ID NO: 70399 - DNA, 399 bp, Glycine max
  Peptide Sequence Number=SeqID_162084
atggggtgtcggtcactcctgccaggcttatctggccctaccacgctccggctccactgggtgtctaggaggcatgatcccaggaacacacagccgttggctgatggcttcctcgtcaaacccccaggcctggctcctcctttgactaaactcatagcgttggccctcctccaagaccaatggatgccccaaaaattgattaatgggatcctcatcaaaagggatccattggcccctcacccaggagcacttgtctttgactccctcttctgtgggctatgcgttggcgtagaactccatgactatccttggatcatacttagccatgggtgccgcaagttgagtccattgcctcctggcaatttcctcctagaatttggcatactctctttcccttaa

SEQ ID NO: 70400 - DNA, 309 bp, Glycine max
  Peptide Sequence Number=SeqID_162085
tattgcacgcctagacaagcgcagggtgatgcaccgcaggctgcggacgcaccgccaccacctcatcaggctgatccagctgggtcatttggcatggagcggtatttacagcacttgagccaaggtttcgctccttttgcgtgccctactttagatcagttcagggctgaggttgcatggcccggagattggcctgaggcccaggcaggggaggtgcctgcagaggctcccggcgatgcagatgaggcccacatggatgaggagatgtcggatttactcggtttcttgggagggagtggagccacatga

SEQ ID NO: 70401 - DNA, 177 bp, Glycine max
  Peptide Sequence Number=SeqID_162086
gcttgtaatgagcttcaaaacaaagaaaggggaacataggctcaaagggactatcaaaggaattaattcaagcaagaagtatcaacaagagttaagccaaggctattgtgcaagcaatcaatgggggctaaacacaccgaataaaatagatgatgatggctcaaattctcaccaagg

SEQ ID NO: 70402 - DNA, 171 bp, Glycine max
  Peptide Sequence Number=SeqID_162087
atgcttccttttgatttcggcatgtctcggaacttcacgtattgtgcaacaaagggtgctaagtacctcgaagcggtcaaacaaacgttacatgccatgaaacaatggagcggattgcatgatacaggaaacgaagatttggatgacgccacttccggtgaaggaagataa

SEQ ID NO: 70403 - DNA, 318 bp, Glycine max
  Peptide Sequence Number=SeqID_162088
agacaggcccagggggatgctccgcaggccgcagacgtgccgccacctcatcaggctggtccagccggattgtttgatacggagcagtatttgcggcatttggttcgccagcaagtggccaaccaccgggcacatagccagggctttacttcttttccgtgccctactccggaccagttcagggcagaggtcgcgtggcctggagattggcctgaggcccgggcaggagaggcaccagcagaggctcccaacgaggcagatgaggcccgcgaggacgaggagatgaccgatttcttaggaggaagcggggccacatga

SEQ ID NO: 70404 - DNA, 279 bp, Glycine max
  Peptide Sequence Number=SeqID_162089
atgctgaaaccacttcagtttcaagccaaaagaagagaaggtcaagcagctggtgtctcgctaagcgagacatatgcgcttagcgagtggcatccgctaagcgaggcactcagctcgcttagcgtgttggaaaatcctagaagaggatcagtcaaatatgtgctcgctcaacgcgctacaagctcgttcagcgagtcgtttgtctcttctcgcgctcagcgcgcccagcttgctaagccaaaattcacttgctcgcgcttagcgagccaatctcgctaa

SEQ ID NO: 70405 - DNA, 456 bp, Glycine max
  Peptide Sequence Number=SeqID_162090
atggcttgcacccgcattccggatttacacgcgattcaaatttcagtcagcccgcatcaattggaccttgcaccttacgctttgaggtcatacagtgctcaatggaatgccccggggctcctccatgatatgcacatgttgtgttcaagacgtatcctcggaaaaatggagacaggctttgtggttaatttagggatggcctttatggataattgggtggtggggaatttcatgtgtctcccccacggtttaagagacatgtgcatgatcagtttggggttgttggctctcaatgggtataggagcggagttattgacattctcattaggagtgtacgccacattgggtggcgtatagttgagaggcaagccatatggtgggaaggcgtgctcgttttgaatttgcacatcatgggggccgcccgtacttcccaaagctttgcctaccatatctga

SEQ ID NO: 70406 - DNA, 251 bp, Glycine max
  Peptide Sequence Number=SeqID_162091
agcatgatggctcttgggtgaaaaagggtgctcgacctgttgatgaagaaggacatggtggagaagattcctctcttcttcaaaagattttggataggttcgatggtcttcaaacctttgttggtgaaaggtttgatactttggagttacactttaatgagatggagtcaagaatcaccagggtcgaagaagatgtttcttatattcgtacaagctttgatctaccaccaccgccgccaccatcatcttag

SEQ ID NO: 70407 - DNA, 357 bp, Glycine max
  Peptide Sequence Number=SeqID_162092
atggcggcccgggtgatgttggggaatggctacgagcccggaatgggtttaggcaagaacaacggcagcaaaaccagcctggctcaagtcgccacgatatgcgaggatgaccccccgaggggatcggttttggtatggccatgtcctcttggcttccgactaggaaattggcgagtggaggaatgcccagacgtttacgcaacaagcataatatctgatgatgagtccctcgaaggtactaatacccgggacccggccatcgatttcaagcaagaagcgagtcagacagagagtgaagaggacgaggatgtgggacttcccccagagttggagaggatagtcgctcaggaggactga

SEQ ID NO: 70408 - DNA, 398 bp, Glycine max
  Peptide Sequence Number=SeqID_162093
atggtaccaactgttgaagagtttgaggagatattaggatgccctcttgggggaaggaaaccgtatcttttctccgggtttcttccctccttgagtaagattgcagttgtggtcggagattcggcaaaagagttggatcgcatgaagcaaactcggaatggcgtagtaggcctgccacggaaatacttggaaggcaaggcaagggatatggcaagccaagagaaatgggtcccattttcggatatactagttttgctgatctttggggttgtcctctttccgaacgtggacagtttggtggacctagccgtgattgatgctttccttgcatatcaccacagcaaggagagtccaatggtggctatcttggcagacttatttgatacctttgaccgaag

SEQ ID NO: 70409 - DNA, 806 bp, Glycine max
  Peptide Sequence Number=SeqID_162094
gcagcaggctggcgcagataccgaccggtattgccccggtactgcccacgcccgctcagctgcagcgtgatttgctgggcggtgaagcggcgctgtgggcggagaacgtgaatagccgggtgattgatacgcgactgtggccgcgcgcctttgtggtggcggagcggctgtggtcggcgcaggatgtgaccgacagcgagaatatgtaccagcggctcagcgcgattgatcgctgggggacggtgtcagtcggcctgcagcagcatcagcaggccgaggtgcagatgatgcggctggccaacagcagcgatatcactccgctgcgcgtgctggcggaggtgctggaaccggcgcagtattacacccgccagcacctgaagtttcaggccgggcattatgactatttcgagccgctgaaccggctggcggacgtgctgccggccgagagcgagccggtgcggctgctggataaacaggtggatgcgctgattgctaatcgcggcgatcatgctgccgccagcgccctgcgccatcagctgcagcgctggcagcgcaacagcgatgcggtgatgccgctggtgctgggtaactatcagctgaaagcgctgcagccgcaggtgcgccaggtcgcagagctgagccggatggggctggatctggtgaacgcactggagcgcaaccaggcctatggcgcaggcgaggtggcgcagatgcacgcccggctggatgcggcggcgcaggtgcaggatgaaacggtgctggcgctggtgcgaccgctggagaaactgctgcgatcgtcgagatag

SEQ ID NO: 70410 - DNA, 309 bp, Glycine max
  Peptide Sequence Number=SeqID_162095
atggggcgtaatgatctgatcaaaatcgaaaatacttttctgaccgatgatcagatcaatcagctggcagtatacgcgccgcacgccacggtgaatcgcattgatgagtatgaagtggtggcgaagatcgcaccgacgctgccggaacgcatcgagcgcgtgctgacctgtcccaacggcaactgcatcagccgcagcgagccggtgttctccagctttgcggtgaagcagcgcgatgacgatgtgcacctgaagtgtaaatactgcgagaaagagttcgcgcgccacgtggtgctcggtcactggtaa

SEQ ID NO: 70411 - DNA, 105 bp, Glycine max
  Peptide Sequence Number=SeqID_162096
atgaaggttgccgaagtggcaaagattttccacattcaaagtcttcgaagactgggtgaagacggaggaaatcgatcaacagtggaaagggacggctctaggtag

SEQ ID NO: 70412 - DNA, 1038 bp, Glycine max
  Peptide Sequence Number=SeqID_162097
atggccgatgccgatgtgattgcgcgccagcagtttgtcgccgccgtcagtccggagatcatcgccacgcagcccattcgttacctggctaacgcctccaaaacttcagtttccggcgtaggcgtcgactattttcgcattcagggcattaagctggtggaaggcagcaacttcagcgatgagcggcacgcgcgccaggaaatcatcattgatatcaacacgcgcaataaattatttggcgaacagggcccgagcccgattggcaaaatgattgtgctgggatcggtgccggtgcgtgttattggcgtggccaataatgaagatggtctgtcgcccaaccgtctcagcgtctggctgccgtggagcacggtgatgtatcgcattagcggccagaccgcgctcaccagtatcagtattaaactcaaagatgatgtggtgagcggtgcggcggtggaatcgctcacccagttgctgacggcgcgccacggcaccaaagatttcctgatgttcaaccgggacaagtatcgtaaagcgatagaaggtgcggcggccacgctgacgctgctaattttactggtggcttcgattgcgctcatgatcggcagtattggcgtaatgaacatcatgctggtgtcggtgaccgaacgcacccacgagatcggcgtgcgcatggcggtgggcgcgcgccgcagcgacatcctgcagcagtttgatcgaatcggtgctggtctgcctgctcggtggtgtactcggcatcggcgtggcccttgcgttgggcgcggctctggagctggccgatgcgggcttcagcctggtgttctccgtcaactcgattctggccgccttcgcctgttccagcctgatcggcgttggcttcggattcctgccggcacaacgtgccgcacggctcgatccggtggaggcactggtccaatagccaatgcatctacctgtattgacagcaggttcgcgcaatgtccgcagtgtgtactacggctaccgagaatgtccgcacaggagctggacgatgtttcttag

SEQ ID NO: 70413 - DNA, 1015 bp, Glycine max
  Peptide Sequence Number=SeqID_162098
ctgcaaccaccaccgctgcgcctgcaaaagcggtacaccacaagaaacatcataaagccgctaaaccagctgctgagcaaaaagcgcaagcggctaaaaagcaccacaaaaaagccgtaaaacaagacgcgactaagccagctgtagagcagaaagcgcaggccgctaaaaagcaccacaaaaaagcgaccaaaccggctgtagaacagaaagcgcaggctgctaaaaagcatcacaaaaaagcagtaaaacacgaagctgctaaaccagctgcacagccagctgccgcgaaagagctaaagacgctttttttcggtcatgacgaccgcacacgcgtcgccgatcccacccaggccccctgggatgctataggtcagctggaaaccgccagcggtaacttatgtaccgccacgttgatcaccccgcagcttgccctgacggcaggccactgtctgttaacgccgccaaacggcaagccggataaagcggttgccttgcgctttgtgtcgcaaaaagggacctggcgctatgaaatccacggcattgaaggccgggtggatccctctctcggcaaacgcctgaaaccggatggtgacggctggattgtgccacccggcgccgcttcatgggactttggcctgatcgttttacgctacccgccttcaggtattacgccactgccgttatttgacggtgataaagccgcccttaccgccgcgctgaaagccgccgaccgcaaggtgacgcaatcaggctatcctgtcgatcatctggatacgctttacacgcacaccgactgcattgtgaccggctgggcgcaaaccagcgtactctctcaccagtgcgatacgttaccaggcgatagcggctcaccgctgatgttgaaaacggaaaacggctggcagttgatcggtgttcagagctcagccccggcggcgaaagaccgctggcgtgcagataaccgggccctgtccgtcaccggttttcgcgaccagctggaagcgctggcgcagca

SEQ ID NO: 70414 - DNA, 282 bp, Glycine max
  Peptide Sequence Number=SeqID_162099
atgcagcgcggaggagaggccggtatagccgccgcccaccacgcacacgtcacagctgatcgactcgttaagcgtcgggaaaggctccagggcaatccagatggttttcagttcagtaaatttttcaagcgcgtgcagggacttatcgcgaccgttgccgctctgcttatagccgccaaaggggacggtcatatcaccgtcgttatagttattgacgaagaccgagcctgctttcaggcggcggctcatgcgatgcgcgcgggagagatcgcgggtccatag

SEQ ID NO: 70415 - DNA, 141 bp, Glycine max
  Peptide Sequence Number=SeqID_162100
atggaagttgagcttcaggccatgctacctgctcaagaaaatgctccaaagggtctaatgtttgtgagtgttggagatctagtcctatggcaactgactgaggagctgggatggatgatgaagggatgtcatcggttctag

SEQ ID NO: 70416 - DNA, 345 bp, Glycine max
  Peptide Sequence Number=SeqID_162101
aaaagttcttgaagaagtactttcctgaatcgaagactgcagaaggcaaagctgccatctcttccttccaccagttttcaaatgaatcgttgagtgaggcacttgaaagattcagaggtttattgcgaaagactcctactcacgctgggagtaagatcaaaatgaaaacccttgacgaagcaatggacttaattgaaagcatggatgctagtgacattgccattttgagagaccgagcccgtattcctaccaagaagagtttattggagctaacctcacaggacactctgttagcacaaaacaagttgttgtccaagaaactagagacactaacagaaacactca

SEQ ID NO: 70417 - DNA, 276 bp, Glycine max
  Peptide Sequence Number=SeqID_162102
atgcctgtcaatgatcacaccattctacgtgatagaatgcatcaacccactaagaagagtttactggagttatcatcacaagacgctgtgttggcacaaaataagttgctctctaggaaacttgagatcttgatagaaaccctgagttgtaccatatgtggtggtactcatgaatccggcctttgcattccttttgaagagcaaatgcaagaggttagctacatggggaatcaacaaaggcagggatacaatcaaggtggattctcaggtttctag

SEQ ID NO: 70418 - DNA, 336 bp, Glycine max
  Peptide Sequence Number=SeqID_162103
atgaagcttcccagatatggagagctaaatcctctactggttcttccttctttaccaagtaacacaagttcccctagagttcgatactcggttcttaccgttttatactacttgatcacctatctaggcccattaggaagcttcaacatgaagcaaccagctcgcctaggcgaactgggcggcaacctcctcccctattttagctataaaagggcgtgggaggctgaagggaagggtttcagcacccttagtgagcaaattccactgaaattggtgagaagaagaagcaaaaagaggaaaaatcaaggccgaggcgcttccgtaacacttctatga

SEQ ID NO: 70419 - DNA, 467 bp, Glycine max
  Peptide Sequence Number=SeqID_162104
atggcagattgtttccgtaatgatgttgctggcagctgtattcagattcacaaaaaagatgagtggatctggaaaatagaccctactagacaatattcggagaatgaagcacatgtatttttgacatgtgatagaatacttccattatggtgggaatctatgacatgggtcaacattcatggagcttttccgcagaaaccgtggcagcacttttcccagcacgcgttctgtttgcctagtagaattcgtcttaaccgatggagaagttggtggctggccctcacatggacattgtggcagcaccggaataaaatcatcttctctaatcaaacttttgatggtaacaagttaatggaggatgttatttttacactatggacatggttgaagaactttgacaaggactttgccttcacctatagctattggtcgtctaacatagcatcgggatttgtcttttcaggggg

SEQ ID NO: 70420 - DNA, 168 bp, Glycine max
  Peptide Sequence Number=SeqID_162105
atgaattatgaatcgtcagattttcatcagacggttcttatcatccaactgggtaaatgtgtgacttctccgactacaaggaatccaggtttgagtgaacccttttatccacatgtagtcgtgttcatgccaaaagaaatcaaatccatctcatctgatggagggtga

SEQ ID NO: 70421 - DNA, 504 bp, Glycine max
  Peptide Sequence Number=SeqID_162106
atggaaataagtattgcaaggtctcatctcgaaacacagggaatattcttttcaaatatttcaagaacaataggatgggaaagcattaggaaacttccatgtaatgtggctgcccagggttcaagacgggattttcacagattggcctcttcctgtcaagcttttactgcagtgtatcctagaaggtcttttatctgtagagcaaattctatgccaattagtttacaggaatctgcatcatatggagataattctattgaggatgaggatccatatacagacttggaagaggaagctttggcaaaaccacctaccagtgaacagataatgacattgcttgctgacacacagagagcaaaactcactaagaagcttagtgaggccaaccagcaaaaccggttcctaaaaagacagcatctttttaagtatgatattgataggttgcatcgggtcaatgccaatagagtgaaagccgccttagacattggctctaaaaggaggtga

SEQ ID NO: 70422 - DNA, 396 bp, Glycine max
  Peptide Sequence Number=SeqID_162107
atgttgctcataaatttgtttaccaatatttgttacatattcattctaagaaaaggaataggcctgaacacaaaagattacacaactttgttggatgatgatgatgatgctgggaatgagagggtgtttgaggatgaaaatgatgatggccttccttgggatgtagtttttgaggcttcgggaatcggacaaccaatgacatatactaggcaaaggattcaaaagagaaagaaaccccttagtgttgaagatgttgcacctaagacaaaaagaggtcaaagaagggtgagggctcaagggctcgaggtcgaaggtgagggtcttgagagaaagggaggtcgtgagagtgaggctgacgcgaagctaccgccgtggagggaggttgtgagggactga

SEQ ID NO: 70423 - DNA, 378 bp, Glycine max
  Peptide Sequence Number=SeqID_162108
atggaattagaattggtgatttggaatagggtcataggaaaggaaaatggggttgtggagtttcaagtgagagagagttttaaaagaatgaaggtccggggcaggggcaggggcatgaaagagaagagccgtggccacaccgtaatccgaagaaagatgcccatgatagagtacagctcgtgcatagagcagacaccatacactagaaaatcaggtgcccgtacgcttcatcgattgagagtcttggggacccagaatgatcctgggctccaccttttctacaatcacctcttccctcacgcgcctctttttctcttctttcttaatcctagtaatcattccacggattcaagaattatgccttcaccattacattag

SEQ ID NO: 70424 - DNA, 1497 bp, Glycine max
  Peptide Sequence Number=SeqID_162109
atggccaagcactttcttctgcttctttttgcagtatatgttgccgctattgatgaagaaccttttataggggtgaatattggtagagatctctcagacatgcctcaccccactcaagtagtagcactacttaaagcccagcaaattcgacatgttaggctgtatgatgccgaccaagctatgctcattgctcttgcaaacacaagaattcaagttgctgtgtctgtccctaatcaagagatccttgcaattggtcaatcaaataccacagctgcgaaatgggtttcccataatgtgatagcacattaccctgccactaacataactactatttgtgttggttctgatgtcttaactaccctcccctatgcagcaaaagtgcttgtcagtgcccttaagttcattcactcagccctcgtggcatccaatcttgatcaccaaatcaaagtctcaacacccctttcctcttccatgatccttgattcatttccaccttcacaagccttcttcaaccgctcactgaatccagtcttggttccaatgcttgatttcttgcaaaccactggctcttatctcatgctcaacatctacccttactatgactacatgcagtcgaatggtgtgattccattggactatgcactcttcaaacccctccctccaaacaaagaagccattgattccaattcccttctccactactccaatgtgtttgatgctgcggttgatgctgcatacgttgccatggcttttctaaattacactaacattcgtgtggtggtgacagaaacaggctggccctcaaaaggtgactctaatgagcctgatgcaacagtggaaaatgcaaacacttacaacagcaatttgatcaagcatgtgcttaacataaccgggactccgaaacaccccggaattggtgttagtacttacatctatgagctctacaatgaggatgcaaaggcagggccattgtcagagaagaactggggtttgtttgatgcaaatggtaaacctgtttatgttttgcacttgacagaatcaggaggagtgttggcaaatgacaccaccaatcaaacttactgtgttgcaaaggatggtgctgatcctaagatgctgcaggctggaatagattgggcatgtggacctggcaaggtggattgctctcctttgctgcaaggacaaccatgttatgaaccagacaatgtggtggcacatgcaaattatgcttttgacacttactatcatcagatgggaaagtctcctcagtcttgtgatttcaatggcatggctacaatctccaccaccaatccaagtcatggatcctgtgtatttccaggaagtcttggcaacaatggcaccttccccaacgtcacgttatcatcaatgaattccacaaattcagattcttctgcctgcaatctccatagtggtgaattgggaattagaagccttctaatggtgatagtacttctactatggggagtggctttgctataa

SEQ ID NO: 70425 - DNA, 429 bp, Glycine max
  Peptide Sequence Number=SeqID_162110
atgtctccagaatgtgctatgatgggtgtcatctcaactaaaaccgatgtttatagctttggcatcctattgctagagattctaagtggaaagaagaataataattatcatccattcaatcttgttgcttatgcatggaaattaaggagtgaaggcgaagctttaaagctaatggacacaactttggatgggtcatactctcctaccaaagtgatacggtacattcttatcgatctcctatgcacacaagatcaagcaagggatagacctactatgcttgaggttgtttcgtttctttcaaatgaaagtgctcatttaccaccacctaaacaaccaggattttgtatcattagagttatggaagagatagagaagcacaacagttgttccataaatgagataacaaattcattgacatccggtagataa

SEQ ID NO: 70426 - DNA, 222 bp, Glycine max
  Peptide Sequence Number=SeqID_162111
atggaaggtgttcggaaggatttagcacttccaaatgtggtggacgattcaagcggcaaggatgactccagcaagcggcaatggcttcttcatttgcccttgtggccgcaatggccgcccttaaggcttctgactccatgggaggagaagacggagttcaactttgtgattgagggtgtgctgagcaatgcgggaatcacaatgattaaggattgcggttaa

SEQ ID NO: 70427 - DNA, 1089 bp, Glycine max
  Peptide Sequence Number=SeqID_162112
atggcttttgtgagcctaaaggaggtggttgaaaaccagaaacagaaaattattgatgtggaggataataatcttttgaaagctgactgcaagagcgaactcaacaaatccttaaaaattgttatgaagatggttaagaaggaagctatgctggataaggaatgtcagaaagaactaaaacagattaaagttctgaactctaaaatgagtcgtgacattgaatgtattaagaaagagaacgagaagattacaaaggaacttgaagagagcaaagcactgcaaaaaaaatttacacagcaaaatgggctgatcatgaaggaattaggagaaagtagagcactcaatgatatgcaacataaaaatttcactgaagagattcgaaagaatgtaatgcaaattggctcccttcaggtggctctgaagctaaagaaagataataatgtttcagcattggataaagaactaaaggttgaaaatgaacgactcaatgccaaagtgattcagctggaaaaacaattagaaagcattcaagagctagaattggagaatcaacaacttaaagagaaattagatgtgatgaagcacatggaagatgaatttctgaatatggttggtgctttacatatgaatgtagtggaaaaggagcggtcacttagagactcagaagatttcaaccagtcactgatcattaaagagcgtgagatcaatgatgagcttcaaaaagctcgaaagacattgattaagggcattgcggagatatcaagtcttgatggcaatattgatgtgaaacaaatgggacaaatagacacagagccttttgttaaggctttgacagggaggagaagatataataaagaggaagcagagcaaatagctttggagacatgttcattatggcaaaaggatctgggagacccccattggtatccattcaaaatagtcacaattggtgggaaatcaaaggaaattataaatgacgaagatggaaggctaaaaagattgaaaaaggaaatgggtgttggagcatataaagcggtcgtggcagctctgatagaaatgaatgaatacaatccaagtgggaggttcatg

SEQ ID NO: 70428 - DNA, 903 bp, Glycine max
  Peptide Sequence Number=SeqID_162113
atgacgaaccatagttatgtggaggaggctctgagtaaacagaacgaagctattgtgagagttgagaaagacattcaaaaccacattcaaaattctttagatatggagcatatgcatagtgagaaggctactattatgagcaaactcattcccgagctagttgagaacattgagtccatgcaaagaagtgtgccagaaatggaaaacaagtataaagaatcgttgaacataatcaagaagctgacgagcgagggagataccaagcatgaggaatgtcacaaagaagtacaacagttgaaggtcatgaactctattataagtcatgaaatggaatgtatgaaaaaagagcatgagcagatcagcatggaactgaaggagaataaggccataagtgatctgcagcagaagaactttactgaggtgattcaaaagaatgtaatggaaataagctctcttcagtttgctgctctgaagcaacaagatgagtatgagaatgtattgaagctggctgaagtgctaaaggagaagaatgaacaactcaatgcaccaccagcatcagtcccagcaccctctggcacctccatgcagagctcagacgttctagtgctgatgctgcagagcctctaccatggcttatgcctgctgatgcagaatatccatgacttggctcagcatcgaccgattatgagcatggaggcattcatggcccaggtggcctggccaggagtccagttttttcctttggggggaggtgaggctcctacagcccaagagccgcagccagaagcgtatccagagtcggaggtcacaccagaggctactccacagatttctcctgctgccacacctctagtggaggtcttcgaggatgaggatgatttttatcttgatttttatgattaa

SEQ ID NO: 70429 - DNA, 813 bp, Glycine max
  Peptide Sequence Number=SeqID_162114
atgtcaacaagtgattacgagttaataaagatcgagacgtttgttcttaaaacacagatgaactgtcaaggatgcatgaacaaagggggggtctgttctgtgttggatgccgccatttgcatcagcggttcaggtggtgccgccactaactgtggcaagaaagggctgacgtggctggtgctgccagcaccaactgcggcaccagcgagacacttgacaacccgccaatgccaatggcgggacattatgcaagaagagagaggagtcgtattgcacagagagaaaactgggtgttttgagataataatgctgaggaagaggaacagcggcacacgctgtaccgcaattgatgttggcggcacccagccacgtgtctgtaaagtagacattaatgcagaagagcaaacggcaattgtcacaggcattgtcaacccatccactttggtccagaagttggccaaatttggcaagcatgcagagatatgggatgcaggatacaacggtgatcagaacaataaccaagctcaattaataaataatcacagtgactatgaaaatcagtatatgattcccccctttggcgaaaatcactggggaccccaatggggttttaatgctggcttagagaatagtgaaactatttatgctggcttagagaaccaagaatgggcacgtaacttccctggagagtcatcaactagcaaatatggtcatcaaccatctcctatggccaacatacatgaatatcatcatgaattccatccatcaaatatgatgcagttttcttcccatatcatggacctgaacaattaa

SEQ ID NO: 70430 - DNA, 183 bp, Glycine max
  Peptide Sequence Number=SeqID_162115
atgctgagggcctccctaggtgttagactagggcatgccaccaaatgctggcccctcagtggcatatccggggtaaagctcgaagtcgatcagagcatggtcctggggttgctggcgttcaaggggaacaagagcagagtggtcagcattctcgtcgagcacatgtacaacattgggtggtag

SEQ ID NO: 70431 - DNA, 1484 bp, Glycine max
  Peptide Sequence Number=SeqID_162116
gaattggatcgtcgaatgcgtaacggcgagctggcggtagcgatagaaatcccgccgaactttggccgcgatatcgctcgcggaacgccggtgcaaataggcgtgtgggtggacggcgcaatgccaaatcgcgcggaaacggtgcgcggatacgtacaggcgatgcatctggcctggctgcaggagatggccgggcagcaaagtagcccgaatcgtgatacttcgctcatttccatagagacccgctatcgctataacccggacgtgaagagcctgccggccatcgtcccggcggtgatcccgctgctgctgatgatgatcccggcgatgctcagcgcgctgagcgtagtgcgtgaaaaagagctcggttcgatcatcaacctgtacgtgacgccgaccacccgcagcgagttcctgctcggcaaacagctgccttacatcgtgttggggatgtttaacttctttctactatgcgctttatcggtcttcgtatttggcgtcgcgcataagggcagtttcctgaccctcaccctggcggctctgctgtatgtcaccatcgccaccgggctgggattgctgatctcgacatttatgaagagccaaatcgccgctattttcggtaccgcgattattactctgattccggccacccagttctccgggatgatcgatccggtggcatctctggaggggccaggtcgctggatcggacaaatctacccgaccagtcatttcctgaccatcgcccgcggcaccttctccaaggcgctgaatatagcgatttgtggcctgctcggcgataaagcgatgctggcgctgattgtgtttgcttttaccgtgtcggtttactcctcggccacggtaatgcccggctctctgcacctggcgcctatcgccattgccgatatggataaatcacagctctcatcgcggatcattaacggcttttatcggccgtggtttttaacgccggagttgatcagcgccgatgaaatggatgccgggctggatgcgggacgatacacattcgccatcaatattccgccaaacttccagcgcgatgtgctggccggtcgtcagccggaggtgcaggtcaacgtcgacgccacgcgaatgagccaggcctttaccggcaacggctatatccagaatattatcagcggtgaagtgaacagctttgtcgcccgttatcgcgacaacagtgcgcttccggtagagctggcggtgaggatgcgctttaaccctaaccttgagcaagagcgcttcggcgcggtgatggcgattattaacaacatcaccatgctggcaattgtcctcaccggctcagcgcttatccgcgagcgagagcacggcaccattgagcacctgcttgtgatgccggtaacgccgtttgagataatgatggccaagatctggtcgatgggtctggtggtactggttgtctccgggctgtcgctactgctgatggtacaggagttttgcag

SEQ ID NO: 70432 - DNA, 729 bp, Glycine max
  Peptide Sequence Number=SeqID_162117
atgccctcacctttagaggactatacgtcctcgccttcagaggacaacatgtcccggccttcagaaggctgcacgccttcaccattagaggactacacgtcctcgccttctgaggacttcacaggactacacgtcctcgcctttagagggctacatgccctcacctttagaggactgtacatcctcgccttcagaggacaacatgtccccgccttcagaaggctgcatgccttcaccttcagaggactacacgtcctggccattagagggctgcacgcactcgccatcggaggactacacgtcctcgccatcagaggagtacacgtcctcgccattagagggttgcacgcccctgccatcagagaactacacgtccttgccatcagagggctgcacgccctcaccttcagaggactacacgtcctcgcctttagaggactacacgtccttgccaatagaggactacacgtcctcgcctttagagggctacacaccctcgccttcagagggctacatgccctcaccttcagaggactacgcgccctaaccttcagagggctacacgtcctcgccaacagaggactacatgtcctcaccttcagaggactacacgtccttgccattagaggactacacgtcctcaccacccgaggacttcacgtcctcaaaggacttcacgttgttcgatcaagtggggggttgaataaattattactagacctttactaa

SEQ ID NO: 70433 - DNA, 264 bp, Glycine max
  Peptide Sequence Number=SeqID_162118
atgactctcggcaacggatatctcggctcttgcatcgatgaagaacgtagcgaaatgcgatacttgccacgctcgagaccaatcacgtgcgagccggtcagttctggacccatcgacgaccctttgcgtgcacgcacgctcccaacgagacctcaggtcaggcggggctacccgctgagtttaagcatatcaataagcggaggaaaagaaactaacaaggattcccttagtaacggcgagcgaaccgggaaaagcccaccatga

SEQ ID NO: 70434 - DNA, 252 bp, Glycine max
  Peptide Sequence Number=SeqID_162119
acttatcaaggtaatccttgtggcgtctacccggacttatcttccttcaccggaagtggcgtctacccagacttatcttcctccactggaagtggcgtctacccagacttatcttccttcactggaagtggcgtctacccagacttatcttccttcatcggaagtggcgtctaccctgacttatcttccttcactggaagtggcgtcaaccaaaaactctacagcctgtatcaagcgatccgtgccccgtaa

SEQ ID NO: 70435 - DNA, 376 bp, Glycine max
  Peptide Sequence Number=SeqID_162120
atggctctgaagaaactctccacgaagaggtctagaagagacgtcccaggagaaggatccagtgctgccccagattttgatagtcatcatttccgaagtgtcgagcaccagcagtgcttcgaggccatcaatggatggtcgttccacggggagaggcgtgtccagctcagggaggatgagtatacgaactttcaggaggagatagctcgtagacgttggacaccgctagtgactcccatggccaagtttgaccctgagatagtcctagagttctatgctaatgctttgcccacggaggagggagttcgggacatgcactcgtgggtacggggtcagtggattcccttcgatgccgatgccctcagccagttcctag

SEQ ID NO: 70436 - DNA, 252 bp, Glycine max
  Peptide Sequence Number=SeqID_162121
atgtatgttgttgttcaagaaaaagaaaagctaagtgcggaaaggcaattgagcttagctcatcagttggctaagcgtgcatccatcgctaagcgtagcttcagtgcgcttagcgcagtagaagaatctggcagggcatcaatatcaaggccgcatgctaagcacgagatcagtgcgctaagcgcagcagttgtcttcagccaggctcaacgcatgactggcgctatgctcaaatccacttactcgcgctaa

SEQ ID NO: 70437 - DNA, 415 bp, Glycine max
  Peptide Sequence Number=SeqID_162122
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagaactataaagataccagggcgtttccccctggcggctcccctcgtgcgctctcctgttcctgcttttcggtttaccggggtcattccgctgttatggccgc

SEQ ID NO: 70438 - DNA, 1044 bp, Glycine max
  Peptide Sequence Number=SeqID_162123
atggcgctcttgtcctgtcaggaaaagcgggaggccgccgccgaggcgccgcgaccggtgctctcggtggtggttgaggaaaagtcggcggatgcgctgcagctcaccggaacggtggaatcgcgcattcagacggatctcggttttcgcgtcctcgggcggatcatagcgcggaacgtcgatgtcgccgatctggtcaagaagggcgatgtggtggcctcgatcgatccgctcgcgcttgaactgtcggtgaagagcgcgcagtcggatctttccaatgccgaagcgcagctcgccaatgccgtgaccaccgaacagcgccagcgtgtgctggcggaggcgcgtagcggcaccgaggcggcgctggaggaagcccaacaggcgacgcgcaccgccaacgcctccgtcgccaaggcccgtgcaaacctggacaaggcggaagaacagctgggttacgcgcagctccatgcggaattcgacggtgttgtcacggccacatcgggtgaaatcggccaggttgtttccgccggccagacggtcgtcaccatcgcccgcccggaagtgcgcgatgtagtggtggatgttccgcaatttgcggcgcagcgtctggatatcggctcgaccttcgagatcgccctgcagctcgatccaaaaatccgaaccaccggcgtggtgcgggaaatcgccccggcagccgaaacggcaacgcgcacacgacggaccaagatcagtctgcaggatgcgccggcggcattccgcctcggttccgtcgtcacggcttccgtgcttgctgcttccgaaccgcggatcatgctgccggcatcggccctgctgaaaacggagggcggctggtccgtctggatcgttaatgccgacacggcgaccgtcacggcgcgcccggtcacgatagagggtgaacctgccgaaggcggcagcgtgcgcatcaccggcggcgtcaaacccggcgagcgcgttgccagcgccggcgttcacaagcttaaggatggacaggccatcaggatcgatcaggaggtccgtcagtga

SEQ ID NO: 70439 - DNA, 363 bp, Glycine max
  Peptide Sequence Number=SeqID_162124
atgcttccatttgatttccggtgtgtcacggaaacttacggattgtgcatcaatatatttttggtttttcggcatgtcctggaatttcacaaattgcctaatgatggatgccaagcacctcacaaggaccaaagaaaggtcgcatgtcatcaagcaaagaggatacatctacttagggattgttatactgagaacaagagagggtacatctcttgtggatcagttcaagtggagggtacatccacttggtttttcaaagagaacaagggacggtacatcccttgtggatctttgacttgtaaaggattttacaaggttgaaagaaatctcaagaaccataggttgcttggggactggatgtag

SEQ ID NO: 70440 - DNA, 396 bp, Glycine max
  Peptide Sequence Number=SeqID_162125
atggagatagaggaagaactcaagaatattacaaaaggtgatccacctcaacgggagagaagtgaaaaaattgccataaagaaaaagttcaagaaaatggcacaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 70441 - DNA, 219 bp, Glycine max
  Peptide Sequence Number=SeqID_162126
atggatccaacaactatgctcagaatgatgcatgcacctgacctcaactctcagatgcaatgcgtatttgttgaggccacccagtcgtacaccgtaactccccacctccttggtgatcagcctgggccacaaaggagtttcctaccaggtgacacaccccctagtacaaagtacatactgccacagtttatactatttcccgtgtcatatgtggcatga

SEQ ID NO: 70442 - DNA, 129 bp, Glycine max
  Peptide Sequence Number=SeqID_162127
atgacttacctcgggttttctactggaggaaaaaactggaatttctcacttcccatatcattttcctcagatgaatttcaaacttccagagttcctaattcaagaagacctaagataggtatgccttga

SEQ ID NO: 70443 - DNA, 219 bp, Glycine max
  Peptide Sequence Number=SeqID_162128
atggctacaccacccagctctcctcctcctcctactggtgtagcatcagagtcgccacagaaagaagctgaatctgatatccctgaagcatctgatctgaggacaaaaaagaaaatacttcagactgaaagtgtcgatgacattgtatgcgaaaagtacgacattagcaaggagaagtgggcccaactttgtcagacccgcagagacccttcgtgggag

SEQ ID NO: 70444 - DNA, 450 bp, Glycine max
  Peptide Sequence Number=SeqID_162129
atgctggtgcgcataatccacacccgcctccccgcagcggtctgggcaaagtcttgcacaacagctgggcgatcgcctcctcgtcaaagccggaggcctgcgcagaactctaggactatctcagggtcgaacttggccatgggagtcactagagtactcatcctctacgtgctatctccggtgactgttgaactccgtagaggcgctggagctttccccatgggcgtccctcctgtacctctttgtggagagcttcttcggagccatctcttgttggggatgaataacaacgcaaaatggaatcaaaaaacgttgagaaatgggggtgctcgcccaggcgagctaacctcgcccaggcaagctaaccctggcctcctcaacatgcgaagccagtcacaggatgatgatctactgaccatcagcctagtgcctgctcgtacccgtccctga

SEQ ID NO: 70445 - DNA, 619 bp, Glycine max
  Peptide Sequence Number=SeqID_162130
catcttcagagagctgcatgccctcgcctttagagggctgcacgccctcgccttcatagggttacatgtcctcgccttcaaaggaatacacctcctcgccattagaggggtacacgtcctcatcttaagaggactacatgcccttacattcagaggattacgcctcctctccattagagggatacacgtcctcacctttagaggactacacgtcctcaccttaagagggctacaagccctcgccttcgtagggctacacgcccaagccttcagaggactacacgtcctcgccatcagagggctacacgtgctcgccttaagagggctacacgtcctcaccttcaaaggactacacaccctcacttttagaggacaacacgtcctcgcctttagagggatacacgtcctcacttgtagaggactacacgtcatcccctttagagggatacaagccctcgcgtccatagggctacacgccctcacctttagaggactacacatactcgcctttagagggctacacggcctccccttcaaatggctacacaggactacatgtcccaatcttcagagggctgcatgccctccccttcatagggctgcacgcgctcgcctttag

SEQ ID NO: 70446 - DNA, 411 bp, Glycine max
  Peptide Sequence Number=SeqID_162131
atgattaatgacgtcatctccccggaatttgatgagaacggccgcgcgatgcgccgtatccgcagttttgtccgccgccaggggcggctgaccaaaggccagcagcacgcgctggagaactattggccggtgatgggcgtggagtatcaggctgacgctgtcgatctcgccgcgctgttcggtcgcgaagcgccgacggtgctggagatcggttttggcatgggcgcctcgctggtgaccatggcgggcaacaacccgcagcagaactttttagggattgaggtgcactcgccgggcgtgggcgcctgcctggccgacgcccacgaggcgaagctgagcaacctgcgcgtgatgtgccacgacgcggttgaggtgctggaaaacatgatcccggacggctcgctggacatg

SEQ ID NO: 70447 - DNA, 2052 bp, Glycine max
  Peptide Sequence Number=SeqID_162132
tccgtttatccgctgttcgcctcgctcgatgtgaatgccaaaatccatgaaggagagagcggtcggcggctgtgggcggagtgcgtggagctgggtatcgaagcgcgtaaagcgatactagcgcagtgtaaattattgcggccatttgtgccgccgctggtcggcgggaaaccgtggcaggagcattcgacggcgactatcgccagcgaacgtcgcttctttagcttcgagccgggcgcgagctggcacggctttagcggttatgctgacaatcaatactttgtcgatccgtgtaagctgctgctgaccacgccgggcatcgatgccgatagcggcgactatactgagtttggcatccctgcaaccatcctggcgcactatctgcgcgaaaacggcattgtgccggagaagtgcgatctcaactcgattttgttcctgctgacgccggcggaaagcgcggaaaaactggcgcgactggtggcgatgctggcccagttcgaacagcatatcgaagcggattcgccgctcgccgaggtactgccgactatttacaacaaataccctgttcgctaccgcgattacagcattcgccggctgtgtcaggagatgcacgatctgtacgtcagcttcgacgttaaacagctgcaaaaggagatgttccgccaggatcatttcccgccggtggtgatgaacccgcaggacgccaacgtggagtttatccgcgataacgtcgagctggtgccgatcggccaggcggaagggcgcatcgcggcggaaggggccttgcctgtggggcggcgcggtgcagcgttacttcctggcgctggaagagggcatcaaccgcctgccgggcttctcgccggagttgcagggggtctacatcgagaaaaaagatcacggctggaagcgcatcttcggctatatgatcaagccatagaaaaagggccggttcgcaccggcccttctcatttatccacgcggaacgcgttactttctgcggtagctcttctgcgcggtattcactttcaccagatagcggcgcgactcggcggccgggtgcttggtggtcagcgtctgatacacgtcgcccggctgcatggcgttgatgatgcccaccgcgcgcgttctgtcgctggagaacacccgcagcacgctgccggcgccgccgttgtaggcggtgatcaccgcatagcggcgcgaggtcgggttctgaatgccgcccaggtagttgttctgcaggatcgccaggtaggcggtgccggtgtcgatgttgttctccggatcgaacaggtagctgcggctcggggtgccccacttgccgcgcatctggaacacatccttgccggcggtgtgctgcatcacctgcatcaggcccagcgcgtccgaaccgctcaccgcatacgggttgaagctcgattcggtctgcatgatagccaggatcagcgactcgtccacgccgtatttttccgacgccttgcgcaccatcggcagatatttgtgcgcacgtttgtccaggtggttcggcaccagctggatggtgaccgagtagatcacgtgcaggccggaggtgcgtttttgcagcttggtctgcagcaggtaatcggcgaagtgcgccgcgcgccattcccagcggatcggcgcgcccttgttatccagcacctggccgtacaggaacggttctttgctgatctggatatcgttggcgtcggaatagagatcgatggagccaggatcgtcacccatcagcagcgtgctgatgatcgcctggcgcaggtgcgcggccggatcggtggtggcgatggtctcgatggtaatggcgccggtgtcgaagttgatgtggctgcgggtttggtattggtcggtatatttgacgtagtctttcggcccggcgatcagaacttcgttcagaccccagatgttctcgatgttgtgggcgaattggcccatcagaatgtcgaagccgttggtatctttaatccaggcttcgttgatttcttcactttttttgccggaacaggagatcagcaaaggcgctattacgagcaaagctaa

SEQ ID NO: 70448 - DNA, 425 bp, Glycine max
  Peptide Sequence Number=SeqID_162133
gcggtgccgcaatggcgttattgattgttttcactccacatgcccgggcagaggataacctgtattttcatggcgagctggtggcggaaccctgcgtgatcccgcctggcagtgaaattgtcccgctcgattttggcaccgtgatagataaatacctttatagctatcaacgtacgttacccattccattggccattcagctggcggagtgcgatctgagtctggggcaatccctgacggtaacttttgtcggtagcgaaaacggcagcttaccaggctatttagcgttggataccggcagccaggccagaggcgttgcaatcggcttagagagtatggaaggtgagccgcttgctctacaaagcagaaccattgttcgtggggattttagtgctgctgtcacctttaacctggaatatgaatag

SEQ ID NO: 70449 - DNA, 50 bp, Glycine max
  Peptide Sequence Number=SeqID_162134
atggccgactctggtgacaaaaactttctcttgtatgatattcacgaacg

SEQ ID NO: 70450 - DNA, 550 bp, Glycine max
  Peptide Sequence Number=SeqID_162135
tattggatctatgagcatttcccatcagttggtttcgccttagctgccaaggattatgatgaaaggagaccgcgtgcatgccaatggacctctggcaaggcactgcccgtgttgacttatcgcatgcgtctgaacagactaacccctgacgtagtgtgctggatttcatatgatgaccaccattcatttagagaatttgagactattctgccacatcctactatgccttcggtttttgttgaagaaatggatgatagatggatgcagttcggtgactacattgcacctttaggggatcctcctagagtttcgtcggttcagcaatatgacacatttgttgaaccagatgtgcatcagcaaccggtgggggcagcggcacctgatggagcagacgttgatgtgcatcatcctggacatgcagtggtagcaattgctgataagttggagaggcttctgaacctgaggatcctgaccgaaggaacagaagcctatactattgctgaagaatgtttgagcatcgcaagaagttacataagtcagccaactgtag

SEQ ID NO: 70451 - DNA, 330 bp, Glycine max
  Peptide Sequence Number=SeqID_162136
atggatataaagagaaaaggaatagcactcagagcctcatcatcggttattcaagaagaaagtgacaaagaggacttgactgaaacagaagaagatgatgatgatttcagactctttgtgaaaaggttcaataaacttatgagaaacaaaagaaataaaaggaaatcaaacatcaatacaaagaagaaagaagaagactcctccttagccccatcatgctatgaaagtaatcaacctgggcacatgagatccgattatcttgtctttgaaagaagaattgaaaaatccgacaagaggaatctcaaagaaaagaaagaaaagaaaacatag

SEQ ID NO: 70452 - DNA, 700 bp, Glycine max
  Peptide Sequence Number=SeqID_162137
atggctccaaaacagattttcgcaaagagatctaggaaggacgccgcggctgaagggaccagtgccgcccccgagtttgatagccaccatttcagggacgatgagtacaccgattttcaagagaagatagctcgcagacattggatgccgctggctactcccatggctaagtttgaccctgaggtagtcctggagttttacgctaatgtttggcccatagaagagggagtgtgggacatgcggtcatgggtgaggggtcagtggattccctttgacgcagatgccctcagccagctcctgggtgacccgctagtggccgatgggttcgacgaagaggccattgcccagctattatgcataccgggtcaggatttcgctcgaaccgctgcagggaggcgggtgcggatcatgcgcaccagcatgaccaccttaacccagatgtggatgacattgctgctcagcaatgtcttgcctactgatcataactttgaccttcctctgccgaagtgtcagctagtgtatgccatcctgacacggatgagcgtccatgtggctcagttgattgctgacgccatctatttatttgcaggtatgccacccaccaggcaccttctagacccggataagtctaacagggccctggggtttccagcattgatcacgggcctctgccagttattcggggttcccgtcacaccta

SEQ ID NO: 70453 - DNA, 273 bp, Glycine max
  Peptide Sequence Number=SeqID_162138
gcgggggtaccgtatggttatctgcacctttcatcaaccaagggcaaacgagcccgctgacacgcagactaacatcgtcttctgcacctttggtcatccagggacagcgagtcaggtggcaggcagagataccttatggtcgcccgcacctttcgtcaaccaaggcgaacgagttcgacggtatcaggatgatacattcaagcccgacgatgcacgagattcctctctgctgggcagggacgatcaagttcaatagcgtgtggaaacgtcttg

SEQ ID NO: 70454 - DNA, 204 bp, Glycine max
  Peptide Sequence Number=SeqID_162139
atgtccaatccaggccaacaatatatcgagacgctcaaaattaaacaatggaagctctcgagaaagtcaaatggtcataatttttcacttggatgtccgattcaggcgcataatatatcgagatgctcaaaattaaacatggaagcactaggcaaattcaaacggcaatatcttttgactcggatgtccgactcaggccaataa

SEQ ID NO: 70455 - DNA, 536 bp, Glycine max
  Peptide Sequence Number=SeqID_162140
ggcgcgagagaaggagagtgacagacaaagacagaagaaatgagagatggagcgaaacagacacggcgaggacgagtgtgaagcagtatcgaaacacggcgaggactagcacaaacagaagaactccaaacggttccccttcaaggagatggaggaacaatgactacgctaatgaagagttgctatggaggcacttcaaaaagtggggtgacgtacgtgatgtatacatcgctaaaaggctcaacaaggatggcaggagatacaggttcatgcggttcaagggagtctcggatgcaaaaggattggaggtgagactggacaacatcttcatcaacgattgtaaactatttgtcaaccttcctaggttcgacaaaccagttcggaatacagagttgcagaaaaagaaccccattgggaggaagtacaccgacgaagcaagtaagccctgcggggagacaaagaggacagctgaggctaacaccaaagaggttaacctgatcatacccatgatgatcgaaggcacaggaatcacatag

SEQ ID NO: 70456 - DNA, 300 bp, Glycine max
  Peptide Sequence Number=SeqID_162141
atgatgagcatgaagaaggtaatggaggtcaatgcggctgtagttgacgctaccaacaccgttgctgaggtggacccgactcccccatctggcctcaaccaaagaaatcatctaacctcgaatgtagtaggtcaaggaggcaaagagttgggaagtacgggcggcccccattatgtgcaaattcaaaacaagcactccttcccgccatatggcttgccccccaactatacaccacccaatatggcgcacactcctgatgagaatgtcaataactccactcccatactcattgagagctaa

SEQ ID NO: 70457 - DNA, 309 bp, Glycine max
  Peptide Sequence Number=SeqID_162142
atggcttttgcaaaaagcacaattgcggtgattctattattgttcatggtaacagcagcaatagtatgttacgctgcaagcaagggtaacactgattgtgaatttggtccaagggtgcaaggtgaatggggtgattcatcagctaccttggagaccagccaagcctcacctggtggttttcctttgcctttattgtttcccattgccattttctgtgttcttctgttcttcggttccaaatttctagttttcggggttcctatattgtttgttcttcttttagttgttgcctttttgggacttaggtag

SEQ ID NO: 70458 - DNA, 669 bp, Glycine max
  Peptide Sequence Number=SeqID_162143
atgaattttgttatgtacatgggagaaggaattatgtgcttggttaccatcacattcaaccaattatccgatcaagtgctttcctttaaacttagacatgtacttaaatttagacaacttgaattgtctggtcttggagtaaaaggtcttttccaattccaaatcagagaacatgggagcaacagagaacttgctcctttaaacttggatctaactcatgctgtattgagggatctacctgagttcgagtttatatggaaaggcaccacaaattttctaagcctccagatgcttgacatgatttatgtgaatggatgtccaaaattgaaaaccatcttttcccctaccattgttagaagcttaccaatgctgaacacattgagaataactaattgtgaggaattagagcacatatttgattcaggtgattcagaagaattcaaatgcctatatactttttcacaacaagtgtgcttcccaaatttggagtggattgaagttgaaaaccgcaacaagttgaaatgccttttttataattttgtggctggtcatttccccagtctgtctgatttggatatagcagagtgctctcaattagagaaggtttttgcttttgaacatgaagctggtgatgatggtcaagaaggaactggaaaggatggagaataa

SEQ ID NO: 70459 - DNA, 345 bp, Glycine max
  Peptide Sequence Number=SeqID_162144
atgagtgaggagaaggaagaagacgacgagtcaaagaagatgaatggggtgaggtggtgcggccaggctgttggcagtgatggctgccactatggagagaggcagcggctttggtttagattcgacgataacctttgctgctggctggtagctccatttgccgatatctgtttggtttttttaaggttcttcacttgtttggtttctgggttgtgcttaaattttctcgttgaatccagatttgttggtgaaatacaaaaacggaaaaagattctggagcatcttactcgctattggtgtttcaagctttgttgttccgcaagggaggagattctttataaataa

SEQ ID NO: 70460 - DNA, 3813 bp, Glycine max
  Peptide Sequence Number=SeqID_162145
atgggggatatcgttttttccatcgtagcaaagttagcagaatatacagtgggcccaattttacaccatgctcgatacttgtgttgtttcaacaacattgcagggaatcttccaaatgccaaggaagaattggaattaacccgaaacagtgtgaaggaacgagttgaagaagctattaagaggactgaaaaaattgaaccagcagttgagaagtggctgaaagatgttgagaaagtcttagaagaagtgcatatgcttcaaggaagaatttcggaaattgctgaacttccaggcatgaagtactattcatccaaagattttgttcttttcaaatcaacagaatcaacttataagaagcttttggaagcattaaaggataaaagcgcttgcacaattggactagttggactaggaggctcaggaaaaactactttggcaaaagaggttggtaagaaagctgaggagttaaaactttttgagaaggttgtcatggtaacagtctctcaaactccaaatattagaagcatccaagtgcaaattgctgataagttgggtttgaaatttgaggaagaatcagaggaagctagagcacaaagactatctgagacattaatcaaacacacaacccttctaatcttggatgatatatgggaaatcctagactttgaagctataggtattccatacaatgaaaataataaggggtgtagagtactcttaaccactcggagcagagacgtatgcatttctatgcaatgccaaaaaataattgagcttaatctcttagctggcaatgaagcttgggatttgttcaaattgaatacaaacataactgatgagtccccatatgcattgaaaggcgttgcaagaaaaattgtagatgaatgcaaaggattgcctattgcaattgtgacggtgggaagcacactgaagggcaaaactgttaaagagtgggaattagcattttcaagactaaaagattctgaaccactagacattccaaaaggcttaagaagtccttatgtctgtcttggattgagttatgataatttgaccaatgaattagccaagtccttgttcttgttgtgttctatatttccagaggatcatgaaattgatttggaagatttgtttcgatttggaaagggaatgggcctacctgagacttttggaacaatggagaaagcaaggagggagatgcagatagctgttagcatcctcattgattcttatttgttgttgcaggccagtaaaaaagaaagggtgaaaatgcatgacatggttcgtgatgtagccttgtggaaagcatctaaaagtggtcaagcaattttggcaagcactggaatggatccaaaaatgttggacgagaatgaaaccataaaagataagagagcaatatccttgtgggatttgaaagtggacaagcttcttattgatgatgatcaactaaattgtccaacacttgaaattctcttgtttcattcttccaaggttgactttaaagtatcaaatgcttgttttgaaaggctaaaaatgattaaaatcctggcattcttaacatctagctataatttgaggtcagggatgacatatggtaccttgtcactgccacaatcaatcgagtcattacaaaatcttcgtactctatgcttgagaggttataaattaggtgacatttcaattttggaaagcctaaaagctcttgagattcttgacttgcgtggttctacttttaaagaattgcctaatggaatcgcgttattaaagaaattgaagcttctggatttgttccgttgtataattcaggaagaaaatgcttacgaggttataggaagatgtttgcagctgaatgaattgtatttgtatataggttcatatgcatatcaggaatttccacataatttgtctttctcaagattgcagaggtatgttttaatttttgaaatgcacccaagctttgtggatagatggaatttgcatagatggatttggcatagagaatttagtgactatcagacttacatatttgaagaacatagaccaactagagttttacgcatagatggttttaatgcctcagttcaaagttttatatcattaccaatcaaggatttctttcaaaaagcagagtaccttcatttgaggcaccttgagggaggttacgaagatgtactcccatccatggatccaaaaggcatgaatcacttgattttcctattcctcaaatattgtccagagataaaatgcctctctgatagtaccaatattgatctgctgcaaactgaagatgctttctccagcctagtcattttaatgttgtctgaattggatagccttcaagaagtgtttcatgatccctcttcaagatgctctctcaaaaatttggaaaaggtaatcatagacggttgtagacaattgtacaatatttcctttcccaagaactcaaagctatgccatctcaaggacttgagaatatataattgcccgatgctaacttgtatcttcaagccatccattgtccaaactctagagctgctagaggttttgaaaatatctgactgctatgaattgaagcagataatagaagaagtggaagaagggagtgttgattatgttagcagtcaaagtcataataatacctctttgatgctcccaaaattaaggaaacttactatttctggctgtcacagcttggaatatatattccccatttgttttgctcaagggctagtaagtttggaagagctgagcattgaatactgtgataagttgaagtatgtatttggcagtgaaaaggagcatgatcttacagtgtaccagcaccagaatattcacatcaacttccttaatttggaaactctacggttgattcggttaccaaatttgaaagagttacattgcaattattgtccaagacttcctgactcttgtgtgcgtagggtgatgattattgattcagatctgcaacaagactcgactgcaacggagaaggaattactatgcttggttgccaccacttttaaccaattatccgatcaagtgctttcctctaaacttggacatgtacttaaatttagataccttcgtctccatggtcttggagtaaaaggtcttttccaattccaaatcagagaaaataagagcaacagagaacttgctcctttaaacttggatctaactcatgctgacttgtgggatctacttgagctcgagttcatatggaagggccccacaaattttctaagcctccagagtcttgacatgatttatgtgaatagatgtccaaaattgaaagtcatcttctcccctaccattgttagaagcttaccaatgctgaaacaattgagtataattgattgtgaggaattggagcatatatttgattcaggtgatgcacaaagcctatatacttgttcacaacaagtgtgcttcccaaatctcaggactattcgtgtcctaaagtgcaacaagttgcaatacctttttcataatttcgtggctggtcactttcaccgactgaactacttggaaatagaacattgttctcagttacagaaggtttttgcttttgaatgtgaaactgatgccgatggtcaagaagggattgttaaggatggagaaaaagtactactacataacctgctatgtataacactcagaagtttgccaaacttcaaagagattcaccatggattcaagttaaaagatgatgttatgcgacatgacataactgattgtcctaaatattctccaagtttatatctacacacagtcctaatttacacaagaatatatgctgctcacaaaggataa

SEQ ID NO: 70461 - DNA, 790 bp, Glycine max
  Peptide Sequence Number=SeqID_162146
atggatgatcacatgaataaagctttgcaagaaaagccaatcttaataggtcttgaggatttgtaccaaggaatccctgatgaatccgttaacctcacctttcaacacctggctgaagtgaaaacatcagataagagaaaaccaacaacaacaacaacaacaccttcacgctccatagccaaactacctagtcttgatttcaccaaaggcttgcaagcttctaatcaccaacaccatgaacactatctacaagactttggccatggtgaaccatcaccattgggtcattctggtcattttattagccatgctagtggtggtgcacaaagacaaagccctcgactcatggctggaaatgatcatttggggcatggaatgagctttgatggtgtgagtgttgcttcaggaagaggtagccgacggcgccgacccgggattcctcactctaagatttgcacaatttgcaatacctatgtttatatcttccggactagatgcctggtgtgcggcagggtttactgcaggcaatgtgtagaaagaggaatgggggagatgatagaaggaagaaagtgtattgagtgccttggattgagattcagccaaaggtacatagaaagagcagggaaggtagggtgctgtagttggaggtatccaaatacattaaaacaggctgagctcaagtgtgctgagaaaggaccaaggagaagcgtaaggcatggtcacagtgggatggcaaactcaacaagatcacgaagtcctattagccctagaaggactcataatgctattg

SEQ ID NO: 70462 - DNA, 249 bp, Glycine max
  Peptide Sequence Number=SeqID_162147
atggcagaggcactagtagttctactgaagaagatgagtgtgcaaattgagagcaagaaaaagaaggagatactagtaggggtgtgcagtgcagtgagtaatagaggtagagagagtggaaattttggatggagtattagtagtggtacggtttatctgatgagagaggttaaaaaaaagagagagaagcaagaaaaacaaaggctttctccattgtctttcaacgattcccaaacccagaaaaactaa

SEQ ID NO: 70463 - DNA, 420 bp, Glycine max
  Peptide Sequence Number=SeqID_162148
atggagagcaagagaaataccattacccttgtgaacaaaacacatcttttgtgcaatgtctcctttttcttgttcttaatttgcacactggctttttgcagtattactattgcctcctccattccatgtctagatactaggtgtcccatgcttgccaatgctgatattgattttgaggaacttaagggaaacattggacaaagcttggtgtctaaaggtaaaatagaggtcttctcaatgaacttgggcttgtccaggggaattctaagtgggcctgggtcagtgccaccgacttgtcactccaagtgttgtaagtgtacaccatgcaaaccaactctgtgctcagtgcataatgagggtggtacgtactacccactgaggtggttgtgcaagtgtggcaacaagttttacaacccatga

SEQ ID NO: 70464 - DNA, 1647 bp, Glycine max
  Peptide Sequence Number=SeqID_162149
atgggagcccttcccactaacgcttttcttgtaacaggtctatatccaacattaacaagtctacaagcattatctttgaacccttggaacatttacagcaaaatccggacccttcatgtggatattatggcttactatcaacactcaaaaagtcacagaccaggtcgtttaatctcttgggagactactccaactctgccttttgtgaagtttaacacagatggaagttcctttggaaatctgggaatagctggttttggtgtgaagagcaacggcgaacctatttccgttaagtcgcgaacgttcgttccgaaagccgcttccatgagcgcgagcaacaaatggagagcaatgtcgcaccaccagcatcagcctctgtgcacgcgcacgcaccagatcggcgccctcctcctcgtggcgaccaccttcttcttcacgagaatgctttccacctccacgctctccaccagcgtcgtccacgtgtcgcaaccccggttccagtgggggcagtcccagctatccctcaagatctacgtctaccaagaagacgaaatcgacggtttgaaggagctcttgcgcggaagggacgctaagatcacagacgaagcttgcctcaaaggccagtggggcagtcaggtgaaaatacacaagttacttctgcaatcgaaacaacggacatggaagaaggaggaagcggatttgtttttcgtcccatcttatgtgaaatgtgcgcgaatgatgggtggccttaacgacaaagaaattaacagcacctatgtcaaagtcataagtcaaatgccgtattttcgattatctggaggccgcaaccatatatttgttttccccagtggagctggtgctcatttgttcaagtcatgggcaacgtatataaaccgttccattattcttacgccagagggggatcggactgacaagagagatacaagtgcctttaatacatggaaagatataatcattccaggtaatattgatgatggtatgactaaaactggggataccacggtccagcctttgcctctgtcaaagcggaagtacttagctaattatttagggcgtgcacaaggaaaagcaggtcgtcttaagcttatagagctttcaaagcagtttcctgagaagttggaatgtccagatttgaaattcagtggacctgacaagttgggaaggaaagaatattttgaacacctacgcaattccaagttttgcctcgctccacgtggggagtcatcttggacccttcgcttctacgagtccttttttgtggaatgtgttccagttatattatcagatcaaatagaattgccattccagaatgtcatcgactatagccagatatcaataaaatggccatccagtcaaataggccccgaactattgcagtacctggaatctataccagatgaagaaatagaaaaaataatagcccgtggtcgacaagttaggtgctggtgggtgtatgcttcagattcagaatcttgttcagctatgcgtggaattatgtgggaacttcaaaggaaagtgaggcaatttcaccactcagctgaaacattttggttgcacaatggatctattgtaaacagaaacttggttgaatttcccaaatgggaactccctgtgcctttgccttga

SEQ ID NO: 70465 - DNA, 270 bp, Glycine max
  Peptide Sequence Number=SeqID_162150
atggcactttcttcttcatcttcaacatccatatttgctttagctttgttcactactcttttgcttataggaagttcttcagctcaactctctgagaacttctatgatagtaaatgtcccaaggttttctatgccgtaaaatccgttcttcaatctgctttggctaaagaacctcgccagggagcatctatcgttcgcctcttctttcatgactgctttgtcaatggtaatacttttattttgtcagctatcaagggtaataatacctaa

SEQ ID NO: 70466 - DNA, 186 bp, Glycine max
  Peptide Sequence Number=SeqID_162151
atgagtgaagcttttatatattgtcagtgttgcaggaaggctcttggagttttcaaagaaatacggcagaggatggctggagagggtggaagtagccagcggcaacaaacagtgatcaacttgatcccaggaagcatgcggatcaagttgatccgcaaacttctaaatgatcaagttgatccgtaa

SEQ ID NO: 70467 - DNA, 2922 bp, Glycine max
  Peptide Sequence Number=SeqID_162152
atgaacccttccacactcaccccttcccacacccaccgtcctctcctcctaccctctcccttctacagcagacggcatcgtttcagagtctccctccctcgctgttcctccgacgccgccgctccctctcctccgccaccgacgccgccgcagcgaccgcccaaggacctcaagggaatcgagctcctcgtcgacaagctctctccgccggccaggctcgccacctccgccgtcatcgtcgccggcgccgcggccgcaggctatggccttggctcccgcttcggaggcagccgctacgccgcgctcggtggagctgttgccctcggcgctgccggcggtgctgcggcgtacgctttgaacgcggctgctccgcaagtcgccgctgtgaatttgcacaactacgtcgcggcgttcgacgacccttcgaagctgaagaaggaagagattgaggccattgcctccaagtatggtgtgagcaagcaagatgaggcattcaaagctgagatttgtgatatatattccgagtttgtttcttctgtgcttcctcctggtggtgaggaacttaaaggtgacgaggttgataggattgtcagcttcaaaaattctttgggaattgatgacccggatgctgcctctatgcacatggagattgggaggaaaattttcaggcaaaggctggaagttggggaccgtgatgctgatgttgagcaacgtcgggcgtttcaaaagttgatatatgtgtcaaatcttgtatttggagatgcttcatctttccttctaccttggaagcgtgtattcaaggtcaccgattcccagattgaagtagctgtacgtgacaatgcgcagcgattgtttgcttccaagctgaaatcagttggcagagatattgatgcagaacaacttgttgcactaagaaaagaacaacaattatgtcgcctttctgatgagaatttgccatgtctgatcatctgtgagtttttcagtcctggagttagccaagcaattgcagagctggatagggtattggcatttaataatttactcatctcatttaagactcatccagatgtggatcgctttgcccgtggtgttggtccagtttctttagtgggtggagagtacgatggtgacaggaaaatagaggacttgaaactcctttacagggcatatgtttcagatgctttgtctggtgggcgcatggaagatgacaagcttgctgcactaaatcagttaagaaatatatttggactgggtaaacgtgaagccgaggcgatttcacttgatgttacgtcgaaggtatatcgcaaacgacttgcacaggctgttgcagatggtgagttagaaatggcagatagcaaagcagccttccttcaaaatctatgtgatgaacttcattttgatccacaaaaggccagtgaacttcatgaagaaatttatcggcaaaagcttcagaaatgtgtagctgatggggagctcaatgaggaagatgttgctgctttgttgaggttgcgtgtaatgctctgcataccgcaacagattgttgaaacagctcattcagatatatgtggcagtttgtttgaaaaggttgtgaaggaggcaatcgcatcaggggttgatggatatgatgctgaaatccagaaatcagtaagaaaagcagcacatggcctgcgacttactagggaggttgctatttctattgcgagcaaggcggtaaggaagatttttattaattacataaaacgtgcgcgggcagctggaaatcgtacagagtctgcgaaagaactgaagaagatgatagccttcaacaccttagttgtaactaatttggtggaggacattaaaggggagtcagctgatatttcaactgaagaacctgtgaaagaggacattacacaaactgacgacgaagaatgggaatcacttcagacactcaagaaaataagaccgaacaaagaacttacggaaaagttgggaaaacctggtcagacagaaattactctgaaagatgatcttcctgaaagggataggactgatctttacaagacatacttgctttattgtctaactggtgaagtgacaagggttccgttcggtgctcagatcactactaagaaggatgattctgagtatcttcttctaaatcagcttggtgggatcctgggattgagtagtcaagaaatagtggaagtgcacaggggtctagctgagcaagcttttaggcaacaggctgaggtaattttagctgatggacagttgacaaaggccagggtggagcagcttaataacctccagaagcaagtaggcttacctcaagaatatgctcagaaaataatcaagagtataaccactacaaaaatggcagctgccattgaaactgctgtaactcaagggaggctcaatatgaagcagattagggaactcaaggaagctaatgttgatttagacagtatggtatccgagaacttgagagaaaccctcttcaaaaaaactgttgatgacattttctcatccggtacaggagagtttgacaatgaggaagtatatgaaaaaatcccatcagatctcaacattaacaaagagaaggcaagaggtgttgttcatgagcttgcaaaaagtagactatctaactcattggttcaggccgtgtctctactaagacagagaaatcacaagggagtggtttcttcactcaatgacttgctggcatgtgacaaagcagtaccctcacagccagtttcatgggaagtgccagaggagcttgctgatctatacaccatatacttgaagagtgatccaactcctgagaatttgtctcgtttgcagtatctgttgggtataaatgattcaacagctgctgctcttagggagatgggagatagattactcaataccactgctgaggaagagaagtttgtattctag

SEQ ID NO: 70468 - DNA, 111 bp, Glycine max
  Peptide Sequence Number=SeqID_162153
atgattatggtggtgatagtgaagattgtagcatcaatcatggtagtgacaaacaacaatcaagatggaatacgatttagtcatggtggtggtggcagggcgacaatgtag

SEQ ID NO: 70469 - DNA, 342 bp, Glycine max
  Peptide Sequence Number=SeqID_162154
atgggactgacgaaacctgtagataggccagatcatgatgtcaatgatcccctatatctgatgacattgactatcccacagctttttctaaagttgttgcaggttatgtgggatgctaccgtgtttggggtgtttaatgacaacttcctcttgtacataaagcatgaagatctgtctaaaatagcagatgatggtaaagtggtggctggacaaaaatatagaaatgacaataactcaagctacagggctccaaatgagaacaaggttgaagatgaaaggaaggaaggaaggaattactctttccggtgtgggcaacacacaaaggttgtgaaagtcctttga

SEQ ID NO: 70470 - DNA, 213 bp, Glycine max
  Peptide Sequence Number=SeqID_162155
atggaaatcatatcgatgcaatttgagcagctcgatgtttgtggcaaagattctattgaaaacattattgatgtcaaagcggatggtggttgtggttattgtgcaatagctaccttattgggttaccatagagaagtagatgaatattacggatatgaggttttttttatgagatcattgtcctttaccaccattggcgttgttatggaatag

SEQ ID NO: 70471 - DNA, 126 bp, Glycine max
  Peptide Sequence Number=SeqID_162156
atgattccacttaaactgttacaagaacacaataagggattagaccaaacatacctacgtgaggtggcgaaggagaagaagcacagacttctgacgatgctcgagtgcgacgaacacgatgtttga

SEQ ID NO: 70472 - DNA, 318 bp, Glycine max
  Peptide Sequence Number=SeqID_162157
atgtggacaggtgctgcaagtggccagctccaagggggtctggggattaaagaaatatctaaattcaatgtagctttgctgggcaaatggatatgggccttagcttctggtcagcagtatttatgggctagaatcattaactctaaatatggaggttggacagagttccagtttggacgagagaaaaggggattttcctactggtggagggacttgaggaagctttatcatcagaaatgtggctatccaagaaatgtggctatgtcttcacttggaggctcctcaaggacaggctccctactaagggtaatctcttaa

SEQ ID NO: 70473 - DNA, 183 bp, Glycine max
  Peptide Sequence Number=SeqID_162158
atggctgaaaatggaaagttggatcagatagaggaaaggctaaaggtcattgaaggaagtggagattatgcctttgctaacctagaagagttgttcctagtacccgatatcatcacccctcccaagttcaaggtgccggactttgacaaatgggggcatacgcaaaagatgaggaactgctga

SEQ ID NO: 70474 - DNA, 639 bp, Glycine max
  Peptide Sequence Number=SeqID_162159
atgatcttcgtgccttatgtggaaagaattacaattttatccgaagagcaagagagagtcactgagccagtgtcacatggtcccacatcagagcgtcaatttcctgcacaacagtttcacatgcttcagtcaagtattgaaactcaggggatagacagaagaagggacattgttgaagcggaagaatattcccaacaaatggcggagcgtggccatggaatgtattacacgccacaaacatttgctgagtatccgacccagatgtatcaatatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaatgtaacgggacaaatacctaatacgggtgacttattcggtgttgatttgcggcacgcatttttgcggaggctgacgaagaagaagcggggaggcatcggggcagaagaaatcctgatcgccaagcacgaagatgggatcgaccatgtggcacatcctcacgacatcacggacaccaaaatgaatgatttgcatgtcttcgtttattaa

SEQ ID NO: 70475 - DNA, 357 bp, Glycine max
  Peptide Sequence Number=SeqID_162160
atggcgagacgtattctggtcgtagaagatgaagctccaattcgtgaaatggtgtgcttcgtgctcgagcaaaatggcttccagccggttgaagcggaagattatgacagcgcagtgaaccagctgaatgaaccctggcccgatctgattctgctggactggatgctgcccggcggttccggactgcagtttatcaagcacctgaagcgtgaagcgctgacccgcgacatcccggtggtgatgctgacggcgcgcggtgaagaagaggatcgcgtgcgcggtctggagaccggcgcggacgactacattaccaaaccgttttcaccgaaagagctggtggcccgcattaagccgtga

SEQ ID NO: 70476 - DNA, 279 bp, Glycine max
  Peptide Sequence Number=SeqID_162161
atggcacaacctccaccccgtgagaggaatctaaggaaaatggctgcacctgatttcacctacgaaagcttgtgcatccaataccctaatgaggatgtcccatatgttcttaaaactggactgatccatttgcttccaaagtttcatggccttgcaagtgaagacccacacaaacatctgaaagaattccatattgcctactccaccatgaaacccccagatgtccaagaggatcacatatttctaaaggtctttcctcattcttcagagcttaactaa

SEQ ID NO: 70477 - DNA, 294 bp, Glycine max
  Peptide Sequence Number=SeqID_162162
atggcacgcagagacaaattatggtcattctgcacccttttgtcatccagaggcggcgagcccgatgacatgcagagacaaattatggtaattgcacgcaccttttcgccatctggagacgatcgtgtccgatggcacgcagagacaaattatggtcattctgcgccttttcgccatccggagacgatcgtgtccgatggcacacagagacaaattatggtcattctgcgccttgtgtcaaccgagaggaacgaattcggaagtataaggatgatgttggtcgttcagtgttga

SEQ ID NO: 70478 - DNA, 1227 bp, Glycine max
  Peptide Sequence Number=SeqID_162163
gctctcacctttagaggactacacgtcctcgccatcagagggccgcatgccctcaccatcagaggactacacgtcctcgccttcagaggactacacgtcttcaccttcagaaggctgcacgtcctcgccatcagaggactgcacgtcgtcacctttagaggactacatgtcttcgccatcagagggctgcaggccctcaccttcagaggactacacgtcctcgccatcagaggactgcacgtcctcacctttagaggactacacgtcctcgccatcagaggaatgcatatcctcacctttagagggctacacgtcctcgccatcagtggactgcatatgctcaccttgagagggctacacgtcctcgccttcagagggccgcacgccctccctttcagaggactccacgtccttgccatcagagcgctgcacgccctccccttcagaagactacacatcctcgccatcagaggactgcacgtcctcaccttcagaggacttcacgtcctcgcctgcagaggactgcaccccctcgcctttagagggctacacgtcatcgccatcaaaagactccacgtactcgccttcagaggactgcacgtcctcgccttcagaggactcgacgtcctcgcctatagaggactacaagtcctcgccatcggaggactacacgccctcacctttagaggaccacacgttctcaccatcagaggagggctgcacgccttcaccttcagaggactacatgtcctcgcctttagagggctacaagcccatatcttcgaagggcaacacgccttctccttcagaggactacacgtcctcaccttcagaggactgcatgtcctcgcctttagaggactacacatcctcgccatcagagggttgtacgccctcgccattagaggactacacgtcctcgccatcagagggccgcacgttttcaccttcagaggaatgcacgtcctcgccatcagagggctacacgccctcgccattagaggactatacgtcctcgccttcagaggactgcacgtcctcgccttcagaggactcgacgtcctcgcctacagagtactacacgtcctcgccatcggaggactacacgccctcacctttagaggaccacacgttctcgccatcagagggttgcacgccctcaccttcagaggactacacgtcctccccatcagagggctgcacgccctcacctttagaggactacat

SEQ ID NO: 70479 - DNA, 246 bp, Glycine max
  Peptide Sequence Number=SeqID_162164
tggacccaatatgtcgatttcccacatggcgaagggccaaggggagctcagacagtgaagatttttaggaggagtgtgtggcatgtctgcaaactcttggcattgcatgcatctcctggtaaagtcgagggagtttgctctgagtgttggccacgtctcttggatgatggtcttgagctgcctaaccttcttggtgctagccagcttggagagcatgttttcttgagtattgctttcactaaggat

SEQ ID NO: 70480 - DNA, 1041 bp, Glycine max
  Peptide Sequence Number=SeqID_162165
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactgggggccagatgcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataa

SEQ ID NO: 70481 - DNA, 120 bp, Glycine max
  Peptide Sequence Number=SeqID_162166
atgagcaagaggctccaagaggattgggctacagctattgaagaaggcccgagggttctcatgaaccttagggtaggtgttcgcttccggcaagtgcaccagatcgcacaagtagtataa

SEQ ID NO: 70482 - DNA, 393 bp, Glycine max
  Peptide Sequence Number=SeqID_162167
atggagaattggcgaacagcgctaggaatcaattcgcggggctccagactcgatggtggtggacacatgaccagcgctacgcaatcaattcatgggtctccaaataagatggagaatggagaattggcgaacagcgctagggaatcaattcgcggggctccagactcgatggcaatcaatttgcggggttccagactcgatggtggtggacacatgaacagcgctaggcaatcaattcatgggtctccgaataagattgagaatggagaattggcgagcagcgctaggcaatcaattcatgcgtctcccaataagattggagaatgggaattggcgaatagcgctaggcaatcaattcgcggggctccagacttgatggtggaggatgcatga

SEQ ID NO: 70483 - DNA, 153 bp, Glycine max
  Peptide Sequence Number=SeqID_162168
atcaatcaagaacaattcaagagttcaagataagaatcaagaagaattcaagactcaagaagaaaatttagagtcaagaatcaagattcgaggttcaagatcaagattcaagactcaagattcaagaatcaagataaggcttaatcaagataa

SEQ ID NO: 70484 - DNA, 201 bp, Glycine max
  Peptide Sequence Number=SeqID_162169
atgtattcagacgaagacgttagaaaaaccaaaaagaggtctgcaaatattgaaaagaagggtttaggagttgtttatgcctggggaagacaactttacaacactagtgatcggttaagactaaactttacaaagaaaaagaggttgttgatgatagatggagaagatgaatgtgaacataataacaagggggacccctaa

SEQ ID NO: 70485 - DNA, 282 bp, Glycine max
  Peptide Sequence Number=SeqID_162170
atgtcattgcctagcgctgttcatgtgtcctacaccttcgagtttggagctatgcttcatgattggctaaccccatcaatgtcattgccaagcgctgttcatgtgtcctccaccttcgagtctggagccccgcgaatgtcattgcctagcgctgttcgccaattctccattctccactttttttcggagccccatgaatgtcattgcctagcgctgttcatgcatcctccacccaaagagtttggagctatgcttcatgattgcctagtgtggaccctctaa

SEQ ID NO: 70486 - DNA, 1161 bp, Glycine max
  Peptide Sequence Number=SeqID_162171
atggagcagttgaaaattcatgacatcggcaccggcctgcatttccgcgccgcgcatacccacaagtattaccgtgaacgctatccgcagctctcgctgccggccaccgaatggaacagcgaacgtatctgctcgctgcccctgttccccgacatgctcgatgacgatcctgagatgctggaagaaaaaccgattcgcaaagtctccgtggtgatcccggtgtacaacgaagaacagagcctgccggagctggtgcgccgtaccgacgcggcctgccgcacgctcggccttgactatgaaatcttactggtggatgacggcagcgccgaccgctccgcgcagatgatcgccgatgcggcggatatgccgggcagtcacgtggtcggcgtgctgctgaatcgcaactacgggcaacactcggcgattatggccggtttcagccatgtttccggtgatgtgatcattacgctggatgccgatctgcaaaacccgccggaagagatccccaatctggtcaaagctgcgcagcagggctacgacgtggtcggcaccgtgcgtcagaaccgtcaggacagctggttcaggcgccgcgcttcacgcaccatcaaccacctgattcagcgcgtgaccggcaaagcgatgggcgattatggctgcatgctgcgcgcctatcgccgtcacattgttgatgcgatgctcaactgccacgaacgcagcacctttatcccgattctggcgaacaccttcgcgcgccgcaccattgaactgccggttacgcatgccgagcgtgagtttggcgactccaaatacagctttatgaagctgatcaacctgatgtatgacctggtgacctgcctgaccaccacgccgctgcgtctgctgagtattgtcggcagcttaatcgcgctggccggtttcgccttttctctgatcctgattgtgctgcgcctgttccttggtgccagctgggccggtgacggtgtgttcatgctatttgccgtgctgtttatttttgtcggcgcgcagtttgtcggcatgggcctgctgggcgaatacatcggtcgtatttataacgacgtacgcgcccgtccgcgctacttcattcaacgtgttatccatccgcaacaagatgccccgtctgtacaggaaattaagcaatga

SEQ ID NO: 70487 - DNA, 579 bp, Glycine max
  Peptide Sequence Number=SeqID_162172
atggctatcggtgaccacacaatcttgtgtgatagagttcatatccctaccaagaagagtttattggagctttcatcacaggatgctttgttggcccaaaataagttgttgttcaagcaacttgaagctttagctgaaatactaagtaagctgccaactcaattgcatgctagtcaacctttaccttcatctgttttgcaggttacaggttgcacactttgtggtggagctcatgagtcaggcttgtgtattcccactgaaggaacaactcatgaagttaattatatgggaaaccagcatagacaaaattttaatgcaagtggattttctagatttcaacatggccaaccttaccaacagcataatcaatggagaactcaccctggtaatcacttcaacaaagaccagggtggaccatctactaggccgctacagcaacaagggcttggcatatatgagagaacaacaaagctggaagaaactcttgctcagtttatgcaggagtcattgtccaatcataagagcacagagtcagccataaaaaatctagaggtccaggtagggcagctggccaaatag

SEQ ID NO: 70488 - DNA, 681 bp, Glycine max
  Peptide Sequence Number=SeqID_162173
atggagaaggccacaccgtctgatccccgacccgctccaattattgaggacattaaacaggataactccggaaaggtagaaataaccttcaataggagaaattccttctcatcaaggatagaagcctctaggtctgaatacgagtcagccagaaggtctttttcagttagaacccgttcaataccagtaggactaaccagatctgagttacataaccagttccctactgtaaacctccaaggactagataccacttctagcataccaagaacgacctacaaccaagatcaggaggacaaccaaaacattgataaggaaacccttaggaaagatttttattctccggcgaatgagcctcaaaggagatggtttttccagaattacaggggtacaaacagaaaacagatccaagacaagttctacgaatttgtcgaaagagtcaaagttaatgtccttttctttgattggttccatgcttacaacatcaaaaaagatatagattacccatggaagcaagacatcataggtgatccatcaacaaacgttataagcaactggcaagtaagagatggtgagatgatccaatcggaattacctcccacgaccaaatatcaactcccgaatatcaaagacagtaacaacaaacctgtaatggcaaccccatttaaaacaagatattaa

SEQ ID NO: 70489 - DNA, 177 bp, Glycine max
  Peptide Sequence Number=SeqID_162174
atggataagagcttgaaggtaggagaagatgagtggagggagagggagagaaggggcacgaaatttatgcctcaaatgagcccactaatccaagatcaagtccaagattctccactaagtgtgcttaggtgtcataaggcatgccaagccatgaaggacattgccccaaagtgttga

SEQ ID NO: 70490 - DNA, 258 bp, Glycine max
  Peptide Sequence Number=SeqID_162175
ccaatttacaacagcatgccccaagagactcagcataaggatgcacaggtcaaagttgagtatgtgaaaagattgtatgaccaagtgaaggtgcaaattgcaaagaagaatgaaagttatactaagcaagccaacaagaaaaggaaggaagtggccaaatacagtctaaaggcccaagtggagaaggacgaaggcccaagtggagaaggacaaagcccccgagtggagaaggatgaaggcccaagtggagaaggatga

SEQ ID NO: 70491 - DNA, 209 bp, Glycine max
  Peptide Sequence Number=SeqID_162176
atggacgaagatcaatggatgtatgacagtataatgtctgaagaagttgatatagattatcaaaatgaagaagaatgtggtgtgaatgaaccacatgttgattgttcggatgcgttcaataattctcaggtgtttgactgccgagatgatgttttgcagtgggctcgatctgttgctcatgaaaacggatttgtggcaatgattataag

SEQ ID NO: 70492 - DNA, 653 bp, Glycine max
  Peptide Sequence Number=SeqID_162177
atgtttcatgttgtcttcttagacactttgcaagacctcagtcagactgggaggtatgcatggggagctgctgccctggtgcatatgtatgatcacttgaatgatgcttgtatcaacagcagccgacaacttgctggttacgccaccttgttacagcactttccgtcagttgcggagtgcatcgctgatccggactacgatgaggtgtctccacatgcatgtcggtggatttctatgaagaagactgtgaagaccatatctacaaagacctacaggcagcatctggatcgacttaggattcttgatgtctgctggatgccttatggggagcatcgactatttggatacatccagagtattcctgcacaacttgtcaattcatgggagtcatttgatgaaatagacgacaggtggatgcactactcagaccatcttgcgccagcaggtcccggagccaacagctgcatcgacacatgcctgtctgaggtggagcagcccagacatgtagtggaggcttgccaagcgatcgctgaaaggttggagcgtcatctcaacctaaggatagtcacgctaggcatagagacacatgaggtcatcgaacaatgtctcaagattgccaggggtgtcatagaagaccgcattgtgtatgtgag

SEQ ID NO: 70493 - DNA, 231 bp, Glycine max
  Peptide Sequence Number=SeqID_162178
atgacagaaactgtttgtatcgataaccgcttgggtatctccgcatgtcacctgacttcacgggtcatgatgatagaaaccgtttgtacggataaccgcttgggtatctccatacgtcacctaaattcacaggccaggatgacagaaaccgtttgtacagttaaccgcttgggtatctccatacgtcacctgacttcacgggtcaggatggcagaaagcgcggaagacgac

SEQ ID NO: 70494 - DNA, 378 bp, Glycine max
  Peptide Sequence Number=SeqID_162179
atgtggcttgacctttcagataatgctttggaggtgatttcttctacttttggaaatttatctcttgaatatctagacttgtctttaatcaagtttgaaggttcaacttttcgagaatttggtgctttcaagagcctcaaaacattgaacctttccaataacatgctggtgggagagggtacatctacttgggttgttgtgactgagaacaagagagggtacatctcttgtggatcagttcaagtggagggtacatccacttggttgttcaaagagaacaagggagggtacatcccttgtggatctttgcttgtaaaggattttacaaggttgaaaagaaatctcaaggaccgcaggtcgcttggggactggatgtag

SEQ ID NO: 70495 - DNA, 111 bp, Glycine max
  Peptide Sequence Number=SeqID_162180
atggccaatggtcacgagcaggagaagataaggaagaagcagaaggaagtgatgagtgatgaaaaaggattgaaagaaaaggtggctttgggagatgaagatggatattga

SEQ ID NO: 70496 - DNA, 489 bp, Glycine max
  Peptide Sequence Number=SeqID_162181
atgtgggctttccttaccgatcgtcagatcgactgggctcacttggttcggtacctaatgcataaggcattacaggctaatgcacctcttccatatcctcaattggtcaccctctttctctgtcattttcaaattcctcttgatgatgaaccttttgttcaagtcaagcgttcctttgctataggtgctggtgctgtcacttcatttggttaccataaggatcgcaatggtcaatggacgaagaaagatgcactccctccacaagacaaacatactccttctcctcctcctcagcgagatgattcagcccttatgactgaagttctttcagaattacggggtcttcgcacttatgtagttgaacgatttgattctttggatggttgctttgcaggaatggatatctatctcacgcagcttgaagaggatgtggtttatattcgtcagagctcgatcttccaccaccaccaccaccctcttagtgtttag

SEQ ID NO: 70497 - DNA, 159 bp, Glycine max
  Peptide Sequence Number=SeqID_162182
atgaagaagagatggtggttgcgcaacgtgactagttttcttaagtattcaagcaaagtatatgatcaagaaggattccatagtcagatagttgttgcttcatccattaaatttgggcacaacaactaccagcagaaatatattccgcttcagcagtag

SEQ ID NO: 70498 - DNA, 407 bp, Glycine max
  Peptide Sequence Number=SeqID_162183
tgagggcgtgcagccctctaaaggtgagggaatgtagccctctgaaggagaggacatgtagttctttgaaggcgagggcatgtagccctctaaaggcgaggacgtgtagtcctctgaaggcgagggcgggtagtcctctgaaggcgaggacgtgtagtcctctaaaggtgagggcgcgtagccctctgaagatgaggacgggtagtcctctgaaggcgaggacgagtagtcttttgaaggcgagggcatgcagccctctgatggcaaggacgtgtagtcctttgaaggtgggttttgtggttgatttagggatggcctttgtggataactgggtggtgggtaaggagaagggttgctattggttgagtaatgacattgttgggttggtgggaaacttggccgtatag

SEQ ID NO: 70499 - DNA, 417 bp, Glycine max
  Peptide Sequence Number=SeqID_162184
atggcgactaagatgaagcgatgcccatttgaagccttgggttcgatagccccaatcacgtctatgccccacattgagaatgactacaatgctgccaacatgttcaacgatcaaagcaacaccatatcatggtttcttttatataagacattcccactcaagaggaaactgattgccaaccaacgtaatgtcctcttgtcgttgtcagaggcctcaggtgggtattccttgttgtcagaccctaatttcatccggggactaccattcactgatattttgattctcggtagtcgaattacaatattaagtgctagttacagtgcaaagcaaggaatcactcagtattttgatcaagagtacaaaaggataccaaggaagggggcaaaagggtcttttttggatttttctgaaccctag

SEQ ID NO: 70500 - DNA, 207 bp, Glycine max
  Peptide Sequence Number=SeqID_162185
atgaggttctgcaacgtgatcgtggtgaccacgaccatgaatgtggcagtgtcgaacagcaaggtcgtcgctttgtgggggctcatgccgttgttcgatggcagaacagagaaacaaagggaagggagagaacgcaaagccaatggaaacaaatcagacaaagattacatatggcatcacacatggcatgcctgtgtggccggttaa

SEQ ID NO: 70501 - DNA, 426 bp, Glycine max
  Peptide Sequence Number=SeqID_162186
atgaaagattgtagaaatacaagtagtggggatgtctcctccacctctaggacctcacaatcactcacaaactcatctcaagctctcaggacggtttcctctcaagctctggtctctgtagatcttcacacaacaaaatctctcaaactctctggaacttggacctttctctctctagaactctctagacatgcagaagcttcaagaaaaggccaaactcttcttgaaaatctgatttcaggcttaaataggtggctttgttcgtgctccggatggaccaaagcggtgtgcttagcaggatggcccttcactcagcgaacaagcacagctcatccttcttccagattcttcctcacgcttagccgaggattgttgcgctcagcggatagctcgctaagccaatctgttggcttagcgagagggtga

SEQ ID NO: 70502 - DNA, 357 bp, Glycine max
  Peptide Sequence Number=SeqID_162187
atgccacaatatgcctttggcctcctcacttcccacacatcttcgaaggagattatccgcacctactttgaacaagtgtggatcatcccaaacgtaatgccgggcatcatagaagaatctctttctctgctgccaattgagatctttcggtatgacacctgctgccttgaaattatctatatcagtgaaccagggtctccctacaatcaaaaacaaagattcatcaggaaatttatgatgcaatccttctccataagggcattgggtagaagactccaagtagattgggctagagatccaagggaagaccctagggttctcatgagccttagggtagatttcgagcccatgggctaa

SEQ ID NO: 70503 - DNA, 246 bp, Glycine max
  Peptide Sequence Number=SeqID_162188
atgattttcaaagttccccactcaaacgagagcccttcaattaattatgtgatatggatggtagcagaatggagaaggaagagagagaggagacgccacttcaaggagaagatgagtctagaagaagctcaccaccataggaggccatggataagagcttggaggaagaaggagatgaatgaagggagaggaagagaagagcacgaaattttgtgctctcaaagagctctgaaatctgaagtttaa

SEQ ID NO: 70504 - DNA, 216 bp, Glycine max
  Peptide Sequence Number=SeqID_162189
atggagaattcgtccctaacagttaaccacttaatccaaccctatttcaatttactaagcgaaaatcaacttaggggagaactgccaggaaaccacattacaagcgaaacctcaaagagagttgggcttcgccctcaaaaggaaacaacaccagaaaatctagccttccatggattcaaacagaaaacgcaattgaaacatgaagcagaaacgtaa

SEQ ID NO: 70505 - DNA, 474 bp, Glycine max
  Peptide Sequence Number=SeqID_162190
atggaactagagttttgggacaaaaatcccttcaaggccatagccaaggcattttctccaagcttccatttcaaacctagtgccaccaataaaacaagaatcttctatgagttcatactgatagactcaaactcagtgtctatcaagcacttcaaagactcaaatgacacaaatttgaacacccattcgactgtccaaattcttaagtttcaagcccatccaaaattcctaaaaactgctaatccagagacctctttattcctcaatcaaaagtctcaattagcttctttccttgccagttccagatcaaaagaaagtctggcaaaaaatctaaaagaagtcctacagcttctccaacaagaagaagacgaaggcttttcctcaaagaaggaagataataactcttcagaagaaaatgatcctttctaccaaaatgaagacgaatgttttggattttcattaaatgatgattaa

SEQ ID NO: 70506 - DNA, 326 bp, Glycine max
  Peptide Sequence Number=SeqID_162191
atggcagaaccatcaaagaagcgaaagggttcttcaagtagaagccaacagaactcagagtctcaggatactccgattccaccatccatttcgtcctccacgttgttctcatctgaagagcaacgtatctggtacacaactcttttctcttcttgctcaattatagatcctaagttcatggacatggagttcttttctgacgaaatgtttgagtgtgttcaagcatttcagaactccggatctagcttctcaaagaagcctcttgagaaagcttctcaaagaagccacgaggaagcttctagagaaagctacatgaagctgcctcg

SEQ ID NO: 70507 - DNA, 639 bp, Glycine max
  Peptide Sequence Number=SeqID_162192
atggaagacatgttaacctctaggaggttcattttggaagcactgtgcgaagctgggatgattcgccttgacgggaacaagggggactcttgtttaatacatttgggggcatcacacgacgtagagacatgcccaatggcgggagaattactacaagggatgatggatagaggcctaattgaagtttgtagcgcaagaaaaggggaaggggatgtgtgcatgcagtcgattcataagagctcgagtaagcccaagccattggtgatccacttcacaagggatgttgccacacataagcctcgaggtttccagtctgtcccagttaagaagcctacgccttccccttacaaaagtgataaggatgatctatcctctactaaggtcacaaacatcttcagcacaagcggcatgacttgtagcggacgaatcttcgcagcactcgagccactggtgcgatccaaagacccaaaggggaaagtaaaggcaaacgtggaagagagcggtaaggtgggcttgattctaaataatgaggtcctggttggaaggtttgccaaggaagaggatgactttagcaaaaaggaattatacgctgaagaagaaatcgagttcctgagaatcatccaacagagcgagttcaag

SEQ ID NO: 70508 - DNA, 479 bp, Glycine max
  Peptide Sequence Number=SeqID_162193
tcaaatgccttcaaggtggcatgaaggtcacaaagaacacatcttccttgcattttcgcctcttagctagagacgccatgaaactcatgtatgctggaaacaccttccatattgtagcaagaaaagtgctgatagtcaaggaagttatccgcgggtggagagaggctggtatcgttattggtagtggcgatataggtggagagagaaagaacagtgtcgtgtcgccaatgggaatggcgacacccaagctgggactcgctgaccatagggcaagggcaatctcgccgttagcattggcgagatgctccctgttgactggtgccgctagcccttctggcgggattggcgctgttcatttcggtatgctcttcttgttcatgatgagactaaacataaggtctgaaatagggtttaaagctagctgtagatgttcacaggttgcgcatgctctccttgttcatgatgagactaaacataag

SEQ ID NO: 70509 - DNA, 333 bp, Glycine max
  Peptide Sequence Number=SeqID_162194
atggacaattgcttgttcgcaaagtctatgaatacattagaggtgccaagcctactgaaatctctccaagtttgggctcacattcgtgatttggctcctttccgcaggcgtttcacttctttgcagtgcattactgactctttaattaggggcagatccacatcacgtgttcaaggaaaattccgttgcctgactatagcaattatagtctactgcatctggctgtctaggaaaaagttgatttttgaagattatcaattttctgtaatagaggttattagcaagataaaatttcttatgtatagacaagcgcacctattgcatttgttttag

SEQ ID NO: 70510 - DNA, 180 bp, Glycine max
  Peptide Sequence Number=SeqID_162195
atgaatcctgaggaaggggcaggtctaacactagtgcagatggctcaggctaagaagaagacatatctagtactgcagtggaaggctctggctcaggtggagtgggatctgaggcctctagaatgtcatcctcctggtccaactgaggctcccgtgttggatcaagtggcatcagaataa

SEQ ID NO: 70511 - DNA, 180 bp, Glycine max
  Peptide Sequence Number=SeqID_162196
atggctggagcaggtggtggtggtgatgagtatcatcagttggacggagctcaacgtttgttactcgacgcgatgaatgcactgatgcaacgtttgctgaactgtaacaatgaaggaggtgggaacagaggtaacaatggcggtaatgacggaccgaggcagaaccgggttgaggagtaa

SEQ ID NO: 70512 - DNA, 651 bp, Glycine max
  Peptide Sequence Number=SeqID_162197
atgcctagcccacgaaggagggagttcgagattatgcgctcgtgggtaaggggtcagttgattccctttggcacagatgccctcagccaattcctgggccacccactgatcttggaggaggaccagcggtgcgaattcagccagaggagggaccaggcctccggctttgacgaggaggccatcgcccagctattgtgcataccggggcaagactttgcttggaccgctgcggggaggcaggtgtggattatgcgcaccagcatgactactctgactcagatatggatgacgctgctactcagcaacatcctgcccaacgaccataattttgacctccctctgcctaagtgccagatggtgtacaccatcctgacacggatgactgttcacatggcccagataattgcttacgctatttatttgtttgcaggggcggcgcccactaggcaccctttggaaccggagaggtccaacagggccctgggattttcggccttgatcacgggcctctgccagttctatggggtacttgtcatccccagcaaggtaatccagccaccgatcactcgagctttcatcgagaaatattgcacccctaggcaagcgaagggtgacacacaacaggctgcagatgcaccaccacctcagtag

SEQ ID NO: 70513 - DNA, 258 bp, Glycine max
  Peptide Sequence Number=SeqID_162198
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaacctggacaggcggtggaaactaccaagcttggagtacggtaggggcagagggaatttccggtggagcg

SEQ ID NO: 70514 - DNA, 261 bp, Glycine max
  Peptide Sequence Number=SeqID_162199
atgggaggaactaaaaggcttttagtgataattcccaaggtggtcatatctctcttgatggtttctagagggactaccagcaacaacatgctatcaaagagaaaaactctagatgagggttcactgttatcaagcaagtcggagacccaacatgaccacagattcacctccactccttatgttcccatggacccgagtatagggcccctttttaactcaccgtgtgtacaaatagtgttggtgtttgtctgcatcaaatga

SEQ ID NO: 70515 - DNA, 93 bp, Glycine max
  Peptide Sequence Number=SeqID_162200
atgaaaaaccaatttgacgctggcttcttggccgttgctcgatacccggaatgggtcaccaatatcgtgccagtccctaaaaaggatagaaag

SEQ ID NO: 70516 - DNA, 279 bp, Glycine max
  Peptide Sequence Number=SeqID_162201
atgatgacaaaaagcccaaagaatgattgcaagaagattcaagattcaagaataatcaagatcaagattcaagactcaaagattcaagaatcaagagaagacttaatcaagataaagggtacatctacttgggttgttgtaactgagaacaagagagggtacatctcttgtggatcagttcaagtggagggtacatccacttggttggtcaaagagaacaagggagtgtacatcccttgtggatcttttcttgtaaaggattttacaaggttgaaatga

SEQ ID NO: 70517 - DNA, 284 bp, Glycine max
  Peptide Sequence Number=SeqID_162202
atggtgcgcggtagacgacataagtctccgcgtgtcaacgagctcggaccgcgattgacaaagggtgcagaagatgttgatgtagaagacgacgttagtctctgcacgtcacctgacttcagagtcagtgtgacagaaatctctctaccggaagatgctgacatctccgggaagggtgcagatgattacattggtctctgcgtgtcaatcgggcttggggtgtgtgcgggttaccgtcgggtgtctccgcatgccaccggaatcttgggtcacggtagcaaaag

SEQ ID NO: 70518 - DNA, 609 bp, Glycine max
  Peptide Sequence Number=SeqID_162203
atgtcagccaatgatcatgccattctatgcgacaaaacccataaacccacaaagaaaagcttgttagaactatcatcacatgacactttattggcacagaataagttgctttctaagcaacttgagattttaaaagaaacacttggttgtaccatctgtggtgaggctcatgaaacaggccaatgtattcccattgaagaaaacactcaagaaattcattatatgggaaatcaacagcgacaagggtatactcaaggaggattttcaggcttccatcagggtccttataatcaacaaggacagtggaggtcgcaccctggtaatcagttcaacaaagaccagggtggaccttcaaataggccaatccaacaagggcctaacatctttcagaggactactaagctggaggagagtttgactcagtttatgcagatagctgacaagtcatccaacagttttgtggcaaatacagaaaagaatcccaaggaggaatgcatagctgtgatgacaaggagtaaaaggtttgtggaggctaaggatgaggagagtgttgtgcataagaagaaagctgttaaaagaaaggtaccgatggcaacaaaaatgatgtga

SEQ ID NO: 70519 - DNA, 255 bp, Glycine max
  Peptide Sequence Number=SeqID_162204
atggttgaggcacactctatctctactcttatggttacaaactgcaaattgtccaaacatggagctgatctatttcatgatccaactctctataggtcagaagtgggtgccctgcagtatgctacccttactagacctgagattagttatgctgttaataagacgttccacatcaggagcagctatctttcttggctcaaacttgatatcctagtgatccaggaagcagaaagtcacagcaaggtccagcactga

SEQ ID NO: 70520 - DNA, 201 bp, Glycine max
  Peptide Sequence Number=SeqID_162205
atgtccaccttatcacgtgccacaatccccaaatatgttcttaatttcttcttgtggggaccgtcgaccttccctgtagcaggatcaacatgcaccactggtctctcaacaccaggtggtctagtggacaacgatcgtaggtgtgtggctgtgtatgtgtgtgtgtgtgttgaagatgcacacaaagtgatgcagtgttaa

SEQ ID NO: 70521 - DNA, 1091 bp, Glycine max
  Peptide Sequence Number=SeqID_162206
atgctgcagctggagctggaagagcgcctggaagcgctgtcgcagaacgtcagcgaagccggcgaacgccgcatggagatgcgccaggagctggagcagatccagcagtgcatccgtgagctgacggcgcgcgcgccggtgtggctggcggcgcatgacgctctgagccagctcatgcgatcagagcggagagccggtggaaaacagccagcagtggaagcgcagatcgaacgtctcagacagccgggcggcgcggaagatcagcgcctggtcacgctggccgaacgtttcggcggcgtgttgctgtcggaaatctacgatgacgtcaccatcgacgacgcgccttacttctcggcgctgtacggcccttcgcgccacgccatcgtggtgccggatctgtcgctggtgcgcgagatgctggaagggctggaagattgcccggaagatctttacctgatcgaaggggatccgcagtcgttcgatgacagcgtattcgccgtcgaagagcaggaaaaagcggtggtggtgaaaatcgccgatcgccagtggcgttattcccgctacccggaagtgccgttgttcggccgcgcggcgcgcgaaaatcgcctggaagtgctgcatgccgagcgtgaaacgctggcggagcgctacgccacgctgtcgttcgacgtgcagaaaacccagcgctcgcaccaggctttcagccgctttatcggcacccatctggcggtggcgttcgacgccgacccggaagcggagatccgcggcctgaacgcccgccgtggcgaaatcgaacgcgcgctgaacaatcacgaagcgcagaaccagcagcagcgtcagcagtacgatcaggccaaagagggcatttccgcgctcaaccgcctgatgccgctggtgtcgttgctgaacgatgaaacgttgcaggaccgcgtcgacgatatgcgcgaagagctggaagaagcgcaggacgccgcgcgtcatattcagcagcacggcgtgtcgctggccaagctggagccgctgctgtcgtgctgcagagcgatcctcagcatcatgaacagctgcagcaggattacgcgcagctgcaaagc

SEQ ID NO: 70522 - DNA, 532 bp, Glycine max
  Peptide Sequence Number=SeqID_162207
atggatttgcactacctgtccacgctggcgccgctgtatgcggcgaatcacatgcagccgatgtggcaggatcgcgaaaccgttcagcaatttcagcagcagctggccgagctggcgatgtccggcgtgcagccgcagttcacccaatgggtgaagatgttgaccgatccggcgctcagtgaagcgggccgcgatgcggtgctgtccgatgcgatgctgggctatttgcagttcgtctccgccatcggtgccaacggcaacaactggctgtacagcaatattccctacaagcttggcttgccgcccaccgcggtgatcaaccaatggcagctggcggtgcgccaggcgcgtactctgagctacgtgaattcgctcgcgccgcagcatccgcaatacgccaagatgcatcaggcgctgcgcgacatgctggcggataatcgtccctggccgcaggtgggcagcggcccgagcctgcgtccaggccaaatgagcaatgatattccggcgctgcgtgagatcctgacgcgcaccg

SEQ ID NO: 70523 - DNA, 396 bp, Glycine max
  Peptide Sequence Number=SeqID_162208
atggctgccaatgctacatatgaatgtgttaaaattcatgaggaagtgcagtacatgaataaccaaaggcaagggaattaccaaaactacaacaatcaaggctataaacctcatccaagcaagggagtatttccaatgccatgcctaggcagaacctctatgaaaagcaaaagaggtcatgctacatatgaatgtgttaaagttcatgaggaaatgcagtgcatgaataaccataggcaagggagctacaagaactacaacaatcaaggctatagacctcatccaagcataggtgaagagcaaaggagtatttccaatgtcatgcctagggagaacctctatgaaaatactagcaagctggaaaagaccctcacacaattgatgcaaatattctaa

SEQ ID NO: 70524 - DNA, 275 bp, Glycine max
  Peptide Sequence Number=SeqID_162209
gagaagagacagaggagacactggtgagacaggtagttgctgccactcctgagcgatccattgaggctacttcagagccttctgcactagtggtaaacctaccctcacctcagcctgcagcagacccctccactcctcttctacagatgctagaggaccctactacaccagtcctagctatggacacttctcctcgaactactccagtgcttcagctgacacataaggaggatagtcagacacaggacacccaagaccagtcacaggaattttga

SEQ ID NO: 70525 - DNA, 201 bp, Glycine max
  Peptide Sequence Number=SeqID_162210
atgccggacccagggcctatgacaagagcatttaataataacaacaacaacaacaagaacaacaacaacaacaagaacaagataaacaacaacaagaacaagaacaacaacaagaacaagaacaagaacaagaacaagaacaacaacaacaagaacaagaacaagaacaacaacaacaacaacaacatacaaggcatatga

SEQ ID NO: 70526 - DNA, 210 bp, Glycine max
  Peptide Sequence Number=SeqID_162211
atgcagaaaaagctgtcaaattttgcagcaaatttgccaattatgcagaaaaaaaatggttgtgcagtgttgatttttgctgtcacgggaaagggtagtttcatgacaaatggaattgaattgtttggatattgtgaaagcttggcggggctgatggggacccaggctgagaggaacgaggagaaggctacgtgcgtgcacgtgagctaa

SEQ ID NO: 70527 - DNA, 207 bp, Glycine max
  Peptide Sequence Number=SeqID_162212
atgagcacccccaccaacgtgcaggacgagcaatctctgattgaacggtcttggaagttaacactcaagagcgcagccagcccacatcaattagaccttgcaccttatgcttcagggtcatacagtgctcaatggaatgccccagggctcctccacgatatgcacatgttgcgttcgagtcgtatcctcagaaaaatggaggtttga

SEQ ID NO: 70528 - DNA, 357 bp, Glycine max
  Peptide Sequence Number=SeqID_162213
atgaaggcctacatggaggccatgaaagagaaaatgaccataatgatggaagccatgatgagtgtgagaaaaatgatggaggtcaacacggctacagttgttgctgcaagtacagccattgaggtggacccgacccacccatctggcctcaatcaagtaaatcgtccagtctcgaatatggtaggtcccgagcaagcattccttcccacctgtggcttgcctcccaactatacaccacccaatgttgcacacactcccgatgagaatgttgataaatccactcccataccctttgagactgaacaaccccaatctagtcatgcacaggtccctcaacccatgagaaaagacacatga

SEQ ID NO: 70529 - DNA, 543 bp, Glycine max
  Peptide Sequence Number=SeqID_162214
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggggcaaagaaggcctcctttctgggggggccagagccatcagtgagataccactctggaagagctagaattctaaccttgtgccaggacctacgggccgagggacagtctcaggcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacg

SEQ ID NO: 70530 - DNA, 636 bp, Glycine max
  Peptide Sequence Number=SeqID_162215
gctcatcttggtggtgaagctttttcttccatggcttattccttaaaaggatggcgcctcctctcacctcttttcctttgtcttccgctgcatctccatggtggaaaatcaccattaaagaaccccattaaagctcaaagatcgagcctccatagaagccccacaagcaagcttccatcaagtggtaatcagagcacaagagaactacacgccctcgccttcaaaggactacacgtcctcgccatcagagggctacatgccatcacctttagaggactgcatgtcctcggcatcagaggactacatgtcctcactgtcaaagagttgcacgccctcaccttcagagggctacatgtcctaacctccagagggctacacaccctcaccttcgcaggactacacgtcttcgccatctgcgggctgcacctcctcgccatcagaggacaggacgtcctcgccatcgaagctgcacgtcgtcgccatcagaggctgcacaccctttccatcagaggctacacgtcctcgccatcagaaggctacacgccctcgcctttagaggactacacgtcctcgcctttagaggactacacgtcctcgcctttagaggactacacgtcgtcgccatcagaagcatga

SEQ ID NO: 70531 - DNA, 1110 bp, Glycine max
  Peptide Sequence Number=SeqID_162216
atggctgcggtacagctgataggtcagcgtttggccgatggggatcagcaagccgccgcccatgccctgcagggtgcgccagccgatcagcgcgccgatgctgtcggcgttgccggcgccgaaggtgcccagcatgaacagcgccagcgacagcaggaacacccgccgcccaccgatgcgctgcgccagccaggcgctgagcgggatcaccagcgtcaggccgagaatatagccgttgctgacccacgccagttggctgaccgacgcccgcatcgcctggccgatggcggggtaggcgacgttggcgataaacatattgatcagatcgacgaaaaagccgagcagatagacgattgccactttgctgcgataagacatggtgcctccgctggagaacgagctgggggtgtcactgctggcgcgcagcacccggcggctgtcgctgaccgacgccggcgaacgcttttaccagcgcagcctgcaactgctgcaggaggcggaaaacgtgctggacgacgtgcgccgcgatcaccacgggctgagcggcgtgctgcgcatcaccagtacgccggagtatggcgcgcaggtggtggtgccggcgctggcggcgttttcgcggcagcatccgcggctgcgcatccagcatctggcggattccagccaccgcgcggcgctgatcgacagtttcgccatttttccggtggcgtcgccgggttacctggccgagcgaccgattcattcgctgaccgagctggcgcaggcgcagtggatcgcccacagccggctcagttcgccgctcagctggcaggtggccacgccgcagcgcgaagcggtgctgttcaaggtggcggacgctgcgacgctcaccggcgacagcgccgcggcattgctggcattcgccctgcatggcgccggggtggcgctgctgccggcgtggctggcgcagcccgaaatcgacgccggccggctgcagcggttgctgccggatcaccgtttccccgagcagagcatctacgcgctctacccgaatacccgccacgtgccggaaaaggtgcgggcgtttatcgattttctacgcacgcgggtggcggccaaccgttagcgaaataa

SEQ ID NO: 70532 - DNA, 660 bp, Glycine max
  Peptide Sequence Number=SeqID_162217
ttcctgggccaccctctggtcctggaggagggccacctatgcaagtacaaccagaggaggaggctatcgtgcaactactatgcataccggggcaagatttcacccgtgccgctgcaaagaaacaagtgcggatcatgcgcaccaacatgaccactattacacagatatggatgacattgctacttagcaacattctgcccagtgaccgtaatgccgatctccccttgcagaaggatcgtgcccacaagacacccagtggacccggagaagtccaacagggccctagggtctccaactttggttacgggcctctatcagtcctacaggggatcgtgcccacaagacacccagtggacccagagaagtccaacagggttctggggtttccagctctgattacgagcctctgtcagttttacggagtgcttgtcacccccagcaaggtcatcaagacccctattaaccgggctttcatgaagaagtattgcgccccccaaacaggcgcagggcgagacaccacagcagcctggggatggccggcagcgggcaataaatgcacccccgtcacctctagagttcacctcagctcatccacaaaaaggttagagtgttgcctacgacccgtggtcgaccagcaggcgaccaagtccaaagtcaaag

SEQ ID NO: 70533 - DNA, 300 bp, Glycine max
  Peptide Sequence Number=SeqID_162218
atgaccaactactatccaccagaccttcctccttctattggagttcctcgaggcagccaaggagcagtgctgaagaaagttctccataggattgctgtgcagagctctaacttccttgacccaggaataaaattcccaccacaaaggcattattttatgacaagagaaaaaatggtgggatgcagattcaacttgactttggcagaaggggcagaggtcattttgaaggacaatctgcctcctaataaggttttccttagatggaagcctatcccagagaagtctccaagcaaaagctag

SEQ ID NO: 70534 - DNA, 672 bp, Glycine max
  Peptide Sequence Number=SeqID_162219
atgggatcaaatcaaacacctctgctcaagaaaaggttctatcaagtcaaaatcaagagcttagaggtcaccagtttacgagagttgggtcaattgatgggtcaacttcaacggaaagccttccacaaagcctatggtaagatttgggacctagctatggtagaagtctctatggaagcgattgcatcccttacccagtattatgaccaacccctgaggtgcttcacatttgaggatttccagctagtgctgactatggaagagtttgaagaaatcctgggatgcccactaggaggaaggaagcgatatcttttctctgggttctatccctccatggctagagttgccaaggtagtgaaaatctcggcacaagagttggatcgggtaaagcaaaacaggaatggggtagtcggagtaccaaggaggtgtttggaggaaaaggcaaaggccatggcaaatcaaagcgaatgggcttcttttattgacatcttggcacttttgatctttggggttatcctttttccaaatgtggaagggttagtggacctagcagcaattgacgctttcctcgcctttcaccatagcaaggaaatcccggtcgtcaccattttggccgacatgtatgacatgttcgaccggagatgtgaaaaaagcagtgcaagaattgtttga

SEQ ID NO: 70535 - DNA, 237 bp, Glycine max
  Peptide Sequence Number=SeqID_162220
atggtccccagtggagtcgccaactgtcgcagcctacccttcggcggaagggcgacgcgagggctcatgggtgcatcttccaagaaagaaaaatgcgcggagtcgccaccaacgtttattcgaggaaaacgtcggaaaaaccggaaaggaattaatgaaacattgggcttaatccggattttggttatggacttgaagagggcaaataaagcagtgcttaccttagttaatttctaa

SEQ ID NO: 70536 - DNA, 861 bp, Glycine max
  Peptide Sequence Number=SeqID_162221
atgaaaaaaacatggcttaccgccctgctggcggcctctgtcaccctgctcagcgccttggcgatcaataccggaccggatgaggcgctgtggcagaccgtgaagcaggtggcacacgataaatatcagctcgatgtcgatgtggtggcgtttaacgattacgtgcagccgaacgaagcgctgttcaataaagatgtggacgccaacgcgttccagagcctgccttatctggagatgcagtccaaagagcgcggatataaatttgccgtcgtgaccaataccttcgtattcccgattgccggttattcacgcaaaattaaatcactgcaggatctgccggatggcgctaccgtgaccgtgtctaacgaagcgaccaccttggggcgtagcctgctgctgttgcaggcgcagggcctgctgaaggtgaaacccgaagccggtctgctgccgaccacgctggatattaccgataacccgaaaaagctgaagattgtggaagtggatacgccacagctggcgcgcacgctggacgatccgcaggtttatctgtcgatcattaataataactttgccgcgctggtcaatttatccgcctcgcgtgacgggatgtttatggaaggcaaagcgtcgccgtacgtgaatgcgattgtggcgcgcgaagataataaagacagcccgaacgtgcagaagctgaaagaagcgttccagtcccagccggtactggataaagccaacgagatttataaaggcgatattattaagggttggatggtggtgccgaaatacaatgccgcacggatcgtagcggcgcaattcattgcgcattccggtagttgtgcggtgtttcactcagcgcgataa

SEQ ID NO: 70537 - DNA, 720 bp, Glycine max
  Peptide Sequence Number=SeqID_162222
atgttgatgccgaggcctccatctttcacaatgcaactttgcttgagtgagtcgaaacacgtacctagactctctagcagtgagcgccaaagtggaatcccaatcctccaaggcaagcgaatcccttccacggaaccgcctaaccgcgaaaaactgcgggtacttgggaaccaaacaatccttaaaatcggagggcagacccaactcaggcccaagaagctccaccgtttcgagcggcaccctgcaatcgacgcagagcatgagcagcttccgcaggttagtaaccaagaggggctccatttgggctcgggcatgggtctcctcttgggccaggcggagggcccgggccgtgagggagacggaagggggcgtgccggcgacgcggaagagggagggatgcttctccatgaggcccatgaaggcccatttgcggacgaagcccacgtgcttctcgaggtcgcggaggaagagggtttggggttgggattggatgagggagctgaggtggagaatcatggatggcttcttgcggagctccattactctgtcaagttcgggcactctgtggtacgttttcttcttcggccttcttccgccgctcgatttctgccttatggagaaactagcgtttttagagtggcggaacggaacgccgtggcgaagcatcgcacagaaacgcaagacctcctagtgaggtgtattatctgtgatcagagttaa

SEQ ID NO: 70538 - DNA, 459 bp, Glycine max
  Peptide Sequence Number=SeqID_162223
atggacgaagatcaatggatatatgatggtataatgtctgaagaagttgatatgaacgaacaaaatgaagacgaagttgttgtgaatgaagaacatgttgattgttttgatgcgttcaatacttctcaggtatttgctacccaagatgatgttttgcattggactcgatctgttgcttatgaaattggatttgtggcgataattatgaggtcaaacacaaatactggtatgagaggacgaacttcatttgtcttaattggttatgaaaagagtggtcagtataggtctaggaagaaagattttgtaagaagagatattggtagtaggaaatgtgggtgcccctttaagctttgtgggaaaccagtggttggagaccaaggatggatggtgaagttaatgtgtgagaaccacaatcatgaaatgacaaagtcattagttggacatccatacgttggttga

SEQ ID NO: 70539 - DNA, 3120 bp, Glycine max
  Peptide Sequence Number=SeqID_162224
atgccatattcttattcgttccgagtagtttctcatacaattatcaaacatgtacttgtttgtctcttgctggcaatagcaaagatagacaataataattcttcaaatccagtgacatgttttacttgtcgtcccaatgatacccctcagataaagtacgatgtctttgttagctttagcggcgctgacatacgacaagatttccttagccatttggttgagggtttttatcgaaggcaaattcatgcgtttgtagattacaagattctcaaaggggatcaactatctgaagcacttcttgatgcaattgaaggatcattaatttcattgattatattttcagaaaactatgcttcttcgcattggtgtttgtttgaacttgtgaaaattgttgagtgtagaaaaaaagatgggcagattttactacctatcttctacaaagtggatccttcaaatgtacgatatcaaaaggggacttatggagatgccttcgctaaacacgaagtaagacataatttgaccactatgcagacctggagatctgctttgaatgaatctgctaatctatcaggatttcattcatcaacttttcgggatgaagctgagcttgttaaagagatagttaaatgtgtgtcgttgaggttgaatcatgtgcaccaagttaactccaaagggcttgttggagttggtaaacgaattgcacatgtagaatcattgctacaattagaagcaacagatgttcgtgttattgggatctggggtatgggaggtattggtgaagaagatttgaaaattgacacacctaatggattgcctcaatatgttgagagaaggcttcgtcgtataaaagttcttatcattcttgatgatgtcaatgattctgaacaactggaaattttagctggaacacgtgattggtttggattaggtagcagaatcatcataacaactagagataagcaggtacttgctaaagagtctgctaatatatacgaggttgagacattaaactttgatgaatccttacggcttttcaatttgaatgcctttaaagaagttcatcttgaaagagagtaccatgagctttcaaagaaagtggtgaattatgcacaaggcattccattagttcttaaagttttgggtcaccttcttcatggaaaagagaaagaaatttgggaaagccaacttgaaaggcttaagaaagtgcaaagcaaaaaggttcatgatattatcaaattgagctacaatgatcttgatcaggatgaaaagaagatatttttggatattgcatgttttttcgatggactgaatctgaaagtaaacaaaataaaaattttattgaaagatcatgattattcagtggctgcgggattagaaaggttgaaggataaagctcttattagtgtttctcaagaaaatattgtaaccatgcacaacatcatacaagaaacagcttggcagattgctcgccaagaatccattgaagatcctagaagccaaagtcgactattggatcctgatgacgtttatctagtactaaaatataacaagggtaacgaggctatcagaagcatagtcatcaacttgtcgggaatcaagcaattgcaattaaaccctcaagtatttgctaagatgagcaaactatattttctagatttttataataaagggtcctgcagttgcctccgggaacaagggggcttgtatcttccccaagggcttgaatctttgtccaatgaattgagatatcttcgttggacccattaccctttggaatctctgccttcaaagttttcagctgaaaatcttgttgaactgaacttgccctatagccgagtgaaaaaactttggcaagcagtgccagatcttgtgaatatgaggatccttatactccattcatccacacaactaaaggagctgcctgacctatcaaaggccacaaatcttaaagtaatggatctccgattttgtgtagggttaactagtgtacatccatcagttttctctctcaaaaagcttgagaaattgtatctaggtggttgcttttcccttagaagcctccgaagcaatatccatttggactctcttcgttatctctccctctatggctgcatgtcactgaagtatttctcagtgacctcaaagaatatggtaaggttgaatttagaactcactagtatcaaacaattgccttcatctattggacttcaaagcaagcttgaaaagctacgtctagcatacacttacattgagaacttaccaacaagtatcaagcatcttacaaagctgcgacatctagatgtaagacattgcagggagcttcgaactctaccggagcttcccccgtcacttgaaacactagatgctcgtggatgtgtatcattggagactgtaatgttcccttctactgctggagaacaactgaaggaaaataagaaaagggttgctttctggaactgcttgaaattggatgaacattctctcaaggctattgagctgaatgcacaaattaacatgatgaaatttgcacaccaacatttgtccacatttggtgatgcccatcaaggtacctatgtgtacccgggaagcaaagttccagaatggttggtgcataagacaatacagcgtgattacgtgactattgatctctcttttgttcttgctccacactcctctgatcacttgggcttcatttttggcttcgttgttccggaagtccctaatgagggtttggttttggaatttaagataagcactggaggagaaggtgaaggtagcaatatcaatgtgtacttagacagaccacgtcatggtattaaatcggatcatgtgtatctaatgtatgaccaagcatgttctcgctacctaaatagtcgtgccaaacatcatccaaggttgaagattaaggttacagtagcatcgcgaacgcacacatccaagtatgtaccattgcagttaagagggtttggagtcagcacaatcaacactacacaatacctcagttttgttcgtaaagtagaattgggtgatgagcttctacctggaatcagggaagatgcagaagctggaactctgcctgctaatgttgttgcgggaatggaaggattctacaatatataa

SEQ ID NO: 70540 - DNA, 1047 bp, Glycine max
  Peptide Sequence Number=SeqID_162225
atgaagaacttatgtgagaatggctctggtcctacccatttaacatcttatgctcttggatgctcatcatgggggacttcctctgaatctgatgtgcaacaatcatccatgtccaaaagtttgagcttgaaaatgagtgttctgccgcaacaatgccataagaccaaaccattgagttttcaatatcaagatcgagattcatcttcaactcaatcaaccggtcagtcttatccagaagttggttcagcacaatcaggtcaaatttcagtgcagtgtagcaattcttctgctagttcaacacacaacacaactgggggaaagagtgtggaaggtgtcatcgggtcaactgtggggattcaggattgtaccttccctccttcacaactgtgttacaaccaatcacttgctcatactgcattccactttgctgagccgtgctttagtggcctactagctgctccatttgtgccacaatctaatattcatcatgctcagctactaggaatgactcctgctcgaattcctctgccacttgatcttagtgaggagcccatgtatgtgaacgcaaagcagtaccatgctattctgagacgcaggcagtatcgtgcaaaactggaagcacagaacaaactcatcaaagaacggaaaccatatcttcatgagtcccgccatctacatgcactgaagagagctagaggttccggtggacgctttttgaatgccaaaaagctccaagagttgaaactcacttcagcaaaccgtggcctagatgtttctggctgtactcaattgaatctgagtggaaatatgtcagaatcaaaggttcaagcagtagaaaacttgaactacagaaatggtgcttctacaaccacgtgttctgatgtcattagtacatctaatagtgatgatgtcttccagcaacatgagtcagactttaggttatgtggttacccttctcatattggaaggaacatgcagggttattccgcagacattggtggtggtggtggtggtggaaatcaacaccgtctatcagtccttatgtga

SEQ ID NO: 70541 - DNA, 1107 bp, Glycine max
  Peptide Sequence Number=SeqID_162226
atgttgacttgcatagcgtgtaccaagcaactcaacaatggatctcttcgccaagaagagggggaagaagctgttcacactcccagcaccaagcaagccatcaaggctctcacttctcagatcaaggacatggcagtgaaggcttctggggcatataagagctgcaggccatgttcaggatcttcaaatggtaacaggaataggaagtatgcagactcagatatggggtcagattcagcaaggttcaactgggcctaccgaagaaccgggagctccaattcaaccccaaggatgtgggggaaggaagtggaaaatggtagggtgaaagggctttcaagtggagaaggaacaccagcatcagtgagtggacgaactgagtcagtggtgttcatggaggaggatgagcctaaggagtggattgcacaagttgagcctggtgtgcttattacttttgtttcattgcctcagggagggaatgatctcaagaggatacggttcagtcgtgaaatgtttaataaatggcaagctcagaggtggtgggcagagaattatgacaaggtcatggaattgtacaatgttcaaaggttcaatcagcaagcagttcctcttccaaccccacctagatctgaagacgagagctcaaagattgaatctgctagggacagtcctgccactcctccactcagcaaagaacgtgcaccccggcattttcaccatccaatgggaatgggctactcctcatcagattcactggatcgccaccaaatgcaaccccacccttgctatgaaacaagcggtctggcatcaacacctaatctttccaacattagtgcaccaaagaccgaaagatcatcccttgatggttctgtaaggaccagttcatctggagaagatcactcgggcgagttttcaatcagcaatgccagtgatatggaaactgaatgggttgaacaggatgaaccaggagtatacatcactatcagagcactgccaggtggaaccagagaactcagacgtgtccggttcagccgagaaaggtttggagaaatgcatgcgagattgtggtgggaagagaaccgtgctaggatacaagaacaatacttgtga

SEQ ID NO: 70542 - DNA, 390 bp, Glycine max
  Peptide Sequence Number=SeqID_162227
atgatgagcaattccaaacaagagaagaaatggtgggaaaaagttatgaacagtatagggaattggatggcacacaagaaaaaggatgaatggttgaaggacatgaggggtaacctaagtttgctggctaccgtaattgcaacaatgacctttcagagtgctattaatccaccaggtggcattaggccagcaagtgaaactggagaaatcacatgtccagatatacaagcaaaaacattacgcatgtttggactcgttatttttatttggatcatacttctaggaatcgtcgcaattttcctctccctacgcctagttgtttggattgtcactaaacggcggattgaaaaacgaactgaacaaggagatcgaagatcaaaaccaaagtaa

SEQ ID NO: 70543 - DNA, 780 bp, Glycine max
  Peptide Sequence Number=SeqID_162228
atgaaggcaagcttgcagtttgactgcggaaagccatacaacataaccgcttgtggccaacagataaatttggcatgtttcagcactggcattttggatgatggaaatgctctttgccaggcttgtgaacagtcactgtcatctttgcttatgttgaaggatgtttatagaaaagagattgattatgttattgtatcaaaactgatcgatgtttgttatgatgttctgaaaatcaccacagatgccattccagattcagtaaatgagctgaagcaatattttatcagccttctcatgtgttctgcagaacagttaggttgggattctatatctggagaagatcattctatttcactcttgagaggagaagtttttcaagccttggctacctttgatcatgctaaaacacagcaagatgcattatgccgctttcagattttgttagatggcagaaatacttctctgcttccagccaacattagaagggttgcttatatagctgtaatgaggaatactaccacagaaaataggactggattggaatccctattgagtttctataggagtactgatgtattgctggaaagggaaaaatattacgataattgggaaagaatattggccagatatggtgcgggacttttacttaccaatttcataagccaaatgttcccactggttaatagtgatgagaaagcagatgagatagaagaattttttgccagtcacatgaaccattccatcattatgaatttgaagttaagcattgaacagatctga

SEQ ID NO: 70544 - DNA, 1401 bp, Glycine max
  Peptide Sequence Number=SeqID_162229
atggcgattgacggtagtttcagccttcattcttcgcttcggaggttcctcgatcgttgcccgaagctccagtgttttccgccgcttgagtcgctcgaacgaatgggagacttggtgacagaagaggaagtagttaatgtgttagtgggggtgtttctgcaccccagttatacaattccgttgattgggtgtttccgaccaattgctcaacatattgtagataaagctgttgctttgcttcgtcttgtgccaaatttgatgtctattcctaaggatactgctcgtgaagatgatcgtgacagagttttggatggagttgtgaatgtcatagagttttatagtcaacagggaaggggtctggatcttcatgagcttgcttgtctagccttctgccgtgctcttgacatgggtccttttctgctgagttgggaagagttctgtcaggacacatcactagagaaagctggctggtatgttaaaccaatagcagacattatgtctgattctctggataaaagaatggatttcaagaatgggaactgtttaaaatcctttggcttgaataatcagctggttagttcaccaaagcttcttgagttgcaaccgcgttttaagagtcaactgcttactacaagggatgatgtgtcagtaagtaatacattcgtatttacctcagctgtgaaaagaagttatgatagagttcttttggcggtgagtcagaagtggcctgttcttttatatggtccctctggttctggaaaatctgctctcattgccaagctggctcaggatagtggaaaccaaggtggctgcttcacgctagatatctcagtggttgttgttgggcttatcgggccacttgttttggacctcctgcaaacttggcttttggggttgagttggggtcaaactcaaattctaagagttctatctatccagatggatgatcaaatagatggtagaacattagttggatcttatgtctgtgcagataggcctggggagtttagatggcaggctgggtcacttacccaggctgtgcagaatggtttgtggattgtttttgaggatatcaacaaagcaccatctgatttacactccatattaatgcctttattggaaggggctggttcatttgcaacaggacatggggagaataaggatgatccaaatagtaacaggtttgattacaggagaaaaggtttcatgaaaatcaaaaccatgaacttgatgaaatcccttggctaccaatcgagctttgaacctgttaatggaaccatcagcattttcctttaccctgaaaacccatttacagccaatagcttgcctattaggagcatgtggttgggaaagaaaatggtaacagctttcaaaaatggaaatgctggtggatttccttga

SEQ ID NO: 70545 - DNA, 216 bp, Glycine max
  Peptide Sequence Number=SeqID_162230
atggatcgtagtgggctgctaggaggaaagggctatatattttgggtcatttgctcttatgctgatatattaaagaagaaaaaaaggggtggtaaagaattcaaggtagaggaagtggttggtggaaaaaattcaatggttgtgctcgaaagggtactacaaggtgatgtcctcgacaatgttggagatgaaaggatggttgttacaggaacctaa

SEQ ID NO: 70546 - DNA, 675 bp, Glycine max
  Peptide Sequence Number=SeqID_162231
atgttattttttgagaaccaagtcacgcaatatacatatctttggagggaaggggtacctaagaaggtggtggataagttggtgcggctacaacgatcatttctttggggtgaaggagagggacagaggaagttggcatgggtgaagtgggacacaatatgcctccctaaggagaaaggtggtctaggggttttggagtcaaagtatgggggatggagaaacttagatgaggcgaggaggtaccacaaggagtcaatatggtggcgggacttgagttttatgtgcagttcagaggaggaaggtgggtggctcaatgaaggtgtgaagtggaaaataggatgtgggtcgcggcaacatcacactattcaacagatgggcgttgaggtgggcgaatcatgggaatggaattttgagtggcagagattgatactggaaggggagatggaactagcagctagctttatggaggatagaggagttgaggttgtggcggatgagaacgaagacggcgcactcacacttatttggaaaatgaaaattccaagcaaggtagcacactttgtttggaggctggaggaagcgtcccaaacattttttggccgccaaagaataatgcctttatggtgggagagccttgcatggacagaagttgtaactgttccctgcatcacctaa

SEQ ID NO: 70547 - DNA, 1500 bp, Glycine max
  Peptide Sequence Number=SeqID_162232
atgaaattttgtatatttcaggaaaagaagagtatccgaccaactttttcagctgaacgaatatttggtggcactgtattggcaatgtgctcaaatgatttcatctgcttttatgattgggctgaatgcaggttgattcgtcgtattgatgttaatgttaaaaacctctactgggctgatagtggtgatctagtgacgattgctagtgatacatcattctatatcctgaagtacaatcatgatgttgttgcatcatatttagatagtggagggcctgtagatgagcaaggtgttgaagatgcctttgagctccttcatgaaatgaatgaacgtgtcaggacagggatctgggttggggattgttttatctacagcaattcttcttggaggcttaactattgtgttggtggtgaggttactacaatgtttcatttggaccgtcctatgtacttgttgggatatcttgccagccaaagtaaggtctatttgatagacaaagaattcaatgttgtgggatacacactacttttaagtttgattgaatacaagacactagtcatgcgcggtgatttggaaagggccaatgaaattctaccatcaattcctaaagagtatcataacagtgtggctcgtttcctggaatcacgagggatgatagaggatgctcttgaagtagctactgaccctgactataggtttgatctagccatacagcttggaagattagaggttgctaagggtattgcttctgaagtgcagagtgagtccaaatggaagcaattgggagaattagccatgtctactggaaagttagaaatggctgaagagtgtttaaaacacgcaacagatttgagtgggttattgctgctatattcttctttaggagatgctgaaggaatatcaaaacttgcaactcttgctaaagagcaagggaagaataatgttgcattcctttgcttattcatgttgggtaaacttgaggactgccttcaacttttggtagaaagcaatcggattccagaggctgctttaatggctcgatcctatctcccaagcaaggtctcagagatagtggcaatttggagaaaagatctcagtaaggttaatccaaaagctgctgaatcattggctgatcctgaggaatatcctaatttgtttgatgattggcaagttgcactagctgttgaatctaaagctacggaagcaagaggtgtttaccctcctgcatcggagtatgtgaaccaggctgataaatcacatatcacccttgttgaagctttcagaaacatgcagatagaagaaggggatcagcctcttgagaacggggactctaaccatgagttgactgaacaaaatggagaagagcactatacagaggaacatgaggagcacgaggaacaaaatggagaagaaggaagccaagaggaggcagttgtagtggatgccgattctactgatggtgcagtccttgtcaatggtaacgaggcagatgaagagtag

SEQ ID NO: 70548 - DNA, 642 bp, Glycine max
  Peptide Sequence Number=SeqID_162233
atgagacagcagtatggtttaaaggggaatggttgtacggattgcctgcttcattgctgttgcgagtcctgcaccctcagtcaagagtatcgtgagcttaagcaacgtggatttgacatgattattggtatggtggcatggaaatgtcgagcaacgaagtcggaagtagccatgactgctgcaacagctccattagtcgaaaagggcatgagttgtgcggggaaaagtaaggggttcaaggacggtttggacgaagacggccacgcgccgtcgtctccaacggaggtgaaacactcggtagagcctttaaacacgaggcgcagaggcgaggaggacgatggattgatccatcacgacagtgattcgaagtctccgaccaactgccccgtgagcgtgttgtgcggccccgattcggggacaaatttcaccggtagcagtagcggcggtagcagtagtagcaacaacaacagttccaacagcggcgggtgttgttccgggaacgtcactgaggttgaggtggagggagatgaggggcctcttaaatgcgatctcgcgttaagcaaaccttatgggtttagcgagtatgacattgatcacgctattagtgcgagattcacactaagcatgccttcaggcttctaa

SEQ ID NO: 70549 - DNA, 1557 bp, Glycine max
  Peptide Sequence Number=SeqID_162234
atggagagcctcccgcttgagacggcggagaagatcatcctgcggtgggactcgacggcgtcggaggaggcccgcgacaagatgatattctccggcggcgtgacggcgctgcttcctctgtttcgctcttctgttaactccgttaacagcagcagttatcgttccacaagcagcatccgcgagatcgatcttatcccctccgacgccgtctacgacctccgctgcatcgccgagcgcatggtctcctccggctacctccgcgagtgcatccaagtctacggcagcgtcagaaaatcctccgtcgatgcgagctttcgcaaactccaaatcgaaaaactcagcatcggagatgttcagcgtctcgagtgggagcagctcgagaacaaaatcagacgctggatacgcgccgccaaggtctgcgtcagaacgctcttcgccagcgagaagaagctctgcgagcaaatcttcgacggtgtcggaacttccatcgacgacgcctgcttcatggagacggtgaaaggtcccgcgattcagctcttcaacttcgcggaagcaattagcataagccgtaggtcgccggagaagctgttcaagattctcgatttgcatgacgcgttgacggatttgatgccggatattgacgtcgtgtttgattcgaagtcgtcggagtcaattagggttcaggctgcagagattttgtcgcggttgggtgaggctgcgagggggattttgtctgaattcgaaaacgctgtgcttagggaaccttctagggttgctgttcctggtggaacgattcaccctttgactcggtatgtgatgaattacataagtttgatctctgattacaaggttactttgaatgagcttatagtgtcgaagccctcaacggggtctaggtattctggtgatcctgggatacctgatatggatttgagtgagtttgaggagaagacacctttggatgttcacttgatttggattattgtgatattgcaattcaacttggatgggaagagtaagcactacagggatgcgtctttggctcacctttttgtcatgaacaatgtgcactacattgttcagaaggtgagggggagtcccgagttgagggagatgataggggatgactacttgaagaagctcacggggaagttccggcaggccgccacgagctaccagagggccacgtgggtgagggtcttgtattgtttgagggacgaggggttgcatgtgagtggggggttttcttccggggtgtccaagagtgctcttagggagaggtttaaggcgtttaatgccatgtttgaggaggttcataggactcaggcggtttggttgataccggatttgcagctcagggaggagctgaggatatctatatcagagaagctgattccggcatataggtcgtttcttgggaggttcaggagccacatagagagtgggaggcatccggagaattacatcaagtactctgttgaggacctggaggatgctgttttggacttcttcgaagggattcctgtttcccagcacttgagaaggagagctgaatga

SEQ ID NO: 70550 - DNA, 885 bp, Glycine max
  Peptide Sequence Number=SeqID_162235
atggagacacgtattggaaaggaagtaatgcctagagaagaattcagcgattggcctcatggtttactagcaattggaacatttggaaataagagtgaaatcaaagaagacttagacgaccaaaatacacaagaggatccatcttcatcagaggaaatagcagacttcactcctgaagaaattgggaatctacagaaggagttaactaaactcctgagacgaaaacccaatgtggaaaaggaaatttctgagctccctctggacagatttcttaactgcccttcaagcttggaggttgataggagaatcagtaatgcactatgcagtgaatcagaagataaggaagaagatattgagaagacactgagtgtgataattgataaatgcaaagacatttgtgcagataaaagaaagaaagcaattgggaagaaatccatttctttccttctgaagaagatatttgtttgtagaagtggatttgctccaacacctagcctaagagatacccttcaagagtcaagaatggagaagggcatagaggataagaagatgacaaggaagaggaatgaggatgaatcagatgagagaaatggtgatggctgtaaatgggtcaagactgattctgaatctaatgcagttcttgagggtgcttgtgagagggttattgttggtgatctatactgtgacatccctttaggtctttatgtgatccggggggaaaatgttgttctaattggtgagctggacttggagagggaggaacttcccgaacatatgacacgtgtttctaccgcagaaatcaagagggcacagaaagcagaaagggaagcttcagatctgaaagggactatgaggaaaagaatggaattccttgactttgactaa

SEQ ID NO: 70551 - DNA, 564 bp, Glycine max
  Peptide Sequence Number=SeqID_162236
atgacggcctccgatttgcggttgtcttcggaggccaccgcaacctcggaaggggagggggaagagaaagaaaaagagaaagagaagggtaagggggaggaggactcagaagaagagggggatggaggactagaaggaaagaaagagaagaggggacggaggaataaagaatcaaaaaagaagaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 70552 - DNA, 459 bp, Glycine max
  Peptide Sequence Number=SeqID_162237
atggagagtggattgatattggtcttcatgtttctgatcctggcaagcgatgcatttaaggtttggagtaacgataggatacactgttgtgagcaccgagtgatgattataaatgcaaagaaggaaaggtactccatgggactattttcacttggcggcaagatggttcaaacaccagaagagctagttgatgaaattattaatatcaattatgcaacaagcgaggagcaatggtgggggttctccttgttctgctcatcgtcaattgcgaggagctcagattgcgatgccatgagtgaaaggatagaaggaaaattgtgtgctaatgcggctctccccactaagagatctttcttctgcatcttgaagctccaagactctataatttccaaaacactgcaacgcttcacaaccttcagaaggtggccaaggttgcgcaagaaagacgaacaagagtga

SEQ ID NO: 70553 - DNA, 3093 bp, Glycine max
  Peptide Sequence Number=SeqID_162238
atggctgcgttcgctaaaccctcccattcccaacttcgtgcccaaagggatcatcctcttcttccttctacttcaacttcaacttccagcaacttcaagctcaaaacattcactttctcccacaacttgcacacacttcaccccccttttagaaaagctaaacatatttgtgtctcgaattctgccactaccaccacctccctcagcagcaaccacaacccaaactctcatatttaccaactgtgccttcttgggaacttggaccgtgccatgagctacttagactccatgcacgagcttcgaattcccgttgaagatgatgcttacgttgccttgatacggctgtgtgagtggaagagggcaaggaaagaaggatctcgtgtttactcctatgtttccatttccatgtcccatttgagtcttcaactggggaatgcccttttgagcatgtttgtgaggtttgggaacttggtggatgcttggtatgtttttgggagaatggagaagaggaatttgttctcttggaatgttttggttggtgggtatgctaaagctggcctctttgatgaggctttggacctctatcatagaatgttgtgggttggtgtgaaacctgatgtttacactttcccttgcgttttgaggacttgtggtggcatgcctaacttggtgaggggtagagagatccatgttcatgtcataaggtatgggtttgaatcagatgtcgatgtggttaatgctttgataactatgtatgtgaaatgtggggatgtcaatactgctaggttggtgttcgacaaaatgcctaatagagataggatttcgtggaatgccatgatttctgggtattttgaaaacggggtgtgtttggagggactgagattgtttggcatgatgatcaaatatccggttgatccagatttgatgaccatgaccagtgtgattactgcatgtgaacttctgggtgatgatagattggggaggcagattcatggttatgttctgagaacggagttcgggagagacccttcaattcataattcgttaattccaatgtactcatctgttggacttattgaggaagctgaaacagttttctctcgaacagaatgtagagatgtggtatcgtggactgcgatgatatcaggttatgagaactgtttgatgcctcagaaagctcttgagacatataaaatgatggaagcagaaggtatcatgccagatgaaatcaccatagccatagtactctctgcttgttcttgcttatgcaatttagacatggggatgaaccttcatgaggtagccaagcagaaagggctcgtctcttattcgatagttgcaaactcactcattgacatgtatgccaagtgtaaatgcattgacaaggccttagagattttccattctactcttgagaagaatattgtatcttggacatctataatccttggtcttcgcatcaacaaccggtgttttgaagctttatttttcttcagggagatgattcgtagactgaagccaaactctgttactttagtttgtgtcctttctgcatgtgctagaataggagctttgacatgtggaaaagagatccatgcccatgcattgagaactggagtaagctttgatggttttatgcccaatgcaattttagatatgtatgtaaggtgtggaagaatggaatatgcttggaaacaatttttctcagttgatcatgaagttacctcatggaacattttgctaacaggatatgcagaacgtgggaaaggagcacatgctactgagctttttcagagaatggtagagtcaaacgttagtcctaatgaagttacatttatctccatattatgtgcttgcagcagatcaggtatggtggcagaaggcttagaatattttaacagcatgaagtataagtactctattatgcctaatctgaaacattatgcatgtgtggttgatttacttggccgttctgggaaattggaggaagcttatgaattcatacagaaaatgccaatgaaaccagacccagcagtttggggagctttattaaattcatgtaggattcaccatcatgttgaacttggggagcttgctgcagagaatatctttcaagatgatacaacaagtgttggatactacattcttctctctaatctttatgctgacaatggtaaatgggacaaggttgcagaagtaagaaaaatgatgagacagaatgggctcatagtagatcctggatgcagctgggtggaagtcaagggtacagtgcatgcttttctcagcagtgataactttcaccctcaaataaaggaaatcaatgcacttctggagcggttttataagaagatgaaggaagctggtgttgaagggccagaaagcagtcatatggacataatggaagcttccaaggctgatatattttgtgggcacagtgagagactggccattgtctttgggcttattaattctggccctgggatgcctatttgggtgacaaagaatttgtacatgtgccaaagttgccacaacattgtcaaatttatctctagggaggcatctgctcttgcacggatgaagcttataggagctagcctgattagcaggaaaactcgctgcaattccgcaaattccgttattgcggtttgtaagctgtctggggatttgtttcccgaacgtgaggcttcggctatgcatgtttcggtgagtgtggggcttatgaatttcgtggggtgttggttcggagccatgccttgtacttctggtggtttggcgggacaatacagaattttgggtcagtttccaattgagattcttggggtgcttttgttgtttgctgggattgagttggctatggctgccaaggatatgcttgtttgtgaggctgtttctctcactggatcaagtggtgcgttaggcttctttgttggcattgtgcttggggtgatgcgtgcaccaggctttttgccaaactacgatgcaatggattgttggcgtgccgttggattgggaaacatccgaacgtggttgaagatacttaggacttcacagtctataattcagtgctttggaatttggatgtactctctttaa

SEQ ID NO: 70554 - DNA, 1461 bp, Glycine max
  Peptide Sequence Number=SeqID_162239
atggtgaaggacaaattaaagaaacatgttctaactgctttcactcctaatgaggattctgtggctattctgtctgccaacgaggtggccaagggaacaagcttattagctctcagcacaatcgatggaagtgttatagctgttgatgtttccactggtgagagaaagttgactaccagccatcctggggggatttgtggactctcatttgcaaacaaaggacgtcttcttcgcattgttggacataatggagtggcatacgaggttaatactgaaacaggagaggttttaaaggaatttaaaatctcaaaaaagtctattacttctctggctttctcaaatgatgaaaaatatttagctattgtcagctctagactgcggattataagctgggaaattgggaaagagattctgaagttccctaatgatttgggaaatgtacagctcatttctatatcgagtgatgccaaaaatttagttacatcagattttgagggtaaacatcttcaagtttggaagtgtgatttaaattcaggaaatgtgggtagagttactggtagaggttctgcctatatatggaatttgaatgcttcctccgaagatcagatacagccaactaaattgaacacgaagaccaaaatagttgaaacggagaaggaaaatggtgtaagttcaaagaaaaggcatgcttcgattattgcatccagattacaacctgtagaggaagataaacagattaaagctcttgtgacttatggatctgtagatcatccacagtttagtgtcttaaatattagcaattcaggcgagaatatagtattatatgttggagatgagactgattctgttcagcagcatgacagtccttctggcaaagcagcaataccaatggaaagcaagaaagttaagaaaagacaagcaacatctgatcctgatccaccaacctcaactgacgaggaggatttagatcaacatgaggctgcagaaggagtccttcttgatgacgatttgaatgagccaacaatgggagagaaacttgctagtctaagtttactggatgagaacaaatcaaggagtgaaatagagcaagaatcttctgtcccagcaaagcctccaagtgcagactctgtacatgttttgcttaagcaagcattaaatgctgatgatcgcacccttctgctagattgcttgtatacacaagatgagaagctgattgagtctagagtctccacttttaaatctgccatccaactctcaagttgtttagacacgcttcacataggggctattgacgaggaggaagatgaaggtgaaatggtgccagttatctatgaggataaggatagtagtgatgaagaatctgatgataccatggaaactgacccagatgaacaacaaccagaagaacaatttcatgctgccagatacattgatgcaagtgatgatgatatgtcagattga

SEQ ID NO: 70555 - DNA, 1977 bp, Glycine max
  Peptide Sequence Number=SeqID_162240
atggctactgcagcaggtgcagctgcccttttgtactacacattgaatcggaaattgcagactcacgatgtaattgatgaagaaaatgggagtgatccgccagctgatacgccattaggtattggccgtgtttctcatcggttaatccaagcccctgcaacatggttggagacaatttctacattgtcagaaactctcaggttcacttattcggagacacttgggaaatggccaattggggatttggcgtttggtatcagttttcttctaaagcggcaggagagtaatatggctaagggaaactatcatgtgggcagtgaattttgtggtaaggacagtgtgcagctgaaaggatctgaaattactgctgaacttaagtatctcttaaacttgttgacattgtgttggcacttttcaaagaagccctttcccttgtttttagaagaaactggctacaccgaagaaaacgttctccttcgagaagcaaaagcaggaattttgaaaccagcttttacaataatagctgatcatgagatgggatgccttttgttattgattcgtggcacgcatagtatcaaggatactttaacagctgttactggaaatgtggtaccatttcatcacactgttgttaatcaggggggtgtcagtgatttggttttaggttatgcacattgtggaatggttgctgctgctcgatggattgcaaagctcgcaactccttgtctccttgaagcacttggccactaccctgactataaagttaagattgtagggcactctttgggtggaggaactgccgcaattctaacttatgtgttgagagagagaaaggaactgtccgtaaccacgtgcgttacatttgctccagctgcttgtatgacatgggagttggcagagtcaggtgatagttttattacttctattataaatggagctgatttggtgcctacattctcagctgcttctgtagatgacttgcgttctgaggtgacagcatcagcatggataaatgacttgaggaatcaaattgagcaaacaagaatactcagtactgtctatcgttcagcttcagcattaggttctcgcctcccatcgattgccactgctagagcaaaagttgctggggctggggccattttgcagccagtttctaatggtactcaggttgtgatgaagagggccaagagtatggctcaagcagcatgggcacgtccaaaccttaatttgtcctcttggtcatgcatgggacctcgtcgaagagccatgagtgctcattactccagagatgggggaaattcccctacttcttcttcctctaccaacattgaaagttccgatccacttcttggttctcccacaaaggcaattaatgcaaagaatatgaaccttcctgtatcttcatctatagaagagtggtcttctgagattgaatgtggcaatgaaagtagttcagatactgaggtggatgttgatcatgatgacagtctgaacatgatggacagtgacagatatgaggatcagatgagtgaagtggagttgtggcatcaactggagcatgagctgtatgatggacttgaaggtgaggagactgatgttgcaaaggagataagggaagaggaagcagccatagcagaggaagtagggcaaacccggagctctgcaccaaaaatgaaagaaatccacagatttttccctccgggaaagataatgcacattgttacactccactctgacgctgccgagcatgaaagtgatggtagccgaacctctgcaagttcagagagtagtgagctaaatgagactaagattgggatttttctaacttcaagatctctgtatagtaaactcagactttcacagagaatgatcagtgatcacttcatgccagtttatagaaggcagattgaaaggctaataaaagaattcgaggaagaatctactgagggtcacaatacacaagaggtagtgctatag

SEQ ID NO: 70556 - DNA, 282 bp, Glycine max
  Peptide Sequence Number=SeqID_162241
atggatggtggtggctacaacttaacaacaacctctttgagcagttcaatggagcaagtgatgagacccaaatcaccattgccgggcttagttgattttcatgggaagcggaagcaaatggttaagattcaggttttggagagagagattgtcttccacgggtttgctgctccaacagttgcctgctgcataagaaaacagcaaaaggttgttgttgggactgctgttcttcatcaaactccaagtgttgtcactgttgtggctgctgctgctgctgcttga

SEQ ID NO: 70557 - DNA, 360 bp, Glycine max
  Peptide Sequence Number=SeqID_162242
atggctcttgtctcagtcaccaccgcaaattcttcgaagttcattctcttacgcactctctctcgttctcacgctttctccttcgctctccaccgtcaattccaactactctcgtcttcctccgctgtgctccgccgtcttccccggttcctcgccgcctcccccggttctccgctcccaccttccgaaaacgattccagcaggcaccttgaaggagcagatgttgctacatctttagccaaaattcaagatagaatacagatcttctttgctgttcttttctggatatctctattcttttgggcttctgcctgggatgggaggaatagaccaaacaagggatcaagatttagaagataa

SEQ ID NO: 70558 - DNA, 336 bp, Glycine max
  Peptide Sequence Number=SeqID_162243
atggctccacctgctgctagatcctatcctctacatggtctcaaacttccaatcactgtgcttttcgtctttttcctctcctttctaccttccaaatctggtggatcagtgatggtggagacaagggagggtttggagcaaagaaaaatggtgatagggtcaaagccacctgcttgtgtgaataagtgcaagagttgtaggccatgcatggctactctggtcgttccaaatcaccaaaagaggaagggtttcaaagtgtcttctcgtggggacgatgatacatattatctcctttcatggaaatgcaaatgtggtgataagctgtttcaaccgtga

SEQ ID NO: 70559 - DNA, 378 bp, Glycine max
  Peptide Sequence Number=SeqID_162244
atggaccaaaacttaactaacatgcagggatttttgggctcgggtgtggatttcccagttgggaacgtgtcgtttttcttgtttttttcggggcatgttgcgggttcagtgattgcttccttggacatgaggaggatgcagaggtgggaactggcttggacttttgatgtgctcaatgttttgcaagctgtgaggttgctgggtacaagaggacattacactattgatttggccgtaggggttggtgctggaattctctttgattctttagctggcaagtacgaagatagcaaaaggaatgctgctctatccacaacccacagagcacaatttgattgcgtcaacaatgtggatatagctaaaaaaattaacaaatga

SEQ ID NO: 70560 - DNA, 510 bp, Glycine max
  Peptide Sequence Number=SeqID_162245
atggcgacggcaacgtaccctccaccgccaccttattacagactttacaaagattacttgcaaaaccctaagtctgctcccgaccctccaccgcctattgaaggcacttatctttgttttggagccaattacaccactagtgatgttctaccaaccttggaagaacaaggggtgcgccagctctattctaagggccctaatgttgatttcaagaaggagctgaggtcactcaacggagagttgcaactacacgttttggagcttgctgatattcttattgagagaccttcacagtatgcaaggagagtagaagaaatttcaacagtattcaaaaacttacaccaccttttaaattcattgcgtcctcatcaggcgagagcaacattgattcatattttggaacttcagatacagcgccgtaaacaagcagtggaggacataaagaggaatctagtgctctggtaccatgatagtgaaatgtctctgttctatcaatttgagagcctttaa

SEQ ID NO: 70561 - DNA, 1197 bp, Glycine max
  Peptide Sequence Number=SeqID_162246
atgattgatggctaccttagaatgaaccatttcataggggctttggcacttttccgtgagatgcaaatgtcaaatgtgaaacctgatgagttcaccatggttagcattctaatagcatgtgcacttctgggagcacttgaactaggggagtgggtaaagacttgcattgacaaaaatagtaataaaaatgatagttttgttgggaatgctctagtagacatgtactttaaatgtgggaatgtcaggaaagcaaaaaaagtattcaaggaaatgtatcagaaagacaaatttacctggacaacaatgatagttggtcttgccatcaatggccatggtgaagaagctcttgccatgttttcaaatatgatagaagcttcagttacaccagatgagataacctatattggtgtcctatgtgcatgcatggtagacaaaggaaaaagttttttcactaacatgaccatgcaacatggaattaagcctactgtgacacattatggatgcatggttgatctccttggttgtgttgggtgtttagaagaagcccttgaagtcattgtgaatatgcctgtaaaaccaaattcaattgtttggggatcacctcttggtgcttgtagagttcacaaaaatgtgcaactagcagatatggcagctaaacaaattcttgagttagagcctgaaaatggggctgtttatgtcttgttatgtaatatatatgcagcctccaagaaatgggaaaacttgtgtcaggtcaggaaattgatgatggagaggggaattaagaaaacaccaggttgcagtttgatggaactgaatggcaatgtttatgaatttgttgctggggaccagtcacatcctcaatctaaagagatatatgcaaagttagaaaacatgatgcaaggcttgataaaagcagggtactcacctgatacatcagaggttttccttgatctaggggaagaggataaggagactgcactttaccggcacagcgagaagttggctattgcctatgctcttattagttcagggcctggagttaccataagaatagtgaagaaccttagaatgtgcgtggattgtcaccatatggcaaagcttgtgtcacaagcttacaatagggaactaatagttaaggataaaaccagattccatcatttcaggcatggttcatgttcatgtaataatttctggtaa

SEQ ID NO: 70562 - DNA, 5127 bp, Glycine max
  Peptide Sequence Number=SeqID_162247
atgcccccaagatcaggaaaagggaaatcaaataaagcaaaggcagagaaaaagaaaaaggaagagaaagctgcagcagcaccttctcttgttgacatcactgtggtcaccccatatgacacacagattgtcttgaagggtatctctactgataagatacttgatgtaagaaaactattggctgtgaaggtggagacatgccatttcacaaactattctttatctcatgagaccaaagggcagagattaaatgacagagtggaagttgttaccctaaagccatgtcttctaagaatggttgaagaggattatacagatgaagcccaagcaattgcgcacgtgcggagggtcttggacattgtggcctgcacaacaaggttcggtaggcccaaacggagcgtagcaagctcagagtcaaggcccaagaaaaatggtaaggcccaacatcagaaccagacaagtttgagcccaccggggacaccgaatggggaatcccgggtcgggtcaccgtcgtcggaggcgccaccgtcggcgatcttggataacgtggggatgaaggccattcacccaacaccgaagctctcagatttctacgagttcttctccttctctcacctctctcccccgattttacatttgaagagatgtgaagtgaaggatgaagaggataggcgcaaaggagattactttcagcttcaggttaaaatatgcaatgggaaggtaatagaagtggttggttctgagaaagggttttacacagtagggaagcagtctctgcacagccacaccttggttgatcttctccaacagctcagccgagcctttgctaccgcatatgaatcattgatgaaagcctttttggaacgtaataagtttggaaatcttccgtatggattccgagcaaatacatggcttgtccctccgtctgtcgcagagtctccttcaatctttcctgcattacctgctgaagatgaaaactggggtggtaacggtggtggccaaggaagaaatggtgaatttgagcttagaccatgggcaacagattttgcaatactggcctctcttccttgcaaaactgaggaggagagggtggttagagatagaaaagcatttctgcttcacagtcagtttgttgatacctcaatatttaagggtgttgcggctatacagcatgccatggaatccaagttaaataccaagaatgaattgaattcttatccagattctgttctgcatgaagatcacgtgggagacttatccattatagtcaaacgtgatatccaggatggaaatgcaaagtacaattctttactggatgaatctagcatgcataaggtggatgctcagaagaatttactcaaagggttgactgcagatgaaagtgtaattgttcatgatatgtcttccttggctgttgttgttgtacaccactgtggatatactgcaacggtaaaggttgtgggtaatgtgaacacaaggaagcctaaagttcgagatattgagatagatgatcagccagatggaggggcaaatgctctcaacatcaacagtttgagggtactgcttcacaagtcgggagctgagtcattagaagggactttatcatccctgtcaaattcgaatgacttagatgcttctaaagtccttgttcggaaggtggttcaagaatgtatggaaaagataaaggaggagccaagtgcttcagaaaggtctattcgatgggaacttggttcctgttggatccagcatttgcaaaaacaggaaacttcaacagataacagttccaaaaacaaagaagatggcaatgatcttgagcaagctgttaaaggtcttggaaagcaatttaaatttttgaagaggagagagaagaaatccaataatctagatggtgcagattctagggagcaaaatgactctagacttgcaaacatgaatgatgttgcggataaagttgagccaaacaatgatgacttaagtaactctaatgaattagagaaactactttctgaagaagcatttttgcgtctcaaagaatctggaactggtcttcacacaaagtcagtggatgagcttatcagcatggcacacaagttttatgatgaagttgccttgccaaagctggctatggactttggatcactggaactttctccagtcgatggtcgtacactgactgactttatgcatttaagaggattacagatgcgatctttgggtaaagtggttaaacttgcggagaatcttccacacatacaatccctttgtattcatgagatgatcactcgagctttcaagcatctacttaaagcagttactgcctctgttgacaatgtagctgatctatctgcagccattgcatcaacactgaatttcttacttggtgggtctcgaacagaagatggcgctgaccaaattttgattgatgatcataatctcagaattcaatggttacatctgtttttgtccaaaagatttggctggacactaaatgatgaatttcaacatttaaggaagttgtcgattctcagagggctctgtcacaaggttggattggaattgttcccaagagattatgacatggagtccagtaagccctttgggaaaaatgatattatcagcctggttcctgtttgcaagcatgtagggtgctcctcattagatggacgcaatttattggagtcttccaaaattgctcttgataaaggaaagcttgaggatgctgtgaattatggaacaaaggcattagctaagatgatggctgtttgtggaccctttcatcaaaatactgcaagtgcatatagtcttctagctgtggttctctaccacactggagattttaaccaggccaccatctatcagcaaaaggccttggatataaatgagagggagctagggcttgaccaccctgacactatgaaaagctatggggatctttccgtcttttattatcgtctgcaacacattgagttggctctgaagtatgttaatcgtgctctattccttctacattttacatgtgggctgtctcatccaaacacagcagctacttatataaatgtggctatgatggaagaggccatgggaaatgttcatgtggcactcagatacttgcatgaagctcttaaatgcaacaaaagattgttaggagcagatcatatacagactgccgcaagctatcacgccatagctatagctctttcattgatggatgcattttctctgagtatgcaacatgagcaaactacactaaagatacttcaagcaaagcttggatcagaagatcttcgtacacaggatgctgccgcgtggcttgaatattttgaatcaaaagccatagagcagcaagaagcaactaaaaatggaactccaaagcctgatgcatccattgcaagtaaaggtcaccttagcgtgtcagatctcctggattttattagtcccaacccaaaaggaaatgatgctcggaggaaacagaggcgtacaaagatactctcaacaagtgataacaacagtcaagaacatgatgaagcaatagctgatgagacaattctttttgataactcaaaagatgctctaagtatgatacaaggcaaaatagaagaaacaaatggcaaacttgattctcaagtacagaaacaaaatggtgatttcactgggtacagaccagtgacaagtgaacctgtttatgaggcgtcatctgatgaaggttggcaagaagccaattcaaaagggcggtcaggaaatgctgctaaccgcaagtttgggcacaaaaagcgacatcatctatcaaagctcagcattaatggttcaaataattacatttacagggaaggcagttctaggaatgagattacttcgccaccacaaagaggagttccaaaagtcatgttagacatgtcatctccatctagacaatcaaaatctagaaacttaactttgaatgaggattctgttaatcattcaacaaaagcttctgtgtccaaaatttcatctccggcatctctgagttccttggcttcaaagtctatatcttacaaagaagtggctttagcaccaccaggaactgttttaaagccattgttggaaaaggctgacatggaaagggttaatgctggagatgagatatgctgcaatcctgctgtgacatcaataagtgaaggtagttgccaaagttccataactaatacagtttgtcagcatgatgaaacagaggaaactcatgaaaatgaacctcaacaagaaagttctggatcggaacttgagaaggtttctgatcaggcaaaatctacagcagaaacaaatggcagtaagctttcagctgcggccaaacctttcaatccaggaatgttgtccatgtctcaccatttaaattcagcttccttcacaagcatgtatgatacagatgttagtcaaggcatgcacgtggagactgtgcttccccctgctgttgctagggtcccttgtgggcctagatcgcctctgtattatagaaccaactatacttttcgcatgaaacatggttctactaaaggtcaaacctctatcagagaaagaagtggatttgggtctccaagaataatgaatccacatgcgcctgagtttgttcccagaaatgcttctcaaatagaagccaatgatgccaattcaaatgtttccaatgagcataactctttgtctgacataggcatgtcagaagaaaacaagctagatgaaaattttgttgaaatcaatgggagttccaacaaaaacagtatttctgaatctgagaagtccgagatagctaggcagatactgctcagttttctagtgaaatctgtcaaggaaaatattgattctgtggatgagtctaaggatggtgaaggaaaaattgagatcttggaaagttgttctgatgaaatagccaaagacagtgctgtcataaacattatgtatggaaatgaagaaaagaataagacagtgcctcattccagtgatagtgatgagcaagagaaattaggtgttactgaaaaaaagaatggagatggtgaagggtttatagttgtctcgaagaggaggaaaaacaggcagaagatcacaaatggagtcacagaattgtacaaccaacagtccatttgtgcttcagttcgttga

SEQ ID NO: 70563 - DNA, 867 bp, Glycine max
  Peptide Sequence Number=SeqID_162248
atggaggaatatccaaccattcaagtctcaaagagtgcacatctgctagatttcctatatcacatgattgtccccaatatattagaaggccaagatacaattgaagttgagtttaaacaaggagaagaagaagaggaaggaaatgaagaatcaaatgctgacttcagccaagttaagcaactctatagtgaactatggaagaggctttcaaaactaaacaaagggccagtgaagttaataattgtatctagacgatttaaggttctgaagcaacctcttgagtaccttttctctcaaaatggaggagaaagtgagaattcaagctcaaatagtagtctcaagaacaagccaccctcggtggaggaaatcactgttccttctgttacagaactcttgaattcgggggttcgttttttacctactaacggaagcatattaaacattacttttgatgcgaaaacatgcacgttttacctccccacaataggtttggatgctaatactgaagttttcctgaaaaatttggttgcatatgaagcatcagttgcatcaggtcccttggttgtaacccgttacacggagttgatgaacgggattatagactcggatgaagatgcaaagattctcagagaaaaagggattattctgaaccacttgaagagtgataaagaggtggctaacctgtggagtgggatgagcaagttgttgagattgtcaagggaaccattgctggataagaatgaaggtttaagttgtgaagttcatcaaggcttatgtgcttggttcatggcagattttaacgttccttactaccatcatgctcttgctcttgatgaccttgcaagcctgctgctctgtctatactag

SEQ ID NO: 70564 - DNA, 117 bp, Glycine max
  Peptide Sequence Number=SeqID_162249
atggttatgaaccgcgattgtcaaaggtcggtcaacgcttggaagaagaaagataatgctggtctgctcaagaattgtgaatctcagctccaccaactctctagcctttgctcatag

SEQ ID NO: 70565 - DNA, 210 bp, Glycine max
  Peptide Sequence Number=SeqID_162250
atggaggagtcaggggaaaattggccttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaaggtcggtaccaaatttttttaa

SEQ ID NO: 70566 - DNA, 174 bp, Glycine max
  Peptide Sequence Number=SeqID_162251
atgataaacaaagaatttgagcatgcaaaaaaccgaggatccaaaatctatgcagaggttcgtggctatgggatgtcaggtgatgcatatcatttaactcaacctcctagtgaggggagaggagccattttggccatgactcgtgctttaagacagaggttttctgttggctga

SEQ ID NO: 70567 - DNA, 483 bp, Glycine max
  Peptide Sequence Number=SeqID_162252
atggttgaaagacaaaaatggcaaaggagagtgggcctcactattgagaggataatcatgacggacaagacttcaatcctggccaatgctagtagctatgtgaaacaacttcagcaacgtgtgagggagctagagcaagaagttcaatccaacgtttctagcaatgaaggtgccaccagctcttgcgaagtgaactcatccaatgattattactctggtggtggaccaaatgaaattcttcccgaggtcaaagtaagagtgttacagaaggacgttctcatcataatccactgtgagaaacagaagggcatcatgctcaaaatactttcccagcttgaaaatgttaatctctctgtagtcaacagtagcgtcttgcgatttgggaaaatcactctcgacatcaccattattgctaagatgggtgagggttacaagatgacggtggatgaactagtgaagaccctgagagtagcgatatcttga

SEQ ID NO: 70568 - DNA, 747 bp, Glycine max
  Peptide Sequence Number=SeqID_162253
atgaatgatgattttagctgcaccaacgctgtatcctctgaagagatggttaggttgaacaatgatagctcaaatgttgtagcagcgattggaccaaaagtggaatacactgactcctatttgaagagcagtgaagagaaattaggaagttgttattggcgtaaaaggggtgtggaaaaccatgagttggaggcaaaggcaagggataatgagagaggaacaaaaagggcaagaacctcttctgagacacaatatcatgtgatgtcagagagaaaaaggagacaggatatagcagagaaattcatagcactctcagctactatacctggcttgaagaaggtagacaaggctacggtgcttcgggaagcccttaactacatgcgacaacttcaacagcgtatagcagtgctggaaaaagggagcaataataaaagtataaagtcattgatcatcacgaaatcacgtctttgttctgcttcatgtgaaacaaactctaatgaagtgctccctcaagttgaagcaagaggtttagagaaggaagtactcattagaatctattgtgagaaacgaaaggacatcatgctcaagcttttggccctgctaaaagatgttcatctatcaatagccagtagcagcatattgcaatttggaaactctattctcaacattatcataattgctcagatgagtgagaaatacaacttgacggtgaacgatttggttaagaccttaaagcagatcttttga

SEQ ID NO: 70569 - DNA, 516 bp, Glycine max
  Peptide Sequence Number=SeqID_162254
atgttgtgcataacctcacaacacaacaccactaataacacgacacaacaccaccatagtacacgccacccgaaaagcaaacgggtacaagtcggatattacgaaactgcccctgatcctcgttcgccgccgttcttgttggcaattacggtaatttccgagagagaagcggcgaggaaaaaacgcgagaagggaacggaacggaagttacggaaggcgttcacggcggagatggtaggcggcgatcagaggggtgttggtgtggccctcgtagccgtcgatggaggtggcggtggtccaggtgaggggagtggtgggggtgtcccgggcgccgctgatggggagccttggggtgcggcgctggcggtggacccagcggcggatgacggagggtcggtggtggtggtggtgacggaggaggaggagctggttggcgacgagggtgtcgtcggccatgaccattgtaacccattggtcattgaccttagacatgataatggcagaagagttggttga

SEQ ID NO: 70570 - DNA, 660 bp, Glycine max
  Peptide Sequence Number=SeqID_162255
atgctgtgcaggaagagctccaaaaacgacgtcggctcgggatcggtgccggtgcacctcaacgtctacgatttgacacccatcaacggttacgcttattggttcggcctcggagtgtatcattccggcgtgcaagttcacggcgttgagttcgcgttcggggctcacgagtactcgttgacggggatattcgaaggagaaccgaagaggtgcgaaggtttcgcgttcaggaaaacgattctgatcggaaaaaccgatatgagacccggtgaggttaaggcggtgatggaagaacttgctgctaagtacagaggtaatgcttacaatctcatcacaaagaattgcaaccatttctgtaacgatgcttgtcttagactcaccggaaatcctattccaagttgggtcaatcgtcttgctcgaattggatttatgtgcaattgtgttcttccggtgacattgaactcaacaaaagttaggcatcacaagatggaagaaaagcaatgtgaaggagagaaacaagcattagcgactaaggcaaagaaacttagtgcttcaaattcatcatcatcttcccctgagggactgcgcaggggaaggagtagaaaccgacgtgcccttcctccatcttcacctttgattattggatcttcttcatcttga

SEQ ID NO: 70571 - DNA, 287 bp, Glycine max
  Peptide Sequence Number=SeqID_162256
taattctcaaaatgggattctttctaaacaatttttgggatgggtctgtttttgacgtgaacttccaaagaaaacgccagcagcaatggcgatttgagcatgcagcaacacgtggagggaaaatcgccaatatcagcggcgatttcgtgtcacctggactcgccagtttgactggcgagttgcaccctgtctcgccagacacagtggcgacatgcctccaggctagcgcttctgccggtctcgccagctcaggaattgctgaatgtacccctaaatccttgagttag

SEQ ID NO: 70572 - DNA, 63 bp, Glycine max
  Peptide Sequence Number=SeqID_162257
atggagaaaaatgaatggagaaaaaagaaaaaagatttaaaacatctgaagtgcattaattaa

SEQ ID NO: 70573 - DNA, 288 bp, Glycine max
  Peptide Sequence Number=SeqID_162258
atggtttacaacgatggccctggacccacttgtcatcacaatggtagcacgacggtggttcctcagccaaggcgacagccagcggaagggacattggttgtagggcctggactatgctgcgcaactcaagaggatcctgaccatcaaaccagggaacctcaagtttcatatgagtgcaaggatgagggaagatggtggggatttgggcgaagtgttggtggctggaattacagcaaatcgttccaatatggaatcaattttgctattaagggttgtttgggcctctga

SEQ ID NO: 70574 - DNA, 159 bp, Glycine max
  Peptide Sequence Number=SeqID_162259
atggagatgcaatcggtgcatccaagcataagctccgacaatccatcaaacgtagccgccaccatgatcagtgattacaagaagggagagactatgaagaagaagaagaagaagaagaagaagaagactgagaaaagaggaacatggatgattagatga

SEQ ID NO: 70575 - DNA, 696 bp, Glycine max
  Peptide Sequence Number=SeqID_162260
atgtcgcagcttcaatggactacagctctgaagaagattctgatatcagcgaatcttagattgaagagagttggtaagagttctgctaacagaagtgcacaacaaaaggcaaaccaccttgctctaggaaagtatttggagaccgacctagcctgtgaagcagagccaatccagcgcccagctctacctcaagctctgagtagtgaattggaggaaaaaaagcggaagcttgattcctggagtagagatctaaacaaacgtgaggccctaactgatcaagagaagaagaaacttgaagaggacaacaagaagaaagatctgaggaatgagtcactcctattggcttcaaaggaacaaaagatagcccatgagagtgtcttaaggcttgttgaagagcaaaagcgagagaaagaggaggcctataacaagatacttcagttggaaaaacagctagatgccaaacaaaagttggaaatggaaattgaagagttaaaagggaaattgcaagttatgaagcatcttggagatgaagatgatgcagctgttcagaataaaacagaagagatgaatgatgaattgcaagaaaaagtagataatttggaaaatatggaggccatgaatcaaatccttgttgtgaaggagcgtcagagtaatgatgaactgcaggaagctcgtaaagaattaataatagtatga

SEQ ID NO: 70576 - DNA, 688 bp, Glycine max
  Peptide Sequence Number=SeqID_162261
gttggagcagagtttctgggcacgttcccttctcatgtctgcggcaataggcgctgcaattgaaaaagagaagtcacaaggatcagtggtgggatgtgcagtaattagtggagttactgtgatgataatcatatgctccataggccacatctccggagctcatctcaaccccgctgtcaccatctcctttgctgtaataaagcacatgccgtggaagaatgtgcctgtgtatattggtgcacaagttttggcatcagtgagtgctgcatttgctctgaagttaatttttcatccattcatgagcggtggagtgacggtcccttctgtgggatatgggcaagctttcgctgcagagttcatggtcagctttactcttatgttcgttgtcactgcagtggccgacggcacaagagttgtgcgagagttcccgggaatcattatggtgcaggtgcgattgttcgcgggaatcgtggtgggagccactgtcatgatcaacatactcatggcgggggcagcaactgggagttcaatgaacccggctagaacactgggtccagcaattgctgcacacaactacaagggcatatggatctatctcacagctccaatacttggatctctatgtggggcaggtgcctacactgtgctcaagctgcctgatcgcaacactactatgcaggaagagtga

SEQ ID NO: 70577 - DNA, 180 bp, Glycine max
  Peptide Sequence Number=SeqID_162262
atgggagaaacactcacaagtagaaattcaacaagaaaccctcctcatcaactgattgtcaacacttcccttgcaacaatatggaaggtgtttccgggatacatgagtttcatggcgtctctagctaagaggcgaaaatgcaaggaagatgtgttttatgtgaccttcatgccaccttga

SEQ ID NO: 70578 - DNA, 534 bp, Glycine max
  Peptide Sequence Number=SeqID_162263
atgaatgtgggactattggttgtttattggatttccaggacactaggggttggcctaggaagacagaaccctatggtagatctccttcactattcaagtggtgaaggacatgatggacagcctgtaagtggtagatcacttggatcttggagcaaacataaactcaccaattttcttgaccatgcatgtgatgtcaactttgaggcagaacaagaccagtattctgtgggtctaatacttggttctcagaattttgcagagaagcttgaaccaattgagattgtggcaaagcaagaagctgctcatggtgttgaggagttaactgcggggctgggcagatggaaacaaaccataactatgatcagaaaggtctatctttcttcgtgcctttgggtttttgatcttgaccatacttggatgaagaagacacaacaaatgcaagttgtgattcttgctgagtcgttccaagctaacgtagtttttcttcttggatcaatggatcacaacaaatggtgggaatcagttccatcatga

SEQ ID NO: 70579 - DNA, 459 bp, Glycine max
  Peptide Sequence Number=SeqID_162264
atgccgaatccggatgagagtgagaggaatgcagcagcaaggaagcttggacgtgtgggggagaagctcctcaagaactcttctgttcataaacttctgccactgcttcaactattgtattttagtgactcttatgaattttgcttatggtatttttggttttctaactttttgaaattggagctgctactatcaaccctgggacaagagctaaccgagccaattcaagaatcacttgtatcttcaaagaaggctttgatttccattaaacttttgaggctcacagatgaggatgttaagatttcagttacatcttgcctcattgagattacaagaatcactgatgtcccttatgatgatggacaaatgaaggaaatcttcaagcttatagtggcatctttcgagaaattttctcacatatctggtcatgaaaaagcacttgacatacctggctattga

SEQ ID NO: 70580 - DNA, 195 bp, Glycine max
  Peptide Sequence Number=SeqID_162265
atgaaaaagtacaaaagctctggtgaaaattggaagacagagaaaccgcaaacaagaacagaaatgttgactttctatggaaaccaaaactatacaacaacaacaacgccttatcccactaggtggggtcggctacatggatcaacttccgccataatgttctgtcaagtaccatacttctatccaaatcattaa

SEQ ID NO: 70581 - DNA, 228 bp, Glycine max
  Peptide Sequence Number=SeqID_162266
atggatcacttcgtctatatttcagagcaagcaagcactcaagcaactgcaatgggtataatcaggagtacattctctttcattgcagggacagcctttggggtttacttggctcagaattatcaaatccctaacatcaggaagttagctgacactgccttgttacaggcaaagcaaattgaggaaaaatatcgtaagtctaagaagaagggtggtgatgatgattaa

SEQ ID NO: 70582 - DNA, 822 bp, Glycine max
  Peptide Sequence Number=SeqID_162267
atggtgatgggcatttcatctccatcttacaagctgaaattccttcgtcctcgccaacttgaacctctttctttgactccgccatcatcttcattcagagcgttggagttgaaagagaaggttcagcctctgatcccatggccggtgtctccctttacaaacctaaatcctacgaattccctctcttatgctcttcaagacggcaaaattcgcctcgaaatcgatttcccgtattacctgataaaccagaaggcagagcctcttagttgttcaaagcagctctacattctatctgtcaggaacacccttgattttgacttcgaagatgacaatgaaggtcgttggcaatctactgagcctccatcactctacatattcattaactgcagtacacgtgaacttgcgtatatagagaagtatgtgtgcagatttaggccttccgggcttcccagccaaagatttgcagtaccgctttctttctcaattcactccatccgaatcagagagtattcaaaggtgatgcttaaacaagcagatggttcttatgcttgcatagcagaaagtgcaaactgcttcagccttggcgagcttcatactaatccattgactgatataggccaaagaggaattgttgagggtcttgggacttcaagaagaagagggaagttctctagaatttcttcgaagaggctacaaggtgttctcttgcaagcacgtggtgggaagaagattttgattcagaagtatcttatggatggcggagttgagttgtgcactgttagacgagactgttttactgcatccgcatgtagtggtcattga

SEQ ID NO: 70583 - DNA, 1719 bp, Glycine max
  Peptide Sequence Number=SeqID_162268
atggaaatctttcaagccacagcggacaagatgaggatgagttccaaaagatttgcaacactctttgttgtattcttcatatcattttctgtttttctcattgtttcttcaatataccgaaactcaagttattatgctatttttgaggggttatccaaaggcagggaagccggagaatcagctcaaaacgttacaatcaatagatttccattggaaggaacagtccacaatacatcagaagagaacttagtgtcggagcatggcccgaaaaatgtttctttgactagttcaacaactgagtcaactccagatcttgaagacaaagacaaattgctaggtggacttttaaccactggatttgatgaagcatcatgcataagtaggatgcagtcccaattgtaccgcaaagcttctcctcataaaccttctccatatttgatatctaaactacgtaactatgaagatattcacagaaggtgcggacctaatagtagagcttacgacagaagcatgagaaagattgtacgctcaaagaacaaaggtgctgcagctacattgtgtaagtaccttatctggacacctgctaatggtttggggaatcaaatgattagcatggctgcaacatttctttatgctatgctcactgatcgagtgatgcttgtaaaatttgacaaagacaagcagggcctattttgcgagccgtttctcaattcaacttgggtattgcctgagaagtctcctttctggaatgaaaagcatatagaaacatatcagaccatgctagagaaggataggaataggactagcaattcaaaggatgatttaccatcagttctgtttattaatctacagcacaccctcagtgagcctgagaaattttttcactgtgaccatagtcaatatcttcttcgggaagttcctttgttgattttgcagtctgatcaatactttgtgccgtctctgttcatgaacccatttttcaaccaggaggttaccaaaatgtttccagagaaagacacagttttccaccgtttggggcgttacctttttcacccttcaaacgaggcatggaaactgatcagcgattactatcaggaacacttggccaaggcagataaacggataggcttacagattagagtatttagtcccgtttctactccacaacaaacagtcatggatctagttttaagctgcaccttgaagcataagatactgccacaagtggatttgcaaacttcagccggaaaaaatcatagtgtaaaggcagttcttgtggcatctttacatagagagtatggagataatttacggagtatgtatctgaagaaagcaacagttagtggggaagtcatagaagtttatcagccaagtcacgaagagcatcaaaagtttaatgataataagcataatctaaaagcttggatagacatgtatctaataagtttatctgaggagttagtgactacctctctctctacttttggctacgttgctcagggattggggaatttgaaaccgtggcttctttacaggctagtcaacaatgacacccattttccatcctgtgaacgagatttctcatcggagccttgttatcatgttcctcccaagcattactgcaacggaaaacctatcaaagatgttgtttcttctttcccctatttgagggagtgcaaggattattgttatggtctgaagctggttaacagtacgtag

SEQ ID NO: 70584 - DNA, 1902 bp, Glycine max
  Peptide Sequence Number=SeqID_162269
atggagattaatcccaagagatttacaacattattctttgttgtacttttcatatcatttcctgttgctttcatagtttcttcaatctatcgaaactcaagtttcgctattttttatgaggggttaacagaatcatcggctcaaaacgttacaaacaatggttttccgttgggaggaagagtccacaatactacatcggatgatgagattgagactcacttaagaacaagacacaatgataccgtgtcggtggtgttgccgggcaatattcaaaacggtagcactgtagaagaaagagctagaactatgaatagtactgcatcaggaataggtggagttaaggacctgcaagagagatcccaaaataatttcgctactgaaggaagatctgagaatatcacagcagcatatgctggctcgaaaaacgcttcactggcaagttcaacaaatgtgtcaaccacagaacctgttaatcttgatgacaatgacaaactgcttgggggattgttaacttctggatttgatgaagcatcatgcaaaagtaggatgcagtcccatttgtaccgcaaagcttctcctcataaaccttctccatatttgatatctaaactacgtaaatacgaagaaattcatagaaggtgcggaccaaatactagagattacgacaaaagcatgaaaaagattgtaagctccaagaacaatggtgctgctaccaaatgtaagtacattatctggaatactgccaatggtttggggaatcaaatgattagcatagctgcaacatttctttatgccatcctcactgatcgagtgctgcttgtaaaatttaataaagacaagcatggcctattttgcgagccatttctcaattcaacttggatattgccgcagaagtccccctttagttcttggaatgaacacaataccgaaacatatcagaccatgctagacaaggatagggctagcaattcaaagaagggtttaccatctgttctgtttattaatctacaattcagcttcgaaaaccctgagaaatattttcactgtgatcatagtcaagatcttctccggaagatccctatgttgattctgcggtctgatcaatactatgtcccatctatgttcatgaacccatttttcaacttggagattgccaacatgttcccagagagagacattattttccaccatttgggtcgctacctgtttcacccttccaacgatgcatgggaactaatcagcagttactatcaggcacacttggccagtgcaagtgaacggataggcttacagataagagtatttaatgctgctactactccaaagcaagcaatcatgaatctagttttaagctgcacattacagcaaaagatactgccagaagtggatttgaaaacttcagtgtcttctgctggaaaaaacatgactactgtaaaagcagttcttgtggcatctttacataaagagtacggggataatttacggagtatgtatctgaagaaaccaacagttagtggggaagtcatagaagtttatcagccaagtcatgaagggaagcaaaagtttaatgataatgggcataacctaaaagcatggacggatatgtatctgttaagtttatcagacgtgttggtgactacctctctctcaacatttggctacgttgctcaaggattgggaaatttaaagccatggcttctctacaggctagtcggtaaccatagcggcgattttccacgctgtgaacgggatttctcaacagagccttgctttcatatgcctcccaagcattactgcaacggagagcccatgaatgatatcgtttcttctttccccaatttgagggagtgcaaggatttaaggtttggtgtgaagctggcggccgttaacggttccatgtag

SEQ ID NO: 70585 - DNA, 129 bp, Glycine max
  Peptide Sequence Number=SeqID_162270
atgacgactatgtggatgcacggaaagttgttgagctgcacaactagagaagggaaaaaagaaaacagagatgggcttggccgcatacacacgtgtggcccttttccttctatgcttattaaggtgcag

SEQ ID NO: 70586 - DNA, 2910 bp, Glycine max
  Peptide Sequence Number=SeqID_162271
atggcgagagggagcagatcagtgactagcagcagcaaatggaggtactgcaacccctcctattacctgaagcgcccaaagcgtcttgctctgctcttcatcgttttcgttggcgtctctttcattgtctgggaccgtcaaactctcgtcagagagcaccaggttgaaatttctgagctgcggaaagaagtgactggtttgcaaaatttgttggacgatttaaataacaaacaaggtggtacctctgggaagactgacttgagaaaagctaccaagaccagtaaagaggtcctagatgatccgattgatatcgagaggagggaaaaagtaaaagaagcaatgcttcatgcttggggatcttatgagaagtatgcatggggccaagatgaacttcagccacaatcaaagaatggtgtcaatagctttggaggtcttggagcaactttaatagattctcttgatacgctatatattatgggtctcaatgaacagtttcagaaagcacgagaatgggttgcaaactctttggattttaacaaggattatgaagcaagtgtttttgagacaaccataagtgcatatgatctttcaggggacaaagttttcctcaacaaagcaatagaaattgcagacagattattgcctgcatggaatacgcctacaggaattccttacaacatcattaatttgtcacatggacgagcacacaaccctagttggactgggggtgagagtatcttggcagattctggcactgaacaactggaattcattgttctatcccaaaggactggagacccgaagtatcagcagaaggtggaaaatgtaatagcccagctaaataaaacatttcctgatgatggattacttcccatctacattaatcctcatagtggggcagcaggctactctcccatcacatttggggccatgggtgatagagatatgtgggagaaatcaatgaaaggtctatcaagtttgattaggagatcaacaccatcttcatttgcttatatatgtgagaagaatggaggatctctaacagacaaaatggatgaactagcatgctttgctccagggatgattgctttgggatcatttggttacagtgctgatgatgattcacagaagtttctgtcacttgcagaagagcttgcttggacatgttataacttctaccaatcaactccaacaaaattggctggggagaactatttctttcattctgggcaggacatgagtgtgggtacatcatggaacatactgaggccagagacagttgagtccctcttttacctttggcgtctaactggcaacaaaacgtaccaagaatggggttggaatatatttcaagcttttgagaagaactcccggatagagtcaggctatgttggactgaaggatgttaatagtggagtcaaagacaacatgatgcaaagcttctttcttgcggagaccctgaagtatttttatcttctcttctcaccttcttctgtcatcccattagatgaatgggtattcaacacagaagcccaccctctgaggattgtgaccagacacgaagagggacttgttaagaatttaaatgagaagcaaaaacctttttctagaataggtggcaggaaggaaggaaggtcagcttgtaagatgtcagcatttcctcattgcgagggaccaccatccaccagctatcattccctcacattcactgttccttcttcacggcttcaatgctcatcatcgcaggctaagccagcaaccaacattgaattcaacgatcgccacagtcagcgagctgttaaaactgccttgtggtgtaactttcttgttttttcactcaagtttggagtatggttagcttcctctagtcatgttatgttagctgaagtcgtccactccgttgccgattttgcaaaccaggcgctacttgcttatggtttatctagctcgaggcgtgcaccagatgctattcatccctatggctattccaaggaaagatttgtttggtccttgatatctgctgttgggatcttttgtcttggttctggtgccaccgttgttaatggagtacagaacttgtggattgcacagccccctgagaatatgcagtatgcagctttggtgatatgcggttcattcatcattgaaggtgcttctcttattgttgccatacaagctgtcaagaaaggtgcagctgcggagggaatgaaattaagagactatatttggcgaggccatgatcctacatctgttgctgtgatgacggaggatggtgctgcagtcactggtcttgttattgctggggcatcattggttgcagtgaacgttactggaaatgccatttatgatcccataggttcaattgtagtcggcaacttacttggaatggtagctatatttcttatccagagaaaccggcatgctttgattggtagagctatggatgaccatgatatggagaaagtacttcagtttttgaaaaaagacccggttgtagattccctctatgattgcaaaagtgaagttattgggcctggattcttcagatttaaggcagaaatagctgatcattctaatgaaacagattttaatggagagaaggtggtgcaaaattatcttaaaaggactggacgtgaagagtgggcaagacagtttcgtgaagctgctaagcagaaggatgatactgccctgatgaagattatgtcaaattacggtgaggaagtagttacagctttaggaagtgaagtagataggttagagaaggagatccagaatctcgttcctggtattcggcatgttgatattgaagcccacaatcctccaacagaggcgacctttatcacgagttctgaaggaaatacgaagttgagttacatgcctcgggttgagttgaccctggacagctcttga

SEQ ID NO: 70587 - DNA, 1851 bp, Glycine max
  Peptide Sequence Number=SeqID_162272
atgggagtcaacatgtccaacacaccacctcacaccaaagacttgttttcctcttcatctctctctcttagcttagctgggattttccggcatgctggggaggcggcggagacgtccggcatggaggtggcaggcggcaatgaggtccggcgagaggacactgttgagattagcagcgacaactcaggacccgtgagatccaggtcagaagaagattttgatggtgaaggtcttcatgaggatgacgacgacggcgatgacaagaacagaaagaagaagaagaggaagtatcacaggcacaccgctgaacagatcagagaaatggaagcgcttttcaaggaatcaccgcatcctgatgaaaagcagaggcaacaactcagcaaccaacttggccttgctccaaggcaagttaagttttggttccaaaatcgtcgaacccaaatcaaggcaatacaagagcgccatgaaaattcattgttgaagacagaattagacagacttagggaggaaaataaggccatgagagagaccataaacaaatcttgttgccccaattgtggcatggtaacggctaccatagatgcttccatgtccactgaagaaaaacaacttcttattgaaaatgccaaactcaaagccgaggtagagaagctccgaacagctttagggaaattctcaccaagaacaacgtctcctactacatcttctgctggccatcatgatgaggaagagaatagaagctctttggatttttacaatggaattttcgggctcgacaaatcaaggataatggatatagcaaaccgagcaacggaggagctcataaagatggcaaatatgggggaacccttatgggttcgtagcgttgaaacaggtcgtgatatacttaactacgatgaatatgtgaaggagttcgaagttgaaaattctggtagtgaaaggccaaagacattcatcgaagcctcaagagaaactgaggttgtgtttatggatcttcctcggcttctccaaagttttctagacgtgaatcaatggaaggaaatgtttccatgcttaatatcaaaggctgcaactgttgatgttatatgcaatggggaaggttctaacaggaatggtgcagtgcaattgatgtttgctgagcttcaaatgctcactccaatggtgcccaccagagaagtgtatttcgtgaggtgcggcaaacagttaagtgatgaacagtgggctatagttgatgtctccatagacaaagtagaagacaacattgacgcatcccttgtgaaatgcagaaaacgcccatctggttgtattattgaggataagtcaaatggccattgcaaggtgatatgggtggagcacttggagtgccaaaagagcacaattcatacaatgtatcgaaccattgtcaatagtggtctagcttttggggcaaggcattggatagaaacactacaacttcaatgtgaacgtttggttttttacatggcaacgaatgttccaatgaaggattcaactggtgttgcgacgttggctgggaggaagagcatattgaagttggcacaaagaatgacatggagtttctgccatgcagttggtgcatcaagtttccatacatggaccaaggtcacaagtaaaacaggagaagacataaggattagctctaggaagaacttgaatgagcctggtgaacctcttggggttatcttgtgtgccgtttcttctgtgtggcttcctgtctctcctaatgtgctgtttgatttcttgagggatgaagctcgtcgaaatgaggtacagtacaagtgtacaactcttctgcatcctttttttaataaacctagggtattcttgggctga

SEQ ID NO: 70588 - DNA, 1491 bp, Glycine max
  Peptide Sequence Number=SeqID_162273
atggcactcttgtgcctaacagccatcatcccacaggctcggcctcctccttgcaaccctgcaactgaaagatgtaaaccagcaacagctgggcaaatgacaatgttaatctcttcctttgctctcatgtccattggaaatggtggcctttcatgctccatcgcatttggcgcagaccaggtgaataaaaaagataacccaaacaaccagagggcattggaaacatttttcagctggtattatgcttctacagctttttctgttataattgccctcacagtcatagtatatatacaagatcattttggatggaaagtgggttttggagttccagcagcacttatgttcatgtccactttcttcttctttcttgcttctccactttatgtaaagaataaagtacaaggcagcttaatcactggcttagcacaagtaattgtcgtggcctataagaaccggaagcttcctttaccacctaggaactcagctgcaatgtaccatcgtaggaaggactctgatcttgttgttcctactgataaactaaggtttctgaataaagcttgcatcactaaagatccagaaaaagatatagcctctgatggatcagcttcaaatccgtggagtctctgcacaatagatcgagtggaagagctaaaagctattattaaagttattccactgtggtctacggggatcatggtgtcagttaacattggaggctcgtttggattactgcaagctaaatccctcaacagacatatcacttcacactttgaaatcccagcgggttcttttgccgtagtcattgtgtttataatatttatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatgaaaggcgaaggagagcaatcagggagggacatattaatgacacacatgcagtgttgaatatgtctgcaatgtggcttgttcctcaactttgcttgtcaggcatggctgaagcattcaatgctataggccaaaatgagttttattacactgagtttccaagaactatgtcaagtattgccgcttgcctttttggacttggaatggctgcaggaaatgtgttatctagtttaatattcagcattgtggaaaatgctacttcaagaggaggaaacgagggatgggttttagataatattaacaagggtcgttatgacaggtactactgggttcttgcttcactgagtgctgttaatatactgtattatctagtatgcagttgggcttatggacccacggttgatcaactattcaaggtgtctgacgaaaatagttcaaatgagaaagaattcactcaattgggcaatatgggccaggttgatgttagtgaaggaattggctcaaatgagaaaagagttaactag

SEQ ID NO: 70589 - DNA, 1938 bp, Glycine max
  Peptide Sequence Number=SeqID_162274
atggagaaggaactagaactttcttcagctcaatccagaatggattcccagcgcatttcccaaccccaaaggtgtggtaagggtggcctcgttaccatgcctttcatcatagcaaatgaagcacttgcgagggtggcaacgttggggcttctgcccaatatgatattgtatttgatgggaaactacaatcttcatttaggcaaagctaccaagatactcctcttatcagttgcaaccaccaatttcatgcctcttcccggagccttcattgctgattcttatctgggtcgcttcctcgctgttggtttaggttccttcatcacttttctgataaccatgtctcttaaggatgtgtttagggattcgatccctgaagatcatgttcatgtgtatagaaaagcaagcctttgtggggagagatcagtccctcaaaatttaactggctcaaagaagaatgggatgcccttgggaatgacactgttgtggctaacagccatgatcccacaggctcggcctcctccttgcaattctgaaactgaaagatgtgaatcagcaacacctggacaaatggcaatgttaatctcttcccttgctctcatgtccattggaaatggtggcctttcatgttccctagcctttggtgctgaccaggtgaatagaaaagataaccccaataaccaaagggccttggagatgttcttcagctggtactatgcttcgtcagcgatatcagtcataattgccttcactggaattgtatatatccaagatcatcttgggtggaaattgggttttggagttccagcagcacttatgttcttgtccacttttttcttctttttggcttctccactttatgtaaagaataaaacacacaacaacttgctcactggctttgcatgtgtgattgttgtagcctataagaacaggaaacttcgattaccacataagatctcagatggaatgtatcatcgtaacaaggactctgatctagttgttccatctgataaactaaggtttctgaataaagcttgcttcattaaagactcagaaaaagatatagcctctgatgggtcagcctacaatcggtggagtctctgcacagttgatcaagtagaagaactaaaagctattattaaagttattcccctgtggtctacagggatcatgatgtatcttaacattggaggctcgtttggattgctgcaagctaaatcccttaaccgacatatcactccaaatttcgaagttccagctgggtctatgagtgtaatcatgatatttacaatatttatttggatagctctttatgatcgtgtcattattcctcttgcatcaaagcttagaggcaaaccggttaggatcagtgccaagagaagaatgggacttgggttgcttttctcttttctccacttggtaactgcagcaattgttgagactacaaggcgaaggagagcaattagtgagggacatattaacgacacacatgcagtgttgaatatgtctgcaatgtggctctttcctcaactttgcttgggtggcatagctgaagcattcaatgcaataggccaaaatgagttctattacaccgagtttcctaagactatgtcgagcattgcttcttccctttttggactaggaatggctgtgggatacgtgttatcttcattggtattcagtattgtggaaaaggttacttcaagagggggaaaagatggatgggtttcagataacattaacaagggtcgatttgacaagtactactggcttcttgccacaatgagtgctgttaatgtactgtattatctagtatgcagttgggcttatggacctacttctgatcaagaatcaaaggtaactgaagaaaatggttccaatgaggaagaattgccattaattcaatccaggactaagggtcagtttgataaggtatctcag

SEQ ID NO: 70590 - DNA, 1386 bp, Glycine max
  Peptide Sequence Number=SeqID_162275
atggccttctctctgttccaaaaccccaccttccttaaacttaaacccccaaccatcgcgacgccgcgctggggctacgttcgggtgcggtgcggtggaccgcgttcccagcgtagcccattgatgaaaggccgaatcctgagcatcgaagcaatccaagccatccaaaccttaaaacgcctccaccgaaccaaccctccgaacctctcctccctcgtctccaacaccctcacgcgcctcatcaaatccgacctccttgctactctgcgggagctcctacgccagcagcactgcaccatcgccctccgcgccttctccaccctccgatccgaatacggcgccgacctctccctctacgccgagattatctctgccctcgccgccgccgccgccgccgccgaaatgaccgaccacgtggaccgtctcatcctcgacctcgaagctgaaaatgaagaaatcaagtgcgacgatcacaaggggcttgccagtttgatcaaggccgtcgttgctgctaggagcagagaatcaacggtcaggatttacgggctgatgaagaagagtggatatggttccgttaccgagcccgatgagtatgtggttaaggttttggttaatgggctcaagagtttcggggaagaggctcttgccagagaacttcaggatgaatacaaaattgcgcttgctatggtgggccaaacctcagcttgtgatggtctcatccgtgacttcaaagggaagttatcaaaggcttccattaaaattttgatcaaagtaatgtcctttggacagaattgtggggaatctatccgggttgttcatcaactctttgtctcgcgttcccctaaattggccaagattgggagcataaaatcaagatcctcattgagtgccattaactcggcgatctcttcgtttgacaggcagcagtcaactcttccaatttctatatcaagagttaaccaagttgatgcagcaagattggacgttgaaatgtcagccatgttgaaagagcagttggttaaagtgttcttattaatgaagccaggaatgttatttcagtatgaagccgagcttgatgctttccttgagtttcttatttggcggttctcaatttgggtggacaagccaaccccaggcattgctctcatgaacctgaggtacagagatgaacgtgcagtagaaccaagagataaagtcagaactggtctggagggacctggactcactgttgctcagaagctttggtattgtgttgccactgttggtggccagtatatatgggctcgcttacaatccttctctgcttttcgtagatggggtgatactgagcagaccgttggctcgacgtttatggatcttgatacagcggatagaaggaatatatag

SEQ ID NO: 70591 - DNA, 312 bp, Glycine max
  Peptide Sequence Number=SeqID_162276
atggggaccttgttcgggtttattgttgttgcagaggttgaagggtttccaatggctttgaactggggggattgtgattttggaagggtcgaattaggtgatggagtgttggaaatgttgttgaaggtactattgagtattcacggatttggacttcgattgggattttgcggtggggatggagaaggacaacttcttcgtggcaaatggagaaagaagaccaagaagatcaactcgattccaggaattataatttgcccaaaaaaatatcaactattctctacactcataaattactcgtccaaattttag

SEQ ID NO: 70592 - DNA, 522 bp, Glycine max
  Peptide Sequence Number=SeqID_162277
atggcatccctttttagcatcctctgcacggcttcgatcgttgtcttcttggctgtcaaatttgctgcggctagggaattcaaaatgggtggtgatttgggttggcatgaacatgccccaacgtcactgcattttataatcattgggatgcaaggaacaggttccaagttggtgactctttggttaagaaaatggaactactttcattgtgactcaaatagccccattgatatatttgatgacgggaacagcacagtgattcttgaaggccctggggtgttctacttcatcagtggaactgaagatcattgccagaacagtgagaaattgattgtagaggtgatgtcgccacattcaattccaaactctccaccaccacaagcacaaggtttctcatcattggctccttcaccttctcatagctcaggggtttctgtctccatattgcttggttcagtctttatggctcttttaaccacttttccaaccctgaacttctcttcttctggtcacagtgcttaa

SEQ ID NO: 70593 - DNA, 1266 bp, Glycine max
  Peptide Sequence Number=SeqID_162278
atgtttgtatgtgtgtgcatgaaaaaagatgctccaatgcgtgagaaatttcacttgtgccactcctttactcctcaaaaccccaccatcagtgtctcacacagcaaaccaaagcaaaggaatcctcattccttccatcaaaacggtgcgcttcgctccctctctctaaaaccaacacatactacttctcttcagcttctcccactaaaacacactatctatatggaagtgccggaatacttcgtcggaagcttttttggcaccggaggagccgaacagttctgccctccggagaagcgccactccgaccagaaaaccggcgagcctttcgccattgacgacctcctcgacttctcccacgccgacgccattatgtccgacggtttcttcgacaatgtcgccggaaactccaccgactcctccaccgtcaccgccgtcgacagctgcaactcctcaatttcgggcagcgacaaccgcttcgccaccaccattgtccctcgcggcttccccagtgatcctcaattctccggagaactctgcgttccgtatgatgaaatggcggaactggaatggctctctaacttcgtggaagactcgttctccgccgaggaggagctgaagacgctgcagctactctccggcgccgccgccgcgtccaccgccattggcgcgaaaccgcagacgccggagtcctcctcctccaccgacacgcttccgccgttcgcctccgacgacaccttgcgaaacgcaccgtttctccactcggaaacgcctctcccggggaaggcgcgcagcaagcgctcacgggcggcgccgggggactggtccacgcgcctgctccacctggtcgcgacggagcaggagaagctgccgcagctaaaggcggagccggcgaagaagagagaaggaacgaatgcggagtgttccggacgcaaatgcctgcactgcggtacggagaagacgccgcagtggagaacgggaccgatgggaccgaagacgctgtgcaacgcgtgcggcgtaaggttcaagtccgggaggctggtgccggagtaccgaccggcggcgagtccaacgttcatgtcaacgaagcattcgaattcgcatcggaaggttttggagctgaggcggcagaaggagctgcagcgacagcagcaccagcaattgatgagtcaaagttcaattttcggcgtatccaacggtggggatgagttcttgatccatcatcatcaccagcattgtgggccagactttagacacgttatttag

SEQ ID NO: 70594 - DNA, 648 bp, Glycine max
  Peptide Sequence Number=SeqID_162279
atggtggggaacgaaatgctaggcagtatatctggaggacaaaggaagcgggtaactacaggggagatgctggttggaccaacaaatgctctattcgtggatgaaatatccactgtcttagacagctccacaacttttcaaattgtgaggtctctcaggcaatatgttcacattcttaatggaactgcagttatctctctagtccaaccagcaccaaagacttatgaactttttgatgatattatttttataactgagggtcaaattgtctaccaaggactccgtgaatatgttcttgaaccttttgaatctgtgggttttaaatgtcgtgagagaaaaggtgttgctgactttcttcaagaagcaacttcaagaaaggatcaagagcagtattgggcgcacagagatgaaccacacaggtttgtaactgttactcaatttgctgaggcatttcagtcattccattttgggaggataattagagaagagcttgcaactccatttgacaagtccaagaaccacccagctccattaaccactaaaaggtatggtgttgacaagaaggaattgttaaaggctaacttctcaagagggtatttgcttacgaaaaggaattcattgtttacatcttcaacatatgccaaatga

SEQ ID NO: 70595 - DNA, 2481 bp, Glycine max
  Peptide Sequence Number=SeqID_162280
atgccggtactgcgtagcggagcgcgcaagggccgggcagcagcgaaacagcaacaacaagaacaacaacaacagcaacaaaagcagcagcagcagcagcatagtcccgtggtggagggagaggctattgcgacgaggactcgtcggcggcgtgcggcggcggcagcagcagcggcagtgccggagagtaacaataacaacaacaacaataataccaataaccagcagcaacagccggagcaggtggcagtggtaaatgagaacgtagctattgcggtgagggaagaagagaataatcgggtagcggaggaaggtgttgttggcggtggtggagcagagagggaaggggttgcggagaaagagatgggtggctgtgacagtgggggaccgagcaatgataaggccaatgccgctggggaagatgacgccaatgctcctcaggttcctgagaagatccaagtgggtaattccccttggtataaagtagaaagaaaacttggcaagggtggatttggtcaagtatatgtagggcgacgtactggtggaaatttgaatgagagaactggatctggagctgtagaggttgcattaaaacttgagcatagaactagtaaaggatgtacctatggaccaccctacgagtggcaagtgtacaacactctcggtggcagtcacggtgtacctcaagtacactacaagggcaggcagggtgactattatgtcatggttatggatatgctgggacctagcctctgggacgtttggaataatagcaatcatcacatgaccactgaaatggttgcttgtattgccattgaagcaatatctatattggaaaaaatgcactctcgagggtatgtgcatggggatgtgaagcctgaaaattttctgcttggtgctcctgggacacctgatgagaaaaaattgttccttgtagatctgggattagctactaagtggagggatagtacaacgggctcgcatgtggaatatgaccaaaggccagatgttttcaggggtacagtccgctatgctagtgtgcatgcacatttagggagaactgcaagcaggagggatgacttggaatctcttgcatatacactgatttttcttcttcgaggtcgccttccttggcagggtttccagaattgttggtctctaacattattttctcagggggaaaacaaaggatttctggtttgtaagaagaaaatgggaacatctcccgagaccctatgctgctttagtcccctaccttttaagcagtttgttgaacatgttgtaaacttaaagtttgatgaagagcctaactatgcaaaatacatttctctatttgatgggattgttggccctaacccagatattagaccaattaatacagaaggggcacaaaagctcattggtcacaagagaggccggttggcgatggaagaagaggacgatgaccaacccaaaaagaagattcgtataggtttgccagcatcccagtggataagtgtttacaatgctcggagaccaatgaaacaaaggcattttaaattgatccatagggtcatagggatgataattgctcatttccccatccttgagattaagggtggagagggtgattcttcttcccataccatctcgtggaatctgttttacaaccttttatatcactacaacgtatcagatacaaggctatcccagcacatcgagaaaggaaatgaggatggcttatatattagcggtgttgcttcatgtcagaacctatgggcgttaatcatggatgcagggacaggtttcactgcccaagtttacgagctctcacccttctttctccataagaagacatgcttgctacacactttccaaccaacatacaattcacccaataatgaagaggaatggatcatggagcactgggaaaaaaattactatatcagtgcaattgctggagctgtaaacgggagctcgctagtagtaatgtctaagggcacacagtatttgcagcaatcatataaagttagtgactcatttcctttcaagtggattaacaaaaagtggagggagggcttttacgtgacttcaatggccacctcagggtccagatggggagtcgtcatgtctcgtggtgcaggattctcagaccaggtggttgaactagattttctgtatcctagtgaggggattcacaagcgttgggactgtgggtatcgaatcacagctactgctgcaacttgggaccaagctgcttttgtcctgagtgtgccaagaaggaagcctttggatgaaacccaggaaacgcttaggacttctgcttttcctagcacacatgtcaagttaattaggtctctgctaagatgtcatactttgttgtacaggagaagtgggcaaagaacctctacattgcttccatttgctacggacgtacagtttcttaaccctgcaaacgttgccgctgctgagaagcacgatccaggcccaaagaaattttga

SEQ ID NO: 70596 - DNA, 312 bp, Glycine max
  Peptide Sequence Number=SeqID_162281
atgaggatctcagtaacctcgagtgactcagacgcgccgataccgttgagcgggagaagagggagggcgatgaccatgaaggacacgagggcagagagcaccacggggtccagcctcgcctcggaagcatcaaggacaaagatggcgacgacaaagtatgcaggcggcatgaggggaaggcactttgcgactaggttggagcgaagggtggcggcggtggcgatgcagtggcacgactccatgaggtgttgcggtgctgcaacacgacagagttggcctagcggtgcggtagcgctgcggaattggcgctga

SEQ ID NO: 70597 - DNA, 111 bp, Glycine max
  Peptide Sequence Number=SeqID_162282
atggctgaaagaatgaaaaagaaaaatatggaaggtggaagagttggaatgcctcaaaaaacatgccactctctagtggaagaaaatagtggccgtctctacggtaactaa

SEQ ID NO: 70598 - DNA, 675 bp, Glycine max
  Peptide Sequence Number=SeqID_162283
atggcgatttcgtcgtcgacgcaacagttggcaccggtgtcgccatcttcaatggcgtgttgcaccaagcttggactcgccagtttgactggcgagttgagggtaggggtttgcagttctcaggctacgtgcagcagctctgcaggaggagggacagctttttggtggaaaacgccagtgctactggcgatttgtgctgcaggttcaaggtacagctttaaggtacacgatgaattcgattataacagtgttgtatttcaatggaagggcagtaaaaaagcgattcagattaaacgtggaattagtttcaatgctttgaagaaaaaaattggagataaggtaaagttacaaaataatgaaattatttctgctatcagctgtagatttttagtgtcaggaaaatatacttccttgcaaatttgtgatgacgaagacgttgagacgatgctggaaagttttaaacaacaacaagaaatgtcagttctagaattgtacatagaaaaggatgtggctggtggttcaatgtttcattctgcaaattcccttacatcatgtggaaattatgtatctaacgatgacacacaaccgccaacaaatatgagcaatttaaatcttgacgaagatgatgatgatgatgattatcttgtgtctaactcatacgttgaagagtcttaa

SEQ ID NO: 70599 - DNA, 346 bp, Glycine max
  Peptide Sequence Number=SeqID_162284
atgacgaggggcaatccaggtgatttacaaccctttgatcctaaaatagatagaacctttcatagattagttaggcatagtgtgcatcctgatcattctatgcattttgagcatagtgagtattatgttgctggtgattctaaatattctgattttgagcattcaactactaattttcatactgagaacatggctcaacctccacctcgtgagaggactcttagggaaatggatgcacttgatttcacttatgaaagtttgtgcattcaatatcctgatgagggtgttccatatgttctcaagattggactaatacatttgctgcccaagtttcatggtcttgcag

SEQ ID NO: 70600 - DNA, 735 bp, Glycine max
  Peptide Sequence Number=SeqID_162285
atggaggttaatggaggtttaaggagcacctacttgaagctcttgagaagaggggagaggaggcgtcatccactagagaataagccttggaagaagaaacttcaccaccaagagagtgtcttggataagaagcttagagaggaatcttcaattgaggaagagaatgagagagagagggagaaagtggcatggaaaattgaaggaagaaagggagagaagttgaactttgaagtgtgtttcacaagactctcattcatcaaagttgtgacaagtgttacacatgtttctatttatagcctagaccttatcaacacttggggagatatgaagagaatatttttagagaaattcttccctgcatccagaacaacatccatctggaaagagatttatgttataaggcaacaacctggagagaccttatatgagtacgagagagattcaacaaccagtggaggtgctttaatggacaagaatcctatggctgcaagacaattgatttctaacatggcagccaactatcaacaatttggtactagaggggttgcaacatccaaggatgttgcaaatgaagtttctatttctatggttgctgataaccaaaggctagagaataaacttacaaaattgacatcccttgtgagacaactagccattggtcaacaacataatatgatggcagaacatgctgctcatgtttatgctatgcagtatggacaaccatttagaccttaa

SEQ ID NO: 70601 - DNA, 396 bp, Glycine max
  Peptide Sequence Number=SeqID_162286
atgagttcaagattgagtcaaagaacacctccaagaatcaagaggaaatttgatttcaagaatccaagaatcaagtttaaagaatcaagaatcaagaatagacaagttgaagattcaagaatcaagaaaagactcaatccagataaagggtacatctcttgtggatcagttctagtggagggtacatccactaggttgttcaaagagaacaagggatggtacatcccttgtggatctttgcttgtaaaagaattttacaaggttgaaaagaaatctcaaggaccgcaggtcgcttggggactggatgtaggcacgggttgttgccgaaccagtataaaactcttgtgtgtttgtcttcttcttccctactcttttaatttccgctgtgcactttaa

SEQ ID NO: 70602 - DNA, 210 bp, Glycine max
  Peptide Sequence Number=SeqID_162287
atgatgacaacaaaagatgatgacaaaggtgatgaacaaaaagctcaaagatcaaagaacaactcaactgaatcaaagaacaattcaagagttcaagaatcaagaagaattcaagactcaagaagaaagcctagaatcaagattcaagatctcaagaatcaagatcaagattcaagaatgaagaaaagactcaatcaagataagtattaa

SEQ ID NO: 70603 - DNA, 480 bp, Glycine max
  Peptide Sequence Number=SeqID_162288
atggtgtcgaaccaagcaccctctttcaaaaaaaggttctatcatgtcaaagtcaagatcctagaactagccggcttacaagagttaggacagaggatgggccaagttcgacgtcaagccttccacaaggcatatgggaaaattgggtatttggccatgatagaagtatttgttgaagccatcacgtccctcactcaatattatgaccagtcactaagatgctacacatttggggactttcagttggtaccaaccatagaagagtttgaagcaatcttgggatgcccgctagaagggaggaagccgtatctgttttttggattatacccctccatggcaagaatggcaaaagtggtcaagatctcggcacaagagttagaccaagtgaaacaaaatagaaatggggtggttgggataccaaggaagcggcaaaagctttggcagatcaaggagagtggactttattcgttgatgttttag

SEQ ID NO: 70604 - DNA, 582 bp, Glycine max
  Peptide Sequence Number=SeqID_162289
atgggatcaaatcaagcaccctcttttaagaaaagattctatcatgtcaaaatcaaaagcctagaggtagccgatttgcaagagttagggcagttgatggatcaactcctatgtcaagctttccgcaagacatatggaaagatctgggatttggctatgatagaagtgtttgttgaagccattgcatcccttgttcaatattacgaccagccgctaaggagcttcacgtttggggactttcagttagtaccgaccgtggaagaatttgaagagatcttgggatgcatactaggaggaagaaagctatatctcttttctgggttatacccctccatggcgagaataaccaaggtggtcaaagtcttggcacaagaattggaccgagtaaaacaaaatagaaatggggtagttagaataccgaggaagcacttgaaggagaaagcaaaggctttggcggatcaaggtgaatgggcttcattcattgatgtcttagcgctattgttgtttggattcgtcctctttccaaatgtggaagggctagtggacctagcggcaatcgacgcctatgacacatttgactag

SEQ ID NO: 70605 - DNA, 249 bp, Glycine max
  Peptide Sequence Number=SeqID_162290
atggaagagggatatgaggctgcgccatctgccccatctgatttgtcagactctaaatggaggctcttgtctcttgctgaaattgcatattctggatggtcatttgcctcactaactcttctaagaaaggttgaggaggagcctcagttgcttgttgtctttgttgtgactgctgctattgctgctgctgtattggaggaggaacatatggcttgtttggaccagcagcattctggaaaggagggatag

SEQ ID NO: 70606 - DNA, 327 bp, Glycine max
  Peptide Sequence Number=SeqID_162291
atgaggaaaaagagtggcacctccaacaacaaccctaataaggctcagaatgcgaaggccattgtgattgtgaagcgaagtggtggtggtgggctactaacgaatctcgttagagatggtgttgaagggattgaagagttggttgggaaaactcttattttggagcttgttagcaatgagcttgattcaaacggcgacatttttctccacattgcacactcaatccctcgcctctctcagcaattgtcgtatgaatcattcccctccttccgcaaagctcacgctttcctctacctcgcacctctctatcaaatcaacgcatggtag

SEQ ID NO: 70607 - DNA, 1632 bp, Glycine max
  Peptide Sequence Number=SeqID_162292
atgggggtgggtggtgatggggtcgccaagccagaagtgatgaaagggctgccgaaaatggtggagagagagggagggagaatgaggtccctcccctccctattcgctcctcccatcaccccctcttcctctcctccctccacaacaagcccctcaaatctcgacgacgtcaatggtagtgtcgatatggaggagtgtggtgtgaaggagcaagtgagcaaggttgaccttgaatatcttgcacagaagaagttgccatggcccatggcccatggcaatggtggaggtgtcatcatcgttgtcgttgatgttgtcaatagcgatgacgacgaatgtgatggctatttggttgttcgaggtgtgatgattgtggagtttgagactgaggaaaaagaggatgaggtgtattatgaggccacatttgagttaccaacagagttcgggaaagttggtgctgttttggttgagaatgaacatcacaatgagatgtttttaaagagcatagtctttgatggtttccctgatggccctgtgcacctcacctgtgattcatgggttcagcccaagtatgataatcctgtcaagagagtcttctttacagacaagtcatacttgccatcacaaacaccaagtggattgagaaggttgagggaagaggaattggaactactaagagggaatggagaaggagaacgcaagagctctgatagaatatatgattatgatgtgtacaatgatcttggggatcctgattctaacattaacctcaaaagacctgttcttggaggctccaaacaatatccatatccaagaaggtgtcgtactggtcgagaacacactgattcagatccatcatctgagaagagaagtttagatttttatgttcctcgcgatgagacattttctgatgtaaaacagtcacaattcacaatgagcacaatatcctcaggactgagtgcaattttagaatccttagatgcaattctcactgaccaaaatcttggatttagaagcttcgaagacatagacacgatctacaaagaaggatttaagttaccacctcttaaaggcaatggcctaaatttcctccaaagaaccgttcccaggttgatcgaggctgctaatgatagccagaaccttttgcgctttgataccccggaaacacttaaaaatgaggaatttgccagagagactttggcaggggaatggcctctaagaagtaaactagaatcccaaatctatggtccaccagaatcagctatcaccagagaagtcatcgagccacatatactaggttatggcacaattgaagaggccattaaagagaagaagttgtacatgttagactatcatgatctattgttaccatatgtaagcaaagtgagagagattgaaggaaccacactatatggatcacgaacactattctttctcactaaacaaggaacattgaagccactagctattgagctcactaggccacctattgatggcaagccacaatggaagcaagtcttcactcctgcttcttattcaatttctcattcaaccaatctttggctttggaggcttgccaaagctcatgttcttgcccatgatgctggtgttcatgaacttataaatcattggtga

SEQ ID NO: 70608 - DNA, 315 bp, Glycine max
  Peptide Sequence Number=SeqID_162293
atggcatgtgttgctgataaaattaagttgatagatggatcaagggaagcttttaagctttctgtaaggatcactgatctttggttcattaggattcccgaaaagtctgaacaagtcgaaatggtggttgttgattctgattggacaggtgctatcctgtacactatgggaaaattactgatggaagcttgcttgtggggcttctatggaggctggatctttgagcttcaatggggtcctttaatggtgattttccaccatggagatgcagcggaagacaaaggaaaagaggtgagaggaggcgccatccattaa

SEQ ID NO: 70609 - DNA, 171 bp, Glycine max
  Peptide Sequence Number=SeqID_162294
atggattttgagttgatagggtttcaactcttggattttctctttgatgcaatcctccctaggaagggaccagttactagatccatgagccagaggcttcaagaggattgggctagagttgctaaagaaggccctagggttctcatgaacctcaaggactccataatatag

SEQ ID NO: 70610 - DNA, 183 bp, Glycine max
  Peptide Sequence Number=SeqID_162295
atggaagtgcctcatgatgctcaagaattcaaagtgacctcagtgagttttgatgggagaggtaatgtcttgagtttgagattcgaggagttaccatttgttcttgtagttcttcctttcaggttgaagtcggtggcgggaggaagttatccaaattcagctcagtatgctggttgtatataa

SEQ ID NO: 70611 - DNA, 822 bp, Glycine max
  Peptide Sequence Number=SeqID_162296
atgcctaataaaggcccaaaagacaacattgccttgtgtccatttccttattattggagtaggaactttgcaaaggaagtgactacgaaatctattgagttaaagccaagtgacaaggaagacaacttctacctcatgtgcatggtgcatatcttgcgtccaaccaagatatattgcttaaaagactggtattttgaagatgcaatgagaagagccattttcactgcatggacaaggtttcatgcgctcaaggaccgtctatactttccttatcagaatccttgggtttcatggcaaatgagcttctacgaaaacaagacaaaactattcaacaatcttcatgtgcatcttggaactcaagtcaatgttgttgaacctccactaattgaagttacttcacaacttccaccaattgtggaagacgccttagccattgttagcacttctattactcctcgtgagataactcctttgaccacctttgctccaagtataagattcattgttgaacgcattgagaccaacatgctaatcaagaacactctggagtcttcgctcaaatccttcaacgattttgttccctataacatgaatctgctaatgcaacaaaggttgcctccatttgtccaacaccagtctacacccatacctcaaccacctccaccaacaccgaccactgttgtgcaacctcatcctgaggttcttgcacaaatgattcctgcatcagaggttgctatacctattgatcatgtgcttgtgcctctgccttcgccaccaaagtcaccacctcctatcactcaacctccatccactgaaggttga

SEQ ID NO: 70612 - DNA, 279 bp, Glycine max
  Peptide Sequence Number=SeqID_162297
atgcagcttatgagccaaatgacatcatggacaagtatgtcctatgaaacattgggttggagtactaaggagtcaattgttttaggcggacatggaaaaacaacattggcccaactcatttacaatgatgaaagggtagtcaaccattttgagataagaatttggaaattgtctaaacaacgagcctttggaccaaacgaggaagaaagggtagagcttgtggtcataagtgtagaagcaaatgactttggtgttttgatgatgatcatgatgatttga

SEQ ID NO: 70613 - DNA, 327 bp, Glycine max
  Peptide Sequence Number=SeqID_162298
atggcacaatatccatgcttcatgggcattggtgaaggaaggcttgcgattgaggattgtgatggtaattctatacatgtttggtatcaaccatggctaaaaactatcgataatgattatgtgatatcaacttgcagcaatggcaataactttgatctcaaagtgggagaccttattgaccatgttacgtgtacttggaagcttaatgaggttgctgaaatttcaatcaccaagattgatatgaatggtagtggaatggagaaggaagagagagaagagatgccacttcaaggagaagatgagtctagaagaagctcaccaccatag

SEQ ID NO: 70614 - DNA, 641 bp, Glycine max
  Peptide Sequence Number=SeqID_162299
gggcgtccattagttggttcccacaatggaaagaaggatgggcaggagtgttatgctcatgtgaagggtgcgccatcggaggagaccatcgcacctttcatcgcacgaggtttcaatgaagctaatgcaaagacacttcagagggtatgtaaggcatggaatgaagtggaaagaaaagataacgagcttaggggaagtggcaatggtgtcataggcggctatcacaaatggttgaaatcaagaatgcaagggataacatggctcccaaagctaaagagtctgagtagggaagaggctaaagtgcctgatgagatcactagggtctggaaagaatgtgatgagcttaaagatatcaacatgaccacggttgaagcgctagagcgggaaatgaaaaaagccagaaaggaagagtggagtaggaacaagtttcgaggggctttgtggggcagcaagttgttagaggttgaagagaagtttgagagaacacagttgagcaaaatagaaggaagtatgttgataatcattgaccaatataaagagaaggtgaacctagctgctagtcacgggcagatgctcgaagatgaaatggcaaaggtgtcagccttacaggttgaaatggaggcgagagaaggagtgataga

SEQ ID NO: 70615 - DNA, 471 bp, Glycine max
  Peptide Sequence Number=SeqID_162300
atgcccgagccacatactgagaagcaagtctggggtttcttggggaggttgaactacatcgcaagtattcgagatgaactactcattgctagaaaggacatgttgtgccttggcatggacagctcactgtttaaggcagtatatgttgagttacactacttggttggtgtccaaaatggatctcataaagtacattttcgaaaagcctgctcttactgggagaatagcttggtggcatgttctgttgtcagaattcgatatcgtctacgtcactcagaaggcgataaaggaagcaccttggcagattatctagctcaaccacccataaatgattatcagcctatgcacccagaattccctgacaaggatattatggccttatttgaggaggaggctgaagatgaaggcagggataaatgggttgtgtggtttaatggtgtgtctaatgcactaggtcatggaagtgaggca

SEQ ID NO: 70616 - DNA, 513 bp, Glycine max
  Peptide Sequence Number=SeqID_162301
atgcttgaagtcactcatgaaggaacaacaaatgtgagaagagcaggaaagcacactcttgtatccaaatatgaagcattccaaataaagaatggggaaaccatttcagaacttcaaacaagattcactcatattttaaaccatctctttggtctaggaaaaatgtttgaagatgaagagttgaacatcaagatactaaattgttttacaagaacttgggagccaatgattacaacaatgaaggaatccaagaatatagctacaatgacgatggaagctctctttgtggaagcaatgccttccaatattattttgatgatgccaaagaatcaagagttaagcaagttcaaagaatcaggagtcaaaaagcttcaacaatcaagtttcaagattcaagattcaagaacaatcaagtttcaagaatcaagattcaagaacaatcaagataaagattcaagactcaagattcaagactcaagattcaagaatcaagagaagaatcaatcaagataa

SEQ ID NO: 70617 - DNA, 324 bp, Glycine max
  Peptide Sequence Number=SeqID_162302
atggtacatctcttgtggatcagttcaagtggagggtacatccacttggtttttttcaaagagaacaagggagggtacatcccttgtggatctttggcttgtaaaggattttacaaggaatttgaaaattttcttaggagaaccaaagacataaaattctctaaatcctccaagaagattgagaacaacaacaacaacaacaacttcacatgcttcgaatgtgttaagcaaggtcatatcaaatttgagtgtcctatctaccttaaaaaatatgttggtggaaaaaaggaaagaagggtagaaaacaaaagaaagcctacatag

SEQ ID NO: 70618 - DNA, 387 bp, Glycine max
  Peptide Sequence Number=SeqID_162303
atgaagattgatccaaggagttttgatgataacaaatttgatgataacaaagatgatgacaaaaagcccaagagaataagttcaagattgagtcaagaacacttcaagaatcaagagaaatttgatttcaagattcaagaatcaagtttcaagattcaaggtacatccttcgtggtacaagtaaagggtacatctacttgggttgttgtgactaagaacaagagagactacatctcttgtggatcagttctagtggagggtacatccactaggttgtttaaagagaacaagggagggtacatcccttgtggatctttgcttgtaaaggaatttacaaggttgaaaagaaatctcaaggaccgcaggtcgcttggggactggatgtag

SEQ ID NO: 70619 - DNA, 372 bp, Glycine max
  Peptide Sequence Number=SeqID_162304
atgggatgggtgaccttttgggaaatttccaagaaagtgtggctacctgtggagggtttcgagtggtggagtgatgaggacacaactaagggcaaggaccatgaagcacttgaagggcccaagaccagagacagacttaaacaggcccaacacagtgatgaggacacaacaaagggcaaggaccatgaagcacttgaagggcccatgaccagaggcagacttaaacaggcccaacacagtgatgaggacacaacaaagggaaaggaccatgaagcacttgaagggcccatgactagaggcagacttaaacaggcccaacacatcatagagacaaggctagtcatttgtatagctgccattgatgatgattga

SEQ ID NO: 70620 - DNA, 309 bp, Glycine max
  Peptide Sequence Number=SeqID_162305
atgagcagtgagatgaaggcggttgccgaaaaacacactgaaaaagagacagcggcaaggataggcgactggaaacttcttcccaacaatgcaaaacacatcgatggacaacaatgctggtggtggggtcacctgctagaaagcttgccggagcttcggcaaaggacaggggcagctgctagaaaaggggggaaatcgcaggaaaaggggaagaagggcaacaagtggagagctgttggaccttgtggcctcaataatcttaagagggataggcttagaatgcagaagaagcaacaacaatcaatttaa

SEQ ID NO: 70621 - DNA, 783 bp, Glycine max
  Peptide Sequence Number=SeqID_162306
atggttcaaaaaaagggttcagaaataggagaaaataatggcacatcagagttctacacaaacctctttgaccttgaagataactcaccaaagcaggtgaaagttggagggcacttgataatgttcaatgcagacacccttaacacatctctggggaccccagtggtattggggcttagggagaccatccccacatattctagattttgcagactaaggatggatcctcaagagataatggctcgcctttgtattccaggcaggggatttgttctaaatgctgaaggcatgccatggaagctgctgaggagagacctcagcaccttagcacatacttggagtgtgctatcatattctaacttggcctctacatcacatacatctaacctgaacttagatagggcatggttagtttatgggttggtgacgaggatggacatgaacattggagcactcattgctcagtccaactcctctaggttgggatttcctgccttgatcacagctctctgcacggcaaggggagtcacttctaattccctctcttatgaatcactaagcccaaccattaattttgcatatatcaagaaaaaattttggaacctggatcaaccttcggtctactttccaaggactcgcgaggctagggccaaagcagctgagatcccttcctcatccactcctcgggtccctcctgtacccacttctactccaccacctgcttcagctcatctaggaccttccatagacgttatcatggcgatgctccagagcttttactag

SEQ ID NO: 70622 - DNA, 140 bp, Glycine max
  Peptide Sequence Number=SeqID_162307
ataggggtgttaatagcaattcgaatctaggcccttccggtacattctggaagttgggttgcttaaggaggaagcaactgggcgagaagctcctccaccttgttgaaaaatggtttgcatggcttccgtggcttccgtaa

SEQ ID NO: 70623 - DNA, 162 bp, Glycine max
  Peptide Sequence Number=SeqID_162308
gaggaagcagtagctcaagagcatacttctccagttcctatctctccaacacccatatctgaggacaccatgccatcagcaccagccatggagccagagcagcccattcttcaggatgtaccagctgctccagtgttggatttaaatgaagatcagccatag

SEQ ID NO: 70624 - DNA, 318 bp, Glycine max
  Peptide Sequence Number=SeqID_162309
atgttgaccaagaagaatcggtatatccatagtgatagaattgttgtggaagctgatttcgttgtcatagacatagaagaggatgctgacattcctctcattcttggccgcccattcatgtccattacaagctacgtggtggacatgggaaaaaagatattgcagatgggcatagaagatcagaagatcagctttgatttgttccaggaggacaaagatccacctagccaaaatgtctattttaaagtggatgtgatggaggaaaagagacctgagaagaaggtccttgaagtaggaactctcttggatcttggataa

SEQ ID NO: 70625 - DNA, 136 bp, Glycine max
  Peptide Sequence Number=SeqID_162310
atggagtctggaggtgctaccagctatcaagcttatcgataccgtcgacctcgagggggggcccggtaccagcttttgttccctttagtgagggttaatttcgagcttggcgtaatcatggtcatagctgtttcct

SEQ ID NO: 70626 - DNA, 246 bp, Glycine max
  Peptide Sequence Number=SeqID_162311
atggtgaagaatttacacgggcacacagcacatcctttcgctaagcacaagcttcccgctaagtgcatatttggtcatgcgctaagccgagagtctctggagcttagcgctcaacccttgcatctcaggctgacttggtcggctaagctggcctgctcactaagcgcattgcattcactggctaagcgtaacacgtcgctgctaagctcatttccttgcggccagaattgggtttcattgagctaa

SEQ ID NO: 70627 - DNA, 809 bp, Glycine max
  Peptide Sequence Number=SeqID_162312
ttgtcgtttaatgactttgaggaatttcaaggggatttaaataggaggaactggcataagaaaatcgaaaatttggaagagggaagcatagatgtggcacttgtaaaggagttttatgcaaatgtttatgatcttgaagacaagtcaccaaaacaggtcaaggttagggggcaatggattccatttgactcagttgccctcaactcttttttagaaacaccagtggttatagaggaaggagaaagtcttccggcatatgcaaaatttgtgttgctaaggccaaaccagcaagagttagcagcctatttgtgtatcccaggcaagggatttgaattgaatttagacggactacctttgaagattttaaggaaaaatttgactactcttgctcaaacttggagtgtcttttctttttctaacttggctcccacctctcatacttctagtcagattacactcatggcccagcacgactcctggaggctcggttttcctgccctaatcactgctttatgtaaagcccggggagtccactctgattccttgacccatgagagattaagtccagccattaatttggcatatattaagaaaaaatgctggaacctagatgatctctcagtaactttcagagggtcgcacaaggccaaagggaagagcgcaatggagaaggagaaagatgattggagatgtcactacaaggagaagatgagtctagaagaagctcaccaccataggaggccatggataagagcttggaggaagaagaagatgaatgaagggagaggaagagaaaagcacgaaatttt

SEQ ID NO: 70628 - DNA, 502 bp, Glycine max
  Peptide Sequence Number=SeqID_162313
atgaggaagagtgttggacttaagaagaaagctgttgaaaagaaaggtactgatggcaaggaaaatgatgagcgagctgtgaatgaagttgcggaagtaccatatccagtggtaccttccaagaaggacaaggaccatcatttgatgagaattttagatattttcaggaaactagagcagttgccactctactccaaattcttgaaggatatgttaacaaggaaacataagtacattcaccaggaacacattatagtggaaggaaattgtagcgctatgattcaaaaaggactagggactactaagctggaggagactttgactcagtttatgcagataacaatgtcaaatcataaaaacactatgtcagcactgaagaaccttgaggtccaggtgggacaactggccaagcaaatagctggcaaaatgaggaagagtgttggacttaagaagaaagctgttgaagagaaaggtagggatggcaaggaaaatgatgagcgag

SEQ ID NO: 70629 - DNA, 1710 bp, Glycine max
  Peptide Sequence Number=SeqID_162314
atgtccatgtcaggccattcccagcatctgggccagggtttgtgcgggctgcgggcgctccaggctgatgcgccgctccaggtccgcgagatggttgtcgttgatcttgaccgcctcggccacctgcccctgttccatcaggtcgacgatctgcacgtgttcgccatgctcgcaggcggcgttgccgggcggttcatacagcgccacgatcagcgagcagcgcgacaccagttcggccaggtagccgtgcaggatggcgttgcccgacagttcgcccaggcgcacatggaaggcgctggcctggcgcgcccaggcaggctggccggcgcggtgcagcaaggcatgctcgtcgcgcaactgcttgcgcagcgaggcgtagtcggccttggtggcgcgcgcggccgccagcggcaacagggccgcttccagcgcgcgccgcgcctcgaagatctggcgcgtgtcctcgggggtgggttcggccaccaccgcgccgcggttgtggtgcaggtcgaccacatgctcgtgggcaaggcgctgcagcgccttgcgcgcgaccgagcgcgaaacgccgaagatgtcgcacagcgccgcctcgggcagcttggtgccgggcgtcagccgctggctcatgacactttcatagaccgcctcgcaaatgcggcgctccatgtcggcatcgggggccgtgtcctccaggtgttcggacacggcggcggcggcccggcgagaaggcgtcgccctgggacgggatttggcgggatcgcgggtaggcatggcggactcggtggcaacgaaggcaaagggtcgatcaacgggaagacagtccggtcgccggtggcagcccatcgacgtgcgcgcagatctggcccggcgtggcgaaccagatctcgccccggtcgcgcgcggccgccaacggggccagcgcccggcgcaggtgccgcaggcggtagggctgccccacgatatacggatgcagcgcgatgcccatcaccaggggctggcgctgcgcctggagccgcatttcctcgaactgggaatcgcccacagatcgccggcacgcgtgcgcatgcgcgtgggctggtcgtcgtggcaccagttcaaggtgtagcggtagccggtctcggcgagcaggtccggggtggcgcggctttccgaaatccacggcgacagccagccggccggggcgctgccggcgtggcggccgatgcggtcgcggcagtgttccagcaacgcccgttcctccgtttcgcccagccccccctggcgatgcgcgttgctgtagccgtggccgatcagctcgtcgccgcgcgccaggcaggcatcgaccagttccggacaatggtcatacagcgcggtgttgatcagggcgccgaccggcagacccaaggcgtcgaacagttccaggcagcgccaggcgcccacccggttgccgtactcgcgccaggcgtaattgagcacatcgggatgcggcgaggctggccccaactcggcgcccagcccctcgccgaaggcgaaatgctcgatgttgaaccccaggtagacggccagccgcgcgccgttgggccaggcgtagtccgcgcggccggtgatgggctggtaggcgaaacggtagtggccggccagcggcgcgggagtccagggcgcggcaggccccgcattagtgccttgaagcagggatggattcattttggtgcaaatcatgatgcatga

SEQ ID NO: 70630 - DNA, 366 bp, Glycine max
  Peptide Sequence Number=SeqID_162315
atgaaccctaagagaataaaggtcattccggcatggcctactccaccaagtataagaaagatttggggcttccatgacttaacaaactcttacaaaaggtgtggaggaaaaaagcccagagtttcaagaacctcgggatttgagattaaggttgtctctgatagcctcacttttgagcgcctgagcccagtcattaacttggcctacattaggaagaactgttggaaccccgaggatctaacagtttctatccgaggggttaggagggcaaaggctaggccagttgagctcccttccacttctgtggctcctactccagcatccatgtcagcagctccttcttttccagcccagataaattcctag

SEQ ID NO: 70631 - DNA, 147 bp, Glycine max
  Peptide Sequence Number=SeqID_162316
atggcttcctatggtgtggcatctccattcatctttctcctccattcctctgcaatcagacctcaagaagcaaatgaatccattgatgaagaagatccaaggcctacaagctccacatggagctatatcagctatgattgcttgtaa

SEQ ID NO: 70632 - DNA, 115 bp, Glycine max
  Peptide Sequence Number=SeqID_162317
atgcatggagtcgccaccaacgtttatttaaggaaaacgtcggaaaaaccagaaaggtgtggtctacgaactttaagtgtgaaaggttcgagagttgtttttacgcacggggaag

SEQ ID NO: 70633 - DNA, 99 bp, Glycine max
  Peptide Sequence Number=SeqID_162318
atgtgggtgtcgagggaccggtatccagcagattttaggtgggaggagaaagacaagaccgatttcaggaaggaggagaaagacaagagggagggcaag

SEQ ID NO: 70634 - DNA, 591 bp, Glycine max
  Peptide Sequence Number=SeqID_162319
atgagcattcacgtggctcagttaatcgctgatgccatctatctatttgcagttatggcgcctaccaggcaccctctggacccggacaagtccaacagggccctggaatttcctgctttgatcacaggactctgccagtcgttcggagtccccgtcgcgcctagcaaggtgattcggccgtccatcacccgagctttcattgagaagtattgcacacagagacaggcccagggggatgctccgcaggctgcacacgcgccgccacctcatcaggctggcccagctggatcgtttgatacagagcagtatttgcggcatttggttcaccagcaggcggccgaccaccgagtgcatgtacagacccatgattgtctttaccagttgagcctcagcctgcagagccagggttttacttattttccgtgccctactccggaccagttcagggcagaggtcgcatggcctggagattggcctgaggcccgggcaggagaggcgccagcagaggctctcgacgaggcagatgaggcccgcgaggacgaggagatgaccgatttacttgatttcttaggagggagcggggccacatga

SEQ ID NO: 70635 - DNA, 576 bp, Glycine max
  Peptide Sequence Number=SeqID_162320
atgaccactcttacacagatatggatgacgttgctacttagcaacattctgcccagcgaccacaatgccgatctccccctgtggaaggatcgcgcccacaagacacccagtggacccggagaagtccaacagggccctggggtttccagctctggttacgggcctcagtcagtcctacagggtgcccgtcccccccagcaagggattgcccccgtaagacacctagtggacccggagaagtccaacagggtcctggggtttccagctctaattatgggcctctgtcagttctacagaatgcccttcgcccccagtagggtcatcagtcccctattgtcgcaacctaccctttggcgggagggcaacgcgagggctcatggatacatcttccatgaaaggaaaatgcgcggagtcgccaccaacttttattcaaggaaaatgtcgaaaaaaccggaaagacgtggtctacgaactttaagtgtgaaaggttcgggagttgtatttatgcacggggaagggtgtttcccttgctcctacgtattcctcaattgtgataagaaaattatacctacgtag

SEQ ID NO: 70636 - DNA, 483 bp, Glycine max
  Peptide Sequence Number=SeqID_162321
atgtgggcttttctcaccgatcgtcagatcgactgggcccatttggttcggtaccgaatgcataaggcattacgggccaatgcacctctaccttacccacaattgataactttgtttctgcgtcattttcaaattccgcttgatgatgaaccatttgttcaagtcaagcgttcctttgcaattagtgctggtgcagtgacttcttttggttaccgtaaggatcggaatggtcaatggctgaagaaagacgcactccctcctcaagatgagcgtactccttcacctcctcctcagcgcgatgattccgcactcatgaatgaagtccttaccgaattacaaggtcttcgttcttatgttgatgaatgtttcgactcatttgatacacgctttgccggtatggatattcgcctcacacagcttgaagaggatgtaggttacattcgtcagagtttcgatcttccaccgccatctccaccttcttag

SEQ ID NO: 70637 - DNA, 372 bp, Glycine max
  Peptide Sequence Number=SeqID_162322
atggcctctagaaagagaagagcgtctacctcccgacctcaggagccttatgacatatctaggtttgtgtctgaggtcgcatgggagcattacgagaagaacgtgcacaccaggaacatcctcccagagaggaatgttgagttatccatcacacagtacgacgagcagccagataaccacattgatgtggccccagtcaaggaattctatgctaatctttttgatccggaagataaatctccaaggaagtccagagtacgggggaagctgattaagtttgatgctgcgacattgaacgagtttctagagacaccagtgggagcaccctggaagctccagaggaaggaccttactacattggctcagacctag

SEQ ID NO: 70638 - DNA, 231 bp, Glycine max
  Peptide Sequence Number=SeqID_162323
atgtacctccaatttatggccaaagaagagaaggtaaaagctactgatgactcgcttagcgaggcagattggctaagcgagatgcatccgcttagcgaggcatccagcttgcttagcggatgggaaaccctagaagaggataagtcagagattttcacgcccagcacgcagcaagcccgcccatcgaggacgatgtctcttctcgcgcttagcgcgcccaagctcgcttag

SEQ ID NO: 70639 - DNA, 216 bp, Glycine max
  Peptide Sequence Number=SeqID_162324
atggctccgagaaagcttttcgcgaaaagatctaggagggacgccgtggctgaagggaccagtgccgcccccgagtttgatagccaccgtttcaggagcgtcgagcaccagcagcgttgtcgcaacctacccttcggcgggagggcgacgcgtgactcgcgggatgcgtattccacgaaaggaatacgcgcggagtcgccaccaacgtttatttga

SEQ ID NO: 70640 - DNA, 759 bp, Glycine max
  Peptide Sequence Number=SeqID_162325
atgagcgagctgcagaacttccgtcagctgcactctaaaaccccaggtcacccggaatacggttacaccgcaggcgtggaaaccaccaccggcccactgggtcagggcatcgcgaacgccgtgggcttcgccattgctgagcgcacgctggcggcgcagttcaaccgtccgggccatgacatcgtagaccatcacacttacgtgttcatgggcgacggctgcatgatggaaggcatctcacacgaagtgtgctccatcgccggtaccctgaagctcggcaagctggtggcgttctatgacgacaacggcatctctatcgacggtcacgtggatggctggttcaccgacgacaccgccaaacgcttcgaagcctacggctggcacgtggtgcgtggcgtagacggtcacgacgccgacgcgatcaaaaaagcggtagaagaagccaaagcggtcaccgacaagccatcgctgctgatgtgcaaaaccatcatcggtttcggttccccgaacaaagccggtacgcacgattcgcacggtgccccgctgggtgacgacgaaatcgcgctgacccgtaaacagctgggctggaactacgcgccatttgaaattccttctgatatctacgcacagtgggatgccaaagaagccggccaggcgaaagagaaagcctgggacgagaagtttgctgcttacgccgctgcgcatccggaactgggccacagagttcaaacgccgcgtgaacaacgagctgcccgctaa

SEQ ID NO: 70641 - DNA, 270 bp, Glycine max
  Peptide Sequence Number=SeqID_162326
atgttggtgcgcatgatccgcactcgtctctttgtagtggcacaggtgaaatcttgcccaaatatgcatagtagctacgtgaaagcccccctctctggttgtgctcgcacagttggtcgccctccaatatcagggggcgagggtgtgcagccctctgaagacgaggacgtgcaatcctctaaaggcgagggagtgcagccctctgaagatgaggacgtgcaatcctctgaaggtgaggacatgcagtcctctgatgacgaggacgtgtag

SEQ ID NO: 70642 - DNA, 1407 bp, Glycine max
  Peptide Sequence Number=SeqID_162327
atggggcagctccaacggcaagccttccgcaaagcctacggtgagatcgatctgggacttggctatgatagaagtctctgcaaaggcgatcgcttccctcacctactagtgccgactgtagaagagttcaaagaaattcttggatgccctctggaaggcaggaagccttatctcttttccggattctacctctccatgtctagaatcgccagagtagttagaattttggcacaagaattagaccgggtaaagcaaaatagaaatggagtggtcggtataccaagaaagtgtctagaagaaagagcaagggccttggcaagtcaaaacgagtggcctcctttcattgatatcatggcgctgttaatcttcggagtagtcctttttccaaacgtggatggtttagtggacctagcagcaattgacgctttcctcgcctttcaccacagcaaggaaagcccggtcgtcaccgtcttggccgacatatacgacacattcgaccagaggtgtgaaatgagtaacacaagaattgtctgctgcatgtcagccctctatgtgtggttggtttcgcacctattccgccaagatgcgagacacacctgcccactacaaagccaccgttcatgcgcagaaaagagggaagcaaattgggaccaattcttggcaagcataaaaggggcgtcggtcaactggttccctcgctggaaggagggaagatcaggaattctattttcatgcggagaatttccaaatgttcccttgatggggacaaggggttgtattaactgtaatcccgtcctcgcaataagtcagcttggctaccctatgagaggagcaccattggtggagagcctcacacctttcatcacacggggtttcagtgaccccaacgcaagggatagagaacttagggggagtagcaatgggactgtcgacgggtatcataggtggttgagagcctacacacgaggtctggattggctcccgaagctgagagctgctaaagaggaagaggctgaagccccagaggaaagtgaagaggtgcaagctctcaaagcggagctcgagaaagcccaagcagttaaggaaagattcaaaacaagagccgtcagaattcaaagggagaatgacgaacggatggacatcaatgcagccactgccaaagccttggagcaagaaaccaagagggcccggaagggaaaacacgcccggaaggagctttgtggggcagcaacaacgagcttaaactctggagagaagaaagagactagtcacgagagtttgtctcagcagctgagcgagaccgaagcaaacatgttagccctcatcggcaagtacaaagaagaactggatttggcaacggcccatgagcataaggtggtggatgagtacgcccaattgtacgcttaa

SEQ ID NO: 70643 - DNA, 354 bp, Glycine max
  Peptide Sequence Number=SeqID_162328
atgatgacaaacagatttccgaaatatgttgcctggtcgcttcttctgttgattgtaatcgtcactgtcagccccattgggctgaggccccacacattgacgacggtcggcatcgaccgcgcaggtgccttcgccctctgttcggccgccttcgtgctcgcctatccgcgttactggcttgctatcgtcgtcgcggggattgttgcggcttttggcatcgaggcgctgcaattcctgtcgccgacacgccatccgcacctgaccgacgcagccgtgaaggccgccggggctgttgccggcggattggccgcctattcctacctcatgcttcgggcgaagatggccgcaggctga

SEQ ID NO: 70644 - DNA, 747 bp, Glycine max
  Peptide Sequence Number=SeqID_162329
ggcgataacgagcaaaaagcgcagcgcctgtgcgaacgcgtgttgggataccgcattttcggcgacgagaacgacaagatgaatctcaacgtccagcaggccgggggcagcgtgctggtcgtttcgcagttcaccctggcggcggacacccaaaagggcatgcggcccagcttctcgcgcggcgccgcacctttggtcgccgatcggttgtatcaatattttgttggccagtgccgcgaacgcggcgtagagacccagaccggcgaattcgccgccgacatgcaggtggcgctggtcaacgatggcccggcgtctatgtatcacctacgagtacccgtaacagagcaagaactgaaggagtattaccagtttcgctgggaaatgctgcgcaagccgctgcaccagccggtgggttcggaaaaggatgcctatgacgccatggcccatcaccaaatggtggtggacgaggccggtaaaatcgtcgccatcgggcggctgtacatcaatgccgacaacgaggcggcgatccgttttctggcggtagacccgacgctgcaggataaagggctggggacgctggtggcgatgacgctggagtccgtcgcgcggcaggagggcgtgaagcgggtggtgtgcagcgcccgtgaagacgcggtggacttcttcgccaagctggggttcgtcaatcagggggagatcactgcgccgcagaccaccccgatccgccactttttgatgatcaaaccg

SEQ ID NO: 70645 - DNA, 169 bp, Glycine max
  Peptide Sequence Number=SeqID_162330
atggcaactggcaagctgcccgatgctgggcagatcctcaattcactcatcaacagcatcctgctgttggatgactctctggcggttcactacgccaaccctgcggcacagcaattgctggcgcaaagctcccgcaagctgttcggcacgccgctgcccgacaagctcg

SEQ ID NO: 70646 - DNA, 543 bp, Glycine max
  Peptide Sequence Number=SeqID_162331
atggcaagcagaaacaaaaatgtccttgtcatagtctactacgatgcctatgtagcctattgtgacaagggcattgagtttaagggcggaaacaatgtacttgtttcaatgaggagaggcatgaccttcaatgtcttgaaaacaaaaatccaatgcccatcctcttacacaccaatcccatacataaccacaaatgattattacgtccctcattttgaacccatcgaatttgatacccacattacttcatacacacaactgcttggtggatcgtcaaactactgtgagatgaatccccaactaaatgtgccctcccaactaaatgctgacccaactactgatatccatgttgctcagtctgaaagcaatgaaatgtcacatgactattgttccatcggctccacttgttattgtgaatacaaaatcttatcagcaagtgtaccgagtcgtgcaagtaataataaaatgatgttcatgtgttctatgctgagggaaaaaactccaaaccatgatttctcgcatgaatggactaatcctatttaa

SEQ ID NO: 70647 - DNA, 366 bp, Glycine max
  Peptide Sequence Number=SeqID_162332
atgaatctggggatcaaaggtcatgtggctccgcatgccaccggactcttgggtcatggtaacaaaaggtggggtggtcgacaaaagcagggtttttgctcctacgtatcctcaatttgtgatgaggaacttagacctacgctgctgtggtgtttcgccctgcgcttgcctgggggcgcagtacttcttgatgaaagctcgattagttggggtcctgatgaccttgctgggggcaagaggcactccgtgaggacgtgtagtccactgaaggcgaggacgtgcagtcgtctgacggcgaggacgtgtagtcctctgaaggtgaggacgtgcagtcctctgaaggtgaggacgtgtaatcctctaaag

SEQ ID NO: 70648 - DNA, 160 bp, Glycine max
  Peptide Sequence Number=SeqID_162333
atgatcgagatcgtgctggatcagcgccataaacagcaggtcggtgagggcgtactgggccgtgctggaagagatggccgcgctgcgggtgtggggctcttcggcgatggtatagaggcagtggtccgcgcgctgctgcaggccgttgggagaaaagctg

SEQ ID NO: 70649 - DNA, 105 bp, Glycine max
  Peptide Sequence Number=SeqID_162334
atgactctattgatgaagaagatctatggtttcgtaattggaaaggaggattggtgccatcccttgaagaatttgagtcaagaagcaaggggccaaccaccttaa

SEQ ID NO: 70650 - DNA, 270 bp, Glycine max
  Peptide Sequence Number=SeqID_162335
atgttcctcatattcaacactagtgctttgaaaggacttgatgatactccacaatcgaaatccaaggctgctgctaggtggattgttgttaagtgtaatagacaaaaaggaatcactgaatgtggctactacgtgatgcactggatgtccacgataatcttaggatctttcaggaataattgggagacgagctttatttgttccaacatactggtattcagagctgaggttcaagatccttggataccgaaactgagatggcttccttga

SEQ ID NO: 70651 - DNA, 585 bp, Glycine max
  Peptide Sequence Number=SeqID_162336
atggttttaacaaaaatcgatgttgaaataagatactcagcattggttttaacaaaaattgagggcgataaccacggagatggcgagcacgaccgcgagagcgaggacgagagggagcagagcttgcaagaggtggaggttgtgaagaaggaagaggagagcgaggagggagactcagatagtgatgccaaggacgacaagtatagctcagcggatctgaggagaatcaatatgctcaccatgatgacggggaagaagaagtcgacaaagccagaagccctaggcatccaagagcttgaaacgcttgagttgttggacaagccttcactagttcccattaaaaatgagtctttttctgaaattgatgtacactcagagaatgtttgtattgaagaggatgttttggcaccctttttgaagtttttcaaaggaagtagtgattctgtggtggaggaggaagaagtcggtggggtgttggaaggttctaaagaaaggggtgatgagagtgaagaagctaagaaggtttgtgctgagtaccctgagcccaaacctgggcattttgtggttggtgttgttgttattgac

SEQ ID NO: 70652 - DNA, 723 bp, Glycine max
  Peptide Sequence Number=SeqID_162337
atggagacaaaatccaccagttcatttacaaacttagtagaccaatcagtgtgtcctggagatgtggttcttgatctttctaaaatgataaaccagacaattaaacttggaggcggtctacgacaggattgtgatgcaatttctgtaatgaaggctggcagactcaggttctcaaagcctcataaatactgggttgaaaattctcagaagaggtatgtgccatatgcagaggattctgttcttggaattgttgtagactccagatcagataactttcttgtggacataaaaggaccaactttagcatttttaccggtgcttgcatttgaaggaggaactagaagaaatatacctaggtttgagataggtactttgatttacgtgcgggttataaaagcaaaccctggaatgaatccagagctatcgtgcactgatgccagtgggaaagctgcagaatttggtgccctaaaagatggctatatgtttgagtgtacaacaggtcaatcaaggatgcttctcagttctcccacatgtccagtacttgatgctttagggaagaaactgtcctttgagatagcagttggcttaaatggacgtgtttgggtcgatgcagcatctccacacacaactattgttgtagctaatgcgattatgaactctgagacattgagtggtgctcagcagagaataatggttgaaaagctgctgcagaggatccagtga

SEQ ID NO: 70653 - DNA, 1083 bp, Glycine max
  Peptide Sequence Number=SeqID_162338
atggcgggaactgattcacacacaactatgattgatggcctgggtgttgctggatggggagttggtggaatagaagcagaagctgcaatgcttggccagacttgtgtggttttgaccattggaggagttattcccatgagcatggtcctaccaggtgttgttgggttcaaattattaggcaaactacgagatggtgtcacaactactgacttggtggtgataacaaagaaaaccattttccttttaggaagcattaactgtcatgcggttatattgttggtgaaatgggttcccatgagcatggtactaccaggtgtcgttgggtacaaattattaggcaaactacgagatggtgtcatagctactgacttggtgttgattgttacacaaatgctaagaaagcatggggttgttggcaagtttgtagacttttatggaagcattaactgtcatgcggttacatttttggtgaaatgggttagtatgcacccaaaggtgatctttactaggaattgcaaaaatgcaaatatttcatctaaaggcgtggtcccaatgtacagtgaagctaagttggaatttttcatatttctgtggtaccctaaaactaagcttcacccgcgaggaagtatccagcatactgacattgactcatatttctgcacaacatcaaagatttctcatttagtttttaagttgctagcatacccaaatacttcaggttgcattcaatgccacaaaaaaactgatgttaaccttggcaacggttattgcactcctgctcaattgagaaaccatcagcttcagcccatctcgaaaatgagcataacattgtcaacaatgacaagtaggtgggcaccacactacccgaactttgcccactttagctatgacggagccatgtacgaagtacaaataagacaagaccaagggaaatttttctttgctgatggcctcaaaaccttcagaaaagacttagggatctacgagtccaccaccatcaattttttggcctatgaacaaaaatggatattcaacctccacttcactcctccactggatcaacaatcatgcgacagacattaa

SEQ ID NO: 70654 - DNA, 246 bp, Glycine max
  Peptide Sequence Number=SeqID_162339
atggacggcgagatgtacctatggcgacgtgaacggattggaggtgcaagaggcagcgacattgagaaggcgacgagaaagaaatgcgagagtaacggagctgagaatggacgggaggcacaagaggcagtgatggcttttgttgggtttgcatggtggggattggttgggtgttctcattgcggcaggtggtggatttgggtggggctgtgcggagaatgtcgtggtagagataacgggggttaa

SEQ ID NO: 70655 - DNA, 444 bp, Glycine max
  Peptide Sequence Number=SeqID_162340
atggttccatgtatgcattccttaagccatagtccttacacaatgcaaaggatagacgtggtgaatgccaacaatacattgaaacatggcttaaggaatcccaatgagagggcccattggcagctggttgctttgtgtcctatgcaagatgttgtcgtttggttctgttcgttgcgtaagaagcccaatattcatatcaaagctgcaatcaacaatgcaatgaacaaattaaagactactttgcatggtgatactaagcaagctggacctaagtggattgaagttaagagtcatgttcaaaccggaggttttgagtgtggatattacattatgcattggatgtggaacatagtaagcggggagttaaagactaattggaccatgtggtatggtgatggcacgccgttagacaaggagacaatgacaacaattcgtaagaaataa

SEQ ID NO: 70656 - DNA, 129 bp, Glycine max
  Peptide Sequence Number=SeqID_162341
atgaagatggattcagtttctttctatgattggtcttcttcgcttcttggtgtggttctaaaacaaagtgtttctgctacacttatgaagaggtgctgcaagtcaggtttggtgatattgctgtcataa

SEQ ID NO: 70657 - DNA, 621 bp, Glycine max
  Peptide Sequence Number=SeqID_162342
atgccggaaattgttccaaaaggaccccatttggggaataagtttgcaaaagggaaccattttgggaaatttgccgcatcgggaggtccaggacttccacagagggtcgtgcgtcagtttggctacacgcagaccattcctgctcctcctatcgattcatgggtctcgtatgatgatatacatgacaggtggatgcactacgaggatcatatcgtaccagcaggtgaggtgtgcgttgtgccaggagcgtgttccagtgactacatagactggttcatccgcatctcctatcctttcatgacaccaggccacgcattagatcctctgcctcatggtcacaccccgcagccccgagtcgtccctcaggccccgcatacggatatccctcgcgttccggagccaggagcatcgtcgacatctgcggaggagcccaaacatacaatggaagtttgtgatgacattgctgagaggttggagcgccatctgagtctaggggtggtcacgcttggctcatcgacacatgaggtgatcgaagaatgcctcaaattggccaggagtgtgacacatgaccatctagtatacgttaggtgtagacgcaggcggcgcactgatcaggcgtag

SEQ ID NO: 70658 - DNA, 942 bp, Glycine max
  Peptide Sequence Number=SeqID_162343
atggatcccatcacaatactcgttgcacaaaaactcgtcacccttaatgagtcttacaattgtgtgattgcacagttcatagctcacaatacatacaacatctcaacacacatgtatttcaccattcatcacaggaggtgttacacgttccacagcttcgagcaacttcatgttgacgatgttgtcgatatgttggtggaattactcaaggcgtcaaagagcacaccgaggcaacttacaggatatatcacactattacagtgttggatctatgagcatttcccgcctgttgcttccgccctagttgtcgaggattatgacaagaggagaccgcgtgcatgtcgatggacctctggcaaggcattgcctatgtcgacatatcgtaggcgtttggagagactgacccctgacgtagtatgcggtcccttgacggtcattcatcgaccggagagggttgtacgacagtttggatacaaccaaactattccgccacatcctactgcgcctttggtctctgttgaagaaatggatgatagatggatgcagttcagtgactacattgcacctcaatatgacacatttgttgaaccagatgtgcatcagcaaccagtagcagtagcggtagcggcacctgatgaagcaggcgttgatgtacatcatcttggacatgcagtggtaatttatttttttgatggttatgtagcaattgttgataagttggagaggcttttgaacttgaagatcctaaccaaaggaacaaaagtctatactgttggtgaagaatgtttgagtatcgcaagaagctacattagccaacccactgtaggtcacagattgaggcataggtggcgtacgaacgatcattgcttgtttctcccaaaaatgtcacaatttcttataaaattacgaatgtatgctttttgtaacactgaagcatcataa

SEQ ID NO: 70659 - DNA, 300 bp, Glycine max
  Peptide Sequence Number=SeqID_162344
ggacaacgaggatggttagccataatgaagacaaaagctcgtagcagaatcactgacaatatagtaagtgaaattaagccagaggctccataccaagatgatgagcttgtagggcttcaagaagtgttggaacttgaccctgatgtcattaatgaatctcttgcgaatgttgatggaggtggagaagagatagatgcaaatttactcaaacaactagacttggttgaaccagacgaggatgaatgcatgttaagtgagaaagacattgaaagtgattttgatgatacatatacttcttag

SEQ ID NO: 70660 - DNA, 321 bp, Glycine max
  Peptide Sequence Number=SeqID_162345
atgctccctctgctgctcaaaactcgtctccctttgaaactccgccaacctcagtgttttaaaggctattggactcttcaacttccgaaggctcgcttcgctaagcgagagttagtgaattttcgcttagcgagagtgggcgcgttgagcacgagaagagacaacgtcctcgctgggcgggctggctgtgcgctaggcgagcaggtctctgacttatcatcttctagggtttttcatctgctaagcgagctggatgcctcgctaaacggatgcatctcgctgagcagatctttctcgctaagcgattcattagctgcttaa

SEQ ID NO: 70661 - DNA, 492 bp, Glycine max
  Peptide Sequence Number=SeqID_162346
atggagagagctctcactaaagttagcagcatgaaggtggggttggggagctcatggatcaccaagaaggccaaggaggagttctctaacatctctgaagacttctctgtgagcaagccgcagaaaagcctaccggatctcctccgagagtacaatttaccgccagggctatttccacagaacataatctgttacgagtttgatgaaaccaagggtaagctgattgtctacttgccatctacatgtgaggtcagcttcaaggactcttctgtgctgagatacgcaactcgagtcaaaggggttctcaccaggggaaaactttcagccatagatggaatgaaaacaaaggttcttgtgtgggttaaggtgacaaacgtggcagttgaaggttacaagtctgacaagttgtggtttactgctggtgttaagaagtcaaggacaaaggatgcatatgatacacctcgtgatgctgtcagagtatcagaattctga

SEQ ID NO: 70662 - DNA, 333 bp, Glycine max
  Peptide Sequence Number=SeqID_162347
atgaccaagagcaagggcaaggatccacttgaaggacttggaggacctatgacaagggctagagcaaggaaagccaaggaagctcttcaacaagtgttgtccatactgtttgaatacaagcccaagtttcaaggagaaaagtccaaggttttactctcattgggtgaaatcataggaagaccagtcagaatcatgctgttttacaagaatgctccaaccatgtgggatttgcacaaacttaaagggacactcaaatcaagtgtatttactcccaaggcccagacttcgagaagtccattgaggcctctccctcctgattcaggtccaacctaa

SEQ ID NO: 70663 - DNA, 1131 bp, Glycine max
  Peptide Sequence Number=SeqID_162348
atggcgatttccggcgatctcagagtctctgcaacacttcctctctatcgctcccactcgcctccacttcgaacctcttctctcccttcccccaaggtttcgttttctctcatctctcttgtaacgaatgcttctcgcagtctctcacagtatgcatatattctcattgcaattccgctcatgatgatttcaactcctaattacacgcaaaccgcaccatttgagggttctggaattcgattaggggactgttggtggtatctgtggttggcctccattgtggtatactatggtttaggtggtacgtgccttattttccttaagaaggttttaggtttgagctttgtcaagactgccaaaattgtgattatactcgtaggattcttcaaacatgcaaacctttatgataagcttgagtttctcaggttgtgtgacactcagccaaccacttcatctcctctctctctgcatgatccctccctctcagatgtcctcgatgggttgaactttttgctctcagtcactactactctactcccaaatcctctaacaggggcatgtagcatctctgaattcaccccaaaatgcccttgcctaacaattgtacgatgcaataagcgtgggtattgcaagccagtttctgcggtctttggaggtcctaaatttacatcagattctgttagccaagaagccgagaactttctccttgacgctgttaaaatgaacttctttgagcggttaaatttggcttggaagataattttcccatcggcaacatctaggaaaacctccaatgctaggattgccaagcaacgcttgaagatgattttgttctctgatcggtgtgaagtaagtgatgaggcaaagcgaaaaattgtaagcaatgttgtgcgtgctctatcagattttgtggaaatagaatcacaggataaagttcagctgagtgtctctgctgatacagatcttggaactatttactctgtcactgtccctgtacggcgggttaagccagaatatcaagaaatggatgaatttgggacaataacaaatgttgagtataaggacactggagagagttctggttctgttgatgttagatttgatttctatgttgcagacgaaagttcttga

SEQ ID NO: 70664 - DNA, 120 bp, Glycine max
  Peptide Sequence Number=SeqID_162349
atggcgatgacgcacagtgatgatgttggtggtagttgtcacacgcacaccgacctaatatggatgaagaagggtgaggcgacggggccaagtgtggattgtgaaggaggagtaggatag

SEQ ID NO: 70665 - DNA, 1869 bp, Glycine max
  Peptide Sequence Number=SeqID_162350
gcctcattggaagaacaaacgagacaaggtacctttgtcccccatggtcgtgaagacatacttaacacggccatcgggcgaccagatcatggaggttgtgttcgtgcattgggatctggggtcacaataagtcaatactttggaagggcaccacgtggctccagttgctcatcaggctccatcaaccaagtacagttggctgaaataataggaatactacaggagcagtggaaaaatgatatacaggtattgaaacatgagttgaaggaacaaatcatacttgagatgtcgcaaaggggatcgccgatctcagaacctattcaaccaaatatacatgtgttaggagcacgagtaagcacaaaagggagcaatgcagaggctattgtcaacccatctccgcctaatcatgttgctccttccaaacccactatggggttgtatgttcattgccaagattctacagagttggtggccctaggaaaaacatatgatggaggctcgactatatacaatgtggcttatgcagatgatgtcgtaagggttagtgttgacaaagttattaacggtgacactgaagtcccatttttgacatcagagattaagtatgtcaggcaggcccttcacacattcgttgcatggccaacaacacttgtaaaattggcctctaatgagcatgagggcactagtccaagtaaagtcactgatgaagctgttgaatcggtgaatgatgttgttgtagatgacccactgcgcgagtttattaagaccctagttgacatttatgaaaagcctgtagagttggtgtgggatgtaactaaatttggaattccaaatgcagctgcatcgttgttcgtaacctgtgctaatgtattgctgagagatccaacagatgaaaatgtgatccatgttgttgaggaactgcaaaggtggttgcctcgattgagtgccactagtcttcaacagaaaggagatggtaaagagtatcttggtggccaaaatgatgttgaagccgctgaagaagatgatggcccttatcctgcattagatgaacttacctctaagattagtagtcgtaatttggacagagttcgtaaactgaagagtgcaatgacaaggctgactgctagggttcaaagggtcagagatgagcttgaacaattgttggatgatgatgatgatatggttgacctgtacctgtcaagaaaggttggttcatcatcaccagttagtggatcaggtgctgcaaattggtttgctgcctcccccaccataagatcaaagatatctagagcaagtttagcaacaattcatttagatgaaaatgatgtggaagagcttgaaatgttacttgaggaaagcaccgttgtaaaaattgccaatttcaacaacgggcatgacgtcagcatcgacgaaacattgtttttctacaacggtggtttggagaccgatgttgaaacttttaactttcaacaacatcctattcaacatcggttgaccaccgatgtaaaatatggttttccaccgatgttgaaacacaaataccccacggaggaaatgaaattagtacttgctgaagagttaggattgacagaaaagcaaatatctggatggttttgccacaaaaggttaaaatataaaagattgatgaaagatgaagtcgttgctaatgggagacaagattgctcaagtggtgtcatccaagatcgtggtagtggacttgggcaagattcatgcggaagtagtaagcatgctgatcacaggtatctggattcgaaggaggttgagagtcatggcctctataatctggggcaatttgccacgttggatagtttatgtggcactaaaattgacaacaatgcacctcactaa

SEQ ID NO: 70666 - DNA, 948 bp, Glycine max
  Peptide Sequence Number=SeqID_162351
atgcagatcaatgtcggtttgattcaagcaaaggtcatccatttgatggatctaagcctctccattttagtcagctcacctcatggaaacctttggataattctttggcagtcaatcggtaagataattgagcttattgaagggattaccattcttgctgaggattatcataattcagattccttgtacaaaagagataggaatatccgttcacataagaatcaaggaattcctacaggctacatggtccgtgttttccagtggaaaacatttgaactcagtaatgtcttgcagcaatttgtccatgatgtttctagaatgagggatgccattaaaaaacaatttcattgggatgagacactaagtgaaaatgaagctgaaatagggattggaagtggagaacaaaaatcaatattgtcaagaagtggaagtgcagaaaagttggcagagcgtcaagaaaccatccttaaccttgggaaacagttcaaggcattagctgcaccaaaggatgcatacctttttgacaacatgttggctgatgatgatactaaagtaaaggccaggatgatagtgccagtcttaattctatggacattgtaccagctactagaaaacattttacttttgaatgaacttaaaaatgttcaatacaaacacaacatcacagctgaagatgcgtctttgagagcatgtacaaaggtccaacttccaattaaagatgtgcctaacgctaacaacccattcacattcgtaactgcagatttctccactaaagtacaattaactgatgaatgtgcagcttgccactatcacagaggagggcagtgtcaacttgacagcagagagaaattttgttgtaccaacgctacactacaacaaaatcccggtaaacacccaagaatgcaatgcactaagacttgtttcttctatctgtttttcacattttag

SEQ ID NO: 70667 - DNA, 168 bp, Glycine max
  Peptide Sequence Number=SeqID_162352
atggatatcatagagactattttcagtcataaagacattaaagctatcatcttgacatctttgttgcacccgcgggatgaaggcaaaccgattttgaatttcactccaaatggtttggaagctcaatattccactgaaaataaaacacttcctctagagaactcttag

SEQ ID NO: 70668 - DNA, 1965 bp, Glycine max
  Peptide Sequence Number=SeqID_162353
atggcactgaattgtccttatcatattccttttttggccttcttgataattctggcaaccaccaccctcctttgtcaaaactgggacgcattcatggaagataccttgaatgtgctacttaaagagagtgactctgaatttttcaatggcttcaacattctgcttaaaggtacagccacatctgatcctgcagatcctggggttttcaagtccaaaaaatatcttaaaattccagatagcaaaaagcttgatggactcaagaattctaaactaggaggggaatcaacttcgtcgatgcatgatggaaatgcttcaactgttggaccaaaatcggctgataaggaagaattgggaactgaagcaagttttaaagatgcttctatttttactgagaagaaaaatgcatcatcaccttcttcgtcctgtcttctattggtttgctctccttgtgcttatatctgtggttgctcaagttcaagtaacgaatcttctgaacaacaagcaagtgaagatggcatgttctattgcagtttgtgtgaagttgaggtcttcaagtatagcaagcactgtagagtttgtgacaagtgtgttgatcgctttgatcatcattgcaggtggctgaacaactgtattgggaaaaggaactacagaaaatttttcacccttatggttgctgctctcctcttgtttccttgtaaaatacttgatattcttcctagcaagtctcaaaagttgaaccatcctaaaacccaacttgttggaagcagcatgccaaaacctgaagaaaaccccagacttattcttcagtggttgactgggatacttgtgcttatctgctgttttgttgagaagaagaaattttctgtggatatctcctccaaattagggagcagtttctctctggttcccttcgttattgtggtggcagtttgcaccattttggctatgattgctaccttaccccttgctcagctgtttttctttcatattcttctcattaaaaagggaatcaccacatatgattacatcatagctttgagggagcaggagcagcaaggtattggaggtcagcagagtccccaaatgtctcctgttagctcccttactggaatgagcagtgcaagctcttttactacattccatcgtggagcatggtgcacacccccacgtctgttccttgaagatcagtttgatgtagtgcccccagaaacagcttctgtaagctcgctgggaaagaagacaatgagagatgagccggttaagaaaaagaataccggagcagtcaaaatcagtccatggaccctggcgcggttgaatgcagaagaggtttccaaggctgctgcagaagcaagaaaaaaatcgaagattcttcagcctgtgacaagacataataacgaaccattcaggctggatccagaccacaactcaggcagcagtggccggcgaatgagccccaggatcgagaccaacagaagacggcccggtaaacggattcgcctgcctgctgacttgcctgtggaggccatgccaaaattttctgccagcaacactgacaaaattttcagtggaacatctagttttgcgcttctccagctcgaagcacgaagtgcatttcaaccaagtcaagcagtgtcaagctcagctgggattgttgcttcctctcctgaaagcagtttagactcgcctgacattcacccgtttcgtgtgtctacgaccgaagccgaagaagcaagaaggcttgctggtctttctgctgccgccactgcgaacctgaagggaatccctctgtcaaggtcaactagtgatggatatgaggcctctggtggggaggatagtgacagggttcccaccaggattgttcagaggtccacaaattggactaatctgctcttcagtgctgatcaggaggagagagcttttgagacaaaatcatcatctagcatggtttatagcagaaagttgtga

SEQ ID NO: 70669 - DNA, 318 bp, Glycine max
  Peptide Sequence Number=SeqID_162354
atggagcacttgttgtgtgatgtgaacaatgttgaagaatgttctacaattcaggggaagatagggattctgaagaatgatgatgcaataaatgggataaaacagcttggtgaacctatagaagttagaatcactaagtggaatactaagggactgctgacaaggattgagggtttgcgagctttcctacctaaagtcgagcttatgagaagagtaaatagctttactgagttgaaagaaaatgctcaattaaaatcttttctagctttggtttccttgagtgtgattgggagaagcctctatgagctatcctattaa

SEQ ID NO: 70670 - DNA, 229 bp, Glycine max
  Peptide Sequence Number=SeqID_162355
atggcagacgagcagcaccagaggatcacccttgaggattattcaagcagctcagtaccacaactctttactagcattgcacgtcctgaagtgcaagctcacaacatcaactacccgcattctttaattcatttaatacaggggaatttattccaaggattacctaatgaagacccttatgcacatttggcaacgttcatcgaaatatgcaacactgttaagattgtcg

SEQ ID NO: 70671 - DNA, 223 bp, Glycine max
  Peptide Sequence Number=SeqID_162356
ggtacatcctttgtggtacaagaagagggtacatctacttgggttgttgactgagaacaagagagggtacatctcttatggatcagttctagtggagggtacatccactaggctgttcaaagagaacaagggagggaattttagaaggttgaaaagaaatctcaaggactgcaagtcgcttggggactggatgtgggcacaggttgttgccgaaccagtataa

SEQ ID NO: 70672 - DNA, 213 bp, Glycine max
  Peptide Sequence Number=SeqID_162357
gggcagaatcatcttaggccgtggtcagatgccaggactaagctgaaggcagaaaccaatcaaggtaagatggtaacacggtcacagtttgccgcacaatgtcgtttcctactttcagcggaagacaaaggagaagaggtgagaggaggcgccatccacaagggaataagccatggaagaaggagcttcaccaccaagatgagccttggataa

SEQ ID NO: 70673 - DNA, 555 bp, Glycine max
  Peptide Sequence Number=SeqID_162358
atggtcatagaccagtcccttctctttgaactcactcaattatccagtgatgatgtgccgtttgagggtacacttgatgatgagtggaagtttgatttctctgtttctgatgcccgccaaatggtttccaccaaccaagcggatatgatcggaaggcttcttgccggatcattggcattcgaatgccgcatcatgcactacttgattgtgctcatcctactccctagatcatccaaccttgcacatgtttctgaggaagaattgataattatagaggaatggttcttgggtgaagaaggacgcaccagcataggccgcagaagaccgttctccatcaccacctcccagggagatgattcttcatctcttatgcacaacattcttgacaggttggatggactccacaccttcgttagtgagtgctttgactcattcgacagtcgtattgatgccatggatgcacggtttccaggaatggatacacgcatcaccaagcttgaggaggatgtgagttatgttcaccagtgcttcgatcttccaccatcatcctcatag

SEQ ID NO: 70674 - DNA, 219 bp, Glycine max
  Peptide Sequence Number=SeqID_162359
atgaaggacttttggcattgtcataaaattggacttatcaaggtaatccttgtggcgtctaacctgacttatcttccttcaccggaagtggcgtctacccagacttatcttcctttaccggaagtggcgtctaccccgacttatcttccttcaccggaagtggcgtctaccctgacttatcttccttcaccggaagtggcgtcatccaaatcttcgtag

SEQ ID NO: 70675 - DNA, 408 bp, Glycine max
  Peptide Sequence Number=SeqID_162360
atggcaaagtcaatggataactcatcaacctttgaagaaactgaggtaaatcctaaacttgaagaagttttggaagcatttaatgaaatgcatcaagaagctcaaaggcttgatgttttaaacaaaaaattgaaaagtgatttgaaattgcatatcactaaattggcttcaacacaaagaaagagtgatctcaatcacatgctcagcatgcaaaagcatactacagataaggctgtgaaagcaatgccttccaaggttattttgatgatgccaaagaatcaagagttaagcaaattccaaagattcaagaatcaagtttcaagaatcaagattcaagattcaagattcaagaatcaagattcaaggataatcaagatcaagattcaagacttaagattcaagacttaa

SEQ ID NO: 70676 - DNA, 336 bp, Glycine max
  Peptide Sequence Number=SeqID_162361
atggagcattttcttgagcaagtagcctggcctgaagcccaacttccattagtgagacccaacgaggctgctcctcctgagcccacacttgtgcaggttgatccagagctagctgatccattttctccagtggtgaatccactgtcttttcctgagcgtgaagtagttcccccatctccacctctgattatcatctctgatgcatcatctgatgaagcgactgcccctcctgattcaccagtaggagaaacagctgaccttcttacttccctagttggaggaattttcgattcgtcatctggagaagttgttgctctcactgattccccagtgtag

SEQ ID NO: 70677 - DNA, 285 bp, Glycine max
  Peptide Sequence Number=SeqID_162362
atgagccttcactgttatcaagcgagtcggagaccctacatgaccacagatcgacctccactccttatggctcacacagacccgggtatagggcctaatatctcaattggagtcgccatctgtcacaacctaccctacgacgggagtgcgggccaaaagccaaaggagcatcttccaaaaaggaaaatgcgcgagagtcgccaccaacgtttattcgaggaaaacgttagaaaaaccaaaaagaggtctacgaatattgaaaagaagggttcgagaattgtttaa

SEQ ID NO: 70678 - DNA, 318 bp, Glycine max
  Peptide Sequence Number=SeqID_162363
atggatatctgtgaagataatgacattcctataatattgggaaggccattcatgttgactacgagctgcatagttgatatggggagaaagaagctggagctgggctttgaagatcagaaaattgatttcgatttatttgttgaagacaagcctgctccagaacaaaatgtttgcttacagcttattttgaaggatagatataagggtttcaatttcttgaggaagagactgaaaaataacttagaaattttttttctaaaaatagtcctttcgctaaccgcaagccttgtgctaactgcattttttgtcatgctctaa

SEQ ID NO: 70679 - DNA, 237 bp, Glycine max
  Peptide Sequence Number=SeqID_162364
atgaagagtgtatctgttgttgtgtattacgatggtgacttgatttcatcttttgaatggatattgtttgaatgtcccagaggtcctaaagttgtcacaataagcgaggacatagtgtttgatgctttaaggaaaacaattatggatgtcatcgaagatgatagttgtgttgaatacaagtgtatgaagctcaaacatgacaatgatgtgggaaagatatttttcatcttttcataa

SEQ ID NO: 70680 - DNA, 327 bp, Glycine max
  Peptide Sequence Number=SeqID_162365
atgtgggctatcattgaccagtataaagagaaactaagtctagttgctagccatgagcaaattctagaggacgagcacgtaaaagtatcggtcctacaagtggaaagggaagcaagggagagagtgactgattcattacacaaagaagctatgatgtggatggataggttcgcttttactttggatggaagtcaagagcttccaagactgttagccaaagccaaggcgatggtggacgtgtactcagctcccgaggaagttcatgggcttttttattattgtcagcatataatcgagttgatgtctcacataattaggaaccgctga

SEQ ID NO: 70681 - DNA, 450 bp, Glycine max
  Peptide Sequence Number=SeqID_162366
atgcagtcccagtttcagtcagagatgcaatcacatggacttgcactgcctctggagcctgaggttggtccctcagctgctcgtgttagcacaaaggagagttatgttgatccctcagggaatgatccagacatgggtgactcagacaaatgcgggttgtacatcgaacaaaatcctccccacctagttgccctaggaagagtttatgagggatccacaaccattcacaacatccctttattgcatgatcaagtcaaggttggtgttgaggaggttaaacatgcagatgctcccattcctgtacccactaacgagggagttgtgggacccgcaaaacttgcagataggtcagatcatgaggtcgatgatcccctatatttgatgacattgaccatcccacaactttttttgaagcctttccaagttatgtgggatgctaccgtgttcagg

SEQ ID NO: 70682 - DNA, 348 bp, Glycine max
  Peptide Sequence Number=SeqID_162367
atgtaccctccactagaactgatccacaagagatgtaccctctcttgttctcagtcaaacccaagtagatgtaccctctacttgtaccacaaaggatgtaccctccaatgtgttaagacaaagatcttaggtgggagaagagagacacaaaaagaattcaggcggttagtccttggcgaattcttttgggcaaagggagaaaggaatgaaaagatgaatagcacaagttttcaaggtttagaaaaccagaaaacttcagaaagcttttggtacaaagaagaagaagaagaagttcaaagattcaaggcttgtaaaggattgtatgaattagtgttcaagattgaatga

SEQ ID NO: 70683 - DNA, 303 bp, Glycine max
  Peptide Sequence Number=SeqID_162368
atggaaaggaaaaatagatcctttgaagaagatgcaagaacccttctaaatgaaacgagggcatataaagtattcaataaaagaactctgaatgttgaagaatttgtacatgtggtttgtgatgaaaccaactctattgttcaagaaaattctttagaggaagatgcaggttttgaggaaaaggattctactcttgaagatgacatcaaggctgaagaacttgaacaaaacaaagaaatctctacgacaatgtgtaaagaatttcctagagaatggagaactcaaaaattttggataacataa

SEQ ID NO: 70684 - DNA, 189 bp, Glycine max
  Peptide Sequence Number=SeqID_162369
atggagaagtctgaaaagaaaaatattaatgaaaagaaattgaagaaagcatacattacatgggatgaaaacgatatggaatcttctgaagattcagaaaatgaagaaataaacctctgccttatggaaaaaagttatgaaagtgatgaagaggaaaacaaagacatgcctccaataagactggactag

SEQ ID NO: 70685 - DNA, 936 bp, Glycine max
  Peptide Sequence Number=SeqID_162370
atgctcgacgacgagaccgtgctgctggtacgtgaatacgccgcaggcatgcaccgctacgaactgggcctggtcaagggccggatcgatgccggcgagactcccgagcaggctgcggaccgcgaactgaaggaagaggccggttacggtgcgcgccgggtcgacgtgctgcgcgcaatgacccttgccccgacctatatgagccaccagtcgtggctggtggtggcgcgcgacctgtacccggaaaagctggccggcgacgagccggaagaactggaagttgtcccgtggaagctggccgagctggaccagctgatgctgcggattgcgatgatcaaactgaccacggacctgcgcgagaccgccatcgccatcgcccaggaagccggacaggccatcatgcaggtctatgccgatggcttcgaggtgcagatcaaggacgacaacagcccggtcaccagtgccgacctggcggccaaccaggtcattgaacagggcctgcagcagctgaccccggacctgccgatcctgtccgaggaatcggcgcaggtgggctgggagcagcgccgccactggggggcctactggctggtcgacccgctcgacggcacccgcgagttcgtcaagcgcaacggcgagttcagcgtcaacatcgcgttgatctaccagggcgcaccggctttcggcgtggtgctggccccggtcaccggcatcgtctggcatgccatgcgcggcgagttggcctatcgccggcagggcctgcacgacaccgtgctgcgcacccgtacaccggccaccgcaccgttgcgggttgccgccagccgttcgcaccgctcaccggagaccgaggcgctgctggcgaggatgggccgcatcgagaccatcgcgcagggctcgtcgctgaaattctgccggatcgccgaaggtggcctggat

SEQ ID NO: 70686 - DNA, 264 bp, Glycine max
  Peptide Sequence Number=SeqID_162371
atggaagcgcctcggcttggcaccccttccttcttcactcctccctctatttatagcaaaataggggaggagcttgccacccagctcgcccaggcgagccaggaatcaattcgcggggtccgacttgatggtggaggacacatgaacaacgctaggcaatcaattcatcgggtctctgaaacaagatttgagggtggaggacaggcgaacaacgctaggcaatcaattcgcggggctcttgactcgatggtggaggacacatga

SEQ ID NO: 70687 - DNA, 357 bp, Glycine max
  Peptide Sequence Number=SeqID_162372
atgaggaggattgccctagaaaggagggagagaagtgcaggtcagccgcaagggctacaagtgggaagaattcccttttgtcacattgatgaaatcttcgttagtgtgggatggatgtgcgagggacgggttgccgtgataaacgatgaaacccctcaaggtcaatcaaattggatgcggtcgtgtcctccacagtttgaattggggaattggcgagtcgttaagcaacctgggatttccgtggaaaattcaatggaagtgaagccacaccaagaggaaacgaaagtcgtaaaatttggtgttggcaaagaaagaaagaaggtcaaggttggaactgacatgtccgcgaacgtttga

SEQ ID NO: 70688 - DNA, 255 bp, Glycine max
  Peptide Sequence Number=SeqID_162373
atggctactccagctgcctcgcctcttcctcctcctcctgcagacgcatcagcgtctccatctaccttgaagcggacaccggaatttgaaatccctaaagcttctgacagtaggataaagaagaaagttcttcagactgtaggcaagcgatggaggcagtttaaatcagacttgacaaggaaattggcacttgcagccgacaaggaaattggcacttgcagccgacaaggacagtgtggacgacactgtctgtga

SEQ ID NO: 70689 - DNA, 294 bp, Glycine max
  Peptide Sequence Number=SeqID_162374
atgacgctctcacttaggaaaactaggcagcaagtgtcgatatcaccctgtcgtgcacaggcaactaccctccatggtgatcaacctgagtctcaaggaagttccaaatcgagtgacatgcccccaaggatatccaacatggtcatcacaccccccatgtacatacacagcatacatcatcaacatcaacatcatctcatctcaatgtcattatcaacatcaacaccatctcatcttagtatcattatcaacatcaacatcatcatcaacatcacaagcaatcacattccatag

SEQ ID NO: 70690 - DNA, 453 bp, Glycine max
  Peptide Sequence Number=SeqID_162375
atgccacccactaggcaccctctagacccggataagtctaacagggccccggggttttcaacattgatcacgggcctctgccagtcattcggggttcccgtcacccctagtaaggtgatccgaccgccgatcacccgggccttcattgagaagtattgcatgcctaggcaggtgcaaggtgatgcacctcaggctgcagacgcaccaccaccacctcatcaggatgatcccactgggtcactaggcatggagtgttatcgacagcacttggttcgccagcaggcggccaaccaccaggggcagtttagggctgaggtcgcatggcctggagattggcccgaggcccaagcaagggaggcacctgcaggatcccccgacgatgcagaggaggcccgtatggatgaggagatgacgaatttgctcggtttcttgggaggaagcggagccacgtga

SEQ ID NO: 70691 - DNA, 366 bp, Glycine max
  Peptide Sequence Number=SeqID_162376
atgacatacacctttgtcgcaacctacccttcgacaagagggcgacgcggggctcacgggtgcgtcttccaagaaaggaaaatgtgcaaagtcgccaccaatgtttatttgaggaaaatgtcgcaaaaaccagaaagggtgtttccctcgctcctatgtatcctcaattgcgatgaggaagggatcctctatagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 70692 - DNA, 429 bp, Glycine max
  Peptide Sequence Number=SeqID_162377
atgggagtctcgtgcgctgaagcagatagggaatgtgaacctctagacgggacattgcatgatgtggagacctatccaatagtggaggagctactacaaggaatgatgaataaggggcaaattgaagtctacagtgcgaagaaaggggaaggagatatatgcatgcactcagatgacaaaaacccgtgtaagcccaagcctttggtaatccacttcaccagggacgtcaccactcaaaggccccaaggcttccatccctttacagttaagacgcctgtgcccttcccttatagaagtgataaggtggtgccatggaaatatgccgcacaagggtctgacggaaggaaggatgcacccgtcatacgtgttaaggaggacctactgttcacttctctacactattgtgaaatttatcagcaagtgtactga

SEQ ID NO: 70693 - DNA, 99 bp, Glycine max
  Peptide Sequence Number=SeqID_162378
atggcagaatcactttttttggatgatggaaacctcagccagcctatggcaggctaccaaggcataggaaatttttttctaccccaaatacatatataa

SEQ ID NO: 70694 - DNA, 653 bp, Glycine max
  Peptide Sequence Number=SeqID_162379
atggtggtgaacctctatggtgcgcgcgagcgccggatcgcggatctggctgaaggcctccgggcgggtatagacgcggtcggtttggccgacgaaggtcacttcgccttcctgaagcgcctttgcgccgcccgccaccttgtcgatataaggctcgcccaggcccgccacgctgacccgatcgatgtcgccgacctggaagtaactgtgcagcgccgccgtggcctgataatcgccgtgcgattccagttcgatttcgcactccgcacccagcttgaagcgggcaatcagcgtgaaagcgtgcggccacaatttgcgggtttgctcattgtccttcagcgtaaaggtcaggatgacgccgttgtcatcttcatcgtgcgccgtcaggctccagggctggttgcgggcaaaaccgtgggagggttgcgccaccgggccgaaccacggccagcagatcggcacgccgccgcggatggccttgcctttggcgaagggggtattgttgctgagccaaatcaccggctgctcaccgctgggctgccaggccagcaaatgggcgccttgcagcgcgacggccgcgcgcactttcggatgcgacaccacaaccacgcccagctcatcgagttgccgctggctgatggggatcctctaga

SEQ ID NO: 70695 - DNA, 90 bp, Glycine max
  Peptide Sequence Number=SeqID_162380
atggataatagcttgaaggtaggagaagatgagtggagggagaaggagagaatgagcacgaaattttatgcctcaaatgaggagtggtag

SEQ ID NO: 70696 - DNA, 246 bp, Glycine max
  Peptide Sequence Number=SeqID_162381
atgtctcgtgagtttagcctaatcctaactagacttcgttcccagatgtctcttgttgaacttagcctaaccggacagcattacagctacaacataccgaaaaaccaagttactgcactctgtgtccagatatacgatacattagccctatcctatcaagctctaaggatcaaaccatttcccaatgaggatgatcctaaatacatatgtgtttgcatgatcaatacaaaaacatgcgagaattaa

SEQ ID NO: 70697 - DNA, 1161 bp, Glycine max
  Peptide Sequence Number=SeqID_162382
atgaggattgatgctgacagcctgaacaccttcttagagaccctagtagttttggaggagggtgagacactgcctacctattccagatttacgaggatgaggattgatcctcaagagtttgttgcccgtctctgcatccttgaaaggggttttgttttgaatgcagagggccacccttggaagcttttgaggaaagatctcaccactcttgcacagacatggagtgtcttctcctacagcaacctgactcccacttcccacacctctgaccttaatatggacagagccaggttggtttacggcttagtcatgggcatggacatgaatatcggagccctaatctcaggtcagatttctaccattgcccagagtaactcctctaggctcgaatttccagccttgattactgctctatgcagagctagaggagttacctctgacagtctgacctatgagagcctgagcccggccattaacttggcctacattaagaaaaattgttggaatgtggatgatctgacagttaacttcaaaagggcaaggaaggtaagggctcgaccaacagatattccttcttcttctgcaccactaactccttccactttttcaccaccagctcctcccacttctgtcacccctacaccagctgcccaggaccctcaacgctttgaagccatgcttcagagtattcatcaagggcagatcttattactgcagagcttgcaggtggtagctcctccagggtccattctgttagtagagcagttcattaagaaggtatcctggcttggaaccttaccttctgttgtgagagagggtgagggccccagtgctcaggtacctcaacaggtacaggatgcgtcttttgaggctaccatccctggagcttttgatttttcaggtgcagatgtagagatgagacctgatgaggttgttcctcctgagccaattgtgccagttatacatgagactgttgaagaagggatggacctattttttgctcagcaggtagcagatcctcctacacctatcatggagatgccagaagaccctaccacaccagtcctgagactgtcatccactcctccagctactctagttttacatctaacagatgaaaaggatatgcaggacacacaggaccagtcacaagaattctaa

SEQ ID NO: 70698 - DNA, 162 bp, Glycine max
  Peptide Sequence Number=SeqID_162383
atggaagggtggaatcccccacccgagggcagcataggttttgatgcgtgtttaagggatgcaggtgaacattttgtgcaagccataatgtcctttgtgaaagccatatgtcaatcaaggaaggagagaccaatgcagttctacagattcctcaatagatag

SEQ ID NO: 70699 - DNA, 444 bp, Glycine max
  Peptide Sequence Number=SeqID_162384
atggcggcaaagaaggcaacccacaccattcctgaaagtaagaaaagaaagtttgtcaattctcaacctacttcatcgggtgttactaaacctttggggtttcctgcactcattactagcctctacaagtttcaaagagttcagatcccaccgcatcctggacctgcttctagacctcaaccaccaccgagagctcagccatctaacttttttgctcttcaatcctacatgaccacacattttacacatgtagagcagctattggccactaaccattgtgcttacacacctttaaatgactcattttacagggatagtcctatttttcctgaagggatggatgcttttcatggagctcatgtagctagaccaaaacatgaagctcaacaggaaggtcaagaggatgttgaaggaaagcaagtgcttgacacagtagatgattga

SEQ ID NO: 70700 - DNA, 483 bp, Glycine max
  Peptide Sequence Number=SeqID_162385
atgcccacgaagattttgctttggacaccagcagatttgctgcaagtggtggtcgtgacagtggctggtttggtcggcggagatgaacaaagatcgtggatgtatgatagtgtaatgtataaagaagtttatgtgaataaccaaaatgaagacgaaggtggtgtgaatgaagaacatgttaactgttttgattcgttcaatacttctcaggtatttgctacccgtgatgatgctctccgatgggctcgatctcttgcttatgaaattggatttgtggtagtgattatgaggtcagacacaaataatgataaaggaggagaagctaacttaccacgatggcaacatccgtatgctttatatagatctccaatcccctccaatccctccaccgtgaatgcgcagataaaggaggagaagccaacttaccatgacggtgacaacaacgcgactacggtggcggcacaacggcagcacgaacagtag

SEQ ID NO: 70701 - DNA, 270 bp, Glycine max
  Peptide Sequence Number=SeqID_162386
atgggtagatgtaataacgatgccatattgtcgcaacctacccttcggcgggagggcgacgcgagggctcacgggtgcgtcttccaagaaaggaaaatgcgtggagtcaccaccaacgtttattcgaggaaaacgtcggaaaaaccggaaagatgtggtctacgaactttaagtgtgaaaggttcgggagttatatttacgcacggggaagggtgtttccctcgctcctacgcattcctcaattgtgataaggaaatcagacctacgtag

SEQ ID NO: 70702 - DNA, 1218 bp, Glycine max
  Peptide Sequence Number=SeqID_162387
atgaatcatgttgttgacgagcctcatgaggagccttatgatccagttacgagtgatgaacatgctgagttaaagttggcctctcatgggagcaaggttacgaaatttggaaagcctgcacctgagattaaagagaggtggcacaaggaaactagcagtttccatctacccataggagagatgagtataaccctcaatgatatgtgtcataccctaatttcgtctggggatcattgtttggtggcatgcaaccttcgcttggtcgcctcaaggtactcaacacccatcgttaggaaatccgtaaagtttcgtgacattccgaaagtcaaaaagaagcattgttgcgcaatccataaagttctgcaacattccggaagtcaaaaagagtcttgttgcgtaatccgtaaagtttcgcaacattccgaaaggaaaatggacacacccgtgagccctcgcgtcgccctcccgtcgaagggtaggttgcgacagttggcaactccactggggttgcatacaactcccgaacctttcattcttggtagtatgctcgagtcattcatctttatgaaatgttgtcgaagtattggcgatcgaaatttccattccttggattatagggttgaaccaagctcgtgctttctagaaaaggttcatcgagtcaaggtcaagtatggaaaacacgctttacgacgcccttaccgaactcgtgctagagctagagtaatgggtgaactagaagaggtgcaagagcagatgaaggccgacatggaggccatgaaagagaaaatgaccacaatgatggaggccatgatgagcatgaagaagataatggaagccaatgcggttgcaattgccgctaccagcgctgttgctaaggtgaaaccaatgcccccatttggcctcaaccaaatgaataatccaacctcagatatggtaggcaaagatttgggaagtacgggcggcccccattatgcgcaaattcaaaacaagcacgccttcccaccatatgaagtcccaactatacaccacccaatgtggcatacactcctagtgagaatgtcaataactccactcccatactcattgagagccgacaaccccaaactgatcatgcacatgtctctcaaaccgtgggggagacacatgaaattccccaccacaatcttgccgacttcgagccttgcctcagatatgccactgaagggcaagcaagtggtg

SEQ ID NO: 70703 - DNA, 396 bp, Glycine max
  Peptide Sequence Number=SeqID_162388
atgtttgcacattcgattaaaggctgccgtcccttgggacggacgtgtggggtgctaataccttccccatcgcgtcttttccggtttttccgacgttttcctcaaataaacgttggtggcgactccgcgcgtattcctttcgtggaacacgcatcccgcgagtcacgcgtcgccctcccgccgaaggttaaaaaccatcaaaaattgcttcccaatattgaaaatggcatgacgctatccagtccctgtgagggaatggtgtattggttgagtctgcaaaggtacttcacgagaagaaacatcttcaagaattggaattacggtggtggcatgatgatgagaatgttagagaaccgccactatggtgggaggatcctattgcagaaaggcatatga

SEQ ID NO: 70704 - DNA, 159 bp, Glycine max
  Peptide Sequence Number=SeqID_162389
atgtggaattctaagtcggttcaaaaaccgtcgtggaaagccaacactttccatgacgcaaggccttccagggattatgatgattctcagctagacctgtccgggtttgggcaacctaagagcagttccaaacctgcagggtttagtccggaagcataa

SEQ ID NO: 70705 - DNA, 1584 bp, Glycine max
  Peptide Sequence Number=SeqID_162390
atgacgctgtttcctccgatgcacgccctttcgaggatgagtcgatgcacgccctttcgaggaggagtcgatggtggccgagcacggcagcgtgacgatagtgaggatagtgacggtgaccatgacgatgatgattgggaaggcatggagagcaccgaattggacgaggcgttcagcgtcgcgacggcgttggtggacgccgccgccgtcgatcggctctcacagaaggtgtcgagggctaaacctttcattcatattatgtctttaacaataacaattcaagtggcacatgcagatgaagagctgctaatgttattgtctaggatcatcaacaatctgttgctcaatgctgcaatgtctgagtatgttccagctggggtagatggcaaacgttgtctggaaaatgttgtcaatgaagttgtgttgcttgctgctcgtagagccccacaaaatttcagacagctctccctctctctcacgcagccttcttcttcttttctcccatccaccattgttgcccaacaaagcttcaacctttggtgctcatttctgctccaaatcgcgaaaggagagcattttcggagtcgtgaagtgcgtggctacgagtgggacttcgaaaattcaggtttgggtggacttctttctctcttaaatttcgtggtcgatccaacggttaacgaattggatcgaaggaattgttactgtggtctttacgtgagaaaagctgtgattttggttgatcttgagaggattgatggggacccggtgttgagaaaaacgaggatatgggctacgtgggagtacgtgagctcagttggaggtgggcaacaggggatggtgggtttatgcgcgcattgtggatgtggaaagcttgttgtgcaccatcgcccgaccgccacctatggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctgcctgtgtaatcgattacacagaggaatgggtcactggtaatcgattaccaggcatgtgtaatcgattacacagtgtattattgcatatttcatgtcctgagatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacacttcagcgcacggtggagtggatactacccacacctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttctcgaggtggattctcccgaggaagtcatgtcggcatctgaggcagactctacggaggatagcggcccgagagagatggcgatcagcggaggctcttcatcctag

SEQ ID NO: 70706 - DNA, 231 bp, Glycine max
  Peptide Sequence Number=SeqID_162391
atgttcaacattttttacaacaacccaccactaccatttatggtgttatttgccataatttgtgacaataataatccaccaagcaaccagcatgactcaacctccaatcctgaggacctatcagatgaatatgagagttgttgggtcaaaaatcatggtagtgatactgactcctcttccgagcccaaaggaagtaacatgactccatcccacgaaacaatattcaaatga

SEQ ID NO: 70707 - DNA, 189 bp, Glycine max
  Peptide Sequence Number=SeqID_162392
atgactatggaagagggtggggtcaagaaggaggactacacacaagatggaactaatgtagctccatgtagaacttgtagatcaatagtagcagaatggagaaggaggaaaggtgattggagatgccacttcaaggagatgagtcaagaacacgttcaccaccataggaagtcatggataagagcttga

SEQ ID NO: 70708 - DNA, 282 bp, Glycine max
  Peptide Sequence Number=SeqID_162393
atggctagagacagcgtcctaacacgcgtggcgaccggagccgccgttggcggtgctatcggcggcgcagttagtgtgaattttggaactggtgtgttgcatgcaggtgctgtttatgggacttacgatgcaattaggtataagcgtccttgttcttcatctttgcctaacaacatgattctgagcacagacttccctcttggcattgatgtacagggtgtatgcatccctatgattggaggcttagtgaatgctgtcaacaacagtgcccttctaggttga

SEQ ID NO: 70709 - DNA, 570 bp, Glycine max
  Peptide Sequence Number=SeqID_162394
atggctccaaggaagctccctgctaagagggcaaggaaagatgccaccagaaaaggttccagtgcggccccacaggtggatgtggagtttgatggacacaggttccggagtgaggaacaccagcctcgatttgaggcaattaagggctggttgttcctcaaggagaggcaggtccaattgagggacggagagtatgccgagttcctggaggaaatggccaagaagcaatggactcagcttgcggcacccatggctaagcacgatcccgaaatagtcatggagttctatgccaatgcctggcccacaaaggagggagtcacagacaagtgctcctgggtgaggggccaatggatcccctttgatgaggatgccattaatcaatttctggggtatccattggtcttggaggagggccagcgctatgagtttagtcagaggaggagccaggcctcggggttcgacgaggtggccatcagccaactgctgtgtgttccagggcaggactttgtcggaagcatggcggggagacaggtgcggatcatgcgcactagcatgaccaccctcacatag

SEQ ID NO: 70710 - DNA, 306 bp, Glycine max
  Peptide Sequence Number=SeqID_162395
atggaaggcctgatgaccttgctgggggcgacgggcactctgtggaactggcagaggcttgtgatcaaagctaggaatcccagagccctgttggacttctttgggtccaaggggtgcctcgatgttgctgagcagcaacgacatccatatctaggtcagggtggtcatgtggttgagcatgatccgccctcacctccctacagcggttcaggcgaagtcttgcccaggtgtgcacatcaattgggcaatggcctcctcgtcgaaaccgtcagcctggtccctcctctagccatatcacattactaa

SEQ ID NO: 70711 - DNA, 120 bp, Glycine max
  Peptide Sequence Number=SeqID_162396
atggcagatggaacaccttttgttggttgcttaaaagcaagtggttgctggatagatggaggtggaaaatcaactcatgttgctatagcaaatgcaacagcaagcaaggtagcaccttga

SEQ ID NO: 70712 - DNA, 648 bp, Glycine max
  Peptide Sequence Number=SeqID_162397
atggagatcaccaccatccacactaacaacaaggcaaccatcatgcttaacttcaataagcctcaattcatcagaatgtttcagagaaactctgtgctcctgaacaacaaagtgatagtttccaaagttcttggagtgaaggctgagaaagggcctatgattcacgtggctagagcactctacaatgaaaatgctgagaaagttggtgatcagaagacgattgtgtacaacattatgtgtaaaagggctaacatttgggcaaacattctcaataaaagcattctccacaaggccagttcaaaaacttctctctcagacttacataacacatacggccaagaaaccaattggatagaagcatctcctccttttgaagttccaagaagaataaaaataagagcaaccaaggataatccaaaaattattgataaggaatgggctccttccaagaaagttgacaaggaatgggctcctccctctcctccttcaacatcaagcagtgaaaccatgcacgatgctcccatcttgatgcaatcctaccccccaagggcattggatagaagactccaagaagattgggccagagatgcaagagaaggccttagggtactcatgagccttagggtagatttcaggcccctgggctaa

SEQ ID NO: 70713 - DNA, 318 bp, Glycine max
  Peptide Sequence Number=SeqID_162398
atggggttgaaccaagcacttgtttttaaggaaaggttcatcaagtcaagggcaagtatggaagtaaccagcttgcaaaagaaagaatgcgctttatggcgcccttaccgaacgcgtgccagagctagagtaatgagtgaaatagaggaggtgcaagagcagatgaagaccaacatgaaggccacaaaagatcaaatggtcataatgatggaagacataatgagtatgaaaagaatgagggacgtcaacacggctacagtcattgccacaagtaccgccactgaggtggacccgactcacccatctggcctcaatcaa

SEQ ID NO: 70714 - DNA, 360 bp, Glycine max
  Peptide Sequence Number=SeqID_162399
atgaagagggtacatctacttgggttgttgactgagaacaagagagagtacatctcttgtggatcagttctagtggagggtacatccactaggttcaaagagaacaagggagggaacaggatattccatgatgatgatgaagaccaagtcaacttgtatctcatgacaaaatctgatgagaataacaaagaagattctgtaaggaagacatggtacatagatagtggatgttccaagcacatgacgagtgatgtatccaaattcacaactatttcccccaagaaaagtggacatgttacatacggtgacaacaatattagtaaaatctcaaaagaggcaacatctaagccatctctatga

SEQ ID NO: 70715 - DNA, 178 bp, Glycine max
  Peptide Sequence Number=SeqID_162400
atgcaacaggcttttagaagaactgcaactcagattagtaagttggtggatgacatggctaacactatggctaaacaagaggaagaacgtgtagagattgaaacgtatcaaggcatttttcaagttacctctatccatcatcagatgaccactgaagaggaaacgtctgaagtctcca

SEQ ID NO: 70716 - DNA, 330 bp, Glycine max
  Peptide Sequence Number=SeqID_162401
atgcctttcggtccagactattacaatctcctttgccatccagagacaatcgaattcgttggcaggcagagacaaattatggtcatctgccccctttttgaagacttccatgtctttcgatcgagactattacagtctcctttgccatccagagataagcgagtctgttggcacccagagacaaattatggtcatttgcccccttttcgaagacttccatgtctttcgatcaagactattgcagtctcctttgccatccagagacaagcgagtccgttggttttgctgattgggctagttgttggtctggtggtgaaatcgctcgaatga

SEQ ID NO: 70717 - DNA, 156 bp, Glycine max
  Peptide Sequence Number=SeqID_162402
atggacaactcatccttcttccagattcatcctcgcgctcagccgaggagtgttacgctcaacggatggctcgctaagccagcaaattggcttagcgagaagcacaagctaaacaggtgttttatgtccaagatccttgtgatgaaaggtggttag

SEQ ID NO: 70718 - DNA, 427 bp, Glycine max
  Peptide Sequence Number=SeqID_162403
gggcaaacgtgcccgatgacgcaaggagagttacatcgtcttctgcaccttttgtcgtcctgacccgtgattcaggtgacatgcggggttaccttatggttacccgcacctttggtcaaccagtggcaaacaagctcgttgacgcacggagactaacatcgtctgttgcaccttttgtcgtcctgacccggttaccttatggttacccacaccattcgtcaaccatgggcaaacaagcccatagatgcacggagactaacatcattttctgtaccttttgtcgtcctgaccctttgaagtcaggtgatttgcggggttaccttagggttagccgcacctttggtcaactagggggaaacgagcccgttgacacgcggggacaaacatcatcctctgcaccttttgtcgtcttgacccgtgaagtcag

SEQ ID NO: 70719 - DNA, 621 bp, Glycine max
  Peptide Sequence Number=SeqID_162404
atgggcggcagcgtgctggacggcctgaaactgatcgtgcgtgagccgttgctgcgctggctggcgatcatggtggtgttcggtgtgggcgtgggcaccctgctgtacaaccagcaggccagcatcgtgcgtgcggcgttcaacgatgcaggcgctgccacggccttcttctcgcgcatcgacctggcggtgaacgcactggcgctgctgatgcagctgggcctgacccgctggctgctgtcgcgccacggcatcgcgccggccctgttgatccctggctttgcgatcctgatcggcttctcggtgcttgccgcttcacccatgccgttgatggtggccgtggtgcaggtgatgacccgcgccagcgagttcgcattggccaagccggcacgtgaaaccatctatacccgcgtggaccggcagtggcgttacaaggccggcgcggccatcgatacggtggtgtaccgcggcgcggacctgagctttgcgtgggtgcacaagggcttgtcgctgtttggttcacatgtggtgttcatcggtggcgtggtggttgccgcgtgcatgaccgccgccgcgtttggtgtactgcgcgaagaaaaaaagctgccacgcgaccgctga

SEQ ID NO: 70720 - DNA, 606 bp, Glycine max
  Peptide Sequence Number=SeqID_162405
atgaggtgtttggaggagaaggcaaaggccttggcaaatcaaggcgaatgggcttcttttattgacatcttggtgcttttgatcttcggagttgtcctctttccaaatgtgaaagggttagtggacctagcagcgattgacattttcctcgcctttcatcatggcaaagaaagcccagtcgtcgccattttggcaaacatgtatgacacgcccatatgtctgctacaaggtcactacttgtgcatcgagaaaggaaaggcaaattgggaccaactcttggctagcatggagggggcatccattaattggttccctcgttggaaggaaggaaaaatcgggaatctatgctcgtgtgaaggatttccaaatgttcccttgatgggaacaaggggttgtattaattataatctcgtcctcgccatcagacagcttggctaccccatgagaggagcgccatcggaggaaagcatcgcgcctttcatcgcacggggtttcagtgaccctaatgcaggggtacttcaaggagttcacaatgcatgggatgtgctcccaaagctaaaggctgcgagaccggaagaggccgaagctccagaagagagtgaggag

SEQ ID NO: 70721 - DNA, 105 bp, Glycine max
  Peptide Sequence Number=SeqID_162406
atgggacccttccagaacattttggaagctgggttacttatggaggaagcaactcagctcgcctgggcgagctgggcggcaacctcctcccccttttccctataa

SEQ ID NO: 70722 - DNA, 270 bp, Glycine max
  Peptide Sequence Number=SeqID_162407
atgctgaaccctttcctcttcactcctccccctacttataaccgccttctggaggaagaatctggaaggcccaactttcgaagaagttacggaaactcacggattgcgcaacaacacctccttttgatttccgccacattacggaatttcacggatcgcgtaaccctgcttccttttgattcccggcgcatctcgggacttacatattgtgcaacaaagggtgccaagtatcttgaagcggccaatcaaaggttgcatgtcatcaagtaa

SEQ ID NO: 70723 - DNA, 147 bp, Glycine max
  Peptide Sequence Number=SeqID_162408
atggccctctacaggttggcgttcgcttactcgaacccgctcaagctaccttgcagcgacgttttccgcttgtccagcgccgggaagagacgacaatctgtcggtcgtgaccctatcctctatttgcatccgtccctaagtacctga

SEQ ID NO: 70724 - DNA, 1293 bp, Glycine max
  Peptide Sequence Number=SeqID_162409
atgatgcagagctatcgtaatctgatccgcttcgcgcgtcgcaataacctcagcgtctccgccagcccgcaggatatcggcgtgctgacgcgtaagttgtatgcggcctttgaagccttgccgggcaaggttaccctggtaaacccgcaaatttcaccggacctgtcggaaccgaatctgacctttatccacgtgccgccgggccgcgctaaccgtaccggttggtatctgtataaccgcgcgccggatatggaatcgatcatcagccatcagccgctggaatataaccgttatcttaataagctggtggcctgggcctggtttaacggcctgctgacctcacgcacccgtctgtttattaagggcaacggtatcgtcgatttgccgaagctgcaggagatggtggccgacgtgtcgcaccacttcccgctgcgtctgccggcgccgacgccaaaagcgctgtacagcccgtgcgaaattcgccacctggcgattatcgttaacctcgaatatgacccgacggcggctttccgcaatcaggtggtgcatttcgacttccgtaagctcgacgttttcagcttcggcgaagagcaaaaatgcctgattggcagcgtcgacctgctgtatcgcaactcgtggaacgaagtgcgtacgctgcactttaacggcgagcaggcgatgatcgaagcgctgaaaactattctcggcaaaatgcatcaggacgccgcgccgccggatagcgtggaggtgttctgctacagccagcatctgcgcggccttattcgcacccgcgtgcagcagatggtctccgagtgcatcgaactgcgtctctccagtacccgtcaggataccgggcgcttcaaagcgctgcgcgtctccggccagacctggggcctgttctttgaacgcctgaacgtttcggtgcagaagctggaaaacgccattgagttctacggcgctatctcacacaacaagctccacggcctgtcggtacaggtagaaaccaatcacgttaagctgccggcggtggtggatggcttcgccagcgaagggattattcaattcttctttgaagatgcggataacaatgatagcggctttaacatctacattctcgatgaaagcaaccgcgcagaggtctatcaccactgcgaaggcagcaaagaagagctggtccgcgacgtcagccgcttctactcatcatcgcatgatcgcttcacctacggctccagcttcattaacttcaacctgccgcagttctatcagatagtcgaagttgacggacgcacgcag

SEQ ID NO: 70725 - DNA, 135 bp, Glycine max
  Peptide Sequence Number=SeqID_162410
gaaaatgagggaggatcttgccacccaacttgcccaggcgagctaggttgcttcatccagaaggcggtgccttctggagaacttcctggaaggcccaagtgggcctggttgctatttgcaccccctatttactaa

SEQ ID NO: 70726 - DNA, 443 bp, Glycine max
  Peptide Sequence Number=SeqID_162411
atggctccgaaaaagctttctgcgaagagatctaggagggacaccgcggctgaagggaccagtgccgctcccgagtttgatagtcatcgtttcagaagcaccgagcaccagcaatgcttcgaggccatcaaaggatggtcgttccacagagagagatgcgtccagctcagggacgatgagtacacagattttcaggaggagatagcttgccaatattggacgtcgctggtcactcccatggctaagtttgaccctgatatagtcctggagttttatgctaatgcttggcccacagaagagggagtgcgaaacatgtggtcatgggtgaggggtcagtggattccctttgacgcagatgcccacagccagttcctgggtgacccgttagtgttggaggaaggccaggagtgcgagtttagtcagaggaggaacagggccaatgg

SEQ ID NO: 70727 - DNA, 399 bp, Glycine max
  Peptide Sequence Number=SeqID_162412
atgctgcggctgaaaaggaccagtgctgcccccgagtttgatagccaccgtttcaggagcgccgagcaccagcagcatttcgaggccatcaaaggatggtcgttccaccgagagagacgcgtccagctcagggatgatgagtacaccgactttcaggaggagatagctcgccgacattggacgtcgctggccactcccatggctaagtttgacccagatatagtcctggagttttatgctaatgcttggcccacagaaaagggagtgtgggacatgcggtcatgggtgaggggatttcgcccggaccgttgcagggaggcaggtgcggatcatgcgcaccagtatgaccaccttgacccagatgtggatgacattgctgctcagcaatgtcctgcctag

SEQ ID NO: 70728 - DNA, 333 bp, Glycine max
  Peptide Sequence Number=SeqID_162413
atgaaccgaggtgctcgaggacaggtacgagcagatgctaggcccgtgatcagcagatcatcatcccgcgtccggctccgaacgatcaagaagcactactgggaggcagcctatgtccttgatcactccatacaagaaatgtctccgaagaagctctccatgaagaggtctagaaaggacgacactggagaaggctccagtgccgccttggagtttgatagtcaccgattctggagtgctgagcaccagcaacgcttcaaggccatcaaggaatggtcgttccacaaggagaggcgtatccagctcagggaggacgagtaccctaacttctag

SEQ ID NO: 70729 - DNA, 171 bp, Glycine max
  Peptide Sequence Number=SeqID_162414
atggatcagtctagttttaagaacatatgggacatcctcatcagggtattggatgcacaagctttcgtaggtgaaatcagaatgttcaaaatcagaatgttgaaaactataatgctcaaaatcaccaataacagaatgctcgggatgctcaaaaggatcaaagggttgtaa

SEQ ID NO: 70730 - DNA, 372 bp, Glycine max
  Peptide Sequence Number=SeqID_162415
atggtgaggctcatgaaacaggccaatgtattcccattgaagaaaacacttaacaagttcactatatgcgaaatcaacagagacaaggatatactcaaggaggattctcaggcttctagcagggtccttataaccaacaaggacagtggagatcacaccctgacaatcaattcaacaaggaccagggtaacaatgtcaaatcataaaagcattaagtcagcactgaaaaaccatgaggtccaggtgggacaactggccatgcagatagctgacaagtcatccaatagttttgtggcgaatatagaaatgaatcccaaagaggaagtcaaagctatgatgacaaggagtaatctggataaagaaaggtactga

SEQ ID NO: 70731 - DNA, 1059 bp, Glycine max
  Peptide Sequence Number=SeqID_162416
atgaccagcgtcgcccagacaaacagcaccaccaccgtaacaacatgccggcgcggccataacaggccaatcaccagcagcgcccagctggcggcaaacatggtatggccagacggaaaagcaaagcccgtctcaaacgcccacaagaatcgcgccgttcatgataatcaacaacagaatggccggccggaggcgaaagcgcaggcaccacaatacccagccgctcagaatcaggctggtcagcgtgccccacggactggtgacggtttcggtgatccagaacagcacgcgcaacagatgcccgctctcccccggttgccactgccagccggaaagccatacgcccagcggcatcagcacggccctggttcaggttatggcacaatatcggcagtttcgtcgggccagtcgggcccgtgcgttatcatgatgatagcgcatcctctgaaggttctggagagtcacatgcagctgaaacgggtagcagaagccaaactgcccacgccatggggagatttcctgatggttggttttgaagaactggcaaccggccacgaccacgtcgcgctggtttatggtgatattagcgatcacaatccggtgctggcgcgcgtccactccgaatgtctcaccggcgatgcgctgttcagcctgcgctgcgactgcggcttccagctggaggcagcgctgaccgccattgcggaagaaggacgcggcgtgctgctgtaccatcgtcaggaaggccgtaacatcgggctgctgaacaaaattcgcgcctatgcgttgcaggacaaaggctacgacacggtggaagcgaaccatcagctgggctttgccgccgatgagcgtgacttcaccctgtgcgccgacatgtttaaactgctgggcattaatgaagtgcgtttgctgaccaacaatccgcgcaaagtggagatcctgtcagaagcgggtatcaatatcgttgagcgcgtgccgctgatcgttggccgtaacccaaaaaatgcgcactatctcgatacgaaagccgagaagatgggacatctgctgccgaaatcgtaa

SEQ ID NO: 70732 - DNA, 585 bp, Glycine max
  Peptide Sequence Number=SeqID_162417
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttagagctggtgttggctttagttgaagtgagagcaacaaatggttctctggagcagaatgcttgtgccagcagtaacgaaatttcgagccttaaggaactcttgttggctgcagagaaaaagtgttcagatgcagaggaaaaagcacagcaagctacaatgctgaaacgaagagatgacgcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaacccccgttcagccgaccgctgcgccttatccggtaactatcgtcttgagtcacccg

SEQ ID NO: 70733 - DNA, 285 bp, Glycine max
  Peptide Sequence Number=SeqID_162418
atgtcaaaatgtatgcaaacaagatcccaaaagcctgagctgttagaagaacctgagatagaaaggcttcctcatagattgagaaaagagcagagagaaaagataatggttgaggctaaagatgctacacggacccttatggagtatctcacccatcacttaagggaaaccaacaacattcaactgtcagccttgcctcgaggggttactttggaattcaaacatgggttcctccagatgattgaaacaacatgttcaacaaagcttcacatgaggaccccatga

SEQ ID NO: 70734 - DNA, 210 bp, Glycine max
  Peptide Sequence Number=SeqID_162419
atggcattgggtattgggcaaaagcatcaatggaacggggaaacaacagaggctagagagaaaactcagaaacatggaggcgatggagcagatgagatcatgagaaaactcagaaaagaaagaagggcttacctgcaaagggggaaacggaggcggcgacgtggaggttcgcttgcggcaaagagaagacgtgattttcgttttaggtaa

SEQ ID NO: 70735 - DNA, 390 bp, Glycine max
  Peptide Sequence Number=SeqID_162420
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcaccctgattctgtggataaccgtattaccgcctttgagtgagctgataccgctcgccgcagccgaacgaccgagcgcagcgagtcagtga

SEQ ID NO: 70736 - DNA, 561 bp, Glycine max
  Peptide Sequence Number=SeqID_162421
atggctcttaagaaactctccactaagaggtctagaagagacgccacaggagaaggatccagtgccgccccagagtttgatagtcattgtttctggagtgccgagcaccaacaccgcttcgaggccatcaggggatggtcgttccacagggagaggcgtgtccagctcagggaggatgagtatacagactttcaggaggagatagctcgtagacgttggacactgctagtgactcccatggccaagtttgaccccgagatatggattccctttgacgcagatgccctcagccagttcctgggcgatccgctagttttggaggaaggccagcagtgtgagttcagccagaggaggaacagggccgacggtttcgatgaggaagccattgcccagttgttgtgcatattggggcaggatttcgcccggaccgctgtagagaggcgggtgcagatcatgcgcaccagcataaccactttgacccagacatggatgacactgctgctcagcaatgtctttcctagcgatcacaactccgacctccctctgcctaagtgccagttg

SEQ ID NO: 70737 - DNA, 669 bp, Glycine max
  Peptide Sequence Number=SeqID_162422
atgcaggaaaattcatcactacagcgcgctctgacccatatcgccgacgatcaggcgcagattcttgacgatctgcaacgcatgctggcggtggatacctgcttcccgcccggactgggttacgccgaattcgccgacctgctgagcacgatgctgcagccgatgcagttttccctgcagcgcgtttcggtgcccgacgcactgtggcagacgccggacggcagcgcgcggggcgagcgggtgaatctgctggccgcgctggatgccggcgcgtctgaaaactgcaatctctactttcacaccgatacggttccggccggtgatggctggcgctttccgccgctggcgctcagcgtggcggaaaacaagctgttcggacgcggcgccgcggacatgaaaggcaccatcgtggccgcgctggctgcggtgcgggccgcgcagcgctatcagctcagcctgcgctataacccggtgtttttactctgtaccgatgaagagggcggcctttatcccggtattcgttatctggcggagcagcagttattccatggtcacctgctcagcttcaacggtggcgcggtgccgcgcatctgggcccggctgttttggcagtatcgatatcaaaatatcgtcagcggccgctcgcgcactccggcgatccgctgcagg

SEQ ID NO: 70738 - DNA, 468 bp, Glycine max
  Peptide Sequence Number=SeqID_162423
atggcgcctaccaggcaccctctggacccagataagtccaacagggccctgggatttcccgccttgatcacaggactctaccagtcgttcggagtccccgtcgcacctagcaaggtgattcggccacccatcacccgggcttttattgagaagtattgcacacagagacaggcccagggggatgctccgcaggctgcagacggcccagttggatcgtttgatacggagcagtatttgcggcatttgatgagcctcagcctgcagagccagggttttacttcctttccgtgccctactctgggccagttcagggcagaggtcgcatggcctggagattggcctgaggcccgggcaggagaggcaccttctgaggcaccagcagaggctcccgacgaggcagatgaggcccgcgatgacgaggagatggccgatttacttgatttcttaggagggagcggagccacatga

SEQ ID NO: 70739 - DNA, 459 bp, Glycine max
  Peptide Sequence Number=SeqID_162424
atggttgaatctcctcaagagcaagtgcagatggtggagatggttgtggggactgagctggagtggtctccttctctgttgttgctaatgatggtgctggtgctggtggctcctcaaagagctggaagtggtatctatgtgggtgctggaggaatcactgggatctctgtggacgaagagggaggaagtgtagaagaagcaggtgctggtgcctctgatggtgctgaagtggaaggggcctcagatctcttccctctggccttcctaggtcctctgaaagttattgctggatcatcaaaattccaacagttcttcttaatgtatgccgaattaatggcaggactcaggctctcatgggtcaaggaatcagagtggactccccaggatttacataaagcagtgattagggcaggaaagccaagcctcaaggagtcatattatgctatgagtgtaatctaa

SEQ ID NO: 70740 - DNA, 705 bp, Glycine max
  Peptide Sequence Number=SeqID_162425
atggactggaaaatctttttattgcgcgtcacggtcgcgctgattctgggcgcgctaattggcagcgagcgccagctgcgccagcgcctgaccgggctgcgcaccaatgcgctggtcagcaccggtgcctgtttgtttgtgctgatgacgcaaagcgtaccgggaattgccgcagatgcctcgcgcgtggcggcctatgtggtttccggcattggcttcctcggcggtggcgtcattatgcgcgatggcctgaatgtgcgcggtcttaacaccgctgccacgctgtggtgtaccgcggcgattggcgtgttatgcagcatgggcttgttgctggaggcaggcatcggttgcgtggttattctgtgcgccaacatcctgctgcgcgagctggcacagggcatcaatcggcaaagcatcattattgcggaggacgccagccagtattacaaagtgcagatcatctgtctggcggccgatgaggtgcaggtgcgcagcctgatgctgcatagccttggcggcagcggtctgcggctgcaatccctgcacagtgaggatctggaaccctcacaccgcatggcggtaaatgcggaagtgctgggtaaacccagcctgaccgatcagctggaaaatctggtcagccgcatcagcctggaaaaaggcgtcagctcggtcagatggcaggtgtgtgagccggagaccgattga

SEQ ID NO: 70741 - DNA, 1186 bp, Glycine max
  Peptide Sequence Number=SeqID_162426
atggctaactttgttattgttgatgatcatcccattgtgcgcgtggcgataagactggtgctggaaaatgccggacatcgtgtttcagcagaggctggcgacggcgacaatataattagcctggtcaaagaacagagcgccgatgcggcaattattgatattgatctgcccggcattggcggtattgaagcggttaagaaccttcgcaccgtcggatcgttaattccggtgattgtcatgagcgggaaaaacgcggaattttatgcttatgagagcaaaaaagccggtgccaatggctttatcagtaaaaagaacaatctcaatgatctggcccacgccgtcgacgcggtgctttccggctacggctattttccgctgcgcctgagtcatcaggcggagggcgatcagctagtccaggacagcgacaagctgctgctgctgtcgcaccgtgaatacgaagtgctgcgctacctcggtgaaggcaccgagatcgtcaaaatcgccaaccgcatgaagctcagcaataaaacgcagcttaattatcagcctaacgatttgccggcgatgcccgcgccgatgctcaatgacagcgactggcactggctggggcaaaagcgcgacagcgtgattggcatctatgggccggatcggccaccgatgttgcgcaccaatcctgagggaagagtgtttggctacattcccgatgcggcttacgctgcgctgcacagcctgggtatcagttttcgcgtcaaacattacgacaccgcgcccgaagcctttgccgcgctggcgcgcgaagagctggatatgatatttgtgccggccggtgaagcggtgccggcgcatgttaacgacaccattagcgtaaccgcgctgaaagccagtccggttcgggtggtgcgcagcagcagtaacccgctggccggtcaggagtttttacccggcccggcgataacctctccctacagccagctgccgcaggtcgcgatgggcacgctgccctatgccgatgtgccggcggtagaagcctattacctgattgaacgcaactacctgaatacgctgaccatcgatcacattctgcccgatctcagctcgccgtatcgctttgtggtcaacagcaaagaacacgtactggcgcgggcgatgcgcattgcgtttgatgccctgcagcgccacgcggccg

SEQ ID NO: 70742 - DNA, 390 bp, Glycine max
  Peptide Sequence Number=SeqID_162427
atgataaagttaagagcaatgctaagcattatatttgggatgacccctatttgtggaagttgtgcagtgactaggttcttaggagatgcattccagaccatgagattgactcagtcctacaattctgtcattctgtcgcaccaggtggccatcttggcatacagaggacatctcacaaggtgcttgactacggtttctattggcccaccatcttcaaggatgcgtggagaatctgtagcacttgtcagccttgtcagagagcaggcggctcactttcatggagatagcaaatgcctcaacaacccatgtttggagtccctagagccatcgttagtgatcaaggcacccatttttgtggtcaaagtggattggtccttttgtggtgactaa

SEQ ID NO: 70743 - DNA, 171 bp, Glycine max
  Peptide Sequence Number=SeqID_162428
atgtggtaccacatgtcagtgaaaaacctcgtcaggcacctaggagtacatgacaagacaaaccacacactaacaagtcaagtcactctcactagacttaaaggagcactcaaactaggtgacccccaaggcctacactccaaagagtccatcagggtctctccctcctga

SEQ ID NO: 70744 - DNA, 1657 bp, Glycine max
  Peptide Sequence Number=SeqID_162429
gtaccccaattactaccacaatggtcctgtttatgccaccatgatcagcatccttggaacatcagggagactcaatgagatgagggatgtgattgagcaaatgaaagaggattcatgtgaaagcaaagattctgtttttgtgtctgttatcaagacatatgtgaatgccgggctggtggatgaagcaatctctctgtataagagtattcctcggtttaactgtgtgaattggacagaatccttcaacaccatgttgcagataatggtcaaggagaaccggcttgaaattgcacaccggctttttgtggagagctcttgtggttgggaagtgaggtctttggttcgagcattgaacttgcttatgtatgctctttgtcaaaagagtcgctctgatctggcattgcaattattccaagagatggattatcaaagttgctaccctaatagggacaattatgcaattttgatgaagggattgtgccaagacaggaggttgcatgaggccacccatttgttgtattcaatgttttggaggatctcacagaaaggaaatggtgaggatattgtggtctatagaactcttttggatgctttatgtgatgctggaaaatttgaagaagctgaagaaattctggatggtaaagatatagaaaatgctaaacgcataattcacgaagctttgatcaagggctcagttcctagtttggctagttataatgccatggttgttgatctgtacagcgagggtaagatagatgaagctgataaagtcatcattgaaatgcaagtcagaggctttaaaccaacacattctatctttgaggcaaaagtagctgcattgtgcaaggttagtaaagtggatgaagcaatcaaggtaattgaggaggacatggtgaaagtcaattgtctacccactgctaaaatgtacaatattctcttgaaaaacctatgcaatgttggaaattccacaaccatactcgagagcttgaacaagatgtctagcaaggtcggttgcacaggcgacagagatactcacagcattttgctggaaatgctttgtggtgagagaaggcaatatgaagcagttatgtggttggagaacatgataagtcaggggaagcttcttgaaatttctgtctggaattcattggcatctttattttgtaactcagaaaagataaaagtgtcctctgagacatttagtcgcctaagaaggaagactttaattgtatctggtttagctgaatcaaagaaagaacatggagttgaactacttaataagctggaagctgagcatattggagctaaaactgagtacgattttggaagggtgagagtttacggtgaaagatcacttggaaacaataggagggcacgtttcaatgcattatatcaagttccagaattttgtgacatcaacaaaattaaggggaagtttgatggcaaaactgtcatcattacaattccaacgattccggggaaagtccctaagaaagaaacacaaccaactgaacaagaaccacccaaagaaccatcacaagaaacagaatcaaatccagaggaagaaaaagaaggtactcctccttcatatgataatcaagaaagtaaagaagaggctggccatgcgacttcaacttcaaacccaccaaatatttga

SEQ ID NO: 70745 - DNA, 615 bp, Glycine max
  Peptide Sequence Number=SeqID_162430
atgacaaggaaggagatacaagagggaaggatgatggaaaagatcctggaatcctccaaaatggaagatatgctcaccctccttgagaaggggttcgttgctggtggaccaataagtaatgcccaaaaaaggtatgctagagagatttcgagagataaagatttggatggattctcgagtcatgccataactccctttggttatctgaagttaagagttactttcagaaaatatcctttggcaaaggctatcatgagaaaagctagacaatgctacaagaattctcttaaggtgatgacatataaaaaaaagtcacgagaggtaccttcacccgagaagttggtcccaatacctgggaaaaaagagatattggtggcagtactagactatggagtggaggaacatgataataaatttgacagaccaattctagaaggagagctcatccaagtgaaaaacaggctggaggaaataaaggttgtcaaagtaggatttaagttgccaacacctattcttgacaagttatcctgttttggggcagataatgcatgcatttttgcgtggacccctgcatatattgtagaagcaagcttcatgatgatgaatcaagtataa

SEQ ID NO: 70746 - DNA, 421 bp, Glycine max
  Peptide Sequence Number=SeqID_162431
atgcctgaaccatcaaagaagcgcaagggttcttcgagtcgaagccaacgacattccgaggctcaagaaacgcagattccctcctccatttcctcttcctcattgttctcatcagaagaacaacggatacggtacacaaatcttttctcttcttgttccattatagatccaaaattcattgacatggatttcttttccaatgagagttttgaatgcattcaggcatttcagaactcaaacctcattcctttcatgtctttaaaattgcctgtttattctgaattagttaaagctttctatactaatgtcaaaattcaagaaagcactttgatctctgaggtttatgggataaaaatggtcattgaccaatcccttttctatgacttgacccaattatctagtgaaggtgtaccatttgaag

SEQ ID NO: 70747 - DNA, 258 bp, Glycine max
  Peptide Sequence Number=SeqID_162432
atgggtgagattaactttgttgggggagaaaacaattcttacaatcaataccctaacaatttcaatcaaggacaaggcttcaggcaaagtcaagggatgtataggccccaaaccatgcaaaatcagaggcctagacaagaggagagacaacctactcttcaagagaccatgcttcaatatatggccaagaatgatcagagaatgaagctggtggagtctcaactcaccaacattcaatccctcttgtcacaaagatag

SEQ ID NO: 70748 - DNA, 315 bp, Glycine max
  Peptide Sequence Number=SeqID_162433
atggctgagtgtcctgtagtcaagaatggtcaaacatatgagaggcaatccatccaaaagtggcttgatcatgggttgaatgtttgtccaaaaactcatcagagacttactcttacaaatgtcattcctaattacactgtcaaatctcatgttattagattgattgaagaccttcacaggtggaacttggagatgtcaagtatgttagagggatctatacagatcatgtcaaaggccgagaccgggactaccatgtttttagtatggacttcatattgtcccattgccgttgcagaacctttgtgtgacttgtga

SEQ ID NO: 70749 - DNA, 630 bp, Glycine max
  Peptide Sequence Number=SeqID_162434
atggaggtgcatcatcgcggtggttcattcgtagttcgtgattatcgtcatggtgggtgttgcggtgcaacgacagaggaggtgttatggacgaagataggtggatacatgcataacataatgtctcaagaaattaatatgaatgaagacaatggagaggaacctgttgtgtttaaaaatattgatggttctgatgccttcaatacttctcaggtgtttgttacccatgatgacgttttgcattgggctcgctctcttgcgtatgatattggttttgtggtggtgataatgaggttagccacaaatactggaaagagaggaatgacctcatatgttttaattggttatgagaaaagtggaaaatatagtagtagaaaatgtgggtgttcgtttaagctgcgagtgaaaccagtgttgggaggtgaaaggtggatggtgaagttaatatgtgagaatcataatcattcattggctaagtcattcattgaacatccatatgttggtcaactgattgaggatgagaatattattattggtgatatgacaaagtcaatggtcaaatcaaagaatattcttttcactttgaaggaacacaatgccaacaatgaaagacgaagatgttgtacgtga

SEQ ID NO: 70750 - DNA, 775 bp, Glycine max
  Peptide Sequence Number=SeqID_162435
atgggttgcaccaatctaaaggaattcgcgccacgtggcacaattagattcgacatcattgtgtggatttggtttgccgctgatcaattcttggccatgctccacgacagtgacttgcatttagtgcatggcggcgacgagggaggagagcgccttctaggcgcggtggacctggcaatcaccgaggggcgtttgtttgagggccacgacggtgatctcagcgaggcgttgaagattcttgatggcgtcgtggccaagggtaacgacattacaaacatcgagggacttgatgaggcggtaaagaagctagttcatgacaggaggattcgctttggtacatggaatataggcacacttactggaaaatctatggaaatagtggatgttatggtgaggaggaagatcaattttatgtgcctacaagaaactaagtggacaggtgaaaaagcgaaagaattagacaacttgggatttaagctgtggtatacgggaaaaatcagattaagaaatggggtagggattattgtggacaaggagtggaagaaggatgtcgtggatgacacctttaatgttattagtgggtacgcacctcaggttgggttagcagaacactttaaggtaaaattttgggaggatttagaaggggtacttcaggatataccccaaggagagaaagttttcctaggaggggatctcaatggacatgtaggtagcgtggctagaggttttgagggggtgcatgggggttttggcctaggggagatgaatggggagg

SEQ ID NO: 70751 - DNA, 351 bp, Glycine max
  Peptide Sequence Number=SeqID_162436
atggtgcctcgacttcacttttttcttcttttcttcttcttcctgcgtttttccttctgttcctcagagaatcagcccttgaaacccttcccctacatgactatttgtaggaaaaggccatttgtcgaaggcatcaactcacccaggcgagctggttgcttaaggctgaaggtatttcatggcataggcgagccagatgctagcctgggcgagctagggtccagaaatttccagaaaatgaccattttccccctttccttgtggtttttcttcccgggtctaacaatcaaacatcaatttgagcgatccctcgaccttgcgctacaaccggtgccaaacaccgtaatttag

SEQ ID NO: 70752 - DNA, 145 bp, Glycine max
  Peptide Sequence Number=SeqID_162437
atggtggatacattgccaatgttctactatgagaagatggtaggttacatgccttcaagttttgcagatttagtgtttgctggcgagaggatcgaagtgggtctgagaagagggaaatttgattatgcttctactacgacttctg

SEQ ID NO: 70753 - DNA, 504 bp, Glycine max
  Peptide Sequence Number=SeqID_162438
atgaatgatacccactctccttggcttgccaaggtttccgccttctcctctaggcacttcctcggtattcccgctactccattcctactttgcttcactcaatctaattctcattccgagatcttgactattcctgctactctcgccatagaaagaaagaaatgtataaccccaacatggtttgtttataatcatttccatgatacccaacacatgcaactaagaacgcggtgcaaactttcacgcttcattgaggctttgatggcaaagaaaagaacaaaaagcatgagcaaatatatggcaggagtatgcatgagtgaacataacatgcaactgatgacaacagaggggaaacaaaacacgggactaccagcgatagtgcatcaccaaaagaagaaaacactagatgaggcttcactgttatcaagcgagttggagacccagcatgaccacagatcaacctccagtccctatggctcacatagacccgggcatagggcctaa

SEQ ID NO: 70754 - DNA, 542 bp, Glycine max
  Peptide Sequence Number=SeqID_162439
ggctgaaaggtttgctgaaaaaggcgataggatgccctttctatgacaaaaccacacccatgccaacgccagatgcatctgtttccatggtgaaagggagggtgaaatccaacaagagtagtgtcaaaggaatcttttgtcatcggcctgctcaaaggtgtcgtgatggacgcgtacccgtaaataaactgatgataaaattcggtgaggccctagaagattacggtatgggtgacaactggatagcttggactttcaccaaaacgggttcaactcctttaacagagactaagtggccaagatactcgacttgtgacctttctacaacatcgattcaacctaggcttcaatttcatgtttctgaaaatgcgggtaaagatatgggtgaacatttacaggctcagagttgggaagaagatgaatatggtgattgggtagtttgggttgaaaggagttatgtgggaataatgcaaatatggaagaattcactagcaccagccttgtggactagacgacgaagttatggtggagtgatgaagtga

SEQ ID NO: 70755 - DNA, 219 bp, Glycine max
  Peptide Sequence Number=SeqID_162440
atgatgacaaaggtgatgacaaaaagctcaaagatcaatcaaagaacaactcaagtgattaagatagaatcaagaacaattcaagactcaagaagaaagttaaagagtcaagaatcaagattcaaggttcaagatcccaagaatcaagatcaagattcaagaatcaagagaaggcttaatcaagataagtatgaaaaggttttcccaaaaattgagtag

SEQ ID NO: 70756 - DNA, 210 bp, Glycine max
  Peptide Sequence Number=SeqID_162441
atgcagaaatccgaagacttatatataagacaggctgaagtcttttgcggagaggtgctcgtagaagacgtcgtaactagccagcatgcggagaagccactggaggttctcgacatcgtcgtcgttgccgggaaggatgcaggggaggatctcgacagcggagagagggttgttggcgccgccttgccagaggacgtcggcgatgtttag

SEQ ID NO: 70757 - DNA, 306 bp, Glycine max
  Peptide Sequence Number=SeqID_162442
atggcatcttcgtcgtcatgcccctcaagtatacaaactaggtctggtccacttgatggtgacgtgttgtggatgcaacccaagcatgtttcagaacatgtttggaatggggaaccagacaggaaactacacatcagacgagcagtcccgacgtatcaaggtgaagaacaaatcccagaggaaattgttcctttgcttcggcaatgtgggttttattggatcatgaagatgggatacctaaagataaatgcggccttaattactgcgttcaaagatggaggcccgaaactcacacgtttcacctga

SEQ ID NO: 70758 - DNA, 915 bp, Glycine max
  Peptide Sequence Number=SeqID_162443
atgtccagtgtaggagtaatcccagcgagtactgagtatggccaaaggagtgatgacaggttggttatccttgtccgcgacaggactgtaataacatttggcaagcttagagtatggtgccccggtaacagagacttaacggtgaggtcgcagcttaaccataacccagcctccagttgcaaaatttacttcccggtgatggttatcggcaaaatgaacccgctatgtattgaagaaacgttggcggcttctttccaaaggttacctcaaacagtgaggttccagtgcttgaatttcgtgaggatcctaatcgaagaccaagcttttaggcataccatggtgttttgcaatgatgtccaggaagagaggtgtaacagtataggcggaataccaacgatgaagtctaagaacaaatcctcccaaggcttggcgggaattggtaatggatctagtaatcctacgaattttttaggctcatacttggtcaatgcatgcaagagtttgggacaaaactgcttgctgaagaaagcaatggggtggcccttttgcgacaagactgctctcatccctactcctgaagcatcgatctccaaggtgaaaggacattctcttgaactggttctatacctagttccaacaccacatgacctaaatactcaatctagcgttgagcaaaagagcatttggataactaaaggaaaaactagtcgttctatagcaactagaatgtttgttcaagatgaattcacacagaaacgtcatgatccatcacctttcctaaccaaaaagacaggggatgagaatggactggaagttgatagcatgattagtgttgcgaggtggggggaactcaacgggcatgactcgaatgtggaagaaggcattcgccccatcggtcctggccaatcgtcatag

SEQ ID NO: 70759 - DNA, 489 bp, Glycine max
  Peptide Sequence Number=SeqID_162444
atgtctctcagcacaaactcatcatcatcagtgattaagagaaaaaatttagaagaacatcgatggcctcgactaaatttctcatcgcaattgaagcagagtccattttcatggtgcgcagctaattcctctttcaacaggccaagggtggaggtggcagcaagggtggaggtggggttggttgggatctaccctaaaggatttaccatcaaagtgcagtactttgagtttcatgcgatacgggtttacaggcagggaaagggagggtgggttcgtcgtggaagaagaagaaaaggaatgttggtttgtttccaggaaagccattttctggttggtatcgtcgagtttagtggacattgtgttttgtgtggcagtgagattgagttaggtggaggtgagtttggctatgacgtcttcaaggcgatccatgttggacttggagcgcatcgattcgaccactggagctcaatgaaagcaccaaattgttag

SEQ ID NO: 70760 - DNA, 555 bp, Glycine max
  Peptide Sequence Number=SeqID_162445
atgacccaagaactgggagcccgcggaaacaccttacggttatccgcacctcgtcattcagtgaccccaagtgtgattgatgagcaaaggctaatgtggtcatctgcgccctttccggagatgtcggcatcttccggtggagactttttcaagtctcacaagatacgtaggagcaagaacattgcttttgtcggccgccccacaaaatctgtcatactgaccctgaggtcatgtgacatgcggagacaaaatttggtcattccgcacccctttgccattcagacacagtcgtgtccgatggcacgcagagacaaaatttggtcattctgcacccttgtgtcatccagaagcggcgggctcgatgacacgcggagacaccttacggttatccacacccttttgtcatctaaaggcggcgggctcgatgacacgcggagacaccttacggttatccggacccttttgtcatccagaggcggcgggcccgatgacacgcagagaccaaatttggtcattctggacccttgtgtcatccagaggcggtgggcccgatga

SEQ ID NO: 70761 - DNA, 332 bp, Glycine max
  Peptide Sequence Number=SeqID_162446
atggttaggaccagaagattaggtcgtgccttaggtcacgttactggcagaggtgtgggccgaggagatcgtgatgattccgatgatgcttcgcagcgtcgaaggcctaccgcattcgtacggaggcagcgagccactgtgattgcggcgcacgatgagccagtggtccctgcgccagatgttggggctgatgtattttcgaatgacccgatggtaccagctgatgtagaggacattgtggtagacattcctgcgaacacaggcgcggaggctgctgaggatgagcatgagagatttctgggtggtccgagcgacccatccgtgttgaccca

SEQ ID NO: 70762 - DNA, 303 bp, Glycine max
  Peptide Sequence Number=SeqID_162447
atgcaactaagacataatgtggttaagcatctgctaaaagatagaacaatatccatagattatgtgaagtcagaaggaaacttagtagatcctttgacaaaacccttagggaggaatatgatattagaaacattgaggggaatgagactcaagccacttgaaaacaaacaagatgcgcttgatgaaatcacctatatgagtgttaagtggagccgcttgcatgagatcttgaccactatcacacgccaagtgtctttgggatctgtgactgtcacgtctcaggaagttcaaccacgttcatga

SEQ ID NO: 70763 - DNA, 1512 bp, Glycine max
  Peptide Sequence Number=SeqID_162448
atgggaggcatcgttgaggatcatcgtagaagatccagtagcagcaagctaaattctaatttagataagtcacatgatgatcctgatatttggactaaaaaacgtgggaagcctcctcaggagaaaaaagagaaaattgatagaaaggatattccaccaagtgaaaaactatttctggaaaatgttgcgtcgttggccggttcagcattggttaagcctaatggtgataacctggatatggcttgggaatggaattccctaaaagacataagcaataaacgggctgtaacttgtgatttttgtctaaagaccacaaatggtggtataaccagagctaaaaaacatcagatagggttggaaggagacgttagtgcttgcaaaaagatcccaccttcaattaagctcaagattaagcaagcttatgaaaaaaagaaggctgtgaaatttgggctggaagaagaaaatgatgatgatgaggtggaagccacagaagaaattaacctaagagctggaaaaagacgtgccaagggaagtattacgcaaggctctatacatggacatatgaatacgctgaaaattattgaactatcaaacaaactcactcttggaatggccaagaggaaaacatgtataagggatgctagtattaaaaaagcaagggctaaagctaatcgatgcattgcccaattcatccgtgagaatgaaattcctttcgaggttgcatgctctaaaggctttaagatgatgattgaagctgttggagattacggtcaacaattgaatcctccaagctaccataagttgagggctcctctgctaaaagaacaatcagagcttacaaaggaaaaacacaagccacatgagatagagcaaactcagtatggagaggcgattgaagatgaaccggttgttgagccgttgaggttgacttgtggagttgttgatgatgcaattaagcttggtgagccatctagactcactattgaagctcccattgaagaggaaaaggaggaggcgaaacaagaagagaacccgaagcccaagcccgagatcaataagagtggggatagggaatttgagttggttgttcagagagaaaatattagtggaggacataataggagtagcggcaataacagtggtggtgataatggtgatgtctgtggtggtgacgacaataatgagagtgaaataatgatggcaacgattgtggcgatggtggaatgtcgagttgcttatcggatcgatcatgtattgaacttggggcaacttggtcgggtcacgcccaagggagaaaaatatgttgggtcatgtggatcaattaagacaaatgatggtagtgacgataatagtggtggaatagtggtggcggtaacaacaatggtgtgtggtggtggtggtggtggtggtggtaggggtaagggtagggacaatgatggttgtggtatggtaatggtgaaggacacaatggaaattgcacacaatgaccgagtgtaccaacaattgtgctag

SEQ ID NO: 70764 - DNA, 438 bp, Glycine max
  Peptide Sequence Number=SeqID_162449
atgggctctataacacagatccaggggtcgtgtctggataatgtcccagtgcatgtaatttcaatggagactgtgttgatggaaggctcgggagctactcaggatggtggagaaagatcaccaagggggtgtgaaaaaatcaattctttgaaagaaaccaatggtcaaggacaaattgatcttcctgagagtgctaagttcttggtggttacacacagcacagctccaaaaacaaatctgcaggtcgtgcctatgatggttaagggtgaaagtggcgacaatgttgcattgtatgactctgaattgttgtctctggaaatggggtgggatttgatggaaagttgttcctctggtggaaagcttagggttccattggtgaagcctgatgatgactctatggatgcaaagtttgttgctttggtcttcaaatctatatag

SEQ ID NO: 70765 - DNA, 894 bp, Glycine max
  Peptide Sequence Number=SeqID_162450
atgaggagttcttcgagcctgtcagaagttgaagaactggcattatcaggcatgcttcttcttccttatcagatatggaaccttgccggtgagagagttcacgggaatcgtggtgggagccactgtcatgctcaacatacacatagcgagatgataacaaaagatgatgacaaaggtgatgacaaaaagctcaaaggtcaatcaaagaatgagttcaagatattcaagaaagaatcaagaacacttcaagattcaagaggaaagttgatttcaagaatcaagaatcaagattcaagagatcaagcagttatttctggcaatgatgctctctgccatatctcactcaatttttgtccaaatcactccccacaaagcccaaacttcttctttttccactctctttcatttgaaccgattgaaatctcgaaaaatcccttcaaatggctgaaccttcaaagaagtgaaagggcacttcaagtcggagtcaacgactttccgggtcacaggaaatgccaattccttcctccattccctctggatcattgttttcatcagaggaacaacatatacgaaatccatgaaggtaccctaatgtctgaggtttatgggattaagatggtcattgaccagtccctattttatgatttaacccaatttccaagcgaaggtgtaccatttgaaggacatgatggagaggattcatctttcctttcaaagattttagacagatttgatggtcttcaaacctttgttggtgaaaggtttgacaatttggaattacaagttgatatgcgcttcaatgaaatggagtcaagaatcacaaaggttgaagaagatgtgtcttacattcgttcaagcttcgatcttccaccactgccaccaccatcatcttag

SEQ ID NO: 70766 - DNA, 861 bp, Glycine max
  Peptide Sequence Number=SeqID_162451
atggatataatgaaaaaagagttgaaggaagcgatcaaaatagagttatcccaaatggcctcgcaacactcacccccagtagacgcgcctgaccctgacgtattggctgcacgtgtaagcaccaaaggaagctgtgctgaagctactggaaatgttgtagctgaggagccttctgttgttgatgtcactagtatggggttgtacatagctggtgaggattgtacacggttagtttccttgggaaaggtgtttgatagtgccaccatgatacacaatgtcccttacacaaatgatgtggttcaggtcagtgtattaactgtttatgatggtggcgcgagggtcccatttcccacttcagagattcagtatgtgagggaggccaccaacacattcattggatggcagacacatcttatgaaacctatctctgatgattcagaccataatgtgccaaaaccgatgggacatgttgatgggtgcactgcaggtgacaagtgtttgaacatatctatactgcagttgtggatgatgtttatggatggctgcggtagaagcagaggtcatggtttagtgtatggtttccttgagccgcagtctatacacaatgctaaggatagatgtcaacattacattgaaacatgggtgaaggagtcgcaacgacaactgtacttaggagcttacttgaattatgcaatgaagataataactagtactttcgaaggtatgtctgatcaagcagcacctcggtggattgaaccaaagtggttttttgatggaacagcgttagacgtggaggccatcactacacttcgcaagaaatgggcatcatactttttagctattaaaaatatgggatgttaa

SEQ ID NO: 70767 - DNA, 783 bp, Glycine max
  Peptide Sequence Number=SeqID_162452
atggatcaccaacaggtctcacaagcgcatctatatgtactaaacaacacaatagaggttatcgcatacatagatgctcacaaagaaagtgccacagctacacacccaaacatgaatatgatgaggggatatgatatcaacaactattccttctacacaaagtcacaggatgataaaagtaccgtgcaaaacagtgggaaatctgtgagcttggttatggtaaatttagagtgtctgtcttcaagtgccagtgggttaatggaaatatcggtgtttgtcaagacaaaatggggtatcccttacaatattgatgcttcaactcttgatgttaatgagatgtcgacgccccatggcaacacccccgagttcccctccaccttcaaatgctccaagcgcaactacaaaaaggaagatagacaaactacccaactcagaagattgactggcagaagcttggatcaaccgcgacctactgtcaatgtcaaccctattactggattaattgccaagaagaaggtcatgtcaacggttgccacgagatggaggcaatttaagtcctcccttaccactaaatatgtatatgctgacaaagatggtgaagataatcatgatccatctgctaagtatggtttggatccagagacttgggaacaatttgcaaagagccgacaaaccccaaattggcagggaataaggaaaaaagctcaagagattcaaaaattcaatgattgcccccatttactgtcccatggggggtacaatcttctagaaaatgaagactaa

SEQ ID NO: 70768 - DNA, 285 bp, Glycine max
  Peptide Sequence Number=SeqID_162453
atgcaaacgccgctaagagctttggcacctctccgttggaggattgggttggcgcagtcgatgatgaggaggagtcgccaatctagatggtggggtgtcgcatttgctaggagaaggacagtgtttccaacttggagacgcctggcgcctatagcagtagtcttaagaaagtgtgtccaccattggtgtgatgagaaaggagacataacttgtgagatatgtctatcagagtcttggatgcccaggtatagatggggtgtacctagatggggactaggaaggtag

SEQ ID NO: 70769 - DNA, 990 bp, Glycine max
  Peptide Sequence Number=SeqID_162454
atggggttctgcgttgtgctcgctaatatctgcgcagaaatgctgttcgtcgacattgatatttccatgacgcaacttccgcaatttacccgcgaactccttcatccacgctactggctgacctggctgggcatcggtttcctctatgtactggtgctgttgccctacccgctgctgtacgtgactggctgcgggctgggacgccttgccatgcgttttatgaagcgtcgtgttcaggtcgcgcaacgcaatctggcgctgtgcttcccggatatgccgaccagcgaacgtgaagccatggtgaagcacaatttcgaatcggtgggaatggggctgattgagaccggcatggcgtggttctggccggactggcgtattcgtaaatgggtcagcaccagcggcctggagcacgttaccgaggcgctggcccaaaagcgcggcatcctgctgattggcatgcacttcctgacgctggagttgggtgcgcgcgtatttggcatgtacaacccgggcattggcgtgtatcgccctaacgacaacaagttactggactggctgcaaacctggggacgcatgcgttccaataaaagcatgctggatcgcaaagatctgaaaggcatgatccgcgccatgaagaacaacgacatcatctggtatgcgcccgatcacgactacggcccgcgcagcagtgtattcgccccgttctttgccgttcaggaagccgcgaccaccaccggcacgcatatgctgattcgtctggctaatccgagcgtggtgccgtttctggcacgccgcctgccgcacggccgcggctacgaactgaaaatgatgccggatatccgccacaaattttcactggagagtgaactggataccgctatcgtgatgaataaagtggtggaagagacggtgctgctggcgcctgagcagtatatgtggctgcatcgccgctttaaaacccgccctgaagggcagccttcacgctattaa

SEQ ID NO: 70770 - DNA, 486 bp, Glycine max
  Peptide Sequence Number=SeqID_162455
atggggcgtgaggtcaaaggagaacggtttattctgcgcaaattcgctggccagttcacccagcacgctggcgaatttaaacccgtggccgctcaggccggtgataatcagtcggtcaggctcgccgggcagggtatcgataataaaatcttcatccggcgtgttgtcatagctgcaggcttcaccatgcaggcacacgcctacgcctggcagaaactggcgcaggaagctaaaggcttcgttaccgtcagcggcgatgctgccgaacggtttgcggtctgctggcgtctgcatcggctgaccgccatcgtggcgtcccactttcagggcattattgtctgccgggaagccgtagaaatggctgccatccggcatctctaccgtaaagccggggaactggttattttcgctgtagcgcccatcggcctgataccaggcaaacaccttgcgcacggcgtacgggcagattgtccaccagctgactga

SEQ ID NO: 70771 - DNA, 597 bp, Glycine max
  Peptide Sequence Number=SeqID_162456
atgatgtttggctatcgctctgctggcccgcgcgtgcggcttaccaccgatcgtctggtggtgcgtttagtacatgaacgcgatgcctggcgtctggcggattactacgccgaaaaccgcgcctttcttaaaccctgggaaccggtgcgcgatgagagccactgttatccttccggctggcaggcgcgtctgggtttaattgccgacatgcataaacagggctccgcgttctattttgtgctgatggacccggaagagcatgaagtgcgcggcgtcgccaacttcagcaatgtgctgcgcggatcgtttcatgcctgctatctcggctactcgctgggagagaagtggcaggggcagggcatgatgtttgaggcgctgcaggcggcgattcgctacatgcaacgccagcagcgcattcatcgcatcatggccaactatatgccgcacaatcagcgcagcggtgatttgctggcgcgcctcggctttgaaaaagagggctacgccaaagactatttactgattgatggccgctggcaggatcatgtgctgacggcgcttacctggcgcgaatggaacccggatcgtcgcggacaataa

SEQ ID NO: 70772 - DNA, 345 bp, Glycine max
  Peptide Sequence Number=SeqID_162457
atggaagacctttttaagaggtggattgatcatcttgacagcacacgatcaaggaattcatggcataccatgctagctctaaagccgatcaaaactcagtgcaaaatcaggaaattcaatttggcaagagctattccatggaaaattatcaagggggataggagttacaaccttacaatcaaaataaagaagaaagaggttgataagctggcagaagaagtgactaaagttatggccaggagagaagaaaactttgtagaggttgaagctcaagtggaaagccctataaaagagcatgattcaagagaaaaagatgaagaggaaattgaggaggaagcacaataa

SEQ ID NO: 70773 - DNA, 144 bp, Glycine max
  Peptide Sequence Number=SeqID_162458
atgtctataggtggagctgatattgaggaggaagaaccaatagatttgaggtcaaatcctcttcaagggggaggggatgatacaatcctccctaggaaaggaccaatcaccagagccatgagcaagaggctccaagaggattag

SEQ ID NO: 70774 - DNA, 363 bp, Glycine max
  Peptide Sequence Number=SeqID_162459
atgtcgtcatctgcacctttgtcatccagagacggtgagtccgatgacatgtggagataccttatggttatccacaccttttgtcagccagatgcaagcgagcccgttgacacgcagagactaacatcgtcatctgcacctttgtcatccagagacggcgagtctgatgacatacggagataccttatggttatccgcaccttttgtcagctagaggcaagcgagcctattgacacgcagagactaatgtcttcatctgcacctttgtcatccagagatggcgagcccgatgacatgcaaagataccttatggttatccgtgccttttgtcagccagaggcaagcgagcccgttgacacatag

SEQ ID NO: 70775 - DNA, 276 bp, Glycine max
  Peptide Sequence Number=SeqID_162460
atgtcgacaaacaattgtcccgagacgaaattaggatatgatgtggaagcaaagcttcatgatgaatcaacaatgattcaaagcccaagtgaatcaaagaacatccatctcaagagaatcaagaacaagttaagagttcaagaatcaagaagaattcaagactcaagaagaaatcctacaatcaagaatcaagattcaagattcaagatctcaagaatcaagatcaagattcaagactcaagattcaagaatgaagaaaagactcaatcaagataa

SEQ ID NO: 70776 - DNA, 411 bp, Glycine max
  Peptide Sequence Number=SeqID_162461
gatccccagcagaacgatattcccaacaaatgatggagtgtggtcatggaatgtattacatgccagcaacattttccgaatatccttcacagatgtatcagtatccttttgcaggtcatcatactgatacttctgagacctcacattcgttcggtggtgttgtggaaacacagcctcatttttcatggcccactatgactccttcacagcagcacgatgcccccatggcaacacctaacgccccatttgctccgcaatggaatgtacccggagcaatacctgatatgggcaacttattaggtgttgatttgcgtcaggagttttctacagaggttgagcaagcagaagcggggagacaacgcagcggaaaaagaaatcctgatcgtcaagcgcgaagatgggatcaaccat

SEQ ID NO: 70777 - DNA, 459 bp, Glycine max
  Peptide Sequence Number=SeqID_162462
atggcatattcttcttccggagcttctcaaataaaatatgtttttcttcttctttgtgatctcttgcttgtctcgggattgacgggtgaaatatcagtgcaaatatcagataatattcctcgaataaagtatgatgtttttgttagcttcaggggcgaggacatccgtcaaggttttcttggttatttgacagaggcttttcatcaaaagcagatacatgccttcatagatgataaacttgagaagggagatgaaatatggccatcacttgttggagcaattcaaggatcattgatttccttgaccatattctctgaaaactactcctcttcgcgttggtgtctagaagaacttgtgaaaataattgagtgcagggagacatatggacaaactatgtacgacatcaaaaggggagttatgaaaaagctcttgctgaacatgaaaagaaatataatttga

SEQ ID NO: 70778 - DNA, 474 bp, Glycine max
  Peptide Sequence Number=SeqID_162463
atggggatgagaggttgcatcagctacaatcccgttcttgctataagacaacttggctaccctatgagaggggtgccactagaggatgagctcgcgcctgtcatttcacgaggcttcaataagaccaacgtggagacacttcagaaggacaaggaactcaggggcagtaacaatgggcccatcggtggctatcataagtggttaaaagcccacgtgcaaggtttggattggcttccaagtttgagaaccgctaaaagagaggaagttgaggcatcggaggaagacaaagaagtgcaggcccttagggcggaactcgagcaagcccaaacaattaaagaaaggttcaaatcagcggctctgaaaatccgaaaggagaatactgaactgagagatgtaaatgtggctaccaccaaagccttggaacaagaaaccaagagggcttgtagggaagaacatggccgaaacaaattctga

SEQ ID NO: 70779 - DNA, 96 bp, Glycine max
  Peptide Sequence Number=SeqID_162464
atggaggagaaggctggatctttgagcttcaatgaggtccttcaatggtggctttccaccatggagatgcagcggaagataaaggacaagagatga

SEQ ID NO: 70780 - DNA, 330 bp, Glycine max
  Peptide Sequence Number=SeqID_162465
atgacaaagaagaaaattcttcagattgttggcgagaggtggcggcagtttaaatcggacttgactaggaaatgggcccttgcagccgaccaggacagtgtggacgacacagtttgtgaaaaatacgacattagcaaggagaaatgggcccagttttgtcagacacgcagagacccttcttgggaggatgtgcggaaaaagacacaggccatccaaaagcaaaacactgccccccacaataccaaaaacaagctggaggaaactgcccagtctggaagcactgagggcatcattgaccctccatctcccatcagacgccacgtgaagtga

SEQ ID NO: 70781 - DNA, 306 bp, Glycine max
  Peptide Sequence Number=SeqID_162466
atgaagggtaggatgtcaacgtttagctttgaaatgaacattcaagggaaacgtcgggtcaaactgaaactgggaataaaatcactcgtgttgtataaaaactcacagagttttagcattcattattcgctcgcccttgaggagattctgatgtcctcttcttcggggggagggatgaggattctcttcatgggccaaggttcaagggtgtcggtttcgggttacactcccatattatttccacgaggcgcgcgtaacaatgatgatttggaaacaacgcgcaaaattagtcatgcatacagctag

SEQ ID NO: 70782 - DNA, 219 bp, Glycine max
  Peptide Sequence Number=SeqID_162467
atgatgggaagaatcaaaagaattctcaaactgtgtcgttttgaattctttgacaagggagaagggagacacaaaagaattcaggcgaaaaccagaaaacttcagaaagcttttggtacaaaagaagaagaagaagaacttcaaagagatttcaaggcttgtaaaggattgattggaaaagcaaaagtattcaagattgttgttggaaagaatgattaa

SEQ ID NO: 70783 - DNA, 997 bp, Glycine max
  Peptide Sequence Number=SeqID_162468
atgggatcgagtcaggcgcctttgcttaaaaagaggttctatcaagtcaaggtcaagagcctaggagtcaccagtatgaaagagttagggcagttgatgggtcagctccatcaacaagcctttcacaaagcttacggggcaccactagaggaagacctcacacctattattgcacgaggtttcaatagcaccaacgcggaggcacttcagaaggtccgcaaggcatgggagatggtgcaaaagaaggacaaggaattcagaggcagtagcaacgggcccattggtggctaccataggtggttgaaagcctacatgcaaggtctggattggctcccgaatttgagaaccactaagggggtggaagttgaagctccggaggaggacgaagaggtgcaggccctcaggacagaactcgagaaagcccaaactgtcaaagaaaagttcaaatcaacagctcttaggatccgaaaggagaatgtcaaactgagagacataaatatagccaccaccaaggccttggaacaagagaccaaaagggcctgtagggaagaacatgaccgaaacaaattccgaggggctttgtggggcagtaacagcgagcttaagctttggagagagaaaagggaccaaacacgagtagacagtttgatcttgaaagatgaattgaggatttgcctaaggtccaacagaagcttgtctcagcggttatgtgagaccgagaccaacatgttagccatcatcagcaaataccaagaagaattaaatatagccacggcccacgagcacaaagtggcggacgaatatgctcgagtgtacgtggaaaaggaggctagaggaagggtgattgactcgttacatcaagaggcaacgatgtggatggaccaatttgctcttactttgaacgggagtcaagaacttccccgattactggccaagtccaaagcaatggcggacgcctactccgcccccgaggagatccacggactcctcagctatt

SEQ ID NO: 70784 - DNA, 384 bp, Glycine max
  Peptide Sequence Number=SeqID_162469
atggtacaagtagagggtacatctacttgggttgttgtgactgaggacaagagagggtacatctcttgtggatcagttctagtggatggtacatccactaggttgttcaaagagaacaagggagggtacatcccttgtggatctttgcttgcctcccgatgttgcaaccttctccacctccaactgaagctaggccaatcttcatctgatgttaatgcacctaaaccatctccagtacttgcatccacattatctctatcctccgttgatgcacgtggactatccccagtacctacatccacaccttccccatctccgcctgtgggcaatttgcctatagatgaagatgttgtaaatttggcaatggaagaccccccctcttaa

SEQ ID NO: 70785 - DNA, 849 bp, Glycine max
  Peptide Sequence Number=SeqID_162470
tctgttacgtccggaagaagtggtgctggacgcagaagaaaaacgcgagctttaaaggatcctgcgggcagggaagcccggttcatctctgcggaggatcgtgataaacttgcccggttttctgcccgctcatccgttgaggtacttctgaacacgccggcacagctttcactgccactctatctacccgatgatgaaacctttgccagtttctggccgggggaaaatccgtcactgctggcggcgctgcagggcgcgctggcgcaacagcacggcagctatctctacttctggtcacgcgaaggcggcggccgcagccatttgctgcacgcagcctgcgccgaaatgtccgcgcgcggcgaagcggtgggttacgtgccgctcgataagcgcacctggttcgtgccggaagtgctggaaggcatggagaatctggcgctggtgtgcattgataatattgagtgcatcgccggcgaagccgagtgggagatggcgatcttcgatctctacaaccgcattctggaaaccggcaaaacccgcctgctgatcaccggcgatcgccccccgcgtcagctcaatctgggcctgccggatctggcgtcacgtctcgactggggacaaatttaccgcttacagccgctgtccgacgaggacaaactgcaggcgatgcagctgcgtgccggcctgcgcggctttgagctgccggaagacgttgggcgtttcctgctgaaacgcctcgaccgcgaaatgcgcacgctgtttgacacgcttgatcgtctcgatcgcgcctcgatcagcgcacagcgcaagctgaccattcccttcgtgaaagaggcgctggggctttag

SEQ ID NO: 70786 - DNA, 627 bp, Glycine max
  Peptide Sequence Number=SeqID_162471
atgaagatcgtggaagtcagacacccgctggtcaaacataaactgggcctgatgcgtgagcatgatatcagcaccaagcgcttccgcgagctggcctcggaagtgggcagcttactgacctatgaagccaccgccgatctcgaaaccgagcgcgtgaccattgaaggctggaacggtccggtcgacgtcgatcaaatcaaaggcaaaaaaattaccgtcgtcccgattctgcgtgctggccttggcatgatggaaggtgtgctggaacacgtaccgagcgcgcgcatcagcgtggtgggcgtttaccgtgacgaagagacgctggagccggtgccttacttccagaagctggtgtcaaacatcgaagagcgtatggcgctggtggttgacccgatgctggcaaccggcggctcgatgatcgctaccatcgatctgctgaagaaagccggctgcaacagcattaaagtgctggtgctggtggccgcgccggaaggcattgccgcgctggagaaagcgcatccggacgttgagctgtacaccgcgtcaatcgatcagggcctgaacgagaaggggtacattatcccgggcctcggcgacgccggcgacaagattttcggaaccaaataa

SEQ ID NO: 70787 - DNA, 357 bp, Glycine max
  Peptide Sequence Number=SeqID_162472
atgaagttgtacccactttttgtaatgaacccaaaagacgttggtcttttgtgtctagtgatcaaccaagaagcaaatcccgcttcttgcaatgaacccaaggaacgttggtcccttgtgttcagtgttaaaccgagaagaccttctcttgaaaaacagtcaccaagagtagttataaaactgttttgggcttctagtaatcaattaccggagagtaaaaactctggcctaggatcttcttcatcaatggattcctttgcttcttggaagatgaatggcagcagaatggagaaggaagagatagaggagacgccacttcaaggagaagatgagtctagaagaagctcaccaccatag

SEQ ID NO: 70788 - DNA, 483 bp, Glycine max
  Peptide Sequence Number=SeqID_162473
ggtacatcctttgtggtacaagtagagggtacatctacttgggttgttgtaactgagaacaagagagggtacatctcttgtggatcagttcaagagaagggtacatccacttggttgttcaaagagagcaagggagggtacattccttatgaatctttgcttgtaaaggatattacaaggttgaaaagaaatctcaaggaccgcaggtatcttgtagaaagtttaatcacttcaagattcatggcctcttcaaattctctatttcctaaagaaaattccatccataggtcacctatcttcaatggtgagggttaccactattggaaaacccgtatgcagattttcattgaagtcatagatttaaacatttgggaagcaatagaaataggaccttacatacctactgtaatagatgtaagcactagcaccacaacacaaaaacctagagataagtggactgaagaagatagaagaagaatctag

SEQ ID NO: 70789 - DNA, 510 bp, Glycine max
  Peptide Sequence Number=SeqID_162474
atgaaattgttagaatcccttgatctctcgctaaacaacatttcaggtcaaatccctcaaagcttatctgatttgtccttcctcagtttcctgaatctatcataccacaacttatcaggcagaattcccacgagcacccaacttcagagctttgatgaacttagctacactggaaatcctgagctttgtggtcctcctgtaacaaaaaattgcacaaacaaggaatggttgagggagagtgcttctgttggacacggtgatggtaatttctttggaacatcagagttttatatcggtatgggagttggatttgcagcaggattttggggtttttgcagtgttgttttcttcaacagaacttggaggcttgcttattttcattatcttgaccacttgagagatctgatttatgtgatgatagttttgaaggattctgcagtttctaagctcttccacatcttccctctcgctgttccttactctgatacattccacattcccatttcctga

SEQ ID NO: 70790 - DNA, 465 bp, Glycine max
  Peptide Sequence Number=SeqID_162475
atgaggaaaggccttcagaaatatgtgatcctcttggacatctgggggtttcatggtggagcagacaatatggaattctttcagatgtttatgcgggtcttcacctgcaaggccatgaaactttggaagcaaatggatcaatccagttttaagagcatatgggacatccttatcagggtattagatgcacaagctttcgtaggatcaaagggttgtaagtcaagtggatttcctctagtcatacactatattcatcatgcacaactagttgctttctgtcgcaacctacccttcggtgggagggcgacgcgtgactcgcgggtgcatgttccaagaaaggaatacgcacggagtcgccaccaacgtgtatttgaggaaaacgtcggaaaaaccggaaaaagacgtgatctacgaaccctaagtgaaaagttcgggagttgtatttacgcacggggaaggtattag

SEQ ID NO: 70791 - DNA, 165 bp, Glycine max
  Peptide Sequence Number=SeqID_162476
atggaaatagcatctcaaaatttgttggaaattcagaagctgaagtcactacttagcagtgaatttgagatgaaggacatgggagctattgaaaagactttaggaattaatgaagcattgggcttgaatctagaattgggcttggacttgaagagggcagactaa

SEQ ID NO: 70792 - DNA, 327 bp, Glycine max
  Peptide Sequence Number=SeqID_162477
atggataatgggaccactgaggaggtgaagaagattgttactactttaaatgaagctaaaatccctggagatgatgttgtagttaaaatatcaaattgggacaatgtcaatttgtcctatgagccagtttggaccattggaacaggaaaggttgcaactcctgctcaggctcaagaggttcatgctaatttgaggaaatgggttcatgacaatgtgagtgctgaagttgcatctataagaattatctatggaggtaatctgacatccactttacctaaagaatattcatatggtaatcttgcattcattttacatcatgctctttaa

SEQ ID NO: 70793 - DNA, 381 bp, Glycine max
  Peptide Sequence Number=SeqID_162478
atggtgttgttagaaaacatcgtgccaccgtccaagtcgatcagtgaaccgtacccctccaccattgtgctttcatcattagaaggtagcctagttttcaacttctatgcagcttcatgccccacaacaaagttcactgtgagaaacacagtcagttcatcttcttttgatccttcaattcccgggaagctcctttgcttgttttttcatgattgctttgtggaggttagttctagtgctagtgctcctgttgatgttgatttggatgacattaaccacaaaggcaaagcagttattgtgcttcaagcatcgcaggttgaggttagaggtaatggactttcagttgcagctgagaaaacatctgatgatggatacaattag

SEQ ID NO: 70794 - DNA, 1116 bp, Glycine max
  Peptide Sequence Number=SeqID_162479
atggggggccatatgagcaagaagacccctgaaacatcatctggtattaacatcaatgctgatatggcaactgaattgaggtcatatgaggctgcctgcaagcttgactctgatttgcagtcctttaataccaccattcaagctcgagcaaatcaagtcattaatactcttgctgttggagttgaggttcgatccctttcgtttgagtctctcaaacaagtcacagaatgccttctcgagatgaatcaggaagttgtcaaggtgatcttagactgtaagaaagatatatggaagaacccagaactgtttgagcttgttgaggaatactttgataatagcctgcagactctagatttctgtactgcattagagaagtgcctgaagcgagctagggataaccaattgcttattctcatggcccttcagcagtttgaagaggaaaccagcttgggagagacacgctatacgaggacattacaggaactgaagaatttcaaggcagctggtgaccctttcactgaagaattcttccaaatgtatcaatctgtttacaatcaacagatactcatgcttgagaagttgcgagtacgacaaagcaagctcgataagaaggtaaaacaaatccatacctggaggaaggtctcaagtgtgatatttgcggctacagttgctgctgtgttgatctgctcagttgtggctgcagcaattgctactccacatgttgcagctgctctagctgctgttactgcaatcccaataggttcaatgggaaagtggattgactccttgttgaagaactatgaaaatgctatgaaaggacataaggaagtagccatctctatgcaagttggcgcctatgttgctataaaggacttggacaacattcgggttctcattgatcggctggaagttgaaatcgagtctctatttcagaatgtggaatttgcccttgaggaagaagctgtgaaggttgcaatagaggagatcaagaagaagttgggagtttttatgaagaatgttgaagatttaggattacaagctgatacgtgtagccgagacattataagggctaggactgtggttctacaaaaaatcataaagcttccccacacctga

SEQ ID NO: 70795 - DNA, 458 bp, Glycine max
  Peptide Sequence Number=SeqID_162480
ggtacatcctttgtggcacaagtagagggtacatctacttgggtttgactgagaacaagagagggtacatctcttgtggatcagttctagtggagggtacatccactaggttcaaagagaacaagggagggttgaaagaaatctcaaggatcgcaggtcgcttggggactggagacaagttgattcttgccaagttctatctgccaattgatgacaaggagaagccatggtttcaaggtctcaacaaggttgcaaaaaccaaggcaaagaaagataccaaggagaatatcacaagtctcaaaggtaccattttgaacctgacaaaccctctcaaggaaagcttcgaaaaacagaagagctacaacaaaggctttattgtagacttgaagagtttcgcacatgctgtaatggtgggaattcagatagcaagaggagggatgaaagaaatgctaagagag

SEQ ID NO: 70796 - DNA, 453 bp, Glycine max
  Peptide Sequence Number=SeqID_162481
atggaggggttattatttggtagaatctgttgggggtgtgaaggtttgggattctgtttaattatgagtcatcctgccctttgtgaacttctgaacgtagaggatcaaaagatatttaagtttaagtatttgggttctcttgatgttgaagataataaagatgtcaaatcaggctactcaatcacctttaatttcaatcccaatccctattttcagaatacaaagcttacaaagacttttacctttcttgaagaaggaacaacaaagataactgctacccccataaaatggaaagagggcaagggattacccaatggacttgatcatgacaagaatgggaacaagcaggctcgtattgatatagcatatgatgaaaccgaggaaggtagccctgttcatggtagagaaagtgaagaaggatgttgcagaggccttcaaggatcttgtgtttga

SEQ ID NO: 70797 - DNA, 171 bp, Glycine max
  Peptide Sequence Number=SeqID_162482
atgcaagctaaaaagaagaggaaggtttcgaagcataaggaacttgaaaaaatggctaagaaattggaccaagtgaagaagaaagatcctaagaaggtccatgatgaccccaaattgttgcataaaagcattcataaagagaagaaacaacagaagaacgcgaagaaatga

SEQ ID NO: 70798 - DNA, 1119 bp, Glycine max
  Peptide Sequence Number=SeqID_162483
atgcatattcatggagaagatcacaaaggaaaaggagatggaaaaatgaagattctcaaattgatgaaatcaaaacaaatgatgatcttccaagagaatggagagcttctagatatcatcctcttgataacatcactgcaaaccaagaatggaatttttgtcaatcaatcaaagtattgcaaggaattgattcacagatttgggatggagaatgctaagcatatggccacaccaatgagtactgcttgctatttggataaagatgaaaccgatcagtcaatagacattaagcaatatcaagatgatcaacgccaaaggtactattcacaattttgcaatagagtcattctagacccgaagtaccttgaccttgatttctttgatggtgaaacatttgattgttaccaagtgtttcaaaattctggtttaactgaacttatgtctctgaaactgcctcactttcctgaattagtaagagtcttctataataacttaaaaattcatgatggtgttatttactttgagggcacccttgttaatgattggaaatttgattattcttgtcatgattttcgccgcatggtctgcattgaccagactgatatgaccggcagattgcttgctggatcattaacttttgatttctgcatcatgcattacattatttaccggatgcataagccattacgggacaatgcacctctcccttatcctcacctcgtcaccctttttcttcatcatttcaaaaatcctttggatgatgaactctttgttcaagtaaaaaggtctttttctattggtgctggtgtggttacctcttttggttaccgtaaggatgatgatggtcagtgggttcgaaaacaagacttccctctgcctattcctgacgaacgtaccccatctcctccaccacaaaggtttgattcctcttcacttctaaacgacgtcctcactgaactccacggtcttcgtgctttcatgggtgaccgatttgatgctatagatactcaccttgatgccatgaatgctctctttgatgggatagacacgaggatcactcaacttaaggacgatataagcttcattaggcattgcttcgatcccccgactaactcttag

SEQ ID NO: 70799 - DNA, 942 bp, Glycine max
  Peptide Sequence Number=SeqID_162484
atggcaaaaccatcgaaaaagcgcaaaggaacttcgagtcggagtcagcggcattctgggtcacaggaagctccaattcctccctccattccctctgggttattattctcatcagaggaacagcgtatacggtacacaaatcttttttcctctcgttccattgtagacccaaaattcatagatatggagttcttctcaaatgagaattttgaatgcttccaagcatttgaaaactccaatcttattccattcatgtctctgaaattacctatctattctgagttagtcaaagctttttattcaaatttagaaattcatgaagatgttctaatgtctgaaatctatgggattaagatggtcattgaccaatccctattttatgatttaacaaaattgcctagtgaaggcatgccttttgagggtgcactgattgatgaatggaaattcgatttctctgtgcatgatgcctgccggttggtttgcaccaaccaagcggatatgaccggaaggcttcttgccggttcattctcttttgaaagccgcatcctccattatcttatagttcgcattttgcttcctagatcttcaaaccttgcccaggtttctgaagaagacctcattgtcatgtgggcctttcataaaggcgcttcagtcatagcatcctttggatatgttaaagagcatgatggatcttggataaagaagggtgctagaaatgttggtgaagaaggacatgagggagaagattcatctcttctttctaagatattggaaaggtttgatggtcttcaaacctttgttggtgagaggtttgatactttggaactgcaagtggatatgcgcttcaatgaaatggagtcaagaatgattaaggttgaagaagatgtatcttacatccggtcaagctttgatcttccaccaccgccgccatcatcatcttag

SEQ ID NO: 70800 - DNA, 210 bp, Glycine max
  Peptide Sequence Number=SeqID_162485
atggggagtcgcatgggaaccgggacacgacgacgtacaccatcatatccgacaacagcgcaaggcatggctcagaccctctacgacggtgagcacctccaccacgtgataggcaatgacgactgctcccctgactggcgggtgcagttctacttgtcccctacacccgcacccgatcgacattccatgagctcaaacggtgtttcttga

SEQ ID NO: 70801 - DNA, 216 bp, Glycine max
  Peptide Sequence Number=SeqID_162486
atgaccgacagccatcgcgatctccatgagaatcgtctcgggcttcccgacgcgcacgatcagatcggagccacgccactggaggttctgacgcagctagcattgtcgctgaagatacaactaccgcaaaggagcttacctgggttcattgaagctagcattgtcgttgaagctagcattgccgctgaagctgcgctgccaccttactactattga

SEQ ID NO: 70802 - DNA, 294 bp, Glycine max
  Peptide Sequence Number=SeqID_162487
atgtctgtgatgccgcgacgaagtcccacatggccggtcccaatttctagctgccctatcaggatttcttcttctacgattcgccctttcaccccacttggtacattccacggaccaccaagtggggcatttggggtcgatagttcaccactttgggtaaatgaaggagttccccttgaaggaggagaggacccaaatatgcctgtcatattgtaccctggttgtaaatcatgtaggtatgaatacatcagcggcatctgtgatggttcttgggtgaatgcctgcggtgtgtaa

SEQ ID NO: 70803 - DNA, 363 bp, Glycine max
  Peptide Sequence Number=SeqID_162488
atggacgaagatcagtggatatataaaagcattatgtttgaagaaattaatatgaatgaagacaatggagaggaacttggtatatttgaaaatattgattgttctgatgccttcaatacttctcaagtgtttgctactcgtgaagacgtattgcaatgggctcgtactgttgcgtatgatattagttttgtgactgtgagaatgagtcttttaatggtgattttccaccatggagatgcagcggaagacaaaggagaaaagcttggagaggatgcttcaatggaggaaaagaaagagggagagaaagagagaggggggagcacgaaattgaaggaagaaaaagggagagaagttgaactttga

SEQ ID NO: 70804 - DNA, 450 bp, Glycine max
  Peptide Sequence Number=SeqID_162489
acgattcctccacactatccaggttcaagattatgcttagaagatattggcgacagatggatgcacttctctgagtaccttgcaccgtgtgcatcatacttcatggactggttctacatgatttcgcatccattcatgaggtcggcacagcttggggatccagtcaaacatccacctgtcatgcaagatgacacatacgtcaaaccaggtatgcctcaatatccggtgacgacagcaactatggaggaagcacttgtgcaggcaccctctcatgtggagcagcctagacatgcggtggaggctttccaagcaatagctgaaaggttggagcagttgctcaacctaaggaaaatggctaaaggcacagaaacatacgatgtcatgcaagactacctaaggatcgctagaggtgtgacagtggatcgcaatgtatatgtgcggtcgcaatga

SEQ ID NO: 70805 - DNA, 270 bp, Glycine max
  Peptide Sequence Number=SeqID_162490
atgactaaaggcacagaaacatatgatgtcatgcaagactacctaaggatcgctagaggtgtgacagtggatcgcaatttaaccctaacaacgcatgtaacactaaaccctacgtattatagtaaccctaaatcgtttgaatgtaaggaagctgccactattgctgaggatgttcatcacgtggatgacgcagctgacaaggtcttccaacaacctctagaagcaattgttgatgcccagggttttctaggcgggctgcatgacacataa

SEQ ID NO: 70806 - DNA, 246 bp, Glycine max
  Peptide Sequence Number=SeqID_162491
atggcattacaacagtttggttatgttcaatccattcctccactccctactactccatctttatccatagaggagattggtgataagtggcttcagttttctcaataccttgcaccggccacttgccaaaagataacagaaagcttggaacacatgataaatatgaggatgcttactattggaactaatgcatacactataactaagcattgtttaacattagctagggctgtcactgagcaatga

SEQ ID NO: 70807 - DNA, 84 bp, Glycine max
  Peptide Sequence Number=SeqID_162492
atggcaccaaaggatatggagaaaacaacctttattactttctgggggaccttctgctataagcataccagcaggccatggtga

SEQ ID NO: 70808 - DNA, 213 bp, Glycine max
  Peptide Sequence Number=SeqID_162493
atggcgaagagagacatgataaccatgataatggacacgttgccaatgttctattacgagaagatggtagtgatgcaatcctaccccgcaagggcattggctagaagactccaagtagattgggctagagatccaaggaaaggccatagggttctcatgagccttaggctaagctctagcttctcatctcaaggaggtgagcttagctattag

SEQ ID NO: 70809 - DNA, 240 bp, Glycine max
  Peptide Sequence Number=SeqID_162494
atgaccaagcttttctggaagaaatgcatcagcagcttttcatctttcacatatgcccctatcttcctgtcgcaatgtgcccttcgcgggcgagcgagggcgaggctcacgggtgcgctttccaaaggaggaaagatgcgcggagtcgccaccaacgtttatttgtggaaaacgtcgggaaaatcgaaggaaactggtcaaaatgaatattctaagttcgggaattgtatttacgcttga

SEQ ID NO: 70810 - DNA, 228 bp, Glycine max
  Peptide Sequence Number=SeqID_162495
atgatagaagtgttagatgaagccattgcatctcttacccaatactatgaccaatcgctcagatgcttcacttttagggactttcagttaacaccaacaataaatgagttcgaggggatcctaggatgcccgataggaggaaggaagccatacctcttttctgggtactacccttctatggtgagagtagcaagagtagtcaagatctcgaaacgagagttagattga

SEQ ID NO: 70811 - DNA, 141 bp, Glycine max
  Peptide Sequence Number=SeqID_162496
atggcgacaaagataaaacgatgcccattcgaagccttgggtttgatagccctaatcacgtctatgcctcacatcgagaacgaccatggtgctgacaacatattcaacgacacaggtggagcattaacattatctgtaaag

SEQ ID NO: 70812 - DNA, 273 bp, Glycine max
  Peptide Sequence Number=SeqID_162497
atggctatttataggaaaaggccatttggtatttgggaagctcgcccaggcaagttggagcttgcccaggcgagctggtttcttatagttgaaggtatcaactcacccaggcaagctggagctcgcccaggttgcttaagcgatccagcttttcaactggatgccagagaaaacaaagaagcaaaattgaaaaagcaaaaggacgttgaagtgctacaaaacataaaatggaggacattggaatcctatagcataagagcagaagacacttga

SEQ ID NO: 70813 - DNA, 555 bp, Glycine max
  Peptide Sequence Number=SeqID_162498
atggtggcggcgtcgcggcggctccgagacctacagtcctcggcggtttggtttcgtaggttctcaacagattcagcaacgactttgggttttttcaaatgggcaaaatctcaaacaggttaccggcattcccccgaactctactacttgatggttgacgtcttgggaaagtgcaaatcctttgattccatgtcagagttggtggaggaaatggcaagacttgaagggtatgtgacattggaaaccatgaccaaggtaatgaggaggcttgctaggacacgcaagcatgaagatgctattcaagcatttcgcagaatggagaagtttggtgtgaagaaggatactacaacgttgaatgttctcattgatgcattggtgaaaggagatagtgttgaacatgcccacaaggttgttttggagtttaaaggttctgggtgttcttttgtgggatatggagcaacacaagagattggcccatttttagtggacaccgatggtaggggccataaattcaataacttttcatggaacaaaggtatgaaacgtgagatctag

SEQ ID NO: 70814 - DNA, 513 bp, Glycine max
  Peptide Sequence Number=SeqID_162499
atgactaatgcaaactctccgcaagaatcattgcattcagtctcaaacgggaatctaaggggtttgggactgtgtctgtgtgtgtgtgatgagggtgtgtgcgtggatgtgattaggggtttgtctatgtgtctgcgtgtctcatcagggtgtgtgtggtttctcagtgtgtgtgagtcgcatcagggtgtgtgtgtgtgtgtacgacgaatcgcacaaggaatgcattatctttacacagtacttgcttcctcagttcttccacaccagtatctcaagtccagcaatgttctcgttggaccagacaatgaaccaatgcttgtagattacagggtaccagaggcaacacaacaaggccaggtttcacgcagttgctctgtttactgtcttggtgttgtcatagttgagatactgacagcgaggttcccttctcagtatgtcagcaatggaaagggtggggatgatgtggtgcaatgggtggaaactgcaatctctgagggaagggaatcataa

SEQ ID NO: 70815 - DNA, 2046 bp, Glycine max
  Peptide Sequence Number=SeqID_162500
atgccagaggtttacactgtgaaggttgaagagggaaggcctgcaactgatgcaaagccatcagcaggtcctgtctataggagcatttatgctaaagatggtctcttggaggttccttctgattttgagtccccttgggatttcttcagggactctgttaagaggaaccccaacaacaaaatgcttggtaggcgtcaaaaaaccgaatctaaggtgggttcttatacatggctcacgtatcaagatgtttatgatgctgccctgaaaatgggttctgccatgaggagccgtggtgtcaatcctggagatcgttgtggcatttatgggtccaactgtcctgaatggatcattgtaatggaggcttgcaatagctgtgcagcgtcatatgttccattatatgacacccttgatacaaattcgatcatatatcatcaactaggaaatgagtttgacttgggtttatgccttctaggtcctaatgcagtggagtttatcataaatcatgctgaagtttcaattgcatttgtacaggagaaaaagattccatcaattctgtcatgtcttgcacagtgttcttcaaatcttaaaactattgtgagctttggaagtgtttcaaccacacaaaagaaggaagctgaggagcatggtgcgtcctgcttctcatggggagagtttctccagctgggatgcctggattgggatctaccatcaaaaaagaagaatgacatttgcacaataatgtacacaagtggaacaactggagatcccaaaggtgttgttattaagaatgaggctttcatggctgaagtgttgtctgttgaccacataattatgttaaccgatagagtggtaggagaagacgatgtgtacttttcctttcttcctcttgctcatgtatatgaccaaataatggagacctattgcatctacaagggatcatcaataggattttggcaaggcgatgtcaggttcttgctggaagatgttcaggcactgaaaccaactatattttgtggagttcctagagtttttgaccgtatttatgctggtatcaaaagcaaagtatcttctgcaggaggactgcagagtacattgtttcagtgtgcttacaactacaagttaaaatctctggagaagggtcttccacaacacaaagcagcacctctgtttgataggcttgtgtttgataagacaaaactagcactaggtggacgagttcgcatcctgttatcaggagctgctcctttgcctaggcacgttgaagagttcatgagagtcacgagtggatctacattatcacaaggatatggtcttactgaaagttgtgccgggtgtttcacggcgattggtgatgtgtattctatgacaggaacagttggagtccccatgacaaccattgaagccaggcttgaatctgtgccagagatgggatatgatgccctctccaatgtaccccgtggagaaatttgtctgagaggaaataccttgttctccggttatcacaagcgtgaagatcttaccaaagaagttatggttgatggctggtttcatacaggtgatattggagaatggcaatcaaatggagccatgaaaattattgataggaagaagaatatctttaaattgtcccaaggagaatatattgctgtggagaatattgaaaacaagtatttgcaatgcccacttatagcatcgatatgggtgtatggaaacagctttgagtcattcttggtagctgttgtgatccctgaaagaacggtcattgaggattgggcaaaagagcacaatgtgacagatgattttaaatctttatgtgataatcttaaagcaagaaagtacattttggatgagctcaacagcactggtcagaaacaccaacttagaggatttgagctgctaaaagccattcatctggaaccaattccctttgacatggagagagatttaataactcctacattcaaattgaagagaccacaattgctcaagtactacaaggatcgtattgatcaactatacaaggaagcaaagggagcaatggcgtaa

SEQ ID NO: 70816 - DNA, 375 bp, Glycine max
  Peptide Sequence Number=SeqID_162501
atgtctacggaaaagctagtcttttcaggaggctccagagaggtagtacctgtgcgggccaatttggtgttacatgactggaacttagttcaaattactcgaccaagcaaaccaacattaggagttgtgaaatgtagcgttgacgatgcattctttcattacaataggaaaacggaatttggttgttgtttgagggatgatgaaggcacttttattcaggctcatacaagagggctactggctagattcggtgttggaggtccaagagggagaggcatttgcattgttatcaaatttgagatggatggaagaattaccttgtcaagaagttattttggaaacagattgcagagggatggtggaccagctagatag

SEQ ID NO: 70817 - DNA, 354 bp, Glycine max
  Peptide Sequence Number=SeqID_162502
atgaccagtaaacttcaaatgctcataactattgctacggttgtccgtttgaggcccactatatatcaaaacgctcagaattcaaaggagaatctagataaggggatttggagcggatcgtttgatacaggctacggaggtttggatgacgcaacttccggtgaaggaagatatgtcagggtagacgccacaaggattaccttgataagtctaagattggttcaacaaggaactcagagagaaactctcaccaaattttatcaaatgccaaaagttttcttattcaaaacaaaaaccaatacttatagtgtatctgaacaaaaagataaaaatagacatgggccttctaaatag

SEQ ID NO: 70818 - DNA, 288 bp, Glycine max
  Peptide Sequence Number=SeqID_162503
atggctgttattgcagattggctggagttgcctgcagtttttattcttcttattgttgcagctcctgatttcttcacaaacaccttcataagaaataaagttgggggcatgacaaggactaagggtaaggaacctttagaaagacttggaggacctatggcaagagctagaacaaagaaggcaaaggaagatcttcaacaagtgttaaccatgctatttgaatttaggcctaagttacaagtggcgaaacttcagattgtcaattgcatcatgttccaagaagagtag

SEQ ID NO: 70819 - DNA, 417 bp, Glycine max
  Peptide Sequence Number=SeqID_162504
atggtagccataagcccaacaaagattcctcaacctccatttccccgaggatacaactcgaatgtgacatgtgcttatcatgggggagttctagggcattccattgaggactatatgaccctgaaacataaggtgcaaagtctgattgatgcagtgacttgtgctcctgagttgatcttcaagtctgcccaatcagaaattgcacattctacacgtttagtgggggtgccaacttgcacaatttatttcatttcttcttgctacaaggtcatgacaaacgacaaaaaaacatatacctccgaaccctacattggggcaatggtaggcaccatgcatgagcttcaagtgaacataggggcagacaagaagtcctcacctgataggttgaaaacccaaaagggtggcctaggcaagtaa

SEQ ID NO: 70820 - DNA, 249 bp, Glycine max
  Peptide Sequence Number=SeqID_162505
atgccactgggtgaattttcttctactgattctccttcaactgaaaagccattagtaattgataatatggatgatcgagaaggaggaggaaatagaccaccaaggaggactcttgctagaggtactatgatgtctaagagcctaaaggaagcaattgcaatcattgactccattgcagccagtgattatcagagtcaccatgataaggctccagttcacgaaaggtataatgtagttggatactcataa

SEQ ID NO: 70821 - DNA, 498 bp, Glycine max
  Peptide Sequence Number=SeqID_162506
atggctttttgttcatcacctttgtcatcatcttttgttgtcatcattgttatcatcaaaacacctttgaatctcattcaccatgaagccttgcttctacattacccttatggattaccacctaattacacgccatcagtcatacatgatgacgcgggtcatgtcccttcccccatccttgaaggggagcctcctggacagtcggacgaggttcacgaagagcatagagagtatgctcaaggagacatcaatttctaccccccggtccccgtcgaggggtcggcgcccaacacattgccgcaacccaacctcccagcacagccaatattcttgtctacagaaggagcacccccggcagcggaagaaagaaggaaactcgatctcatcgaagagagattgagagttgttgaaggctttggcgactatccgttcgcggacatggcggatctttgcttggtaccgggacgttgtcatccccccaaaattcaaggtacctga

SEQ ID NO: 70822 - DNA, 525 bp, Glycine max
  Peptide Sequence Number=SeqID_162507
atgccctatacggtaacccgcccacactcttttgctatccgtcagactcagagtctggtagaacgcagagacttacgttgtcttctgcaccttttgtcatcccgaggcgatgagcccgatgacatttgggggtaccgtatggttatccgcaccttttgtcatcccgaggcgatgagcccgatgacatgcgggggtatcatatgcaagcccgatgacatacgggggtaccgtatggttatccgcatcttttttcaaccaggggcgaacgagcccgttgatgcgcagagactaacatcgtctcctgcacctttcgtcgcccaagggcaaacaagctcgttggcacgtagagacttatgtcatcttctgcaccttttgtcatcccaaggcaacgagttcgatgacatgcgggggtaccgtatggttatccgcacctttcgtcatcccgaggtggcaagaccgatgacatgcaggggtaccatatggttatccgcacctttcgtcatcttgaggtggcaagcccgatga

SEQ ID NO: 70823 - DNA, 625 bp, Glycine max
  Peptide Sequence Number=SeqID_162508
gaattgctaacataaatgctcaggagaaaaaacaactcagccttgatgaagctgtgaggttaggtatccaaaacagcaagaatctaaagatcgatgccgctaaaatagaagaagcgactgccgaccttttagaagcaaaaaataaacagctgccggattttaagctttcggggcagtacatgcgtttaacgaatgctaaagtagatgtaaaatttctgaacgaatccggatcaggtggtggagtagcctcaccgaagtctgtatttttaggtcaggctaatttatctatgcctatttatgctggaggaagaataaaatatggaattgagtctgcaaaatatctggtggaggcatccaaactaagcacggaaaatgataaaactgccatcgcttacaatgttgcccaggcttataataatttgtttaaggccaaccaatcgatcaaggttttagaagaaaaccttacagcttccaatcaaagagatgagacttttcttaaaatggaaaataatggattgatcgcaagaaatgaccgtttaaaagcaaatctccaaacctcagatattgaattgcagctattggaagccaaaaataactacaatattgcaaacatcaatatggacct

SEQ ID NO: 70824 - DNA, 177 bp, Glycine max
  Peptide Sequence Number=SeqID_162509
atggtctctggtaatcgattaccacggggcgtaatagattaccaggcttcagaaaggaactggaacactgtggaggcctctggtaatcgattaccagcctgtgtaatcgattacacagaggaatgggtcactggtaatcgattaccagatcgtgatggcggcgcagctaatccatga

SEQ ID NO: 70825 - DNA, 357 bp, Glycine max
  Peptide Sequence Number=SeqID_162510
atggatgggcaatggttgaagaaggacgtgcaacctccacaagacgaacgtgctccctctcctccgcctcaacaagatgattcctcagccctcatgaatgaagttctttcggaattacgaggccttcacacctatgttggtgaacactttgattccttggatggtcgcatagatgccattgatgctcgcttggaaggaatggatacctgcatcactcagcttgaagagaatgaattaaattgtcatcatcaaaaatggggagattgtagaagcaaagactttgatgttttgatgatgccaaaggatcatatgcttctcaagtttaattcaagaggatcatatgcttctcaaggttaa

SEQ ID NO: 70826 - DNA, 930 bp, Glycine max
  Peptide Sequence Number=SeqID_162511
gattcgttggaggatcatgcctcacagggttcctttgtcgcctatggacgtcaggatgtattgactgttgccattgggcgaccagaacaccctggtcgtgtgcatgttgttggagttggtgtcacaatcaaacaatactttggaccggctccaaggacctcccgcacttcttcgtccatggctcctgaagacctggaatgcaatcataaggactcacactgcctcttgagccagaggttggtccttcagctgctcgtgtccataaaggagagttatgtttatccctcaagcaacgacccatacacgggtgactcagagaaatacgggttgtacgttgaagaaaaccttccccgcctggttgccctaggaagactttatgagggatccacaaccgttcacaacatgtctttgtgccatgatcaactcaaggttggtgttgaggaagttagagatgtagatgctctcattcctatacccactcaaaagggagttctgggaccaacgaaacctatagataggccggatcatgatgtcgatgatcctctatatctaatgacattgaccatcccacagctttttctaaagccgttgcaggttatgtgggatgctatcgtgtttgggatgtttaatgacgacttccccttgtacataaagcatgaagatctgttcgaaatagcacacggtggtcagtgtctcaacatctctgttatacaattgtggattcttgcatattggcaaatggtcgtcattttgtctaaggaaaatgttgtcatttggttttgttcgttgcataataggccaaacaactaccttaagggaattattaatagacaaaaaggaagcactgagtgtgggtattacatcatgcactggatgtcaactataatcttaggaagttttaagaataattgggaaacgataattgtttaa

SEQ ID NO: 70827 - DNA, 543 bp, Glycine max
  Peptide Sequence Number=SeqID_162512
atgaccggaaggcttcttgccggctcattggcatttgattgtcgcatcctccactatcttaatgttcgcatttttcttccgagatcttcaaaccttgcacaggtttctgaagaagatctcattatcatgtgggcatttcttaccgatcgtcaaatcaactgggctcacttagtccgttatcgcatgaataaggcattgcgatcaaatgctcccttaccctatccttatcttatttctctttttcttcaccatttcgaggtaccttttgttcaaatcaagaagtccttttccattggggctacagtggtcgcctcctttggttatcgcaaagagcgtgatggctcttggataaagaaggatgctcaaccacatgatgttgagggttgctcgcccgctcgagaggattcttctcttctgcagagtgtcatggatagtcaagtagacattcgattcggagagatggattctaggatcacgaagattgaaggcgacattacttacatcaaagattgctttgaccttccaccgccaccatccccttag

SEQ ID NO: 70828 - DNA, 814 bp, Glycine max
  Peptide Sequence Number=SeqID_162513
atcatcgacatggttttcatccgatgatcaacgtctacggtacctttctcagttttcttctagaataatcttagaccctaagtacctagacgtagagttctttaatgatgaaacgtttgattgctatcaagtgtttcaaaattctggtcttgttgatttcatgtcatttaaattgccatattatcctgaacttgtaaaggtcttctactgcaatttaaaaattcaggatggtattattatgtctgaggtgcatggtacttctatggtcattgatcagtcacttttcttttctttgactcatttacccagtcaaggtgcaccttttgagggcaccattgttgatgactggaaattcgattattcgagtcatgatgctcgtcgcatggtctgcaatgatcaagctgacatgaccgcacaagcctctgaggaggatttgattcttatgtgggcttttctaaccggtcgtcagatcgactgggcccatttggttcggtaccgaatgcataaggcattacgggccaatgcacctcttccttatccacacttgattactctgtttttgcgtcattttcaaattccgcttgatgatgaaccctttgttcaagtcaagcgttcctttgcaattggtgctggtgcagtgacctcctttgggtatcgtaaagatcggaatggacaatggctgaagaaggatgcactccctcctcaagatgaacgtactccttcacctcctcctcaacgtgaagatttcgcactcatgaatgaagtcctctccgagttctttggctttttgatgttccaaaagggggagaaaaag

SEQ ID NO: 70829 - DNA, 363 bp, Glycine max
  Peptide Sequence Number=SeqID_162514
atgcaagaagaagaagaatcaaatgatgaagagggcttctcactttttgtgaagaagtttcataaattcatcaaaaatagaagaagggagagaagccataacttcaacaatgggaagagatcccaagaagtttctcctacacttaaatgttataagtgtaatcaacccggtcacataaaggcaaactgcccctcaaatgagtcatggcctgagaagaatgaaaagaaaagttataaagaaaaaagatccaagaaggcgtatattgcttgggatgacaatgactcatcagatggttcggagaaggagatcaaccttctatccaaggactatgaaagtgatgagaacatctctcaagaagtttaa

SEQ ID NO: 70830 - DNA, 312 bp, Glycine max
  Peptide Sequence Number=SeqID_162515
ctgatcaagtttgatgctgctacacttaaggagtttttggagaccccaatggtcctagagcctggggagaggaaggacctgaccactctcgcgcagacatggagtgtcctttcctacttcaaccttgcccccacttctcatacctctgaccttaatatggacagagcgaggttggtgtacggaattgttataaagatggacattgatgaagagagagaggagacgccacttcaaggagaagatgagtctagaagaagctcaccagcaaaggaggccatggataagagcttggaggaagaaggagatgaatga

SEQ ID NO: 70831 - DNA, 186 bp, Glycine max
  Peptide Sequence Number=SeqID_162516
atggctctggaatggtggcctcaaatgactcatcctccacatgttgtggtaccagggctgtgggaccttaatcttctctgtgaagagaagggagttgttgaagtggatgttggagtaggagttgcagatgtggaaggaagctcagctggcctcgccctcgccctcctagcccctcggatagaaact

SEQ ID NO: 70832 - DNA, 126 bp, Glycine max
  Peptide Sequence Number=SeqID_162517
atgaacagcgctaggcaatcaattcatgggtctctgaataagattgagaatggagaattggcgaacaacgctagcgctaggcaatcaattcgcggggctccagactcgatggtggtggacgcatga

SEQ ID NO: 70833 - DNA, 924 bp, Glycine max
  Peptide Sequence Number=SeqID_162518
atggcttccagaaagagaaagagtattggttcaagacccacatcgcagtatggcacaaggagattctcttccttagatgcttggaccagatacatagataatgttctagggagaaacattttactagagaggaaagtagaaatatatcattctaagctagatgagtttaaggttgaattggagaggcgtaatttccataaacgcctcaccaatttagtcgatgggagcatagacctagctttggtgaaagaattctatgcaaatttatacagttctgaggatcatccaccaaagcagtccagagtcagaggtcatttggtgaagattgatgttggcagtctcaacacattcttggagacacctgtgttgcctatagactacagagagatagaggttgccttatgcatacctggccgagggttcatcttgaactcagaaggccatcctgggaagattctcaggaaggatatgactccactagctcaggtgtggagtgtcctctcctactccaacttggcccccacatcacacacttctgacttgacagtggatagagctaggttgatatttgacctagtttctcgcttggatatgaacataggagcgctgatctttggccaaatgacctctatagcccagtctaacacttctagacttgtgttccctgctctaatcatcgcattatgtagagccagaggagttgtctatgatagcctcacttttgaacgcctgagcccgatcattaacttggcctacatcaggaagaactgttggaaccccgaggatctaatagtttctattcgaggggctaggagggcaagggcaaggccagctgagcttccttctacttttgcagctcctactccagcatccacttcagcagccctttctgtcccagttcagacagattctcagcgctttgaa

SEQ ID NO: 70834 - DNA, 153 bp, Glycine max
  Peptide Sequence Number=SeqID_162519
tgtaatagacaaaaaggaagtactgagtgcggctattatgtcatgcactggatgtccaccatcattttaggaagcttcaagaataactgggaagcatattttaacgatcctagaccattggagccacagagattaaaggcgctgcagatctag

SEQ ID NO: 70835 - DNA, 189 bp, Glycine max
  Peptide Sequence Number=SeqID_162520
atgatagctaagaaggacttcgtggttggacagaaagttttattgtataactctaggctcggactcaagagtgagcttcaaggtcaatggacaccggctgaaaccattcctgacaaatccctgctgagtggatgtagtggtggaggagacctccttacttcaccctacttctcttccgccatgacttag

SEQ ID NO: 70836 - DNA, 1746 bp, Glycine max
  Peptide Sequence Number=SeqID_162521
atggcacgattatgggattcttcaagacatttggatgggggttattctcttgaaggacttacaggtgacagaagggtcatgtctagggctcagctgaaccatgaaaaggacttgattggtaaggtgtcaatgaaaactatatttagtaagaaaaaattgaaaaaggatggatctgagggtaaaacaagtatcattgctcctgttgaagagctacagagagatgagcgtataccttggatatgttattctgccttagatgctagcagcactttgaagctgtatgagagcctaaagagccatctttcagacatgccctggaaatttgatggtgtgccagtttatgggaaaaccatgtatgatttctacaatgaatattggtgtccatttggtgagcttctagtcatgatggaatctgagggaatgctagttgaccgggcttatcttgaaagcatagaaaaggtggccaaagcagagcaagaggtagctgttaatagattccgtaaatgggccactaggtattgtcctgatgcccagtatatgaatgtgggaagtgattcgcagttgcgccagctgctttttggtggcattgtgaacagaaaggactccaatcaaacgcttccaactgaacgaatattcaaaattcccaatgttaataatgtgattgaagaaggcaagaaggctccaaaaagattttgtgatataaagttgacgagcttaggttataatctggagactgagatgtacacagcaactggttggccgtcagttagtggtgatgctttaaaggccctggctggaagtatttccgctgattatgacttttttgatgaggattgtaacttggatctcgatgatgaagatgaaaatccttctcaaagtcaagttgcaccggtaaaaattgataaatctgcatatgggacagcctatgcagcttttccaacagaggaagaagggagagaagcttgccatgcaattgctgctttatgtcaagtctgttcaatcaactctttgatctccaacttcatccttcccctgcagggacataatatatcaggaaaagatctccgtgttcattgttccttaaatatcaacacagagacaggacgcttgtcagcaagaaggccaaatctgcagaatcaacctgctctagaaaaggatcgatacaaaatccgtcaagcattcattgctgcacccaggaattctcttatagttgctgattatggacagctggaacttaggattctggcacaccttgcagactgtaagagcatgttggaagcttttgaagctggtggagatttccattcaaggactgcaatgaatatgtacccacatattcgtgaagcagttgaaaaaaaggaagtgcttcttgagtggcatcctcagcctggtgaagataaacccccagttcctcttttgaaggatgcctttgcttctgaaagaagaaaagctaaaatgcttaacttctcaattgcatatgggaagactcctgtggggctttccaaggattggaaggtttctgtgaaagaagctaagaaaacagttgacctttggtacaatgatagaaaagaggttttgcaatggcaagaggagcgtaaaaaggaagctcgcgtgttacattgtgtttacacattgctagggcgagctcgacggttccctttgatggcccaagctaacacctatcagaaaggtcacattgagcgagctgctattaatactccagtgcaggtccttagctctttctaa

SEQ ID NO: 70837 - DNA, 459 bp, Glycine max
  Peptide Sequence Number=SeqID_162522
atgtaccctcctttgttctctttgaacaacctagtggatgtaccctccaccgaaactgatccacaagagatgtaccctctcttgttcttagtcacaacaacccaagtagatgtaccctctacttgtaccacaaaggatgtaccctccaatgtgttaagacaaagttctcaggcggttagtcctttgaaactttgtgaagggggaaacaaaagaattctcaggcgggagaagggagacacaaaagaattcaggcggttagtcctttgttcttttggaaaagggagaagagagacacaaaaagaattcaggcggctagtccttggtgaattctttttggcaaagggagaagagatgaaaagaatgaatagcacaagttttcaaggtttagaaaaccagaaaactttggaaagctttttggaacaaggaagaagaagaagttcaaagagactcagaaattaa

SEQ ID NO: 70838 - DNA, 318 bp, Glycine max
  Peptide Sequence Number=SeqID_162523
atgcgaggatatcgtatggttacccgcacttttcgtcaaccaggggcaaacgagcccattgatgcgaagagactaacatcgtcttctgcaccttttgccatccagggacagcgagtcaggtggcaggcggagataccttttggtcatctgcaccttttgtcaaccgaggggaacgaatttgacggttttactctcgtcgttcaaaaacattcaagcccgacgacgcgcgagattcttctcttctggacagggacgatcgaatgcaatggcatagggaagtgtcgtggttgtccaactttgtcgcttccaatacactga

SEQ ID NO: 70839 - DNA, 1512 bp, Glycine max
  Peptide Sequence Number=SeqID_162524
atgaaagctgatccagtgaagcaggagcaagaatggattggcagaaaccaatatgaggaggaaagaagcctaagattaacagtcataaccaatgacataataggtcagcgaaatgcagatcaactgatacagggtggagaagatgtgcagagcagcccccatgaagagatgtccagagtaacagttatcagcaatgacgtgattgatgagaaaaattctaaccaaaaaatccaggaaaaactgcagattaagggaagctgtgatgagggtttgaagaatgcgaatgaagcgaaagtcattttggagaattcgaagtcttctgtatgctcaatctgtagaagtaggcgtccatacagtggattgcaaaagaaatatacttatgaagaacttgaagctgctacagaaggattttcaataaagtattctctatgtgaaggtgaatatggacctgctttcagaggccagctagagaataaccaagaaatagttattaagcaacacacattcacaagcttacaagaacagaaggtctttatctcagaattccaattgctcataaatgccagacatgaaaatgtgatcatgctgttgggttcgtgtatacgattaagtcaattgctaattgtatacgagaaggcatgcaacggttcacttgaccagtacttatcaattcttgtagagttgattgccggccgtatgatagcagataaaatattaggacagaaatgtcttgttgaatgtttgtgcatttttaggcttcaactatttctattaattggaaccgcaagtcctaatgataggaacgtaaggtcacttcttggacgaagagagtatcgacagttggtggatcccaaagtcagaagctcctatgatgaacaagaacttgtttcattgttccacataacagaaaattgtctgaaaaagaatccaaaggaaagattcacaatgaatatggttgtctctgcactgccatgtgtagcaaatagcaatggcctctatgtaaaggaagacttttcaccagaaaactcaaatgtttcagatgcaaaaaactcaaaaggtgaagaggaatcactgaaagaaaacaatttaggaacagagaatactgaagaggtaaggatgaatcacagagaaggtgagaaagaggaatcattggaggaagaagatttagacacagagaatagtgaaaaggtaaggaggaatcacaaagaaggtgagaaggaggaaacactagaagaagaagaagatttaggcacagagaatagagaagaaagagtggaacaaataacttgtagtagaggcaataatgaaccagaagttagtcaagagtgtgatacctacacaaagtgtggtgaaattagtaagaaaacagaagaaaaagaaggttctagcaccaagctatgtcaaaaatgggaagggtgcttatcttatggtggagctagaaaattttatcaccaaggggctcaagaatacacagcatgtaaagaatttttcggctggtgtgattccatttga

SEQ ID NO: 70840 - DNA, 213 bp, Glycine max
  Peptide Sequence Number=SeqID_162525
atgtcgatttccaccgatgttaaaacttccttttctagtagtgaggaaatcgagaaatacgagaagctcatccaacggagaccagtcagggtcacgctattttgcgagaatgctccgaccatgtgggatcggcacaggcttacaggagcactcaaaccggatgacccccaaggcctacactctgaagagtccgtcagggcctctccctcctga

SEQ ID NO: 70841 - DNA, 285 bp, Glycine max
  Peptide Sequence Number=SeqID_162526
atggaagccatgaaagaccaaatgaccaccatgatggaggccatgatgagtataagaaaactgatagaggtcaatgcgattgcagtcgttgccacaagtaccgccattgaggtggacccgactcacccatctagtagcaatcaagtaaatcgtccaatcctggatatgagccaacatccccaatttggtcatgcacaagtccctaaacccatgggggagacacatgaagtaccccaagaccacactctggtcgacttcgagcctcacctcgaatacgccacttag

SEQ ID NO: 70842 - DNA, 156 bp, Glycine max
  Peptide Sequence Number=SeqID_162527
atgcagtatagactttcacgcttcatcgtgactttgacggcgaagaaaagaacgcaaggcatgagcaactatatggtaggagtatgcatgagtgaacataacatgcgactaatgacacagaagctttaccagcctctagagatatcatcctcttag

SEQ ID NO: 70843 - DNA, 261 bp, Glycine max
  Peptide Sequence Number=SeqID_162528
atgttggacgatcattcctgcatttttctgaggttgttttccggaacttgccaagtggagaatgataggtcttacatgaagtgcttgttggagttggacatcaagaatggcaagcgccctatggagattgatgatgttgaggaggatgagccccaccagccaagaaagtgtactaagaagttggattcttcccataaagttgaaatggctcgaatttcatttcaacgccaatctattgaggccaaggattctgttgtttga

SEQ ID NO: 70844 - DNA, 138 bp, Glycine max
  Peptide Sequence Number=SeqID_162529
atgattaacaagctctaccttgcattctggttgccaatatatgtcactggaattattgaagttggtaatgcagaaatcacagttctggacagtgatgttggaagtggtgaaacccagaaaaagcgtttttcaagttga

SEQ ID NO: 70845 - DNA, 426 bp, Glycine max
  Peptide Sequence Number=SeqID_162530
atggacatagactatgctataagtaaagatgaaccacctgtaatcactgatgaaagtaacccagctgacgttgcgctatatgagcgatgggagcgatccaaccggcttagcgtgatgttcattaagacaaaaatctcggcttggatacgtggttttgttgaccagcatgaaaaggaagaagaaaggcttgtaatggagatgggtgaaagtgcattgctgactactgcttatgggaagaacaaagcaactaagcctcaagctaatcagaaggggaatcgtaaaataccacctcaaactgatattaagaaggtggcaaagtgtttcttttgcaagaagaagagacacatgaagaagaattgccccagattccagaaatggcttgagaagaaagggtatgcaaaacctaaggaaaccagtgggaagtga

SEQ ID NO: 70846 - DNA, 342 bp, Glycine max
  Peptide Sequence Number=SeqID_162531
atgatgaaccatttgtttcaagtcaagcgttcctttgcaattggtgctggtgtcgtgacttcctttgggtaccgtaaagatcggaatggtcaatggctgaagaaagacgcactctctcctcaagatgagcgtactccttcacctctttctcagcgtgaagattcagcactcttgaatgaaatccttaccgaattacgaggtcttcgttcttatgttggtgaacgttttgactcattggatacacgctttgccggcatggatattcgcctcacacagcttgaagaggatgtaggttacattcgtcagagtttcgatcttccaccgccacctccaccttcttag

SEQ ID NO: 70847 - DNA, 291 bp, Glycine max
  Peptide Sequence Number=SeqID_162532
atggctaaaagacccagctttggagccaacatagagaagaaccccaaggaggaatgtgtggaagcaatgacttccaagatcattttgatgatgccaaagaatcaagagttaagcaagttccaaagaatcaggagtcaaaaagcttcaagaatcaacacaaaaatatttcacaaaatcttttaccaaagagttttactctctggtaatcgattaccagaaggtagtaatcgattaccaatagccaacattgctttcaaaattgatttacaaagttgtaatcgattaccatga

SEQ ID NO: 70848 - DNA, 120 bp, Glycine max
  Peptide Sequence Number=SeqID_162533
atggcaccccgattcctcgtgatagtacaacaacttagccctatcctatcaaggtcatcagaatcagaccagtttccactgttgaatgaccctaacaaagcatgcatctacgtgattaag

SEQ ID NO: 70849 - DNA, 162 bp, Glycine max
  Peptide Sequence Number=SeqID_162534
atggagcattttcttgagcaagtagcctggcctgaagctcaacttccattggtgagacccaacgaggctgcttcgcctgagcccacacctgtgcaggttgatccagagccagctgacccacaatctctagtggtgaatccaccttcttcttctgagcttgaa

SEQ ID NO: 70850 - DNA, 369 bp, Glycine max
  Peptide Sequence Number=SeqID_162535
atggccatattttgggaaattttggaccctagctcgcctaggctagcatctagcttgcctaggccatggaataccatcaaccttactagctcgcctaggcgagctattaccttcaaggctaaccatgaaggggaaggggaaaagggtttaaaaagtttagagaggaagaaaaacaaagggagaggaaggaaaaagaagaaaagagaagccaaggcactgccgaatcgcaaccgaggatcattccctacgttgtttcttttgctagccttgtaccctgtgcaacaaccggttcctgatttagggacacagagcaagctcaccgtgttttgtttccttgaccacatcatgcatctcctcataatgtcatag

SEQ ID NO: 70851 - DNA, 276 bp, Glycine max
  Peptide Sequence Number=SeqID_162536
atgcctctacatcttgcgctacccccggtgtatcaagtaggtatccccctcgcccccgtcaaagcaaatgatgcccgcctcgcgcagcgccttcaatataaacctcctagaggttaccataactttcatttgcttaggcctctgaggccacacattgttctattgagtgccccaggacacccccatgataagcgtaggttgtgttggggttgtaccatcaagggaaaggagactggaaaatcttcctggggatcaccaccgccatttggttggtga

SEQ ID NO: 70852 - DNA, 261 bp, Glycine max
  Peptide Sequence Number=SeqID_162537
atgcatggcaatatcaaggaaacaacacatagcatgtttgctccgtgcccctatttcaggaacctaatggggggaactaaaaaagctcgctatttagtgataattcccaaggtggttgcatctagctttcaaaggtttctagagatatcatcccctttgatatcaaacattggggtggtagggactagcagcaacaacatatcatcaaagagaaaaactctagatgaggtttcactgtcatcaagcaagtcggagacttag

SEQ ID NO: 70853 - DNA, 144 bp, Glycine max
  Peptide Sequence Number=SeqID_162538
atgaagatgaagacatatgctgaacccttccttcaggccccctcacgcctatttataggaaatgagggatggaggttgcacagcagttcgcccaggcaaactggttacttcatccttaagctttctaatgggcacgagggctga

SEQ ID NO: 70854 - DNA, 165 bp, Glycine max
  Peptide Sequence Number=SeqID_162539
atggtttttcacttaagacttgtaatgagcttcaaagcaaagaaaggggaacatatgctcaaaggggctatcaaaggaattaattcaagcaagaagtatcaacaagagtcaagccaaggctattacgcaagcaatcaatggggcaaaacacaccgaataaaatag

SEQ ID NO: 70855 - DNA, 213 bp, Glycine max
  Peptide Sequence Number=SeqID_162540
atggagagcttgaacttatctaacacctctatatatgcattgccggcatcaatttggggaagtacgaatctttcagaactttgcctacaagacaaacgctaccaggggagcataaaagagtgtggtgtcttcccagtatatgcttcggaatcaggggccaagctgtttggtagtagtagcaaggaagtttttgaatcccaatccattacttaa

SEQ ID NO: 70856 - DNA, 498 bp, Glycine max
  Peptide Sequence Number=SeqID_162541
atggccccaaagaaactcccttctaagagagctaggaagaccgctacaggagaaggatctagtacagctccacctgtagaaatcgaatttaatggatgccgctttcgaagcctactgaggaaggaattatggataagcgctccaaagtgcggggccaatggattccttatgaggaaggacaacaatgcgaatacactgagagaagaagtcaatttacaggcacccagtggacccagaaaagtccaactgggcactgggatttacagccttaatcataggcctctaccagttctacggagtaacaagacatttattgaaaaatattgcatgccaagacagtttagagccactattgcatggcctggagacagacctaattttcaagaggaggcaggacctgcaaatgctcaaggagctgcccaaggagatggaggaagagctgaggatgatgaagacatggcagacttagttgattatttaattggaggaggagactga

SEQ ID NO: 70857 - DNA, 651 bp, Glycine max
  Peptide Sequence Number=SeqID_162542
atggctcaatccaagaggaaggaaacaaatcataagtatctgacaaagaagaaaacagtcaattggggtggaaaggatactatggtggtcggagaaaagacccgttctggggtagataaaaggaagaagcctaaatacaaggtggggggcaaagagatgtttgagctaattttagtgtatcaaaacttggaatttgagggactccgtcagagtggtgttttgaaaggaacaaagtatataccaaatgaaggaacactgaggttcttagaaagagaaagagaccaaacctatggagatcaccaccaatacctctatttaatgaaagtactagcatggaattgtctatgtactggggttaaagcaagtatagttattgatcagacatgttttcatgctagttatgtggtggacttgaatgggaaagcagctggtatcttatggtgctcgagttgttggaagaagtcaaaagaagaagaattgaagtgctttggaggaaaattgatgaaaaatgaggaagaaaaagcattaaagaagagttggaagaattggacaacttgctcagcatgcaactctcgcttagcgggcaaagccaagctcgacatgaagtctcactcagtgtgcaactctcgtttagcgtgtagtctcacttag

SEQ ID NO: 70858 - DNA, 114 bp, Glycine max
  Peptide Sequence Number=SeqID_162543
atgtcagtgaaaaactttgttagacgcttaggagtacatgacaagacagaccacacactggttacagagatttggatgacgccacttccaaagagggaagataagtcagggtag

SEQ ID NO: 70859 - DNA, 507 bp, Glycine max
  Peptide Sequence Number=SeqID_162544
atggccacaacagcaaagaatgtggtggtgatccaggatgcatctaaaacacttaatttaagagttttttattggattataaatggcttatctcttaagccagaagatgtggtgaccctagttgcaatcctgcatgaggtttatcatcctatggggtacagaatcacggtggataacaagttgcttggggtaaaccagaggatcatcgagcaagagcttgcaaataagaaacaagactacctgatggatgaggggcttgctcagattgttaaacactacgcatcaaataaggttgcatttaagataaagttgtttccaggatcttcaccaaaagatgtggctttagaacaggccacaaaactcaatgcaacttgggtgatacttgacagcataaaaagacatttaatggcacgttatgatttatctttactcttcatggaggatttccaacacatagatgagacttatacacagactggaagaccacagataaaatactttttctaa

SEQ ID NO: 70860 - DNA, 291 bp, Glycine max
  Peptide Sequence Number=SeqID_162545
atggacgaagatcaatgggcgtatgactatgcgatgtcacaagaagttcatatggattatgattatgataatgaagaagaatgtggtgtgactgaaccacattgggctcgaacagttgccaatgaaaatggatttgttgcaatgattatgaggtctgacacagataccggaataaagaattcattagaaaagacactgggagtaggaaatgtggttgtccttcaggcttcgtgggaaactagtgcatggaggggaaggttggatggtgaagttgatttgtggtattcataa

SEQ ID NO: 70861 - DNA, 852 bp, Glycine max
  Peptide Sequence Number=SeqID_162546
atgactcacctcaacgcgccagtgaaaaccgcgcggcggcagcgccacggcctgcgcagcgtggcgcagcagggtgatgtggggatggaacggctgcgtactctgcgcacagccatgacgcgcggcctgggcgcgcagcagccacactacgccgggacgcggccagtgaccggcgtcatcgagatccagcgtaaagccgggctggcggatgcgtgccgccagctgctgcagctgatccgccgtttccgtgctggcctcaccaagaaacgccagcgtcaggtgcagattcgccgccgccaccggtttacccgcgtctgcggcgaagcaatcggcccgccattgcaccagctgttgctggagggcatcaggcaattcgagggcaaaaaacagttgctgcgtggcatgctaagctccggtaatcggctgccggtggtgttgcctcttagcccaggcagagtgggagttgaggtgagtgaggttacgcgcgtcaagcaggtggatttctgccttgcattgtggcgcgcgctggcagtcgcacaggtgctgctggccggccgcgccggcgccgggaaagtccaccatatggctgccgctacagctgctgacattgaagctgccggcaaatcatctggtggtggacgcgccgctggcggcggcgcattgacgtggcacagcggctggcgttggacccagctgggcaacagccaggtcgagacggcaggttatcgcgctggcggggaaaagacgcgccgcgtcgcctggcgccgagggattctgacctgcatctgctgcacgcagatcagcgctgcgtgcggcggcgctggtgagccgagatactcaccaattccatga

SEQ ID NO: 70862 - DNA, 1165 bp, Glycine max
  Peptide Sequence Number=SeqID_162547
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggactttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagatttcaaccaacccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggac

SEQ ID NO: 70863 - DNA, 1239 bp, Glycine max
  Peptide Sequence Number=SeqID_162548
gtcgactctagaggatcccacggttcctttgtgttgcagatggcctccaggaagcggaagagcattggggcaaggccaactgctcagtatgacactagacggttccattcgcttgatgcttggaaccgttatacaaataacatcttaggaatgagcattttgccagagaggaaggtagagatatactacacagagtttgatgacttcaagacaaagttggagagatgtaatcttcacaaacgcctcaccaacttggctgataggactattgatgttgctttggtgaaagaattttatgctaatctctacagctttgaggacccttcaccaaagcaagccaaagttagaggccacttggtgaagatagacacaaccagcctcaacacatttctagagactcctgtagtcctagaaaagggagagacattacccagttactctaggtactgtaggttaccatcagaccacagagagattgaggctactctttgcataccagggagggaccttaatgtggacagagccaggttgatctttggcatggtctctcaaatggacatgaacattggcgctctcatctcaggacagatgacttccattgcccagtctaactgttgcagacttgggtttcctgctttgattaccgctttatgccgagcccgaggggttgtctccaacagcctcacatttgagcgcctgagcccgaccattaacttggcctacatcaggaagaactgttggaacattgatgatctaacagtttctttccagggggctaggagggcaaaggcgaggccagctgatattccatctacttctacagctccagcacctactccagtatctacttctgcagctccttcagtcccagctcatgttcacgctcagcactttgaagccatgcttcaaaagcagttcttagagagggtagcctggcctggggcccaaccttctcttaatagggaaggtgaaggtcccatagcccaggtgagaccagagactgctactactcttgagagatcacctgagggaacatcagagcctcctactccagtggcagacctctcctcaccacaacctgcagctgacccttccactcccacacttgagataccaaaggacccgatgacaccagtcctggcactgaacacatctcctctagctactccagtacttcacttgacagatgaggaggatgctcagaatcaggatacccaggatctgtctcaggaattttaa

SEQ ID NO: 70864 - DNA, 318 bp, Glycine max
  Peptide Sequence Number=SeqID_162549
atgggaaagttggatcatctagaggaaaggctcagggtcgttgaaggaggcagagattatgcatttactgaagtagaagagttgttcctagtacccaaacgtggtcattcccaagtacaagatgaggaactgctgatacatttcttccaagaaagtcttattggggtagctgttacctggtacactaacttggaaccttcccgagtccattcatggaaggacctaatggttgccttcgttagcccaggtggcacccccaatgacgaaaagggagatgataacaatgatagtagacacattaatagtgttctactatga

SEQ ID NO: 70865 - DNA, 1237 bp, Glycine max
  Peptide Sequence Number=SeqID_162550
atggcgggcaaaaccctgtatgaaaagctgatcgaacagcatgtggtacgtcaccttgacgatgaggggcacgtgctgctctatatcgaccggtcaatcctcaatgaatacaccagcccgcaggcgtttagcggtctgcgcgaccggtcgcggcgcgtgcgccatcctgccaccattctactcaacgttgaccacgtgaacccgacgcggccagtgcgcgatgcggcgatgaccgacgcaggcggtcagctgcaggtcgattacttccgcaaaaatgcggagcactttggcatcgagctgtttgacgtgctcgacccgcgacagggcattgaacatgtggtggcacacgagcaggggctggtgatgccggggatggtgattgccgccggcgacagccataccaccacttacggggcgtttggcgcgctggggttcggcatcggcacctcggaaatcgagcacctgctggcgacacagacattgatttatcgcacgctgaaaaccatgcgcgttgaagttaccggcgagctgccgtttggctgcgccgccaaagacatcgtgctggcgttgatcgaacagattggcgcatccggcgctacgggatatgcgattgagtttaccggcagcgcgatcgatgcgctgagcatggaagggcgtatgacgctgtgtaacatggcggtggaagccggtgcgcgcggagcgattatcgcgccggatgacaaggtctacgcttacattgccggcaaaccgcaaatgccggtgggtgagctgtggcagcaggcgctggccgagtggcgcacgttgcgcagcgatgatgatgcggtatttgaccggcaactgaccattgattgcagcgatctggaaccgaaggtcacctggggcatcagcccggatcaggcctgcgccatcagcggccacgtgcctaatccggctgacgaacccgatctggtgaaacagcagtcgatgaaaaatgcactgcactacatggggctgcaggccggcacgccgctggccgacattgccatcacccacgcgtttatcggctcctgcaccaatgggcgcattgaagatttgcgcgcagcggcagcggtgattggtacccgcaaaatcgcgccgcacgtgcgcggcatcatcgtgccgggctcaacccaggtgcggcagcaggcggagccggaaggactggcggccatctttatcgacgctggcttcgagtggcgtcagtcggggtgctcaatgt

SEQ ID NO: 70866 - DNA, 185 bp, Glycine max
  Peptide Sequence Number=SeqID_162551
gagaatgatagatctcatccagcacaagtagttgcagcccagatacgcacactgctatataaacatgaaggctgcacgagttctgaaccaagtccgggattgaagattgatctctatagtgtgtgtagagttgatctttatagtttgtgtggagttgatctctattgttcagagagcaatctctg

SEQ ID NO: 70867 - DNA, 315 bp, Glycine max
  Peptide Sequence Number=SeqID_162552
atgattttacttgataaggcagcttgccaggctttgtggggtcatccagagtttgattgggagtggcaccctgctgtgaacactgctgggggaccatcaatggataatgttaaagctattaagactattctaagaagctttgagatggtatctggcctcagaattaattttgctaagagccaatttggtgcaattggccaatctgaggagtggtgcagacttgccgctgactacctgaattgtggccctctgcagtttccattatgttatctagggatgcctataggtatcaatcctggaaggaaggtggtgtag

SEQ ID NO: 70868 - DNA, 588 bp, Glycine max
  Peptide Sequence Number=SeqID_162553
atgtggccatccaggaggctgtttgtcctctttgtggttgtaggacctcttccagcttctccagcaagccattttgttcaattttgtgatggttttggtgcagcaataaaccatagtagatggtgtgggtggtgggttgctctaactagtactatatggcagaacaggaacctcctgattttccagggcaaaacttttgattcctctaaagtcatggaagatgctattttcctagcttggaaaggtatcctccttttcattccttcagataaatattccaaagtctatattagacaaaaatatcctctttttaaagctcgacctctgcaaattgaggaaaatcatcctcagcttcaagaaggtgataatgattcagcagctcaacctgttaatcaggataaggccaaaaaacagagcaatgaggaagcagaaaggaggctaaaaagcaaaattgaatgcagtatagagggtttagatgcacttggtctagcaaccatggagacagctgctgccagagttcctttcagtagtttcttttattcccctttaatgactaaagaagatataatcaacttgagaaacttctga

SEQ ID NO: 70869 - DNA, 204 bp, Glycine max
  Peptide Sequence Number=SeqID_162554
atggtgcaattatggtttgggattagggtggaaaaacaaatcggtggaccattcggtcctgccaacaaatcttattcggagacccatgaattgattgtcattcatgcatcctccaccaacgagtctggagccctgcgaattgattgcctagcgctattcgcttatcctccaacctcaaatcttattcggagccccatgaattga

SEQ ID NO: 70870 - DNA, 279 bp, Glycine max
  Peptide Sequence Number=SeqID_162555
atgtgtgtgtgtgtgtgtgtgtgtgtgtgtgtgtgtgtgtgtgtgtgtgtgtgtgtgtgtgtgtgtatccatggtgtgccatcttgcatagatttctacaggcggaccgttgggatcctgaaagtaataacttttggtctcccactcagtgaaaaaggcgcgctaagcacaattccaaccgaggggaattgcgctaagcggcctaaagcttcgctaagcccaattccaaccgagaggaagtgcgctgagcacccagagggtgcgctaagcgagccctag

SEQ ID NO: 70871 - DNA, 246 bp, Glycine max
  Peptide Sequence Number=SeqID_162556
atggggagcaatcaaaaacattctcatttagatcctagtgaagactacatcatggctaaagagccaagaagatttactctagaagattattcaagttctaatgtgccacaatttttcaccagcattgcacaagcagaagttcaagcacaaactattacttatccaccatcattgattcagttgattcaaaataatttgtttcatggattaccaaatgaagacccatatgcacatgtcataccctaa

SEQ ID NO: 70872 - DNA, 63 bp, Glycine max
  Peptide Sequence Number=SeqID_162557
atggctgggacgccacaggagaagccaaaaggtggctccactcatttaagggtaatagtctaa

SEQ ID NO: 70873 - DNA, 123 bp, Glycine max
  Peptide Sequence Number=SeqID_162558
atgaaagaacttgaaatggaattgcaaagactaaatcaacatgaagaaaatgataagaagaagaagggaattgctcttaaagcctcatcttcaatccaagaggaaagtgacttagaagattga

SEQ ID NO: 70874 - DNA, 291 bp, Glycine max
  Peptide Sequence Number=SeqID_162559
atgctaagtgcgaatcaacttgggcacatgagattcaattgtcctgtgtttaaaagaagaatggaaaattccgacaagatgaatttcaaagagaagaaagaaaagaaaggatacatcacttgggaagataatgtcataaattattcaagtgattcagagaagaaaatcataagtttaggtatcatgatgaaagactatgaaaatggagaagaacaaagtcgatacattgatagcaaattttccaaacacttggcatgcatcaaagtttattcatatttctccccaagataa

SEQ ID NO: 70875 - DNA, 453 bp, Glycine max
  Peptide Sequence Number=SeqID_162560
atggcacatcaaaaccccccatacttcgccttttgcactcctgggcaaaatgaaacaaagaacaaaatccaaggatatcaaagagagacaaacaaaaacatttacatatttctcaacgaacatcaaggaatgaaaggaatggtatggcccaaaaatacatcatcaagcatagccaacaaaaccccccacacttattcccaaaacaattccaaagctccaaaattccttaaggcttgtaatgagcttcaaaacaaggaaagggaaacaaggctcaaaagggatatcaaaggaattaattcaaggaagcatcaacaagaatcaagccaaggctattgtgcaagcaatcaatggggcaaaacacaccaaatgattatgatgatggatggctcaaattctcacaaaggtaaacttatcacttccaaattgagctttcaaaactatcatgacatgtag

SEQ ID NO: 70876 - DNA, 207 bp, Glycine max
  Peptide Sequence Number=SeqID_162561
atgccgaccttcgaggacgacgttcctaaaggaaagccctacaaggttccggaatttcaacaaacattatcgacaataacgaatcatgtggcttcgcatgccaccagactcttgggtcatggtaacaaaaggtgtggtggtcgacaaaagcagggcttttgctcctacgtatcctcaatttctgatgaggaactcaaacctacgtag

SEQ ID NO: 70877 - DNA, 225 bp, Glycine max
  Peptide Sequence Number=SeqID_162562
atggagcgtgaagctatacgatattgcttcaaaatcgagtccgaatacatggccaccaagaacttttacacagcaccatgcaaccgtcagcataggaagaacgcaatttcaagaatcgctatgtcatcgtcagtctttcaacggtgcatgccatctacgctttctagtctgtttggatgcatgcgttttaggctttcgtgcaagaatcctattccgtcattgtga

SEQ ID NO: 70878 - DNA, 614 bp, Glycine max
  Peptide Sequence Number=SeqID_162563
atgggtgaccaagaggaggtacaggaacagatcaaagccgacatgtcaactttgaaagagcaaatggcttccatgatggatgccatgctaggaatgaggcaactaatggagaagaacgcggccaccgctgccgctgttagttcagctgctgaagcagacccaactctcccagctatcgtgcaccaccctatcccagacgtggtaggacaagaaagaagcacactggggcacatcagtaacccccatctggaatacaaccgagtggcttacccttatggattgacacctaattacacaccaccagtcatatgtgatgacgcgggtcgtgtccctccccccatccttgaaggagaacctcctcgacagtcggacgaggtccacgaggatcgtcgggagcatgcccaaggagacatcaattcccactccccgttccccgccgaggagccggcgcttaatgcactacctcagcccaacctcatgggaaaacctcgaaacccctcagcacagccaatattcttttccgcatacgagccacccccggtagccaaagaaaggaggaagctcgatctcatcgaaaagagattgagggttgttgaaggctttggcgactaccc

SEQ ID NO: 70879 - DNA, 171 bp, Glycine max
  Peptide Sequence Number=SeqID_162564
atggctgctatcggaggagttgggttggatgatgaagagatttcatcagttctcgccctttttctcgatgccatctacaagaaagggatccaaacaactacaaaagtcaaggtcgttcagcttagaaaatgccgcaacgaattacacttggcctatggaagctcggcttag

SEQ ID NO: 70880 - DNA, 375 bp, Glycine max
  Peptide Sequence Number=SeqID_162565
atgtacgactaccatgagaaagaaagaacccctgatcttgaaagtatattgtcagacttcatgacataccaagctagctctaagggttactgttattctatgcaacagcagggaactcaatttgaaatggactattcttctgcagattatcaaagggagtcacaatggcaaactaattatcacaatgaagcagaaggatttcttaatctgaatgatctgttaatgcaatttagggatacagtagagtcaatgcaacaagcctttagaaggattgaaactcagattagtaagttggtagataacatgactaatgcggtggccataaaagaggaagagcatgcagagattgaaatacatcaagaaagcattcttcaa

SEQ ID NO: 70881 - DNA, 384 bp, Glycine max
  Peptide Sequence Number=SeqID_162566
atggccctgaggaaacttgcctcaaagagatccaggaaggataaggcggccgaaggaactagttccgctcccgagtatgacagtcaccgctttaggagcgctgaacaccagcagcgcttcgaggccatcaagggatggtcatttctccgggagcgacgcatccagctgagggacgacgagtataccgatttccaggaagagatagctcgccggcggtgggcatcactggagggcgtgcgagttatgaggtcctgggtgaggggtcagtggatcccgtttgatgcagatgctatcggccaactcctgggatatcctttagtgctggaagagggtcaggagtgcgagtatggcccgaggaggaaccggtccgatgggttcgattga

SEQ ID NO: 70882 - DNA, 546 bp, Glycine max
  Peptide Sequence Number=SeqID_162567
atggatatgaatcttggatccttcatttccagtcagattacactcatagcacaacatgactcctcgaggcttggttttcctgccctaatcactactttatgtaaagccctgggagtccactctgattccttgacccatgagagcttgagtcctaccattaatttggcttacattaagaagaactattggaatctcgatgatccaataataactttcagaggacccaggaaggccagaggaaagagatccgaggcctcttccacacttcctccttcttcctccatagagatcccaatgattcctcctgcacccacacagataccactaccagctcctctttctacagggggtggggcctccacaacccaggagcctgtgactgaggagccaccagcaccagcaccatcaccagcagcagcagaggaggagaccattccagctcaaaccccacaaccatctccaccatttgcacttgctcctgaggagactcagcaatcagcattggatcttaatgaagaccagccacaggaggagcaggacgtttaa

SEQ ID NO: 70883 - DNA, 213 bp, Glycine max
  Peptide Sequence Number=SeqID_162568
atgcatcttcgctctccatgtcttcttcttcagcgtcacgaccaccttgtccaccaccttcatggtgtagaagcaggtgtggtcgaagtcgtagcagtcatggcggaggtggcaaaggtagacactgttgatgtcgtcaacatcgatatacgtgacggagaaggcggaagtcacagaaggattaaacctatgtgggaggaagtgagagaatag

SEQ ID NO: 70884 - DNA, 576 bp, Glycine max
  Peptide Sequence Number=SeqID_162569
atgcagggagggcatggtctccattcaacactctctgcccactccaaaaagttcattggtattcttaatggtattgatactgatgcatggaatcctgccaccgatgcatttcttccagtccagtacaatgcaactgatcttcaagggaaagcagagaataagcaagccttgagaaggaacctaggtctttcatctacagatgttaggaggccattggttggctgtataacaagactggttccacaaaaaggtgttcatcttattagacatgcaatatatctaacattggagttgggaggacaatttgttctacttggttcaagtccagtgccacacattcagaatgaatttgagggcattgccaaccactttcagaatcatgatcacataaggttgatattgaagtatgatgaatctctctcccatgtcatttatgctgcgtctgacatgttcatcattccatcaatctttgaaccttgtggcctaacacagatggtctacaagcgagttaagggcagatataaggaaagggctagattcagatttgggaaacaagacctggggtttctgaggtaa

SEQ ID NO: 70885 - DNA, 546 bp, Glycine max
  Peptide Sequence Number=SeqID_162570
aacaattcttgtaggcaccaaattgccgagatttccgacatgtatcttcaaccgccaagctcaaacgccaaggtgctacttttgctgcttgcagtcgcaactcgtcttgtcaagatcatcggtgttgctctaacagcttatggaggatcaggtaataagaaagtcaacagcagcaagcagggaagagatcatctgagccataaagaaggcactaccaacatacacaacatgcacaaaggggatcaaagcttacccaacacctctgctgttacaaccaacacttctgacgaccaaattcttcgttctgctggaactgaaaagcactctagtagcgttaacaatggtactgaggatgcctttataaactcaggaggcggacatcaatacttcaaggaggcggagttcaacactggtgtgcaagttgccaaggggagacacgctccttgcagtggtaacaatgggactaaaagttcttttcgcaactctggttcgggaaaacaggatttcggaaatgctaagtttaacactggtgctaattacaactaa

SEQ ID NO: 70886 - DNA, 547 bp, Glycine max
  Peptide Sequence Number=SeqID_162571
atgaaggtaatctttcgatttcaagatgtgatagaagtggtacaaaaagaggttcaagaacctgaaaagaacccaactgatgtacaaaaggtggctcgctgtgatttgatgaaaagagatgcaaaggcattgttcattattcatcagtgtgtagatgcgataatttccaaaaaaatcagatatgttgatactgcaaataaggcatgggatactctagagaaatcttgcgcaagggataacaaactcaagaaggtgaagctgcaaaccttgagaaacttggggatcattgacaaggtattaagaaccttgataccaagattcgatcatatagtggtggcaattaagcaaggccaggatcttgaagaaataaagattgaagaactgcacggaatacttgaagctcaagagattaagctcaatgaaagaaacttacaaagatcagttgagcaacctatgcaagcccaaacaaccaaagggaacaattatgatgttggcaagaataagaagggaaagggaaagtggaagaacaataagtggaaggggtcag

SEQ ID NO: 70887 - DNA, 540 bp, Glycine max
  Peptide Sequence Number=SeqID_162572
atgtgtacagttaaaaaggtgatatggaccttccgacttcccgtgacaaaagacgagaccaacatacaacgcatgcgtgaagacatgatgcagatgcgccaaagcgtaacatggggatcgtgttcgcttcgtgcccctattttagggacctacatgggaggaactaaaaggcctttagtgataattcccaaggtggtcatatctctcttgatggtttctagaggtatcatccccttcgaaaaacatattgcggcagtagggactaccaacaacaatatggtatcaaagagaaaaactctagatgagggttcactgttatcaagcaagtcggagacccagcatgaccacagattcacctccactccttatgttcctatggactcgggtataggaccccttttcaactcaccgtgtgtgcaaaaaaggtgttggtgttgtgtgcatcaaatgaatacatatttatcacatgcatacattaaaacatgcttaaagcatcgaagaagtttattcaagaacataaaggaaaagggaaaccgatga

SEQ ID NO: 70888 - DNA, 378 bp, Glycine max
  Peptide Sequence Number=SeqID_162573
atggcttcaaagagagagagaatcttgaaagcgacgtggttgaagaaggaaacagggaaagaagaaaggctcttccacttgaatattgcagcgcccaggagtgtgaaattgtgggagtggaatcaaaaattcagaactgctcctccgcgtttggattattgggtcacgtacatcatggtggggcccgcgttgagtccagcgtgggttctggcttgggggtgtcaaatgaaacgtaacgtaatagtgccaagtggggactttgttctcgtcgctgctctctcggtggtttcgttggtgagaagtagcggggaagtgtttgagtggctggcgaagcttgtcaaagatgaagcgatagtcaaagtctgtttgaagaggtga

SEQ ID NO: 70889 - DNA, 540 bp, Glycine max
  Peptide Sequence Number=SeqID_162574
atggctgcaactctcactgctgtaagaattcccactttccaccaacgccatctcaaacaacacttcacggcaccctcttcctcttccttacgcctcctcaatctcgcaaagatggaaggaagtgagatcagtgagcaagtagtaggggaggatttgggagcaaagaagaaagtttttgtagctggagccactggtagcactggcaaaagaatcgttgagcagttactggcaaagggttttgctgttaaggctggggttagagacatcgacaaggccaagacaaccctttcctctgccaacccatctcttcaaattgtgaaagctgatgtcacagagggttctgataagctagctgaggccattggtgacgattcagaagcagtagtatgtgccacaggctttcgcccggggtgggatttacttgctccctggaaggctaaggctatatgttttatccgagagtggaagacaggattagcactgagatttgtggcaccaagattgtcacagtatatgactggattggcagtgggcatgtga

SEQ ID NO: 70890 - DNA, 153 bp, Glycine max
  Peptide Sequence Number=SeqID_162575
atggacaatttggtgaaattggagaaagagctagaaggtttactatgcggtggggatccagttttaaatgctaggaagctaaacaaggctgagaagtattcgtcgatatccagagacaaatcttggaatcaaaagccccacctctgcaaatga

SEQ ID NO: 70891 - DNA, 1473 bp, Glycine max
  Peptide Sequence Number=SeqID_162576
ggcggccaatgcggcaaccagatcggagccaagttctgggaagtaatctgcgacgagcacggcatcgaccacaccggaaagtacagcggcgactccgaactccaattggaacgcatcaatgtctactacaacgaggccagcggcggaaggtacgttcctcgcgccgtcctcatggatctggagcctggcacgatggactcggtcagatccgggcctttcgggcagatattccgccccgataattttgtgttcgggcagtccggcgccggcaacaactgggccaagggtcactacacggaaggtgccgagctcatcgattccgtcttggatgtcgtgaggaaggaggccgagaattgcgattgcttacaaggtctccacaattccattcatttcattttcagggatgctctcacttgtatacattattttcatcgtatcactgttctacgtgggatctccaacaattttgtgtttattttgtacatgattattgtgttcaactgtgatcatttgaatttcattgtgttggctattacagggtttcaagtgtgccactctttgggaggtggaactggctcgggcatgggaacgcttctcatctctaagattcgggaagagtaccctgatcgtatgatgttgacgttttccgtttttccttcccctaaggtgtcggacactgttgtggagccgtacaatgccacgctttctgtgcaccagcttgttgaaaacgcggatgagtgcatggtcttggacaatgaggctctctatgatatctgtttccgtacattgaagcttgctacaccaacttttggggaccttaaccacctcatttctgctaccatgagtggagttacttgttgtctacgtttccctgggcagctgaactctgatcttaggaagcttgccgtgaatctgatcccattccctcgtctccatttcttcatggttggatttgcaccattgacatctagaggatcccagcagtaccgcaacctgactgtgccagaactgactcagcagatgtgggattctaagaacatgatgtgtgcggcagatcctcgccacggtcgttatttgaccgcatctgcgatgttccgtggtaagatgagcaccaaggaagtggatgagcagatgatcaatgtgcagaacaagaactcttcctactttgttgagtggattcccaacaatgtcaagtctagcgtgtgtgatatcccaccaaagggtcttaagatgtcatccactttcattgggaattcaacatcaattcaggagatgttcaggagagttagtgagcagttcacggcgatgttcaggcgcaaggctttcttgcattggtacactggtgagggaatggacgaaatggagttcaccgaggccgagagtaacatgaacgatctggtggcagagtaccagcaatatcaggatgctactgctgatgaggaagagtatgaggatgaagaggaggaggcttaa

SEQ ID NO: 70892 - DNA, 568 bp, Glycine max
  Peptide Sequence Number=SeqID_162577
atgaaccacgacgatgatgttgtgatcgatattgaggcgatactggaggggacagagccgcacgtaacaaaagagtgttgcatctacaaagtgccctttcatattcgcagactcagagaagatgcctacactccaaaggttgtttctataggccctttcaaccacaaccgccatgttcacctccaaaacatggaaaaacacaaactcatgtactgcaaggcatttcttaaacgaaccaaaacaagttcggacagctggatgagctacatagaaggggtggagcccaaatttcgtcgctgttattcagaaacccttgagttcaggaagaaagaactggtcaagatcatctttgtggattccggttttatactcgagctcttttggagatcttgttctgaatggtcgccagaggacacgtttctttcaacaccttggttgtccaataatatgagaaaaaacctttttttcgttcttgaggatctctacaatatgtccttcactggctcatctaatatccctccatttgcaaggcttacgttttgctattttggctattacaatggatgcg

SEQ ID NO: 70893 - DNA, 228 bp, Glycine max
  Peptide Sequence Number=SeqID_162578
atgcagtgcttggtaaatgaacattctcgtaggagcgttattgcaatggcccaacattcaagccagtgggtgtgtgctgaaggagttgtgttgcttgagagatcagctttcatttgttgcaatcctgctcctgctctgtatctatcaactggcttccgggttcaagctaatacgttgtgtggattgtaccctgtggctcaagcagcctttcactttctcatgacatga

SEQ ID NO: 70894 - DNA, 900 bp, Glycine max
  Peptide Sequence Number=SeqID_162579
atgtggactctcttgaaagaaagtaactacaacaatggagtggcaggggttctttcacttcttgtgagatctgaatcagaatatgacattaaacagccagaggataactttactatagaagagaattataatgagaataaggataagaatgatgttggtgacaacacggatgcagaaaaagcaaatgatgatgatgatgatgtagtggatgaccatcaagaggaagcaaagtacttaccagaggatgatggtccaacggctacagaggaacaacactacaaaggtccagtcacaaaagatgcagatgaaaagaataagcctcctacacgacatttcatccatggatatcacttgatccaaggacagatgaatcaacacaggaatctcgatggttatgacttagggttgtatgcaatatttgaaggtcactccgtgcatgctgttaagaaagcatgtaaagccatggatgatgagattttagaaagcatagctgattctcgtggaggatcaacagctgttgcagcaatactaattaatggagtaaagctactggtagtcaatgttggtgattctcgagcaatatcatgcaaaaatggtcgagcaaaaccacatactgtggatcatgaaccagagaaggaaaaagatcttattgagagtagaggaggttttgtgtctaagaaaccagttagggaatgttcccagagtggatggccaattagcaatggcatgagcatttggagatggaaaactgaaggagcacattacggcagaaccattcggaagatcgatgaagacactgaattcatcattttggcaagtgatggcctatggaaggtacgaggatattgcatgtatcttatgattactgatgaggacactttggctgaagtagagcactaa

SEQ ID NO: 70895 - DNA, 2551 bp, Glycine max
  Peptide Sequence Number=SeqID_162580
ggcttgctatgtggtggaggaagtgaaggagcttcctcaaactgaatgtccaggattgagtattccacaaatgggtccttgcctttatcgttgcacattgcagcttccagaactttctgttgtttcagggacctttaagaaaaagaaggatgcagagcaatctgcagcagagattgctatagagaagcttggcatttgtacagaggccattgatcccactccacaggaagcacaagaaagtttagtatctcgaattgcctacatattttctgaaaagtttgttgtatgtgatcatccactcagtggtcacattcgagcaactttgttgaggaaaggtgatctttgtggttccattcctatttctgtcattgctttctatgatgcaaagcttttcagcttgtgtaaatgtattaatcctgaggtggagtcaaacccatttttagttatttcatacataatgaatgccactgcaaacttacaccagtttcttgctacttctgaacgacatctctggattagaaggctgagtccatatccacaagatattatagagtcattgatgaaagaaaatggttctcaagaatgcattcaggttactgccgtacacattcctagttcagtggaacaatctattgaagcagtgactcttcatatttcttcaagagaatattaccttgatatcattgcatatgaacttggttttgaagatgcctccaatgttctgatttcaaggaatttgggaaaagcttcttctgagacaaggctgttctttactgcttcaaaatcatatctactggatctatcttctaaatttccaaatggaaaagaaaccctttatttaaagggatctctgaatgtaagggcaagttacttcgcggggcaagatataactggtgatgcaatattagcatccattggatatacacggaaatctagagatcttttctatgaggatgttacggttcggttatattacaggcaatgctcgcatctgagttgccatcaagattcacctcaagagcaaactggaggggttctcttcccagggatatactttgttgcagaatctgatgagaatgtgattgaatgtgtcaatggggattgttataagaagcagaatgatgctattcagaatgcttcattgaaagttctatcatggctgaacatgtgttttaggagtatgattctcccttttgagcagctttatgagactgcagacaactttaatattcagatctatttcaaaaacattatcagagatattttagcaggccaatcaactcacaatggtcagcttaatggaattcaatgcaataatttagttgaatcaatctatatgaattcttcatgtgacatgctgggaaatatagtgcactcgttaaagattgaaggtccatattctggtgtctgtccatccaatggatctttaccttgtataaggtattcagtttctttggctgtagagggtgagaatctgaaagaagttattgaagtttgtgatgagtttgagtttgaagtgggaattggtgctgtggtttcctatgttgaagatgttgtgatgcagatgtctgttggtcagtgcgcttatttctcttcaaacttacttactactgagttgatttttgcttcagctggtgattcagtcaaaatgctggcctcgttatcttctaaagactgttgtatggaatatgaaataagtttgatcagggttgctgaacctcctgaggaaagaatggagcaggctctttttagccctccactttcaaagcaacgagtggaatttgcagtgcaacaaattctagaatcccatgctactacgttgattgattttggatgtggttctggaagcttgttggaagcattgttaaattatccaacgtctttaaagaaaatggctggtgttgatatttcacagaagggtcttagccgtgctgcaaaggtacttaattcaaaactagtcacaaattcagatgctggtgggcaattgacaagcatcaaatcagtaattctttatgaaggttcgattacaaattttggctctcaattgcatggatttgatatcggcacttgtttagaggtgattgaacatatggatgaagatcaagcttgtctatttggggatgtggcattaagttcttttcgtccaaggattctcattgtttcaacgccaaattttgaatacaatgtagtactccagaagtcgaatcctccaacccaagaacaagaggaatcagacgagaaaaccctcttacagtcatgtaaatttcgtaatcatgatcacaaatttgagtggacaagagagcagttcacccaatgggcatgcgacttggctgctcggcacaattacaatgtggagtttagtggggttggtggttctgctgatgttgaacccggctatgcttcacagattgccgtgtttaaaagggattggaaacttgaagatgatgtaatcggattgccggtgtttttgaaagcagacaagcaggatagattgtggatgctaggagagaagagaaagagaatttacaggtttaggcagggcactgattag

SEQ ID NO: 70896 - DNA, 1038 bp, Glycine max
  Peptide Sequence Number=SeqID_162581
atgggtttcaccttcagcaccatgaccctcaacctggtcctcctaatggccatggttgccaccaacatcctctccctctaccacctctcctccaccctccaatcccccaaatcccccaaaccacccccaccagtccccgaccaactcctccaccagctccacaccatacgcgccaccatcagtcacctcactcgcctccagaacacccacaacccagcacaaaaatccaccatcccctcagatctactcttatactcccacctctccccaatagcctcttcttgccacaaccaccccgaactcctccacaagtacatgacttacattcccttctctctctgcccctccgattctgacctcgccgaatccctaatcctacgcggttgtcaccccctcccccgccgccgctgcttctccaaaaccccgcaaaaaccccccgtttcccttcctgaaaaccccttcccctcctccctccctgacaacgccgtaatttgggaccattactcttgcaaatccttcgattgcttgaacaaacaaaaccccaacctcggttttgaaccttctcgggatatttcgaggttcaattcgtataagaccgatttggatctcccgatccagcagttgttacagatcgcggcggccgcgaagtcggcgctgcgcctcggcctcgacgctccgcaacgtgaccgtggtgaccacgaccatgaacgtggcggtgccgaacagcgaggccgtcgcactgcgggggctcgtgccgctgcacgtgcccctgcagcagcggctgccgctgttcgacggcgtcgtggatctggtgcggtgcgggcgcgccgtgaaccggtggattcctttgacggtgatggagtttctgctgctggatgtggacagggtgctgaggggcggagggtgtatgcgccgttgattgggaaattagggtacaagaaggtgaagtgggcgacggggaataagaccgatgccagtggcgtcaagaatggagaagtttacttgactgcgttgctgcagaagcctgtgtccagatga

SEQ ID NO: 70897 - DNA, 318 bp, Glycine max
  Peptide Sequence Number=SeqID_162582
atgggaatgggaacgtaccatttggttgggtgtgcagaagaaaccctagcgggtgctctgatgctgatgcagcaggaagaggaagaggtcgcgttagcaataagcggttgtttgaggactgctattaagccaatactagctcttcacgaacttcacaaacactcacggtggcaagaggttgatgaggccgtcgcggtcgatttcgaggtggtccatgacacagcgaagctcctccggcaagacgacagatccaagcgtcgtttggactgcgctgttgagctcatcggcgaagatcttgctgtcgttgttggcatctaa

SEQ ID NO: 70898 - DNA, 303 bp, Glycine max
  Peptide Sequence Number=SeqID_162583
atgtcgagctcgcactcgggatgtttgatgagttcctccaagagctccagaggcgcagatgggaccagggcctgtctcatatatggcttggtgatgaagatggacctggatgtgggcagtttcatttcccaacagatcagtctgatcgcccagtccaatgttgaggtcccttcatatgggacaatagctcatcatggagaacatgcacatgctatccctacacctatagatggacccaccgctcatcactccaaaggcttatcgtcagcaggtcgcttggccaggagactagtcctccactga

SEQ ID NO: 70899 - DNA, 183 bp, Glycine max
  Peptide Sequence Number=SeqID_162584
atgattcatgaggagggagaggccttgacggactcttcggagtgtaggccttgggggtcacccgatttgagtgctcctttaagcctgtgccgatcccacatggtaggagcattctcgcaaaacactgtgactctgactggtctccctatgatattacctagtgagagtgacttgacttgctag

SEQ ID NO: 70900 - DNA, 249 bp, Glycine max
  Peptide Sequence Number=SeqID_162585
atggcagcggaatggagaaggaagagagacaggagatgccacttcaaggagaagatgagtctagaagaagctcaccaccataggaggccatggataagagcttggaggaagaaagagatgaatgaagggataggaagagaagagcacgaaattttgtgctctaaaagagctctgaacccactaatccaagatcatttccaagattctccactaagtgtgcttaggtgtcatgaggcatgtaaagcatga

SEQ ID NO: 70901 - DNA, 567 bp, Glycine max
  Peptide Sequence Number=SeqID_162586
atgttggaaagttattcaggagtcattaacttgcaattttctgtgcttggccaattgttgttgcagtgtccaccatttcggttaagctaccaggggctgggagagcccttgtgctttgcagcatttgggccttttgccacttgtgctttttatttattacatggcagttcaagtcatttccatcaggtggaaggagacagggaggttgggaaaatgtcacctttggttagacttggcactaaaaaaggtgcagaggtagtgaaaggggcaatctttatgctctatgctcttttggttgcttttggtctaatcaaggcacttcctctcacttgtataattttcatggctaagtacttctgtgtgaggcttcatgcattgtttggagttgcactggctttaggactagtgctggctcgaaagagtgtggatgaccctggaagaccccctggcattgttcttagtgctgccacttctttttggcttcctgttcctcctaaacgagtctttgacttcctccgtgatgaaaactctaggaatgaggtatgtgcaaaaattccaaaaagctaa

SEQ ID NO: 70902 - DNA, 231 bp, Glycine max
  Peptide Sequence Number=SeqID_162587
ggtgcatgagtggtaatcgggatgtttttgttgcacggctccatgcttgcgcatgccaacacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 70903 - DNA, 138 bp, Glycine max
  Peptide Sequence Number=SeqID_162588
atgggcaggatcgtcttgagctaccttctgggggtagagacaaaacatgaacagcagaaatcaatcaaggtacttaggaacgggtgcaagtggggatggagtcacgaccgactgatcgttgccctttccctgcgctaa

SEQ ID NO: 70904 - DNA, 453 bp, Glycine max
  Peptide Sequence Number=SeqID_162589
atgaaggaaggcataggtcacatcttagacctcactcccataggagagaaaatgaaagaaagcctcaagaggttaacattaaactcccatacttccatggggaaggacaatgtagaggctaatttagattgggaaataagggtagagcaacaacttaaaaggaagtctacttcaaaatcttatgggtctcactcttatccaaagaaagaccaaggtcaaggaatcttagggacacttgctagcattgccacacctcttgggcttgagtttattcctcaagtaaagaagttgttggatgagggtttggttcgcaagagcttaaatccttgtactttgttggtgcccaaaataggtattattaggcaccaagtccctaaaatgggtggtatgatgaatgttttgagtggtgcaaccctcttttgtaaaatcactcgtacacctaacatcttcatg

SEQ ID NO: 70905 - DNA, 199 bp, Glycine max
  Peptide Sequence Number=SeqID_162590
ggcattgggtagaagactccaagtagattgggctagagatccaagggatggccctagggttctcttgagccttaggctaagctctagcttctcatctcaaggagtgagcttagctattagagagcttctcaaggaagttttctcaaagaagcttctcaaggaagttttctcaagaaagcttctcaaggaagctacctag

SEQ ID NO: 70906 - DNA, 324 bp, Glycine max
  Peptide Sequence Number=SeqID_162591
atgttaggattcacaagcagttctcctcaattttcagccagcccgcatcaattagactttccaccttacgcttcaaggtcatacagtgctcaatggaatgtccaggaactcctccatgatatgcacatgttgcatttgagtcgtatcctcggaaaaatggaggttgaggaaccctggcaggggttatggctaccattgcattatcaagtagtgtttgggcattgggaatgtggtaagcaggcatgccttatggctgatttggggatggcttttttggatgattgggtgatgggtaatgagaagggcagttatgggatcctctag

SEQ ID NO: 70907 - DNA, 426 bp, Glycine max
  Peptide Sequence Number=SeqID_162592
atgaatcgaaaggatcaatcgagaagaaaagtgaaaaagccttgcaagcacagtctaatccaaagaagcatagtgatagatggaagaaagagaaaactgaatggaagagcaataaatggaggggaaatcataacagtgataaggaccacaagaaaggaaggggatccaattcccaaaactcttctaatagaaagaagttcgacaaaagaagtattcaatgctttaactatcaaaagtttgggcactttgctgatgagtgttacagaaaacccaataacaaaagagaacctaaaggcaatgatgcaaaattggctcaagaagaaaatgaggacattgaacagcttgacggctcctcaacagaatctcactttctgcaccctaatgttgtcattctgctcccacgaacaaggttcgcgatcattatag

SEQ ID NO: 70908 - DNA, 208 bp, Glycine max
  Peptide Sequence Number=SeqID_162593
ggaatggcaaccaaaggtaactacaattgcagaatcaagagatctcgctaacatgtctcttgcaactctgtttggaaagcttcaggaacacgaaatggaacttatgagactaaaccaacatgaagaaaatgacaagaaaaataaaggaattgcacttaaagcctcatcttccattcaagaagaaagtgacaaagagaatgaaatataa

SEQ ID NO: 70909 - DNA, 540 bp, Glycine max
  Peptide Sequence Number=SeqID_162594
atgactaggggcaatccaggtgatttacaaccctttgatcctgaaatagatagaacatttcatagattattttggcatagtgtgcatcctgatcattctgtgcattttatgcattctgagcattccgtgcattctgtgcattctgagcattctgttgatggtgattctaaatattctaattttgagcattcggctgctaattttcatactgagaacatggctcaacctccacctcgtgagaggactcttagggagatggttgcacctgacttcacttatgaaagcttgtgcattcaatatcctgatgaggatgttccatatgttctcaagactggactaatacatttgctgcccaagtttcatggtcttgcaagtgaagatcctcataagcatcttaaggagttccatattgtctgttccaccatgaagccccttgatgttcaggaagatcatatctttttaaaggcttttcctcattctctagaggtagtggcaaaagattggctgtactaccttactcccaggtccattgccagctag

SEQ ID NO: 70910 - DNA, 501 bp, Glycine max
  Peptide Sequence Number=SeqID_162595
atggaaaatcctaagcaaacaataaaatcaaaaataatgtgctacaattatggaaaacaaggccacattagtaagtattgtagactaaagaagaaattaagaaaccttaacctagaacccacaatcgaagaacaaataaacaatttgctcatagaaacttcggaggaagaaacagaaacttcatcctccgtactttccgacgaagatctaaacttaatccaacaagatgaccaattatcatcgacggatgatgatgataggaaaatcaatactctaacaagagaacaagatctcttgtttgaagcaattaattccatccccgacccccaggaaaagaaggtttttctggaaaaactcaagaaaacattggaggtaaaacctagacaaaaagattttattacaaacaacaagtttgatgtaagtaacatactcaaaagcttgaggaaggtagtgattttgaaagtaccaacaacggtgaggaaaaccaaccagaaaatctag

SEQ ID NO: 70911 - DNA, 249 bp, Glycine max
  Peptide Sequence Number=SeqID_162596
atggcagaacaagctaaacaagtattttatgttgaagacccttgtgatgaaaggtggaaaatggctacaccacctagcttccctcctcctcctcctattgattcaacatcacattcaccttccaccatgaggaggaaaagaaaagagacccggctaagatcattggctactagaccaattggggcagagagacccctggtccatgtggatcctgcaattgggaaagtcgacggtccccatagaagttaa

SEQ ID NO: 70912 - DNA, 384 bp, Glycine max
  Peptide Sequence Number=SeqID_162597
atgacaagtttagcatgctttcaacaaattccttcacaaataactaccataaggcataaacttggtagaactacccatcatatctcccaaaaacccaatacccacgaaatttatgtgagaagaagtctacccaaacctgaaattgaagttccacaacgtagaggtgcgcttcacgactctgaaaatggcttccttttgcaatatggagtagaaatggtgagcaaagtttggagctttaatgggcaacaatggtggatgagaaggggagaagaaaagcaaccacttgccacttgtcccattttgagtggaacaaaaaggggcccacctcttccccttgatgtgactcatactcagccacgagaagagaaaaatttgaccttttga

SEQ ID NO: 70913 - DNA, 240 bp, Glycine max
  Peptide Sequence Number=SeqID_162598
atggccaaaatacaaggcctaaaagaaggaaaaatctattctaatatttacaaagaagagaggacccaacctttgtccatgggctcaaaaatctaccctgggattcatgagaaccccaaggccttctttagaagctctagcccaatcctcttggagtcttctatccaatacccttgcggggtaggattgcatcaattaataatggtcgctcaattttttgttggcaaagttgctcaatga

SEQ ID NO: 70914 - DNA, 216 bp, Glycine max
  Peptide Sequence Number=SeqID_162599
atgaaagactgcaaaaacacaagtggtggccttgtccgtgctcgtgcgcttagtgcacgtatggaccgcttagcgcacgttagtgatttttggctcaacgcgcttctctcgcttagcggatgggttgaagcggtgcgcttgatgacctggagcagtgcgctcaacgaacctgacaactcatcttcttctggattcttcctcgcgcttagccactga

SEQ ID NO: 70915 - DNA, 408 bp, Glycine max
  Peptide Sequence Number=SeqID_162600
atgtctcagcatatctgttatatagttgtgaattctccacagtccattcagagatctaggcaatcgcagtttgaatcggagagttacatcaagagttggatgcagagttcaaaatgcgatgtctaccttggagcctacctgaatagtgctttgaaaggacttgatgatactccacagcctaaatccaaggctggtgctaggtggattgttgttaagtgtaatagacaaaatggaagcattgagtgcggctattacgtcatgcattggatgtccaggataaccttaggaactttcaggaataattgggaaatgtattttaacgatgttagaccattgaaagcagagagattgaaggcgcttcgcatccagtgggcacaattttatctcaaagttagaaatgaaagttag

SEQ ID NO: 70916 - DNA, 285 bp, Glycine max
  Peptide Sequence Number=SeqID_162601
atgacaatcctcctcaactggttgctcttggaagagtttatgaggggtcgacaaccatccacaacattcctttggaataaacagggagctgaaggaccaacaaaacctatagataggtcggatccttgtgtcgatcccctatacctgatgacattgaccatcctacagcttatcctcaagccgttacaagtgtcgtgggatgctaccgtgtttggggtgcataatgataacttcccattgtgcataaaacatgtagatctttctgaattagcaaaaaatggttaa

SEQ ID NO: 70917 - DNA, 319 bp, Glycine max
  Peptide Sequence Number=SeqID_162602
atgttcctcctgttcagattttgaaaaggcagcagtgtctccggcaaaaccacctcagaagcccgatccagaggttgatgatccgctttatctgatgacattgaccatcccacagcttttcttgaggccttatcaggttacatgggatgccactgtgtttggggtctttaatccagacttcccgctctacataaagcacgaagacctctcaaaaatcccatgcggtggtcaatgtctcaacatattagtgttacagtcgtggattctgcatctgactgaaacaagtatgcaagcggggaattctgatatgtatggatga

SEQ ID NO: 70918 - DNA, 92 bp, Glycine max
  Peptide Sequence Number=SeqID_162603
aagcaaaggaatccattgatgaagaagatcctaggcctacaggctccaatggagcttacatcagcgatgggcttcatttttcaacaacgaag

SEQ ID NO: 70919 - DNA, 441 bp, Glycine max
  Peptide Sequence Number=SeqID_162604
atggttgccctaggaagagtttatgagggatccacagcggttcacaacatccctttgttgcatggccaagtgaaggttggtgttgaggaggttaaagatgcagatgctcccgttcttgtacccactaacgaggttattttagtggggcagacacttaacaccttccttggttggccgacacatatcgtgaagcatttatcagaacatgcagctgtgtctccagcaaaacctgcagataggtcggattatgagatcgatgatctcctatatttgatgacattgaccatcccacagctttttttgaagcctctccaggttatgtgggatgctaccgtgttcagggtgtttaatgaaaacttcacgttgtacataaagcacgaagatttatttgaaattgcacatggtggtcaatgtctcagcatatctgttatacaattgtga

SEQ ID NO: 70920 - DNA, 166 bp, Glycine max
  Peptide Sequence Number=SeqID_162605
atggagatgcagtggaagacaaaggagaagaggattacatcacttggaacccccctccccctcagcctccctaccatgcctatttataggaaaatgggcacttggggcaatggcagctcgcccaggcgagctgtttccttcaccctgaagtcatttgagggcccag

SEQ ID NO: 70921 - DNA, 312 bp, Glycine max
  Peptide Sequence Number=SeqID_162606
atgccacttcaaggagaagataagtcaagaacaagctcaccaccacaggaagccatggataagagcttgaaggtaggagcagatgagtggagggagaaggagagaaggagaatgagccatgaaatcataagtagcttcgtccttaacatcaagctcaacttcttcagtgatagggtccacgtgatgtgtgaagaagaatctggagaagggtgcctccaagatgatctcctctatctcaaaagtctctccagacttggtggatcccaagggagaacaacattgaaggcacatatgagacccatcaactgttga

SEQ ID NO: 70922 - DNA, 186 bp, Glycine max
  Peptide Sequence Number=SeqID_162607
atggtgtctgaaatgtctaacgaagatggtacaccgcggtcgctaagctccggcacggcaagctggttggaccgggtggaattggaagtgctcggttccacagagattgttacagaaggaatgggaagttgttctgacggaggtggtggtggtgatgctggtggagatcctcgcctccctccatga

SEQ ID NO: 70923 - DNA, 615 bp, Glycine max
  Peptide Sequence Number=SeqID_162608
atgatttcgagattgagtcaagaacaattcaagaatcaagagaaatatccaagagaaagtttcatcaagaagattcaagattcaagattcaagaataatcaagatcaagattcaagactcaaagattcaagaatcaagagaagacttaatcaagataaattttcaaaattcaaaatgaagagtcacatctgtggatgtgtaattgattacacctttatggatacatcctttgtggtacaagtagagggtacatctacttgggttgttgtgactaagaacaagagagggtacatctcttgtggatcagttctagtggagggtacatccactaggttgctcaaagagaacaagggagggaacaggtcaaatctgaagtcatctcaagattatgatgaagaccaagccaacttgtgtctcattacaaaatctcatgaaaacaacaaaaaagaatctgtaaggaagaagtggtacatcgacagtggatgttccaagcatatgacgggagatgtatccaaatttacaaccatttcccccaagaaaagtggacatgttacatacggcgacaacaatatctgtaaaatctcaaaagaggtaacatctaagccatctctatga

SEQ ID NO: 70924 - DNA, 432 bp, Glycine max
  Peptide Sequence Number=SeqID_162609
atgacaaaggccaatgtttctctcccaagaacaataaaatgggatgaggtaactcttcctgaaaaatggatcatggacaaggccacatcgtctgttccccgacccactccaactatagaacaaattaaacaagacaactctggtaaggtagaaataacctttaacaggagaaattctttctcatcaaggatagaagcctctaggtctgaatatgaatcggcaagaaggtctttctcggtgagaacccgttcaatcccagtaggattaaccagatctaagtcacacaaccagttccctactgtaaacctccaaggtttagataccacttctagtatacctagaacaacatacaaccaagaacaagaggacgaccaaaagtcgatccaatctccaacttactcctctatgcatgaaccttatgatgttatctga

SEQ ID NO: 70925 - DNA, 714 bp, Glycine max
  Peptide Sequence Number=SeqID_162610
atgtatgtatgtatgagtccacgcgtagccagcaaaggaaccctaagcagaaccctccaacgatgtcttttctttggaacgcagcttcactcctttgcgagtcagcacatggtgcatcatcttcatggcatttactcctttgctatggttcagatggtgcgcaaccagcagaaccagcttcactccttcgcgagccgccacaagtttctcgaagaccaccttcgaatgcagcacgaagggtgggtctctgatgttcgacgtcacaaggatcaaatttctcagatgaatgggatgttgacgtctgaggagaagaaacgatcgctcgaggcagcaaaggcggattttgcgatgggtttgaagcacacagaggctgctatgttaaaatggattttggggggggggggggaatgtttggttttggttttggttcttggtgttagattcttaaaagtcttacttttctataatgtgagtatcatagctaaatatgatccaaaaagtgatttattggatcacgagttcatgctaaaagggaaatggtttcaacagaaggacatggagaaatcctttcaagaccttttacggaagcaggaaggagatcgatcagtgtgggaatatccatttgtttttgctggtgttaacatcacattcatgcttattcagatgctggatcttgaagcagttaccactgatcattatcttagtgatggctag

SEQ ID NO: 70926 - DNA, 294 bp, Glycine max
  Peptide Sequence Number=SeqID_162611
atggcagtttgttgtcgtccgtcctgtatgttctattttgatgattgcattacagctacgcggctgtatccaaattggttgagctgggcattcaccatcgttcttaacatatctgtgtcgttagccttgtattctctggtggccttttaccatttgtttgctaaagaactggcaccacacaaacctctagctaaattcttgtgcatcaaaggaattgttttcttctactcttgccaacaagacaataaactcaatgtaggaaatttcaacctaaaaaagcagagaggatcataa

SEQ ID NO: 70927 - DNA, 465 bp, Glycine max
  Peptide Sequence Number=SeqID_162612
atggcaagccggagtcttagtatgccaaatcctccatttggccttgggaacgggatagaggtctacttttggactgatagatggctctccagtcctctagttgacctcttggacattcctaacatctccaccccaagcttagtgctaaggttgctgacttcctccaggatgacaagtaacttatccaagggtaagatggccccttctatgtcggacttcaacatcataaaaagctttgacattgttgggcacgctcccaaaccttactcgactactcaagtcatttggcatgatcctttattagagtggttgaagtgtaatacagattgggcttcccgtggcaaccccggtagagcgacgggggaggaggtattttcaggaattcccttggccttttcattggtgcttttgctgatttctatggggtttcatcctccctcatggctgagctgcttgcagcaatga

SEQ ID NO: 70928 - DNA, 789 bp, Glycine max
  Peptide Sequence Number=SeqID_162613
atgaagctgatggacattgacagtgagcaccttgggattcaagaggcatatcatgtcatgccattgttaagatgccatcctctgagtttgctaagatttgcaaggatctcagtagtattggtgacactagaaggtgtaaagttttccaccaaaggagacattggaactaccaatatagtttgcaagcagaataattttgtggacaagcctgaagaagctattgtcattgagatgaatgagccattgtccaacacaattaccattagtctgtcaaatgagccgccatttgtagttgagtacaagattgctaagatgggttatgtgcggttctatttggctctcaggataaaagaggatgaaaaagatacgaaacctcaagttgtgggaattgaaggtgagaatgaagaatggataggtgctggtgttggattaggggctccgcaacatgatcgtggtgaccacgaccatgaacgtggcgacgccgaacaacaaggtcgtcgcactacaggggctcatattgctgcacctgcctctattcgacgacaaaatagagaaacaaaagggaggagagagaatgcaggatcaaggaaaacaaagtttgatactcctaatcagaactgcttacaacatatgcttcttctgaaagatgtacctgaatctgatgatcaatgcctcctttcatctgtcaacatagatgaaaagattaggtttgtggagattccgagcgtgaaggttgagagtgcggttccaacagacttggcatatagttccaacagaattccgagcatt

SEQ ID NO: 70929 - DNA, 450 bp, Glycine max
  Peptide Sequence Number=SeqID_162614
atggatctcaatggaaaagtcattactaatgacgacataaggaggattcctgatgctgttataccctccatttttacaatagctcaaattttattggagacccgtcactttggaaagatagattttaggtggtatagagataccttcctaactagagtctacatcagagaagatagtcaacaaccgttctggaaagaaaaatttctagctggtcttccaagatcattaggagataaggttagagacaaaatccgtagccagtctcttaatggagacattccatatgagagtttaagttacggtcaattaatttcttatgtccagaaagtggccctgaaaatctgtcaagatgacaaaattcaaagacaattagccaaagagaaagcccaaacaaagaaggatttaggatctttctgcgaacaatttggactatcagcttgtccaaaataa

SEQ ID NO: 70930 - DNA, 201 bp, Glycine max
  Peptide Sequence Number=SeqID_162615
atgagctcgaagaaaactaggaaaggaaagagtcccagaaggggtgggaatcgattttggaagtccattgtggttcgccttaaaactcccagggaagccatcgaaggtgatttcttcgtcttctttagtcgctgtcaagtaatggatttgagtcatttgatgttgcgggatgtattcttaaagtccaataagctggtttaa

SEQ ID NO: 70931 - DNA, 224 bp, Glycine max
  Peptide Sequence Number=SeqID_162616
gaaagctggagttgctgcacatgatgtccaacgttatgtcaaggaatcagattgggctgcacaatgcacaaggcaagataaaatgtcaaatgaagaattgaagctgcaggatccacgatttttgggacttgagtgttttgtgagccaccttgatgttaccctaacatcaagtgttggacctgagtgtgtagagttgatctctattgttcagagagcaatctctg

SEQ ID NO: 70932 - DNA, 297 bp, Glycine max
  Peptide Sequence Number=SeqID_162617
atgggtcatggaatcacaacgacaagtgtacctaggagcttaactaaatcatattttgaaactagtgcaatgaagacattaaccaatagtttggaaggaaaggcagatcaagttgtacctcagtggattgaaccaaaggtatgtcattatttcttcaaaagtgctctcaagttagtgccatgtgttactttcatagttgtagctttagcaaatatatttcatattgcaattagagccatgttcaaaccggaggctgtgagggtggatattatgtcatgcattggatgtggtgcatag

SEQ ID NO: 70933 - DNA, 607 bp, Glycine max
  Peptide Sequence Number=SeqID_162618
atgtcaggagttgccacaagtttggtgtccatgaattcatctgtgaaaatgacgtttcgtaacaccgctacatttttcggggtccatgtgacctcaactcccgtggatctcaattattatcaacttactgtagccactggaactatgccaaagttttatcaatcaaggaagagccaaagatctgttcgggtaatggtaattgggagtcatattccactgtacggaggtggagccaacctgaacagtgtgaacggtaaaccggttgaaccggtgccgttgacgttgagcgtgatggtgcggtcgagggcttatgttttaggcaaattggtgaagccaaagttctacaagaaaatagagtgttccatcgttatggatccgaagaagatgggcaaggcaatttcactcgtcaagaaatgcacttaccagaataacgaagtctcaggatcagctgctttcaacagtctgttttctataggatcaaaggatggatctttaaagtctttgaaatgcttgatagatactgagtttgagtctttgaaccagagtttgacttgttctggttcagctttggatgcatcaaattgtgtccaccacttggcaaaggcat

SEQ ID NO: 70934 - DNA, 547 bp, Glycine max
  Peptide Sequence Number=SeqID_162619
atgggcatgggagtaaatctgccccttcaaacccgcactcaagaaactcgttacccgcgaagcccaccttgtgaagcccgcactaccagatatgcgggtagcccgcattcacaaaaaaaaaaggagtacgagggagattgttgttgtgcgaaccgtgttgaggagccaaggtggcacatggtgcaacacaaggaaaggagaagaggagtgagagtgcaaaagagagaagtcagtgtgacagcatgtgccagtgaaggagtcatcgttgcgccgacatggcagtacgggattaacaacagcttaagagaaaaagtgcagccagaaggaactcctccaacactttcaaccaaaactggatcaacagatccaagaaggagggaggcaacttgtccagagctggaaccaaacataattctgcctcgtccagcagatggagaactcaccagtgaatatgaaatcagtgaagaagaagtggaaaatgagcttaaggaggaagctatgcagggtgatatgctaatggaagttgtactaatgttgcaagttccag

SEQ ID NO: 70935 - DNA, 180 bp, Glycine max
  Peptide Sequence Number=SeqID_162620
atggaggttgccacaaccacattgttgcaagctccattggagcttgtaggcctaggatcttcttcatcaatggattcctttgcttcttggaagataaatggcagcggaatggagaaggaagagagagaggagaagccacttcaaggagaagatgagtctagaagaagctcaccaccatag

SEQ ID NO: 70936 - DNA, 348 bp, Glycine max
  Peptide Sequence Number=SeqID_162621
atgcatccaaattccacatatggagcatgtgttgtgcctccgacttctccgccaccacctgttgacaccaacctcaccatcgtagatgaaggaaccattagccggtacaagaggagtttcatgttgacacccctctcaagctggcataacaactacctgcatggatatgaacaactcatgcaacacttaaaatcaacctccgatagccataaaatattagcttttgatcaagtctataaattgatcaaatttgaagaagctaagtgcaaggaagattgtcaaagtagtgggtggttgtatgagtgtccaacaaaggtgttgctgaagagaactaggaagggtagttag

SEQ ID NO: 70937 - DNA, 1803 bp, Glycine max
  Peptide Sequence Number=SeqID_162622
atggagacgaaggagaacggaccgagcaagaaggtttcgaatgggggaatagatggacccacgaacccgatggtcactcctctgctcaatgatctctaccaattcaccatggcttacgcttactggaaagctggcaagcatcaagaacgtgctgtgaatccgtttggtggggagtataccgtcttcgctggcttggaagagtgcataaggttcatagctaatttcacgctcgctgaggaggagatcgattttgttagggaatgtttatcttcctcttgtgaggatggattctttgactacctcagaggacttgactgctctgatgttgaggtgtatgctattcctgagggaacagttgtttttcccaaggttcccctgatgagagttgaaggtccagttgccgttgttcaattgctcgaaacaccttttgtgaatctaattaattatgcgtcattagtttctactaatgctgcaaggcatcgtaatgttgctggaaaatccaaaactctacttgagtttggattacgaagggctcaggggcctgatggtggagtaggagcatcaaagtactgctatattggtggatttgatgcaacaagcaatgttgcagcaggaaagttattcgggataccccttcgtggtactcattcccatgcctttgttagttcatacatgagccttgatgagattacagacaagtcacttcgcggaaaagatggttcaagtaggtgtgacgattttgttagtctggtaattcctgagactgaaatggatatattgaaagctgaagctcaatgtagtaaagctctgcatgcttatgcctgtgtctttaatgcaaactttgatttgtcaaatggtgtttttggtgagaccaatcaaagcgagttggcagcattcacatcatatgcattggcatttcctgatggttttcttgccctcgtagatacatatgatgggatttacataactgggaagatgagtgaaccattgtgtgcttataaatctgtgtctaggtatgggaaggtgatgagaagtggaatccctaatttctgtgcagttgcattagctctcagtgatttagggtatgccaggaaatacaaagcagttggcattagattggactctggtgaccttgcatatttatcctgtgaggtcaggaacttctttcgctctatcgagaaggaatttggagtgcctgaatttgggaagttgcaaatcactgctagtaatgatcttaatgaggaaacattagatgctttaaacaaacagggtcatgaggttgatgcctttggaattggtacatatctggttacatgttacgctcaagctgctttaggtgttgttttcaagctggttgaaataaataatcaacctcgtatcaaactttctgaagatgtgtcaaaggtctctattccatgtaagaagcgatgctataggttgtatgggaaagaaggttatcccctggtagacataatgactggagaaaatgagccctctccaaaggtgggagaaagaatcctgtgccgtcatcccttccaagaatccaagagagcatatgtagtgccacagcgtgttgaagagcttctgaggtgttactggcctgggagtactgatataaagaaagatactttaccagctctaagagatatcagagagcgatgcatcaatcaacttgagcaaatgcgacctgaccacatgaggaggcttaacccaactccatataaggttagtgttagtgcaaaattatacgacttcattcatttcctgtggctcaatgaggcaccagttggggagctacagtaa

SEQ ID NO: 70938 - DNA, 357 bp, Glycine max
  Peptide Sequence Number=SeqID_162623
atggaatcaagagatgtgaagaacaagtcaagtggaaaaagaaagttgtctagtgagaacacaagaagttactttgcatgggatttggaaatggagtgtgtgctagttgagtcacatgaagaggccaaacaatttcgattcaaagttattcctaattgggatgatattgtagacctatgtacaaaggataaagctactagacttggagtagaaaatgcattagatacatatgatatcatgagcaaagaagcaactgaagacgaagtaattcatggtgtgagtattgacatagagggaccaagttctaccacaagaaaaacattcacccaagtaagagtgaagagaaagaagggatga

SEQ ID NO: 70939 - DNA, 555 bp, Glycine max
  Peptide Sequence Number=SeqID_162624
atggggaaggagctgagagtttgttatttgattttgacaggttatgctggacacgttgtgcaagtatctgaagtcaaagggcaagatgttgtttgtattataaagaacatagctacattggttgggtcattgttcactttgcatgcctctcagattcatattgatttgcctactctcactgagaaagaccaggaggttataagctcctggggtgttaaaaacaaaattgattttctgtcattgtcatatactcgacacgctgaagatgttcaccatgctcgtgaatttctttcaaagttaggtgatctcagccaaactcaaatttttgcaaagattgaaaatgttgaggctgagaaagttttcaatcaagacctatattttaaaaggacagtcaagtatgttggagaacccatgactcacttggaatctattgcatcctccacggtacgagctgcaattaaggtgaaagcatctattataatttgttttacttcatctggaagggctgcaagattgattgcaaagtataggccaacaatgaactatctgttgtga

SEQ ID NO: 70940 - DNA, 90 bp, Glycine max
  Peptide Sequence Number=SeqID_162625
atggctctgggatggtggcctcaaatgactcatcctccacatgctgaggtacctaggatgtgggacctttgtcttccttatgaagagaag

SEQ ID NO: 70941 - DNA, 114 bp, Glycine max
  Peptide Sequence Number=SeqID_162626
atgaactcgctaagcgagcatgtgtgcgctaagcaagttcatcaatactcattgtatctacgcgctaagtcgagctttcctgggccaagcacgattggttgcggcatccactga

SEQ ID NO: 70942 - DNA, 111 bp, Glycine max
  Peptide Sequence Number=SeqID_162627
atgtcagttttagaattatacatagaaaaggatattgttggtgatgatgaagtcgccgacatggttcaaccagttacaattgttcaaccaagagaagatatatttaattaa

SEQ ID NO: 70943 - DNA, 231 bp, Glycine max
  Peptide Sequence Number=SeqID_162628
atgtcacggaacttcacgaattgtgcaacgatgcttccttttgagttccgtcatgtcacggaacttcacaaattgcctgacgatgggtgccaaataacaatagatatctcagagccctacactgaggcaatgagaggcaccgtgcataagcctcaagcggaccttggggcatatcaaaagttctcacctggtaggttgaaaacccgaaagggcagcctaagcaaaaattag

SEQ ID NO: 70944 - DNA, 306 bp, Glycine max
  Peptide Sequence Number=SeqID_162629
atggtttcatcaaactatttatttcttgaagggaattcaataaatagacctcctatttttaatggagtagaggcaatagatttaaatatctgggatgctctagaagtagggccctatattcccactatggtggtaggaaataaaaccatagaaaagcctagggaagaatggagtgaagaagaaaagaaattagtgcaatacaacttaaaagccaaaaatataattacatctgccttaggaatggatgagtacttagggtatcaaattgtaaaagttcaaaagaaacgtgggataccctacaagtaa

SEQ ID NO: 70945 - DNA, 963 bp, Glycine max
  Peptide Sequence Number=SeqID_162630
gagttgaaaaactttgcggatggtagtattgatgtggccatcgtaaaggagttttatgggaacctctatgaccccgaggataaacctaagcaggtgagggtgagaggtcgtttggtgaaattcgatgcagacaccttgaactcattcctaaagaccctagtaatacttgaggagggggagaactttccagtatactccaggttttgtcgttcgaagccagaaccacaggaaatggcagctcgattatgcatccctagaaggggattcgagttaaacgctgatggactgccattaaagatcttacggaagaatctgatcatgcttgctcagacatggagcattctatctttctctaacctggtccctacctctcacacctcgaatatcacattagacagggccaggcttgggtttccagccttaatcattgctttgtgccaggccaggggagtcatttctgattcattgacattggagagcctcgatccagctattaatgtggcttatgtaaagaaaaactgcttgaacctagatgacctctcagttacctttagagggtcgtgcaaggccaatgggaagaggtctgaggctcccccaccttctgaggttcccccttcctcagctccagcacctactccagctattccttcttcatctatacagataccacttccagttcctctatctagccttcaggacttgggctttccatccattatgagcatggatgagttcgatgcacaggagcctgttccagaaaagccattaccagtaacagcagagggtgaggatgagctcactcctcctgagccctttgattttgatgcagagccatctctagcccctgcacttattcctgatgatgccacaccagtcatggagccagagcagcctatccaggattcatcaacagctccagcactggatcttaatgaagatcaaccacaagagcaggacatttaa

SEQ ID NO: 70946 - DNA, 1008 bp, Glycine max
  Peptide Sequence Number=SeqID_162631
atgggagaagtctccacagaggccattgcctccctcgcccagtattatgatcagccgttgaggtgcttcacctttggggacttccagctatcacctatggtagaagaatttgaagagatcctaggatgccctctagggggaaggaaaccatacctcttcgcagggctaatgggccccgttcatagatattctcgcactgttgatcttcggatgagtcctctttccgaatgtggatgggttggtggacctaaagcaatcgacagtaaaggagagccaaattgggaccaactcttagtcaaaccaagagtaggagcagtgggtcaatcaactggagcttttccaaagcttacgatggaaaatctgagacctaccatggagaagtctccggcagttgccctcgcccgggttgcatcagctatacaatcccgttcttgctataagaaacttggctaccctatgagaggggcaccactagaggaagagctcgcgcctgtcatttcacgaggtttcaataagagcaacatggagacatttcagaagggccgcaaggcatgggaggtagtgcgagagaaggacaaagaactcaggggcggtaacactgggcccatcggtggctaccgtaagtggttgagagcccatgtgcaaggtttggattggctcccaagtttgagaactgctaaaagggaggaagttgaggcaccggaggaagacgaagaggtgcaggcccttaggacagaactggagcaagcccaaacagtcaaagaaaggttcaaatcgctaccaccaaagccttgtaacaagaaaccaagagagcccgtagggaagagcacggacagaacaagttctgaggggatctgtggggcaataacagcgagcttaagctccgagaccaacatgttagctatcatcaccaagtaccaagaagaactaaatctagccacggcccacgagcatagagtggaggacgagtatgcccaagtgtacgcggaaaaggaggctagaggaagg

SEQ ID NO: 70947 - DNA, 399 bp, Glycine max
  Peptide Sequence Number=SeqID_162632
atgtttgcacattcgtttaaaggctgccgtcccttgggacgggcgtgtggggtgctaataccttccccgtgcgtaaatacaactcccgaacctttcactaaaaagttcgtagatctcgtctttttccggtttttccgacgttttcctcaaataaacgttggtggcgactccgcgcgtattcccttcgtggaacacgcatcctgcgagtcacgcgtcgccctcccgccgaagggtaggttgcgacaggggccaatgacaaggcttgtaatgagcttcaaaacaaagaaagggaaacataggctcaaagggctatcaaagggattaattcaaggaagcatcaacaagaatcaagccaaggctattgtgcaagcaatcaatggggcaaaacacaccaaatga

SEQ ID NO: 70948 - DNA, 507 bp, Glycine max
  Peptide Sequence Number=SeqID_162633
atggcatcattcagccagatacaatcccaatttcagtcgcagatgcaatctcagggacttgcactgcctctggttggtccctcagttcctcaagtaaacacaaaggagagttgtgttgatccctcaggaagcgatcctgagacgggtgactcagacaggtgcggcttgtacatcgaagcaaatcctgcccacctagttgccctgggaagagtttatgagggatccactattgttcataaaactcctttgttgtctggccaagtaaaggtgggtgtggaggaggttaaagatctagatgcttccattcctgtacccaatgatgaggtttccttagtggggcatgcaattgacaccttccttacttggccgaaacatctggtcaagcctttatcacagcaagcaattgtgtctccggcaaaaccacctcaaacgccagatccagaggtcgatgatccgctttatctgatgacattgaccatcctagagcttttcttgaggccttactag

SEQ ID NO: 70949 - DNA, 474 bp, Glycine max
  Peptide Sequence Number=SeqID_162634
atggatgtggagaaaaatgtttgtgacagtgtgattgggacgctacttaacattcaaggaaagacgaaggaaggcttgaatacccgtcaagatctagctgatataggcatacgatcacagttgcatcaaaggcggaatttgatatcccagaggcttctaacagtaggacgaaaaggaagttactacagaccatgggggagagatggaggcagatgtgcgcaagaaggcacaggccatccagaagcagaatactgccccccacgttttgtctcgtggggttatgattatttggagcaaaagatcctagctgagaagacgaagaagaagctggaggaagctgcacagtcaagaagcgttgatggcttcaacgaccctccatccccggtcagacgccacgtgaagtggaagatggcccgcacgaagaaggcaggggagatgacgactgaggccgtaaaggaaatcactgagaagatt

SEQ ID NO: 70950 - DNA, 741 bp, Glycine max
  Peptide Sequence Number=SeqID_162635
atggaacaggaacctttaagggagaaatatcccagattgtataacatatcctatcaacagcagaagcttattcaggatatgggatgtcagtctgcaaatgtttgggaatggaagcttgaatggagaagacacctttttgaatggagaagccagtttctgagcatcactacatccaacagatgggaagtcacaaagacaatgggtgggagtggagctttatttggagaaggccattgttttgacaataaaattgatacggcatgtgtttttctcaatgaggttcaggatatggccattcaacaacatggacctgatgtctgggaatgggctgctgaccctacaggtcagtatacagcaaacaatgcatataaggtaataaagggtaagcacatcatgaagaaggcaaataaacaaatatatgataaggaagacagagctgaacagcaggctaagtccatacaatgtgggcctcagttgggccagctaacagatttgccttatgaacctcaaacttacttggaccataccccctctactcataaaaaacctacgggaggtaattggcaggtatattcccggggaagctggtctaataggagacatcaaaggagtggaagctttgaaggaaaccatatgccactaagtatcatacagcagagcagcagcagaaatagttcaggaaccgcaacaggaaatatcagtatagatctacaacaggaggcaagtggaggttatacttag

SEQ ID NO: 70951 - DNA, 121 bp, Glycine max
  Peptide Sequence Number=SeqID_162636
atggcaccctcaaggcctaaggctttcccgatattccattgctgttgggcttcctccatcactgctgtgttgcactcaattatgctttttaagcccctccctgaatcattcttgcactgct

SEQ ID NO: 70952 - DNA, 51 bp, Glycine max
  Peptide Sequence Number=SeqID_162637
atggcagcccaaggaacacgagatggaacttcaacgcctcaatcaaaatga

SEQ ID NO: 70953 - DNA, 141 bp, Glycine max
  Peptide Sequence Number=SeqID_162638
atgttgaatgggttgtttgtggaggatttgtcgctagatgagccttggagagtgaaggaggaagtcttcaatctttacaaagtgttgcctaagattatgttcagtaaactcaagaaagtgttgaatagtgtagtggactga

SEQ ID NO: 70954 - DNA, 249 bp, Glycine max
  Peptide Sequence Number=SeqID_162639
atggcttcacctaaagaaattgcgaccaccatttaccacaatggtcacattgtagatgacccagttcatggatcgataggcatgatggaaacaattctccataatccacaattgaattctgtcgaattttatgctgttactgaccttattcctcaatcacaaccatcgtctccacaaccctcatgtccacaactacaactatcgcctccacaacagttactgtacaacaacatagacctcaataatcca

SEQ ID NO: 70955 - DNA, 180 bp, Glycine max
  Peptide Sequence Number=SeqID_162640
atgaccgttcgaagctttgggtttgatggccccaatgacatctatccctcacatggaaaaaggccaaggggcggacatgacattctgaggatgtggcagaacattgacattgtccgcgtacgcttgacatttatggcatttccttacatgggcgcagcagtcgctttccatagtgagcca

SEQ ID NO: 70956 - DNA, 756 bp, Glycine max
  Peptide Sequence Number=SeqID_162641
atgggatcgagtcaggtaccttggcttaaaaagaggttttatcaggttaagatcaagagcctaggagttgctagtctgaaagagttaggacagttaatgggtcaactccagcaacaagccttacgcaaagcctatggtaagatctgggacctaactatggcggaggtctccacggaggccattgcctccctcgctcaatattatgaccagcctttgaggtgcttcacctttggggacttccagttaacacccacgatggaagagaaatgtttggaagcaaaggcaagaaccttggcaagtcaagacgaatgggcccaattcatggacgtcctggctcttttgatcttcggagtggtcctctttccaaatgtggatggtttggtggacctgacaacgattgatgcttttctcgcctttcacaactgcaaggaaagcccggttgtcgctatcttagccgatctatatgacacattcgaccaaagatgtgagaagaacagggcaaggatcgtttgctgtacaccgaccctctatgtatggttggtttcactccttttccggcaagagatgagacacgtttgcccgctagaaggccatcgctcatgcatcgagaaaaaggaggcaaagtgggactggctcttagcgagcaaagaaggagcggttagcattaattacaatctcgtcctcgctataagacaacttggctaccctatgagaggggcaccattagaggaaggcctcacaccttttattgcatga

SEQ ID NO: 70957 - DNA, 447 bp, Glycine max
  Peptide Sequence Number=SeqID_162642
atggctgaagtagacgaggtgcaagagtggatgaaggccgacatggaggccatgaaagaacagatggccacaatgatggaggccatgatgagcatgaagaagataatagaggtcaatacggctacagttgccactgtcagtgttgtttctagggtggacccgactcccccatctggcctcaacctaataaatcgtccaacctcagatacgggcgaccctcattttgtgcaagtccagaacaagcatattttctcgtcatatggtttgccttcgaactatactacacccaatgagaatgtcaataactccactcctatactcattgagagccaacaacctcaaactgatcatgcacatgtctctcaacccacgggggagacacatgaaatatcccatcgcaatctagccgacttcgagcctcgcctcagatatgccactgaagggtaa

SEQ ID NO: 70958 - DNA, 107 bp, Glycine max
  Peptide Sequence Number=SeqID_162643
gggatgaccttaggcctagagtgcatcctgaagcaggggggtatgccacattgcccccactctcttgctattcatacctaaacatgcgcccaccaagtgctcagtga

SEQ ID NO: 70959 - DNA, 252 bp, Glycine max
  Peptide Sequence Number=SeqID_162644
atggatcaagatgatgataatgatgctggaaatgatttggcaatggttgttggatcttcatcaaggaagcaaaaagcagtccaagaaaatgatgaggatctagattttgaggagaatattgatcttgaatctgaagaagaagaaatcatggtcaattttgaggcatctgatggggaagagggagagggagatgctccattaccatatgataataacgaagatgattatgttgggattggagaagatgattag

SEQ ID NO: 70960 - DNA, 576 bp, Glycine max
  Peptide Sequence Number=SeqID_162645
atggtactagctgagggtgaaaccttacccgcatattccagatactgcaggttgcccactgatattagagaaattgaggctgccttatgtatcccaggtcggaggaaaaactgttggaaccctgatgatttgacagttactatcagagaggccaggagagtgaggacaaggctagttgaggccccttccacatctacagctcctcctccagcatgtaccctagcagctccttctgccccagcttatgcagattttcagcgtcttgaagccgtgcttcaaaacatccatcaggggcagattatcttattacaaagtttacagatggtggcacctccaaactctattccttcagtagagcagtttaatgagtgggtagcctggcccggaactcagtcttctcttcacagggaaggtgaaggtccccaacccaggtaccacaacagatggaggatgagtcatccgagactaccactccagagcccttggtcaaaaggaagaaggcagatcaaacacaagaagctgcaaccacttctgagaaatctcttgaggccactttcgagccttcagaaccagtga

SEQ ID NO: 70961 - DNA, 147 bp, Glycine max
  Peptide Sequence Number=SeqID_162646
atggatatatattcgtggagggagaaaaaggaatcgcatgaagacagtacaagtggaggtttcaatctgttctccgtctttcagacgtttgggaattctatcggagcagtcggaggaatatctgaaggaatctcagggaaccgctag

SEQ ID NO: 70962 - DNA, 426 bp, Glycine max
  Peptide Sequence Number=SeqID_162647
atggcggaacacggaacccgccgcaccaccaccgaccgcctggaagaagccattgctgccctctccgagagacattctgaccttgccaacaaagtcgaggccatgtgcgaacgtctctcacacctctcccaccccacccggccatcaactcaaccttcgttttcctccagaccacccgtcaagctggatatatatccaaggggttacatagaatctgataatgtacaagatgatgtgccttaccaagttgaggaaatgtcacatgtcaacaaagtcattgaagttgaaagtatttttggattgcaagatttgaaaggtggtgttgaagaagtaaacctttctaatttgttgacaaataaagaagaatcaactagtttgaatggagaatcaaacaatattgaacaagacaatgaaggggaattataa

SEQ ID NO: 70963 - DNA, 537 bp, Glycine max
  Peptide Sequence Number=SeqID_162648
atggaatgcattcttacaacatttctcactgcaaaacagaatagtaccttgaacaggggagaaagtgcggttacttcaagtgaagggggagaagcaacaaaatttaatatgactgttggagaactaatggatgcttatgaagtctgcatttccaacttacagaaggcccagtcacgccgatgcatctcttctttgaagaagatttctccaatgaactttataactgaggcagaggagatggctcagacattcagacagagaatagcccaagtagaagctatggctcgtgcagacatgctaaggcaaagtggattgactatcaaagatgatgagatcctgggaccatttacttcatactttcctgaagagggactagatctgagtgaggtgaactattgttactttgaagctggagaaaacaaagaagccttggttaaattggtaacatatgtgcattcaaactcaactacaaaaggcataaagataaagagcaattacaagaaagacaacaagaacaagataggcgaaaaaaggtga

SEQ ID NO: 70964 - DNA, 1110 bp, Glycine max
  Peptide Sequence Number=SeqID_162649
tcgcatgacatggaaacctgtctcatggtagaagaattgcttcagcggctcatggattgcgggcagcttgaagtgtccataggagggagggaagaaccacaaatttgcatgcagttggaagagaaaaaggttcctctaacccccaaggccctagtgatatgttttactaggaaagggaccggctccacacccatatacccccggacagcgcccaagccaacaccatttgcatatcaaagtaataaggtcgtcccgtggaagtatacccctcccgcgttcagcgaaagagttgcaaccgaagttgactccctgtcagctaaggtgaccaacatcaccggcctcagtggcgtaacccatagtggttgggtgttcgcttcccctcacctggcgaagttgccctccaaggggaaagcgcccatggtccaagagcccacaaacgtagccaccccctcgaaagaagtagatcctctagtgacccttccacaatcagaagggaatttggtgttgtttaaatttgaatggttatttggaacaccaaaggttgaacttgtgaagcatgttacagttcagaaggtgttggaatcagttcacattgcagctaacaaaaacacagttctaggagatgtgtcagctatggttcctggtggtatcagaatggctagaagggttcattcacacttcactgttgacaggtcacaggcagtcataagaggaaagaaaggaaataaaaccagtggacttgttgtggaggagactgcatttattgggaataatgtgtcaattttgcataatgtgacattgggagggactggtaaggcaagaggggatagacaccttaagattggtgatggggtattgataggtccagggacttgtattttagggaacattaagattggtgaaggggtgttgataggtccagggaacattaagattggtgatggagctaagattggtgcttgttctgttgtgttgaaggaagtgccaccaaggactactgctgttgggaaccctgctagggtggttggagggaaggataaccctattaaattggataagatgcctagttttaccatggaccatacttcatggtttgattatgctatatag

SEQ ID NO: 70965 - DNA, 477 bp, Glycine max
  Peptide Sequence Number=SeqID_162650
atggggacaaatcaaaacggcaaaaggttttatcaagtcaaggttaaaagtctagatgtcaccagcctcaaggctttccacgcatatcaccatagcaaggagagtccagtggtggctatcttggcagatttgtttgacacctttgaccggaggtgtgagaaaaatagtgcacggattgtctgttgtttacccgctctctgtgtgtggttggtttcacacctattccaacaaggcacaagacacccgtgttcgcttcaaagttatcgctcatgcgccgaaaaaggaagagtcgattgggaccaacacttggctgggataggaggcaacgcaatcaattggtttcctcgttggaagagcaaggaagagttcttttctcgtgtgggctaccctgaatgtaatccattggtcataggctgtttcctgtgtgaaattgttatccgctcacaattccacacaacatacgagccggaagcataa

SEQ ID NO: 70966 - DNA, 420 bp, Glycine max
  Peptide Sequence Number=SeqID_162651
atggaggaagctattcaatccagaagcactgacaccgtgattgatcctccatcccccatcagacgacacgtgaagtggaagatggcctgcacgaagaaaactagccaaataacgtttgaggcagcaaaggaaattgctgagaagattgattcgttggaggagcaggcctcacaggaacaccctggtcatgtgcgtgctactggagtcagtgtgatgatcaagcaatactttggaccggcaccaaggacctcccgcacgtcttcctccatggctcccgaagacctagagcagctgacgcaacaaatcagggaccagttggaggagtcgatcacaaaaaaagtgtctcaacaactaattcagccagatgcagtcccagttttagtcgtagatgcaatctcagggattcgcactgtctcttga

SEQ ID NO: 70967 - DNA, 435 bp, Glycine max
  Peptide Sequence Number=SeqID_162652
atggaatttcaagtgggacaaaagaagcatgtattgagaggatcttcttttgagaggaccgctacattaaggaaaggtccggcaagtcgtgccaactccgatggtgcaaatagcttagccccgccgtggagcactgccccttctcggcccaacaagacaacaccatcatcacggcccatgcccagtacagatcctgaagtagcaaagtttagagagcaagacctcaaattcttacctgagatggaattcctctttaagggtactattgttactggatttgcatcatatgcaccatctgaagattcaagacaaaatgaaggattcaacacaagaatgaaagagacaaatgataacattgataataacactaagatagacatgacaactcagataatgtcttcggcaaaggaaagtggacagaggaagagagcgtga

SEQ ID NO: 70968 - DNA, 1551 bp, Glycine max
  Peptide Sequence Number=SeqID_162653
atgacagctttgaagccaaccttcaaggtcgaagttcctgttgattttccttttgacattgaggacaatcctggagaaagaaccatacaactaaaaggaaaattcagagatgaaattatcaaagttcaagttgacatccctaatgtagcaccagaagaagaacatgaggatgacgaaaatggcaacaatgagaagaatgatagtgaatctagcattcctttagttgtgagtgttttcaaagaaaatggagtgtctctagagtttggcgtgactgcttttcccgatgagatttccattgatagcttgtcaataaaacagtctgaggaatctgaagaccagttggcatacgaggggcctgagttcattgacttggatgaaaatctgcaaaaggcttttcacaagtatcttgagatcagggggatcaagcccagcacaaccaacttcttgcaggaatacatgtttgctaaagacaacaaggaatatttaatgtggctgaagaacctgaagaacttcgtcgagaagaattatctcgctttatcaaagcataatcacgtgaatccccgttgccaaacggtgatttgggtaagggagatcatggacaaagaaaatacaaatgggcctttacattttgatctgaatactggtgcaaagattccatcggttggtcttggaacatggaaagctcctccaggtgttgtgggtgatgctgttattgctgcagtcaaggctggttacaggcatatagattgtgctaggatatatgataatgaaaaagaggtaggggaggctctgaaaacactattttctactggggtagtacagcgtagtgagatgttcatcacatcaaagctatggatcagtgactgtgcacctgaagatgtctcaaaggcactgactaggactcttgaggacctaaagcttgactacattgatttatatcttatgcattggccatttaggacgaagccgggttcaagaggttgggaccctgagattatggctcctttgtgtcttcctgagacatggaatgcaatggaaggtttgtttgcctcaggtcaggcacgcgcaatcggggtgagcaacttttcaactaagaagctgcaagacttgcttggatatgctaagattccaccagcagttaaccaagttgaatgtcacccagtgtggcagcaacctgcgcttcacaatttgtgcaagtctaccggtgttcatctcacagcatattgtcctttaggctctcctggatcatgggtaaagggggaaatcttgaaggaaccactgttgattgaaatagctgaaaagcttcacaagtctccagcacaagtggcattgcgctggggactccaaagtggtcacagtgttcttccaaaaagtgtaaatgaatctaggatcaaggagaaccttagtttatttgattggtgccttcctcctgagctcttctcaaaattatcacagatacaccagcaaaggttacttcgaaatgaatccgctgtccatgaaacttgtagtccttacaaaagtcttgaagaattgtgggatggagaaatatga

SEQ ID NO: 70969 - DNA, 270 bp, Glycine max
  Peptide Sequence Number=SeqID_162654
atggacattgagaatgataggggatacaactgcaatggcaacaacaatagtatggaggaagagattcaaaaggaagatgaaagcgaggtggaggtagagacaaatttggttcagatcaaacaatcaaggacatatcaagggccaaggtgggagatatcctctaaactactatttaatcacccaaaaaacctagaaggaatgtatcttcgagtaagtgatgaacaggatgctcagaagccttttcagaaatccaagatgctcacaatttga

SEQ ID NO: 70970 - DNA, 759 bp, Glycine max
  Peptide Sequence Number=SeqID_162655
atgagcaacgaaatccggttcttcgagctaaacactggagctaatatcccttcactagggctgggaacttggctggctgatcctggtgttgttggtgatgttatagctcatgccgtcgaggctgaaaacattgtgccatcagacatacctaacacttggaaggcaatggaagctttgaataaaagtggcaaggctagagctataggtgtaagcaatttctcaactaagaagttgggagaattgcttgagtatgctcgtgttactcctgcggttaaccagtcagagtgtcatcctgcatggaggcaggacaagttgaaggccttttgcaaatctaagggtgtccacttctctggatattcacctttgggttcccctgcctggcttgaaggtgatttccttaaccatccagttataaatatgatcgcaaagaaattaggaaagactccagcacaggtagctcttcgatggggactgcaaatgggccatagtgtgcttcccaagagttctaatccagcaaggataaaggaaaactttgatatttttgactggtccattcctgaggacatgcttgataaattttttgagattcaacaggaattcccaggttcaaagaagtatttacgaagtacaaagctaagacaagaaagaggacttcgagctattgggcaattcgaactggtgtatggacgagtcgaagtcgaggcagcaagagttctagacttagcgacacttggcgttaggatagcgttcgaccgttag

SEQ ID NO: 70971 - DNA, 300 bp, Glycine max
  Peptide Sequence Number=SeqID_162656
atggaattaatgcaaatttcacttcaatttcagtatcatctgctaagcgaggcatcagcccgcttagcgagtaagaggaatcttgaagggaatctgccatgcaagcacacactcagcgcgttattagctcacccagtgagtcatttgtctcttctggcgcttatcgcgcttggctcgctaagccaaagttcacttactcgcgttaagcgcgaaaatggcgctaagcgtcccttcgaggacagaaagccctttttaaagcctgaagtggaaaatcaggaggaggggagtgtagagctttga

SEQ ID NO: 70972 - DNA, 1158 bp, Glycine max
  Peptide Sequence Number=SeqID_162657
atggtttgtgttgttgtgcttatagttttggtcattgctctgtatccagctgagggaagtaaagcagttgctgaatctggtcgagccaccccagaaattccttcatcgccaaacacaatgaaggacctgggcgtggttgcaatcctgttgtcagtagagttctttgacgtgattgtctacactgtaagcaaagcagccatgaagaaggacatgaatgactctgtgtttgtcatgtactccaatgccttcgcaacttgcctccttcttcccataacttttatcttttataggaaaagagctcttcctctactcacatatttcatagttggccaattatttattaatggcttcttaagttgtagtgttcagatgctcaggttttttggaataggttactgctctcccactttggccactgcaatgtctgatttaatccctgcttttaccttcatacttgccatcgtcttcaggatggaaaaattggattggaaaactaaaagtactcgggccaagtccattggcacattggtatcaatcgttggagccttaataattactttgtacaaaggccaagcagtcataaagaatcatccatcaaataaattgttccccaaaaaacatgtttcatctgagcaatttgactgggtattaggggcaatgttgcttgcgggtcatagctttgttctctcattgttgttcatagttcagacatggataatcagaaattacccaacagagcttgtgatagtgctcactcgcggtacattagttgctatgctatctatcccaccttcactgatttcggtaacggatctaaaagatttgagattaggatttgatgtgaatttgatagctattgcattccaaggccctctctatgttgcaatgtttaagccaattggaatcatctttgcggttatcatgggaattgcctttcttggtgactctatctatcttggaaggcatacgtttctttcatgtctcaatcataagaaaaattggagtgtgcttggagcagccatagtggttattggtttttatgttgttatttgggggaaaagccaagagcaagcaaaggaagagtgtgaagtctatgatgactcggaatcatactcacccgttgtccctcttttgaagaacaagagaatggaggaatag

SEQ ID NO: 70973 - DNA, 207 bp, Glycine max
  Peptide Sequence Number=SeqID_162658
atgctccaaccatatggaatcagcataggcttaaaggagcactcaaactcggtgacccccaaggcctacactccgaagagtccgtcagggcctctccctcctgattcagacactgctcatgaattatacaatacccacgatctcacactcgtattttcaaacacgtttaacacattgcgctacaatttaacactggttcctaaatag

SEQ ID NO: 70974 - DNA, 552 bp, Glycine max
  Peptide Sequence Number=SeqID_162659
atgcaccagcttgtatttggctcttgctctgtcggaacttttgttggagagaagaatcgtggccccaccaacgcagaaaaggcaattgggtatgagcatggccttgttgttcccgaagtaccaattttgggttatgttcttggtactgacgatgacggcgtaggtgttggggtgaacctgaagcatgtcttttgcaaggtcaacggcgatgacgccggcgttgcagcccatgccgccaaggttgaagcttttagcgttacccgcgaaagcttgtacttgttgatgatcatggaggagagggaaggggtgaggttgaagaggctgcagttgatgacaaggatgccgatgtctttggggttgacaagggagaagctcggaggagagagatggtgtcgaagaaggagggatggttggagaccaaaaggagaagctcagaggagagagaaacttggaagagagagaggggtggttagaggggacgaaaggcagaagcttggagactcggaggagacagaaaaaaaatctcatatttttttatttgatctggtgtaa

SEQ ID NO: 70975 - DNA, 561 bp, Glycine max
  Peptide Sequence Number=SeqID_162660
atggtcccctccattttccagaaatttcgatgccttcaaacaatgcaatccgcgcgtgcggtcctgatctcgccaacaaacgcagcgttgttgtcgattccctgcgttttggagccccgtgttgtcgtttaccagatcggagatttcctcgccatgaacgaaaccgaagcggtggaggatgcgagggaggtggtggttgtgaaggaggaagagcgtgcggagaaaatggtttacatgtggggataccttcccggagcctcgccggagaagtctccgatactctctccggcgcctgtgactctctccgatccttcactggccgtagattcgtggaaggacgtgtgcggcggtggttgcggattcgccatggtcatctcagagaaagggaagctcataacgtggggttctgcggacgatgaagggcagagctacttgatatcagggaagcatggggagattccagggctttatcagcttcccactgaggcttcagtggtgaaggctgctgctggttgggctcactgcgcttcggtcactggggttaaacaagaagaattttaa

SEQ ID NO: 70976 - DNA, 849 bp, Glycine max
  Peptide Sequence Number=SeqID_162661
atgggtaatcttgagaaggaacattggcaagttaagaaattcatattcaagtaccttaagggtacaactaatattggacttgtccaccatggagatacatcttatgctctccctagtaactcaaattctgactatgctacagatttggatgcaagaagatctacgactaggcaattagttgttgtctctgttattaggagttttgtattttgggttcagagagagcttgagcatactttgaactacttcgttgtaaattttgttattcgcaataaactgaacaattttgttattcccaaattccaaaggttcatgtttaaggtctgtaagaaattgaaagctcttaaagctcccttgaagaatctttttaagcaggagttcagcaacatctccaaccgagtggagctagctgaggctgaatataacagtgtgcttaattcactaaagcaaaatcctcaggatccttcccttcttgctctggcaaaccgcactagagggcagaccattatgcttagaaaagcggagtctatgaaattttctcaactcatcaaaaacaaatatctcctgcaggctgataaatgctccaaattctttcatgctttaatcaagcgcaacagacacagccggtttattgttgccataaggctagaggatgtgcataacacttcctcccaagatgaaattgcccttgcttttgtgaatcacttttggaatttgtttagttctcatgagttgacccaagctccttccatttcgatctgcaacaggggtcctaaggttccaccgattgctttgcggccttactttgtcctacttctaagcaagaggtttggaacgttatttctgtga

SEQ ID NO: 70977 - DNA, 75 bp, Glycine max
  Peptide Sequence Number=SeqID_162662
atgacagttgtggcttgtggcatgaaggagatgtgtgaagatgataaaggatacaacttttggggatatcaatga

SEQ ID NO: 70978 - DNA, 321 bp, Glycine max
  Peptide Sequence Number=SeqID_162663
atgtcacgccaaaatgagtttgttggttacttgttcacaggaaaaagtcccaaaaactttgacattcccaccggatgtaccatggatgaactgaaggatttgatcaaacaagttgcgcctcgtgggattcccccttatggtgttgatgaaacacaaatggtgattcgtacgttgatccgtaagaagaaaaacaagcaggggcaattttggcatttaataggtttgctgggtgcaccaacaataatgatgggtgcacctagcaacactcctaaatcaggtggattggataccaagtggtttgggtcatttttttctacataa

SEQ ID NO: 70979 - DNA, 480 bp, Glycine max
  Peptide Sequence Number=SeqID_162664
atggattacactgtggaagatatatcaaccactatgggcaccaattttgagtcatcttatcatttgtgtcaagttgcacacccacttctaaaagaatctgggcacgggagcgtagtatttatttcgtccattgcaggtttaagagcttttccatttttttctgcttacgcagcctctaaaggagccatgaatcaattcaccaaaaacttagcatttgaatgggcaaaggataatatccgtgcaaatgctgtcgcagctggacctgttatgattgtccttatggaggctgtcaagtctgataccacaaccgtcttagagtgtggcacattcgaaggcgatcttggtgtcgagaccatcttagaatgtaacacattcgaagacggtcttggagtccacaccgtcttcgaatgtaacacatttgaatctcgacaccaagaccatcttggtgttaagatcatcttcgaatgtgttacattctaa

SEQ ID NO: 70980 - DNA, 296 bp, Glycine max
  Peptide Sequence Number=SeqID_162665
gatcatggcttctctaccctgccttgccttctcctcctcctccttctcctcctcctcctcctccttcccgacgcatcggcttcgctgtctgccatgaagcgggcacgcaaagcctcataacatatttggggattgtggcgcgtgataaggtggacgtcacctacgagaactggaaggaggtccctactgctcagaaggacttgatttgggaggatattcaggcgaaatttgaaatcctagaggcttctgacagtaggacgaaaaggaagttacttcagactgtgggcgagagatag

SEQ ID NO: 70981 - DNA, 831 bp, Glycine max
  Peptide Sequence Number=SeqID_162666
atgcttccaaagttcatcattagccccttcagggtggaatcccaagaagtgaagcatgtggacaagagaagaaagcatgtgagatcatttaagagtaccaacatggatgttggtttgagacttctccctcaaattacaagctcaaatagcacatcaaatgtcctcttgaaatctgcagtgagaaaggcaaaccaacaatccatccctcaagacttatgcttccttaaaacttacaatctatgcaataagcaactatgtccagacaaagatatttacttgtacagagatcaaggtttctgcagtgtagagaccaagcaaatggtagctgcttataggcaatgttctagtgaggcacgtagtccaacaacaacaaaagctgatgagcaaagtcaggaagaggagaaaatcaagagcagattccatggggaggaaaagaagttaagactaataattgaaaataatcacttttactctgagaaacttggccagattgaagaacagatgcagagaaggccccaaggggaggagaagagctcaggaaagttgataatcaatgactgcatgatggatcagatagtagttaatcagctgagcttaataccagaacctattagtggaatgatagatcaaacaaaagaagatcagctggtccaggataaaacacaaacacaacgaagatgccataatgatttactggatgggcgtcaaggtgaaatcattttggagaattcaaagtcctatgcatgctctatatgcaaaagtaggcgtccgaacaatgcatcgacaaaagactttaattatgatgaactcctagaagctatagttttgtag

SEQ ID NO: 70982 - DNA, 399 bp, Glycine max
  Peptide Sequence Number=SeqID_162667
atgatgcttaaagcatacattcacctaggaaaatttgaagagggtctttctttgctggagcaacaagaggaaaagatgtttgccataaacaaattctgtccctgcaggagtggaagcaaggttttggattcactcatacctttagctgccatcatacgtgagcccttgtgccataaggtgacagtctttctgctcatgctcatttttctttgtagaaatatattaaagggggtgaaaactgctctatattatagaattgaattcaccaagccacctagggacaccaaaataggtgaattgacaaatggaagcacttcatgtcctgaaatgttcttttttttggcatttcatgccaataaccaattctttatttggaaagtgccaaaatacttaatgtaa

SEQ ID NO: 70983 - DNA, 198 bp, Glycine max
  Peptide Sequence Number=SeqID_162668
atgcagacaggcagggtcatacgatccacggcaatctcattgatgtcgttatcgcgctatttgccgatcggtgcgtctgtcagcgtctccggcgatacgtgcccgaagcaggcgcccgtcgacacgcccgagaagcgcgcatcggtatcagcgacaccgttttgccccacgagatatgcttcacgcggaggtgagctg

SEQ ID NO: 70984 - DNA, 291 bp, Glycine max
  Peptide Sequence Number=SeqID_162669
atgacagacaatagtatttttcaagcaagtgaacaaattgccagtgcatatctttcaatgcaaggaaaaataactcaccgtagagcgttcaacgttatagggaaaaagaatctgctgccaaacgatgccacgaaacatttatgcagttatcttcaacgacacaaaaacaaatatatgaggcaccagctaggcaagcaaacaggccgatgccgaaaccgtgcaagtgctaatagatctattgattttgcaaagacattagcagtgggatctaagaaagctcttccgcattga

SEQ ID NO: 70985 - DNA, 345 bp, Glycine max
  Peptide Sequence Number=SeqID_162670
atgggtctagcttctagttctacatccataccagaaagtattcacacaaagagtcttgaggtatactttggcaattacacaatgataaagatggaagaaacttcagagtttcttgtgttatttggtggtgaaaattcaaaccctcctaatgatggtagcgaagacaagattttggggctggaacttattgcaagacttcaaaataatggtctcaaagataggatatttgtaaggttggaacttaatgcaagacttcaacatcgcaccataggtttaagacctttaactaggatacatactgatggaagcttgcttgtggggcttctatggaggctggatctttga

SEQ ID NO: 70986 - DNA, 201 bp, Glycine max
  Peptide Sequence Number=SeqID_162671
atgataacaatgatgacaacaaaagatgatgaacaaaaagctcaagtgaatcaaagaacatctcaagagaatcaagaacaagtcaagagttcaagcatcaagaagaattcaagattcaagaagaaagcctacaaacaagaatcaagattcaagattcaagatctcagaatcaagatcagattcagactcagattcagatga

SEQ ID NO: 70987 - DNA, 549 bp, Glycine max
  Peptide Sequence Number=SeqID_162672
atggcgcctaccaggcaccctctggacccggataagtccaacagggccttgggatttcccgccttgatcacaggactctgccagtcgttcggcgtccccgtcacacctagcaaggtgattcggccgcccatcacccgagcttttattgagaagtattgcacgcagagacaggtccagggtgatgcaccacaggccgcggacgcgccgccacctcatcaggctggtccagccggattgtttgatacagagcagtatttgcggcatttggttcgccagcaggcggccaaccaccaggcacatgtacagactcatgattgtctttatcagatgagtctcagcctgcagagccagggctttacttcgtttctgtgccctactccggaccagttcagggcagaggttgcgtggcctagagattggcctgaggcccaggcaggagaggcaccagcaggggcaccagcaaaggctcccgacgaggcagatgaggcccacgaggacgaagagatgaccgatttacttgatttcttaggagggagcggagccacatga

SEQ ID NO: 70988 - DNA, 207 bp, Glycine max
  Peptide Sequence Number=SeqID_162673
atggttttcaaaccgggtgattgggtttggattcacttgaggaagaataggtttacttccaaatggaaatttaaacttcaaaaaaggggagatggtacctttgacatcaattcgagggtgaattcttcccaagaaggagggaatgatagaggactagccaaggtggaagagtttggcttgggtgggctcaacttgagcaaggagtaa

SEQ ID NO: 70989 - DNA, 552 bp, Glycine max
  Peptide Sequence Number=SeqID_162674
atggatatgaaattggggtacattatctcaagtcagatttctatgatcgcacaacatgactcctcacagcttggttttcctgccctcatcactaccctgtgcaaggccagaggagtcacttctgattcattatcttttgagagtcttagcccagccattaatttggcttatgtgaagaagaattgttggaacctcgatgatcccacagtcactttttgggggccccacaaggctaagggcaagaggtctgaagctctaccatcttctgctttccatacctcagctccttctacttctaatgcagctccatctactccagcttcatctgtaccagctctagctttagcctcagagcttgtgccagaggaggacgagctcattcctcctgagccatttgtttatgagactgatccagctagtgctcaggaggaggtagcatcaccagagctcattcctcaatcatctccaactccagttcttgatgatccacaaccatatgctctagcatcagtgcctgatcagcctattgttcaggatccaccagttgcactg

SEQ ID NO: 70990 - DNA, 597 bp, Glycine max
  Peptide Sequence Number=SeqID_162675
acttatcaaggtaatccttgtggcgtctacctagacttatcttccttcactggaagtggcgtctacccagacttatcttccttcattggaagtggcgtctacccagacttatcttccttcactggaagtggcgtctacccagacttatcttccttcaccggaagtggcgtctatcctgacttatcttccttcaccggaagtggcgtcatccaaaccttcgtagcctgtatcaaacgatccgttcctactcagacttatcaaggtaatccttgtggcgtctacctagacttatcttccttcactggaagtggcgtctacccagacttatcttccttcattggaagtggcgtctacccagacttatcttccttcactggaagtggcgtctacccagacttatcttccttcaccggaagtggcgtctatcctgacttatcttccttcaccggaagtggcgtcatccaaaccttcgtagcctgtatcaaacgatccgttcctactcaggttcacatcaacgtcgactgtcaattttttcaatcaatatcggagaaaaatatttttttgccgagatgggctaatgttttcgtggccgaataa

SEQ ID NO: 70991 - DNA, 319 bp, Glycine max
  Peptide Sequence Number=SeqID_162676
ggtacatccacttggttgttcaaagagaacaaggaagggtacatcccttgtggatctttgcttgtaaaggtttttacaaggttgaaagaaatctcaagaacagcagaacggatgaaggataacatggaggccatgaaagagcaaatggccacaatgatggaggccattatgagcatgaataagataatgaaagtcaatgcgacagcagttgctgctattagtgtcgttgctgagatggaccaaacacccccatctggcctcaatcaaataaatcatccaacctcaaatatggtaggtcaaggaggcaaagagttgggaa

SEQ ID NO: 70992 - DNA, 450 bp, Glycine max
  Peptide Sequence Number=SeqID_162677
atggctttgtgttcagtttttcttaatcttcatcttctgctttttgtttgtttgaccatagaagcgttaggtgtggcaaagccttcagtagctagttaccttagccaggagatactggcagagcaagaagctgatagagtgcatggatttcctgcgcagcctcaagttcaagaatatggtggttatatcactgtcaatgaaactcaaggcacaacactgttctatggtttttcgaggccactcgcaaaccagaacaaaaacccgttctcttatggctcaatggaggcagtggctggattaactcagcctaacaatgcaaagcctattgttgattccagtttttccaaggctaaaccagaagattctttggacccacaattcaaaccgccacaagcttcacaactagtttctgtcttcactattttattcttgtttggttgctcaaattaa

SEQ ID NO: 70993 - DNA, 393 bp, Glycine max
  Peptide Sequence Number=SeqID_162678
atggctcttgaagacaaaaaatcagggaccagctggaggagtcgatcacagaaaaaaagaagaagcaacaatcaatttaatcgatgttctttaaacgtgcaagacaaaattgattgcaataaaataaatgagataagggaagagagaaatgcaaactcaatttatactggttcaaccccttcccatgcctacgtccagtccttaagcaaaccacttgatgtagaagcaagcttcatgataatgaaccaagcaattttgatgatgccaaaagcccaagtgattgattcaagattgattcaagacttcaagatcaagcatcaagaatccaatccaagattcaagattcaagagaagaaatcaagaagcaacaagttaagacttcatataggataa

SEQ ID NO: 70994 - DNA, 408 bp, Glycine max
  Peptide Sequence Number=SeqID_162679
atggcagcgcagctgatccgtgatcgcatcgtgatggagtgcctagagggtgtttgggagaccctcgagggcaacgagaggtgccaattccgcggcacagttcgactcactgctacatttcttgtacatccggagcaacccacacgcacacttcagcagcctatggagtggatactacctatgcctaccccatatcgactagttgagcctgttcaattgatagaggtgtcatcctccgaagaggatcctgaaggggacccagaggagttatctcctgaacctgctatggatgccctgacttaccagaggatgatgaggacccacttcctgatgttgattctccagaggatattatgccagcacctgaggcagactctacagaggagagtggtcctggagggatggtga

SEQ ID NO: 70995 - DNA, 423 bp, Glycine max
  Peptide Sequence Number=SeqID_162680
atggagctaattgaaaacatggctgctagtgatcatgccatattgtgtgatagagtgcatgttgcaagttgtgctatttgtggcggagctcatgaatccggtcgttgtattcccactgaagaacacaattatgaagttaactatatgggaaatcaacaaaggcaaggttacaatcaaggtggatactcaggattccagcatggtcctaattataatcagcaaggacaatggagatctcatcctggcaaccaatacaacaaagaccagggtggaccttcaaacgagccaccacaacaagggccaagtctttatgagaggactacaaagctggaggagactctcactcaatttattcaattcacaatgtttaaccacaagagcacggagtcagccataaaaaaccttgaggtccaagtgggatag

SEQ ID NO: 70996 - DNA, 456 bp, Glycine max
  Peptide Sequence Number=SeqID_162681
atgggtgccaagtacctcaaaatggtcaaacgaaagttacacgccaccaagcaaagacagcaaaagaatgtttatacggataaccactcgggtatttccgcatgtcagcatgactccagtgtcagtatgatagatcttgtgagcgcggaagatgacataaatctccgccaaaagaatgtttacacagataaccactcgggtatttccgcccgtcagcgtgactcagatgtcagtatgatagatcttgtgagtgcggaagatgaccaaaagaatgtttatacggataaccactctggtatttccgcccatcagcgtgactcaaatgtcagtatgacagatcttgtgagcgcggaagatgaccaaaagaatgtttatacggataaccactcgggtatttccgcccgtcagcgtgactcaaatgtcagtatgacagatcttgtgagcgcggaagatgac

SEQ ID NO: 70997 - DNA, 366 bp, Glycine max
  Peptide Sequence Number=SeqID_162682
atgagctcaaaaatctatcctaagagaattcaagggactagccgcctaagaattctttgtcctaacacattggagggtacatcctttgtggcacaagtagagggtacatctacttgggttgttatactgagaacaagagagggtacatctcttgtggatcagtttaagtggaggatacatccacttagttgttcaaagagaacaagggagggtacatcccttgtggatctttggcttgtaaaggattttacaaggttgaaagaaatctcaagaatcgttggttgcttggggactggatgtaggcacgggttgtggccgaaccagtataaatcttgtgtttgtcttcttcttccctacactctttaa

SEQ ID NO: 70998 - DNA, 561 bp, Glycine max
  Peptide Sequence Number=SeqID_162683
atggcgtacaccagctggcacttaggcatggggaaggtcggaattatgatcggtgggcaggatgttgctgaggagcaacgtcatccatatctgggtcagggtggtcatattggtgcgcatgattcgcactcgcctccctgcagcagtccgggcaaaatcctgccccgaccggttcctcctctggccatactcgtattcctggccctcttccaataccatcggatatcccaggagctggctgatagcgtcggcatcgaacgggatccactgacccctaacccaggatctcatgtcacgcacgccctcctctgttggccaagcattggcataaaactcaaggactatttctggatcaaacttggccatgggagtaaccagtggtgcccaccgccggcgccctatttcctcctggaaatcagtatactcgtcgtccctgagctggacgcgtcgctcccggagaaacgaccatcccttgatggcttcgaagcgctgctggtgtacaacgctcctaaagcagtgactgtcgtactccggggcggaactagttccttcggccgcctt

SEQ ID NO: 70999 - DNA, 330 bp, Glycine max
  Peptide Sequence Number=SeqID_162684
atgcagctgtttggatacacccagactattcctgctctgcctgtcaattcatgggtgtcgtatgatgatatacacgataggtggatgcactattcggatcatatggttgcagcaggtgagccccgagtcatccctcaggtcccagagacaaatatccctcacgtgccaaagccaggagcaccatcgatatctgcgaggcccgctgtggatgagcctggacatgcagtggaagtttgctatgggattgctgagaggttggagcgccatctgagcctaggggtggtcatgccaggctcatcgaaatttcacagccaattaacacaaatgtag

SEQ ID NO: 71000 - DNA, 147 bp, Glycine max
  Peptide Sequence Number=SeqID_162685
atgactaaagcatgtcaaaagggggtacggaaatgtatatgcctatatgttcttggtagaagtaggaatagcggggggcaagatatgcgggttaggctaattaagggagagaaatccataactgggaggttatgggttaattcctaa

SEQ ID NO: 71001 - DNA, 435 bp, Glycine max
  Peptide Sequence Number=SeqID_162686
atggagaagaagagcaagcgtcaacatgaggaacatccatttactgaaaacccaacactcaacgttgacccaccatccccagtagtaagacacttgaagtggaagatcgcccgcacaaagtggtatggccaaatgacgtctgaagtggcacaagaaattgcagacaaaattgattcattacaggaacaagcaacacaggggagttttgttccacatgggcgacaggacatactcaacacggcccttggccgacctgagcatccaggccgtgttcgcgtcatagggacaggtgtcacaataagccaatactttggccaagcctcatgtgcttctagcacatcctcaccatcgatcagccagcaacagttggctgaaatcatcggtggaattaaggatgacataggaaaggaggtacaggatgagataagaaaggag

SEQ ID NO: 71002 - DNA, 219 bp, Glycine max
  Peptide Sequence Number=SeqID_162687
atggcttcaacggacgtcagagacattttgacagctttcaatccttcactcgacttcttcgctattaccgccggagacggtcgcgtcaaggtccacaccgagttcgccgatattacctcaactcattcaactgctactactttacatcataaatcatccattaacggccatctcgcgctagattatacttgcatcgagtggctctctttcgacaaaaag

SEQ ID NO: 71003 - DNA, 282 bp, Glycine max
  Peptide Sequence Number=SeqID_162688
atgtcatctcccagtggaaatgagcacaaagcatactgggcagtgaagacttgcaacttctctatggatccaagctggcgaggaaaaggaagttggcaactgagtgagttagatgaattccgccctagaagcctacgagaatgccaatggagatcaaaagcgcccccacaaccaagagcttcaaggccaagggacatcgacttaatcctcccgaccccttttttaggggacgtagggggggaaaagacttccttactcccccctactcttcctcccccatga

SEQ ID NO: 71004 - DNA, 336 bp, Glycine max
  Peptide Sequence Number=SeqID_162689
atgctccaaccatatgggatcaacataggcttaaaggagcacttaaacccggtgacccccaaggcctacactccgaagagtccatcagggcctctccctcctgattcagtttttcctccgactgctccgatagagttcccaaacgtgagagaaacggcgaaaggattaaagcctccatttggattatcttcatacgattcctttttctccctccacgaacatgatttcgcaaatcccaacggtcaaagcttgcgcaacggaatttcgaacaacatatccaaattttacgacaatccaacagttaacgaaaccgggatcgtagttttaccaagatag

SEQ ID NO: 71005 - DNA, 291 bp, Glycine max
  Peptide Sequence Number=SeqID_162690
atgaccgccatgagccgcctttgcttgccgtcagatcaccgtacggagaagaacaatttaattggagcagaatcttcaaaactcaactcgaggattcggaaagctggagttgctgcacatgatgtccaacgttatgtcaaggaatcagattgggctgcacaatgcacaaggcaagataaaatgtcaaatgaagaattgaagctgcaggatccacgatgtcggatacgatgtccaggacatcctgcccgaaaatactggacacataaatctgttatatctttaacagattaa

SEQ ID NO: 71006 - DNA, 198 bp, Glycine max
  Peptide Sequence Number=SeqID_162691
atggagaagataaattcacacataatatcacaaaggacctataagggaaaaggccatttggtgcaggggaagcacgcccaggtgagctggaactcacccaggcaagctagttgcttaaagctaaaggtatcagctcgcccaagcgagtggcttcttaggactgaaaaaatttcatggcctaagcgacctagatgctag

SEQ ID NO: 71007 - DNA, 330 bp, Glycine max
  Peptide Sequence Number=SeqID_162692
atgcctatttcgacactagaggtgaggaaggcaacaaagaagaatgatgaagaagagaaagatgatgctcaaagccataatgaatcatctccatcgaaacaacaatctcaacaagaaccaattattgaagaaaatgtgacaccctctaccccgagatatatgagaccagtcagggtcacgctgttttgcgagaatgctctaaccatatgggatgaacataggcttaaaggagcactcaaatcgggtgtatttaaccccaaggcctacactccgaagagtccgtcaagacctctccctcctgattcaggtccaatccaaaaaatattttag

SEQ ID NO: 71008 - DNA, 528 bp, Glycine max
  Peptide Sequence Number=SeqID_162693
atgagcgtccacgtggcccaggtgattgctgacaccatctatttgtttgcaggtatgccacccaccaggcaccctctagacccggataagtctaacaaggccctggggttttcggcgttgatcatgggcctctgccagtcattcggggttcccgtcacccccagtaaggtgatccgaccgccgatcacccgggccttcatcgagaagtactgcacgcctaggcaggcgcagggtgatgcacatcaagccgcagacacaccgccaccacctcggcaggcagaccctgctagatcactaggcatggaacgttatctacaacacttggttcgccagcaggcaaccaaccaccgtggcctcagtcaacaggggcagggtttcgctccttttgcatgccctactccagagcagtttggggctgaggtcacatggcccagggactggcccgaggcccaggcaggggaggagcccgcaagatccctcggtgaggcagaggaggcccgtatggatgaagaaatgactgacgttgct

SEQ ID NO: 71009 - DNA, 1221 bp, Glycine max
  Peptide Sequence Number=SeqID_162694
atggcaacaaaagcaaaagatagttctattgctgggaagaagaaggccccatcatcaaattctcacacgacaatcaccgaaaggaccatcaaaccatccgtaacaacaactacaaactccacttacaagcccaactcaacctcattagagaaaaaaatccccaactatctcaagcccacaaaaacctcattccttgagtcccccacttccaaacaacccaagagtggctcacccagcagtaagccttttgttgcaataagaagaagatctttggacaaaccactttcctcttcaaactcgacaagatccttaacaactccacgtagatcttccattggcccaattaacaaaagcattgtcccttccaaacccatcttagctaggaccacaatttccgctagtgatggaaaaaccaagccattagtcacaaagggcacaaagaaaaccgtccctactaatactactacttctacaagcactaagaaggtatttaataaggatcatgcttcttttaactcaacaaagagcactcctaaagagactacaaaaacttcaaaggttgaaactgagcaagttaaggaagttacaagccaagaagttgaagtgataaaagtggagaatgaagaacagaaagtgcacgaggttgaacatgtgaatgatcatgttccacctgatgttgaatctgaacatgagattgaacatgttcaagggcttgagaactcggatccaccccaatatcaagttgatgatgagagggtcatatctacagtgtcagaaactgaaaaagagacactagaagagaaagcaaaaaataaggaacatgagttggaggaagataataaaacaaaccaagatgaaggaggaaacaataatgagagtgatcaccaagaaaatcatgaagcaaaagttgttgttaacgatgaagatgaaggtgagggtggtgaaattataagagaagattacaaaagtgagaacaagaacaatggagaagaggcaatagaggaacaaaaggaagcagttgaaaaagtagaagagaacaaagttgaggcaacaccatcaaagcaacaatcaggagaaagaagacatgggaaaatggaggctcaggtgtccaatgatgagattgaaaaaactgccaagcttttggaggcaaggaagaacaaggtgagagcattggctggggcattccaaactgtcattgatcaccaaaccacatcaaaatga

SEQ ID NO: 71010 - DNA, 579 bp, Glycine max
  Peptide Sequence Number=SeqID_162695
atggatgcacctactcaacaacatccacctcctactctcattgcttccaaagtaccaggtattgagagtgatgatgataggcccttggtcttcaagaaaagaaaagttgcaccaccttcatttgagacctatgtgcctcaagtgaagaaggaagttatgtgtcctccatctaaaaatagagaacctcatgttgcatccataacttttgagcaggatccaccaacagggatagaagttcctcctcctccaacatggaagcgacttcaccccaaggtgtccaagccttcatcaccaacaataaaacacaagattatctacaaaattccttctagagcttgcagagaaaaggtcagctatgacaaggacaccattggttggtttcacaagattgatgcacaacaatttgatccatcttctgatgatttcttgcctccctttctctgtacaaaacatgtccaacttttcactcccatgtctaagtttgttcctttagactatggccatcaagctctcccctttactaaggatgatgtatataatgttggcatggcaatgatccaatgtgggttgacaaattaa

SEQ ID NO: 71011 - DNA, 495 bp, Glycine max
  Peptide Sequence Number=SeqID_162696
atggggagtgattgcactggtccatattgttggacctacgaacatttccctattgttgtttcgtgtgttgctaatgaggattatcatgagatgaaaccacgtgcttgtcgttggaagtctgggaaggaattactgaccattcctcctcactccgctgccctatctttatctaaagaggagattgacgatagatggatgcaattctctgaataccttgcaccggtggccttttctctctccccactttctctctgcaacacaacacgctcaaacactgagcattgttgtagttgcattgttgcaccaacaccattgtattacaaaaaactccaccatagtgatttctggttagtggtggtctttaagctcaagaagatgataaacggaggttcactggaggcttgccaatggatagcagaaagtttggaacgcttgatcaacataaggatagttactgctggaattgaagcatacactataaggagtagtgcttga

SEQ ID NO: 71012 - DNA, 348 bp, Glycine max
  Peptide Sequence Number=SeqID_162697
atggcattctccatttcttgcagggctgatgaatcccaagctcgtttgatagcaaatacctcagacgttttcttttggagcttggttattaggaaagataacctatgggtaaatgctttgactcataagtatttatctaataataactctattctaaatgccaattgtccaccaggagcttcctacacttggtgtggtattattaaggctaagaaagggattttcaatggcttaggtttagatttgggaatggtgagagttccttgcggtttagtaattggaacttgcatgatgcccttggaaatgtggtgccttttttcccaatccatgattctcatattttcttga

SEQ ID NO: 71013 - DNA, 471 bp, Glycine max
  Peptide Sequence Number=SeqID_162698
atggctttggtggggcagaggtatctaatggcaattggaggcaatgatggaaagagacctttggctgatgtatgggccttggacacagctgctaagccttatgaatggcacaagctagagccagaaggagagggcccgcctccttgcatagcagattttctagaggggtttatctttggaactacttcttcagctcaccagcatctgcttgtaagatttgcagtagacagaggaggattagttggaccagatggttccacacactatggtgcatttgatgtcacttttacggcctgcctccctaacatggtggtgatggttgcttctgatgacgcagaaatttttcacacggttgccacagcagctgccattagtgatcaaccgtgttgtttccgataccagaagggaaatggagttggtgttgaaataccaccagggaataaaggcattcctcttgaggaaaaagaatag

SEQ ID NO: 71014 - DNA, 483 bp, Glycine max
  Peptide Sequence Number=SeqID_162699
atgggagctttatccgcaatggtagcagacgtcttcatggaaacaagaggaattgtgaccaccattgtcaacaaagcagatacggtggtggaaggtgttgaggatgaagagcttgaggtcgacgaaggtgaggatttggaagattgcaacgaaggcatgggtgtggtggaagtggggctaacagttggcccaatcaaagaacttgatgcaagggaggatgtcgcggtgggcggtgctaaggcaaaggatgagggaagctactatctcaccttcgtgaaccacgtcttgatggaggacgcaatgacattttgggagataagaaaggaacttgaggttgaggatgttgattgggagggtgatgatgcaaggaaagtgtatgtagcatggtcggagcacaagttgagaatggaggacatgaaggatttggatttgagatgggttgagaatggaggagacaaaggagagagaatctgggaaaaataa

SEQ ID NO: 71015 - DNA, 321 bp, Glycine max
  Peptide Sequence Number=SeqID_162700
atgctcgaaagttttcaacaacaagatcaaatgtcagttctggaattgtacatagaaaaggatgtgactggtggttctatgtttcattctgcaaattctcttacatcatgtgaaaataatttatctaataatgaggcgcaaccgccaagaaatgtgtacaaggaattcaaaatccattttagaatgatgctttgcattattacaatatcaattggagccatcctgatgaggaggacatttgtggtttggagatgccatcgagttttaatgttgggtaaaaattatatgttggcatggattttgatagtaaaaatgcggtaa

SEQ ID NO: 71016 - DNA, 622 bp, Glycine max
  Peptide Sequence Number=SeqID_162701
tgttcctcttggtgtgggggttcaagggcaagcaatggcggctcacggcggtcatcgctggtcttgggtggtgaaaaatgagcacaaccccctttgcactaggccgggcttagcgcacccttgggcgctcggcgcaacttcctctctggttggaattgggcttagcgcacctctgggcgctcagcgtaacttcttctctgttggaattgggtttagcgcacctttgggtgctcagcgcaacttcctctctgttggaattaggcttagtgcacctctaggcacccagcgcaacttcctctctattagaattgggcttagcgcacctttgggcgctcaatgtcattccctctctgttggaattgcgcttagcgtgccattcatgcttagcaagagatcaaaagtctatgaagcttgtaaagtccccaagtgtggacaaagtgttgtccaggctgcttctatcaagttgtctagggtggaaatgcttttagttttgcaggtgaggtctagcgtgcgtgtgtggcacaggcatagtactcttgtgtacgtgtcactcatggagtgggcacgcactagattcgtggtgcgtgggttagaagggctgcattgtggtgtgaaattttag

SEQ ID NO: 71017 - DNA, 351 bp, Glycine max
  Peptide Sequence Number=SeqID_162702
atggaaaaggagtactcaataggactaatgttcaaatgctctattgatcctggagcacaggtgccaactaatgtgactggtatgcttaaatttgggacaaatcttcttcaagctgtgggtcagttcaatggtcattatgttatgcttgttgcctatatgagtgttacacctttgcaagaggatccagttcttcaagattatcttcagcctgttattacatctgttgattcggacgcggatgataagtatggtcaagaaagagttcaaataaagccaaagttaacgatgcagtcattagtggtgaatgtggtcgtggaatgctcccatcctctgaacctgccactgtattag

SEQ ID NO: 71018 - DNA, 643 bp, Glycine max
  Peptide Sequence Number=SeqID_162703
ggatttgcttcccttcatgcttgctcgtgcattttttctttctccctcaaaacctcacactgtcacacagccaccccatagaagagttggaggagttgctcagagccttagagttagaggacaacctgttctgtcggaagccgcaacacgtgacagcagacaacgtgtgacgcggcagcgtgcggtggtccacaacggtaacagacaaccttgttcatttggaagccgcgatatgtctgggactgggagtgggaatggatcaaattcatcaaatgccaatacaggcacatccacaggtgcagcaagcagaagcaaaaatgctccaggaaataggactgatattgggtggaagcatgggacagatgttttagggaatggtaaaaaagattctgaaccttgtgcttcagtgcttgaagaagttaagatgcttatgatgaacattgttgcagaggttgctaatgcatcagagaagagaagaaagttgaacattattcatgaagaaggtactgagggagtggaagtggagtcaaatagtagtcaaagtggaatacaacgaaaagggatgcttgctttcaaaggaagaagaaaagcaaaatttgttcaggctagtggtggtgagggagttcaagcaactttaaattag

SEQ ID NO: 71019 - DNA, 426 bp, Glycine max
  Peptide Sequence Number=SeqID_162704
atggaagaggcaaaggacagtagaaaaatcatgcaacctggagaatggtgggagatgtttagtgatggaactccagagttgaggagatttgctattcatgtttttgagcttgacttaaaaagtattgctcttccatttgatgagattgaatctgacaatgaatggataactgaagagggatataatgatgaggatgagcaacctcaagctgaaggtcacggtgacaatgttgaattagtgggagatgttggaggaagttcaaatgatccggttgtagatgcttttgatctagataatttaattttcttggaacctaatggtgatgataaacagtctgaggaagaccttgatgatgatggagatggtgatgaaagtgatgatattcatggagatgatcctattagaggattggacatgcttctttga

SEQ ID NO: 71020 - DNA, 540 bp, Glycine max
  Peptide Sequence Number=SeqID_162705
atggtctgcaatgaccaggcagatatgataggtagattacttgctggatcattaacctttgattgtcgcatcatgcactacatcatagttagaatttttcttctccgttcttttaatctggctcaagcctctgaggaggacttgattttgatgtgggctttccttaccggtcgtcagatcgactgggctcacttggttaggtaccaaatacataaggcattacggaccaatgcacctcttccatatcctcagttggtcaccctttttctttgtcactttcaaattcctcttgatgatgaaccttttgttcaagttaagagatcttttgccattggtgctagtgcagtaacttcatttggttaccgtaaggatcatgatggacagtggcttaggaaacaggacttaccacatgagcgtactccgtcacctccgccacaaagagatgcttcctctgttcttataaataaagtcctttctcttaactctgtgggcttcgaacatttgttggtgaatgttttgatgccatggatagtcgcatag

SEQ ID NO: 71021 - DNA, 455 bp, Glycine max
  Peptide Sequence Number=SeqID_162706
atggtttttgagaaacccatagaagaaattaggggatatttcaaaccattgtatattaaggcttatatcaacaacaaaatgctaagtagagtgatagtaaatggtagagctctgttaaatgtgatgccaatcaacaccttagagaaaatcggtactcatgctttgggagttttggtggctgatatcactgtcggtactaaaatcaagaagatggtagagatgattcatgccaatagatttatgtttaaagtcgaagttcatattgttgaagctatttactactcaccattcatgaaactgatccagtgcctggaatgtatgaagagggggcgacgcatgactcgcgggatgcgtgttccacgaaaggaatacgcgcagagtcgccaccaacgtttatttgaggaaaacgtcggaaaaaccggaaaagacgcgatctacgaacttttaagtgaaag

SEQ ID NO: 71022 - DNA, 951 bp, Glycine max
  Peptide Sequence Number=SeqID_162707
atggcattggaactcatggggttcccaaaactagacgaacaaaaggccattcaagaggccgcatcagaaggcctcaaaggcatggagcacttgatccgaactctctcccaccaaccctttcacttaaacaccgaactcaccgatgttactgtttccaagtttaagaaactcatttcgctcctaaaccgaaccggccatgcccgattcagacgggccccggttcagtactcatctccacccgcacctgttcacaacgctaacacttccacctcatcaattcaactccctcctccgccgcaaaaccctaatattcccgcgccggtgcagtttccttctcctgcgccggtggccgttcaccacgcgccggtgacgctcgatttcacgaagccgcacaacgcgcttctgagctccaacgcgaaatctgttgagctcgagttctcgaaggagaccttcagcgtttcatcgaactcgtccttcatgtcctccgcgatcaccggcgatggcagcgtctccaacgggaagatcttcctggcgccgccggcgacctccgcccgaaaacctccagcgttcaagaagcggtgccacgaacaccgcgaacactccggcgacgtctccggcaacagcaagtgccactgcgttaagcgaaggaaaaatagggtgaagaacacagtgagagtgccggcgattagttcaaaaatcgccgatattccacccgacgagtactcgtggagaaagtacggtcagaaaccgatcaagggttccccatacccaaggggttactacaagtgcagcacggtgagagggtgcccagcgaggaagcacgtggagcgcgcaccagacgatccggcgatgctgatagtgacgtacgagggggagcacaggcacgccgttcaggccgcgatgcaggagaacgcagccggggtggtggggttggtgttcgagtcaacgtag

SEQ ID NO: 71023 - DNA, 549 bp, Glycine max
  Peptide Sequence Number=SeqID_162708
atgattgatgaatttggaagattccaaactcttctaaatggtctgctagctcttggatatgaatacacaaatgctcagttcaacatgaagattctagacagccttcctaaggatgagttttgcgtggtgttgttggatctcgacaatgagggtgacgctattaagatctcggtggcatggggcgactctgcgcaatgctactcagatctcaaccaaggaagaggtggtgcatgcagatttgggtcttggcttggtggtggaagtctcgtgctcgtggatctgattagggtggtcacaagcggaatgggtgaagatggcaatgatgatggaggtggtgtgtttggtgaagattgtggtgtgtttggtgaaaatggtggtggtttgtggtggttttggtttttgtggttgaaagagatagtggttgctagtgtttggggaagcagaaagcttctcaaggaagttttctcaaagaagcttctcaaggaagttttcttaagaaagcttctcaaggaagttttcttaagaaagcttctcaaggaagctacctag

SEQ ID NO: 71024 - DNA, 99 bp, Glycine max
  Peptide Sequence Number=SeqID_162709
atgcaatgcgtggcaatgcctccagctgtgaaacaatggtcatatcaaggtgtagtggaagataaaggagaagaggtgagaggaggcgccatccactaa

SEQ ID NO: 71025 - DNA, 288 bp, Glycine max
  Peptide Sequence Number=SeqID_162710
atggtggttcaagccaaggtaggagggcagactaaatttgagcttgcgaaaacaagtttcgaagtgaaaagggagaatgaagtgggtgatggtggtgtttggcatgggttggtgcactacaagggcgtgacggttaagagtggtggtgcatttgggtcaaaggtggtgggtcacaatgtgactatggggtggctcaatggtgttgtttggtggatggaggttgtaaatataagcagcttgttgatgacggctcggaggttgggtgatgtgctgggttggttgatgtag

SEQ ID NO: 71026 - DNA, 66 bp, Glycine max
  Peptide Sequence Number=SeqID_162711
atggtatcatggagaccagtcagggtcacattgttttgcgagaatgctccaagcatgtgggattag

SEQ ID NO: 71027 - DNA, 471 bp, Glycine max
  Peptide Sequence Number=SeqID_162712
atgcccttgcggggtaggattgcatcacaaggccattacaagaaatctcagccaacgagatatgggctcccttactccattgtcaccaacaacagtacttcattcaaagctcaagcttacaaagaatttttgacaatgccaagtgtcaagcacattgtaacctctgtcgaacacccccaaactaatggtcaggcgaaggcagctaatagggttatccttaacgccctgcgcaccagactcaacaaagatgccataatccccatcaaagttggggaactgtcgacaaggaggttgttgttccaagaacaacacaacaaagagaacatgagggtggaactagagaccaaggatgacgtccaagagatttccaaaatcaaagaagaggaaaccaagctccgagcatcaaggagatacaatacaaaggttcaacttggagcctttcaatctggcaacctagtgtcgcgagtctga

SEQ ID NO: 71028 - DNA, 102 bp, Glycine max
  Peptide Sequence Number=SeqID_162713
atggcgaccgaacccaaagcagtcactgaggacgtcaagatcgatctcttcgaagacgatgatgagtttgaagagtttgaaatcaatgaagggagcatttga

SEQ ID NO: 71029 - DNA, 291 bp, Glycine max
  Peptide Sequence Number=SeqID_162714
atggcatcgagtgtgtctggggtagaagaggggatgggcgcatctgattcttggtcacatgctaaaattggagccattataatcaaatggcacagatgctcagaagactttcatgtcacaaagtcaccgaatcctttccccatcaaacctaatgcttcacaatgggatgacaaagaggaaggaaaagaagtgactcagcagtgggaggatgattgggatgatgatgatgttagtgatgatttctctctccagttgaaaagggagttggagagcaacactaataagaattaa

SEQ ID NO: 71030 - DNA, 246 bp, Glycine max
  Peptide Sequence Number=SeqID_162715
atgaggttcttcatagtcatccacctattcatctgctcccccgaacacaaagttcaagatcatcacaggatccaaacacaaacagcaaactgggaggtcacagtgttttgcgagaatgctccaaccatatgggatcacataggcttaaaggagaactcaaaccgtgtgacccccaaggcctacactccgaagattctgtcagggcctctccctccttattcaggtccaacccagaaaacattttag

SEQ ID NO: 71031 - DNA, 702 bp, Glycine max
  Peptide Sequence Number=SeqID_162716
atggcttctttgtcgcgaggtggtgacgacgtcacagtagaacgcgggggatggcaacgagttagagttgtgagggagaggaccattgtgaggacgaacgatcctaacattgctaatgagattgagaacatgttcattcctttgtttgaggaagaagatcgtccagtttgggaaggtacattcataggaaccttgaaactgaaggaagattattctttcttgaacgggccatctcatgacatctcttgggctaagatgatttggataggaactgcagtctgttggctaaaaccttggtgtgatctttggtattgctctattgggaatgctgatcaccttatgcttcaatgtagttttgcttctaaagttagagactggttggagatcaaattgcagcataagttggaccaaaattccatgttgaacatattgggtcatcagcaagttagatggcaaccccctataatgggatgggtcaaatgtaatacagatgaagctactaaaggatctctaggcatagcgggttgtggtgaaatttctgctgtgattacaacaatagaaattgctcatgagaagggttggagaaacttgtggttggaatgtgattcattgatggtggtgcaagattttaaagatgtgaatcttgtgccatggtccttgagaaatacatggagaaatgcagtcattagactagagatttga

SEQ ID NO: 71032 - DNA, 249 bp, Glycine max
  Peptide Sequence Number=SeqID_162717
atgtgcgatcggcgccatccggtgatacttctttttcaaacatcgatcgatcatctttcctggccgacgtcgacttatcaaggtaatccttgtggcgtctacccagacttatcttccttcactggaagtggcgtctacccggacttatcttccttcaccggaagtggcgtctaccctgacttatcttccttcaccggaagtggcgtcatccaaatatccgtagcctgtatcaagcgatccgccccgtaa

SEQ ID NO: 71033 - DNA, 726 bp, Glycine max
  Peptide Sequence Number=SeqID_162718
atgggaagggacaatgtagaggctaacttagattgggaaataagggtaaagcaacaacttaaaaagaagtctacttcaaaatcttatggctctcactcttatccaaagaaagaccaaggtcaaggcatcttaggggtgacaccttataagcccaaagatgataaggggaagacaatagaaaataaaagtgaagaagcaaaaggggaagaatctagtgaagagatctacccccaagaagaaggacaacctttaatggttaaggaggagtgtaaggaggagttgttggatgagggtttggtttgcaagagcttaaatccttgtgctttgttggtgcccaaaataggtattattaggcaccaaatccctaaaataggtggtatgatgaatgttttgagtggtgcaaccctcttttgtaaaatccctcgtgctcctaagatcttcatgatttgtgtacatagggacttattagcaccactcattgagttggtgagaaaccatgttccttcatgggaagatgcccaggaaatgggttttcagaccttaccttacttcaacataccaaacaccactaatacatgtcaaatcctttccaaggtggagggaatgatgcaatcctatcccacaagggcattggctagaagactccaagtagattgggctagagatccaaggaaaggccctagggttctcatgagccttagggtagattttgagcccatgggctaa

SEQ ID NO: 71034 - DNA, 408 bp, Glycine max
  Peptide Sequence Number=SeqID_162719
atggagaggagtatgatttatgctgccagtggtggagctcttagtgatatgacccctgctgaagctaggaatttgattgagaagatggcttccaactcccaacaattcagtgcaagaaatgatgctattgttcttagaggagtccatgaggtggccacagattcatcttcatctactaaaaataaaaagcttgaaggaaaacttgatgccttggtcaacctagtaactcagcttgccatgaatcaaaaatctacacctgttgcaagagtctgtggtctatgttcttctgcagatcaccacttaaatctttgtacttctttgcagcaatctggaatcaatgagcaacctaaagcttatgctgcaaacatttataatagacctcctcagcaacaaaaccaacaacagtag

SEQ ID NO: 71035 - DNA, 96 bp, Glycine max
  Peptide Sequence Number=SeqID_162720
atgactgtatctggacagcggtggctagaaatctatcaggggaaaaacagacttgttgctgctcctgcaagctcttactctgcaatactgacacag

SEQ ID NO: 71036 - DNA, 204 bp, Glycine max
  Peptide Sequence Number=SeqID_162721
atgaaagattgcaaaaatacaagtggcgaggatgtctccttcacctctaggatctcacaatcactcacaaactcatctcaagctctcaaaccggctcctgcttcaagctctgttttgcttgtcctcaagcaaaaagagaacaactcacttgtcctcaagcgacaacaacatgcagtgactatgtacaaaggtgtatgcaactaa

SEQ ID NO: 71037 - DNA, 321 bp, Glycine max
  Peptide Sequence Number=SeqID_162722
atggcttctagaaagagaaagagcattggtacaaggcccacatctcagtatgacacaaggagattctcttcattagatgcttggaccagatacactgataatgttctaggaagaaacattttacctgagaggaaagtagagctatatcagactgagctagatgactttgaggccgagctggagaggcataatttccataaacacctcaccaatttagccgatgggagcatagacctggctttgggccaacctgggaagattctcaggaaggacctgactacactggctcaggtgtggagtgtcctctcatactccaactag

SEQ ID NO: 71038 - DNA, 1080 bp, Glycine max
  Peptide Sequence Number=SeqID_162723
atgggatcgagtcaggcgccttcgcttagaagggggttctatcaagtcaaggacctagccatggcagaggtccccacagaggccattgcctccctcgtccaatattatgaccagccgttgaggaaaccatacctcttcgcaggattctatccatctttagctagaatttctaagatagtccaaatctcggcgcaggaattagaccatagaaagcaagtcgaaaatggggtggttggagtaccgaggaaatgtttggaagcaaaagcaagaatcttggcaggtaaaggcgaacgggccccgttcatagacatcctcgcacttttgatcttcggaggagtcctctttccaaatgtggatgggttggtggacctagcggcgatcgatgcttttctcgcttttcgtgaccgcaaggaaagcctggttgtcactatcctagcctatttatatgacaccttcgaccgaagatgtgaaaagagcagtacaaggattgtttgctatactctggccctctacatatggttggttttgcaccttttccgccaagaggtgagacatgcttgcctgctagaaagccaccgttcatgcacagagaaaaaagaggcaagttgggaccgactcttagcaagcaaagaaggagcgtctgtcaactggttcccccaatggaaagaaggaagaaccggggttcttatttcgtgcggaggatttccaaatattcccttgatggggacaaggggttgcatcagttacaatcccgttcttgctataagacaacttggctaccctatgagaggggcaccactagaggaagagctcgcacctattattgcacgagatttcaataacaccaatgtggaggcacttcaaaaggtctgcaaggcatgggagatggtgcaaaagaagaacaaggaactcagaggcagtaacaacgggcccatcggcggctactgtaggtggttgaaagcccacatgcaaggtctggattggctcctgagtttgagaaccactaaaggggtggaagttgaagcaccaaaggaagacgaagaggtgcaggcccttagggtagaactcgagaaagcctga

SEQ ID NO: 71039 - DNA, 261 bp, Glycine max
  Peptide Sequence Number=SeqID_162724
atgccacggcgaccacctccaatacagctagggaagcggaacccggtgctacagcccgcaataaacttaggccgagatagaaacacgacggtgttcggtcggaggtatagtcctcaagcttacccttatggcttgcctccagacttcactcccccgtaccgctccggaagatttgaaccaagcccctaccttcgaggggtaactccctccttatgccgattatccccctgcaagaagatgatgaaggagatgcccatctag

SEQ ID NO: 71040 - DNA, 444 bp, Glycine max
  Peptide Sequence Number=SeqID_162725
ggccttctttggtagctatagcccaagcctcttggagtcttctatcaaatacccttggggggaggtgcaagagcaggtgaaggccgacacggaggccttgaaagagaaaatggccacaatgatggaggccatgatgagcataaaggagataacggaggtcaatgcggttgcaatagccactaccagcaccattgctaagccctcatttagtgtgaaaaacaagcatgccttcccaccatatggcttgcctcccaactatatgccacccaatgtggcgtacactcccaatgagaatgtcaataactccactcctatactcattgagagccaacaacctcaatctgatcatgcacatgtctctcgacccattggggagacacatgaaatgccccaccacaatctagctgacttcgatccttgcctcggatatgccactgaaggact

SEQ ID NO: 71041 - DNA, 723 bp, Glycine max
  Peptide Sequence Number=SeqID_162726
atgaccgaccctctcaatgagtcaatctcttgcttgctcataagggtggacccttgggtactagtaccatcaccttcaaagggctacacgctctcgcctccagaagactacacgtcctcgcattcagagggctacacaccctcaccttcagaggactacacgtcctcgccttcagtgggacacacgccctcgccctcagaggactacacgtcctcaccttcagaagactacacgtcctcacctttagagagctgcacgccctcgccttcagaggactacacatcctcgcctttagagggctacacgccctcaccttcagaggactacacgtcctcacctctagagggctacacgccctcccctttagaggactacatagggttacatgccctcaccttcagaggactacacgtcctcacctttagagggttgcacgccctcaccttcagagggctacacaccctcaccttcagaggactacaagtcctcaccatcagagggctgcatgccctctccatccgaggactacacgtccttgccatcagagggctacacgccctcaccttcagaggactacacgtcctcgccatcagagggctgcacgccctcaccttaagagggctacacgtcctcgccatcagagggctgcacgcgcttgctatcagaaggatgcacgccctctccttaagaggactacatgtcctcgccttcagaggactacat

SEQ ID NO: 71042 - DNA, 411 bp, Glycine max
  Peptide Sequence Number=SeqID_162727
atgaaaagatggtgggctacacaccttcaaagctttgcggattcggtctttgccagtgaaaggatcgatgtgggtctgaaaagaggcaaatttagtcatcctgcttggacgaatgagaaaactggggcaaatgaagagggtgaggatgaaggagaagcccgtgctgtgactgccattcctatacagccaagtttcccaccaacccaacaatgtcattactcagccaataacaaaccttctccttacccaccgcccagttatccacaaaggcaatccctaaatcagccacaaaccataaccctagccaaggttcatcaaccctcattttcttcgagaatacgactcgaacgcaacgtgtgcttgtcacggagaagccctcggggcgttccattgagcattgtagggctctga

SEQ ID NO: 71043 - DNA, 297 bp, Glycine max
  Peptide Sequence Number=SeqID_162728
atggtggggtacgcaccttcaagctttgcggatttggtcttcgccggggaaaggatcggagcggccaatattggcccttctcattacccaccacctagtcatccacaaagtttgttggccgcacatccaatgccaagcgcaaaccaaaacaccaaccaagaaatgaattttgtagcgaaaaagcctatagaattcaccccaattccggtgtcctatgctgacttgctcccatatctgctcgataattcagtggttgctataaccccaactaaggttcctcaacctccttttttctaa

SEQ ID NO: 71044 - DNA, 213 bp, Glycine max
  Peptide Sequence Number=SeqID_162729
atgatgataaaaaaagatgatgacaaaaagctcaaagatcaatcaaagaacaattcaagagttcaagataagaatcaagaagaattcaagactcaagaagaaagtctagagacaagaatcaagattaaaggttcaagatctcaaaaatcaagatcaagattcaagactcaagattcaagaatgaagagaagactcaatcaagataagtattaa

SEQ ID NO: 71045 - DNA, 492 bp, Glycine max
  Peptide Sequence Number=SeqID_162730
atggataatgaagagggcgtgcaagaacagatgaaggctgacctatcggccttaaaagaacaaatggtttctatcacggaggccatgctaaaactccagaaaactatagaggataatgccacggcgaccacctccaatacagctagggaagtggagccggtgctacaacccgcaataaacttgggccgagatagaaacacgacagtgttcggtcggaggtatagtccacaagcttacccttatggcttgcctccggacttcactccctgtgccgctccgaaagatttgagccaagcccctaccttcgaggggcaactcccaccttatgccgactatcccctgcaagaagaggatgaaggagatacccatctaggccctctgcttcacctcaaagatccatctcccccacgaattaccccaaccaaacatagtccgccatgtcccgtcttcacccgcacccgtaaaagaatccgttcccttcgcgggagataa

SEQ ID NO: 71046 - DNA, 458 bp, Glycine max
  Peptide Sequence Number=SeqID_162731
tttggataccctatgagaggtgcaccatcggaggaaaccattgcgcctttcattgcgcgagaacttaggggaagtagcaatggtgtcataggcggttatcacaaacggttgaaatctagaacgcaagggataacttggctccaaaagttgaagtgtctgaatggggaagaggaaaaagtgcatgaggagagtgaagaggtgcaagctttgaaagctaagctcgaaaagacaagagtaatgaaggagaagctgagggtggcagtcactagagttaggaaaaaatgtgatgagctgaaagatatcaacatgaccgcggctgaagcgctacaacaggaaacgaaaaaagccagaaaggaagagtggagcaggaacaagttacgaggggctttgttaggcaacaataatgagctcaaacttagaatggccgagagggacaaatcaaggatggagagcatgac

SEQ ID NO: 71047 - DNA, 414 bp, Glycine max
  Peptide Sequence Number=SeqID_162732
atgaacaacctgaagcttatgctgcaaaacatctacaatagacctactcaacctcgacagcaaaatcacccacaacagaataattatgacccctccagcaacatgtacaaccccgggtggaggaatcatcccaaccctagatggtcgagtgaatctgaagagaagcagcatatccctcttccattccctctaagagcaatttccatcaaaaaaatggaagaggcagagaaggagatcttggaaacatttagaaaagtagagaagcttaaaggaagtgaaagaattagtatgggcggaaatgtctctgcattgattggtaaatctgttccccaaatccctgaaaaatgtaaagatccaggtcctttgcaatcaactaatgtggtaattcatttagctaatagaagtgttgtctaa

SEQ ID NO: 71048 - DNA, 384 bp, Glycine max
  Peptide Sequence Number=SeqID_162733
atggcttattccctagtggatggcgcctcctctcacctcttctcctttgtcttccactgcatctccatgagatccttccttataggcacttcagtcatagcatcctttggttatcaaaaggagcatgatggctcttgggtgaagaagggtgctcgacatgttggtgaagaaggacatgatggagaagattcatctcttctttcaaagactttggacaggtttgatggccttcaaacctttgttgatgaaaggtttgacaccttggaattacaagtagatatgcacttcaatgagatggagtcaagaatcaccaaggttgaagaagatgtgtcttacattcattcaagctttgatctaccaccaccgccgccaccatcatcttag

SEQ ID NO: 71049 - DNA, 333 bp, Glycine max
  Peptide Sequence Number=SeqID_162734
atgaagaacagtggaaaaccttcgcgaaatcgcccatggaaacgtcttggaagcgttacggaagcgcctcggcttggattttcttcgctgaaacaatttttctcactaattttaagtgattctcatataccaggagggttgaacattttgttctgccctccttcccctatttataggggaaaagagggaggtggttgccgcccagctcgcctaggcgagctgggttgcttccaccagaaggcaccgccttctgttggaagatcctggaaggcccaagtgggcctgattgctatttacacaccccttatttacttcatacaggggatcctctag

SEQ ID NO: 71050 - DNA, 876 bp, Glycine max
  Peptide Sequence Number=SeqID_162735
atggataacgttttaggaagacacatcttacctgaaaggaaggtggaaatataccacactgagctagacgagtgtaaggatgaattggagaggcgtaacttccatagacgcctcaccaatttagttgacaacaacatagacttggctttagtgaaggatttttatgccaacctttacatctttgaagacccttcaccaaagaaagtcagggtcagaggccaccaagtgaggattgatgcagatagcctcaacacattcttggagaggcctcatgtagttgagggcgagactttaccagcatattccagatactgcaggttgcctacagattataaagagattgaggttgccttatgtataccaggccgagggtttgttttcaactctgagggccatcctgggaagattctcaggaaagatttgatgactcttgctcaggtgtggagtgttctctcatattccaacctggctcctacttcacacacctcagacctgacagtagatagagctaggctgatctttggcctagactctcagatggacataaatgtgggagcccttatctctggccagatcacatctatagcccagtctaactcttctagacttgggttccctactctgatcaccgcctgtgtaaggccagaagggaaaaactgttggaatcctaatgatctaacagtttctatcaaaggggccagacgggcaaggatgaggctagctgaacctccttccacatctacaactcctattccagcacgtccctcagcagctccttctgccccagcttctgcagatttcagcatcttaaagccatgtgtcgcaacctacccttcagcgggagggcgacgtgtgactcgcgggagcgtgttctaa

SEQ ID NO: 71051 - DNA, 282 bp, Glycine max
  Peptide Sequence Number=SeqID_162736
atggagcatgaaacattccttgcaacttggttggcagagattgatttctctcccaatggcttggtgagcaaggagacgtcaccacacgttatgcaggatggtggaagcagtcaacactgtatcatcatcgtgattttacaaagaataatattactcggtgaaagagcagtctatgcaatgatgctggctttggaggaagattataaagatggaaatgagataacgaatcaaggcagtttattgaaggagtattggatcttgaaaagagaatcaatagactag

SEQ ID NO: 71052 - DNA, 1029 bp, Glycine max
  Peptide Sequence Number=SeqID_162737
atgccagaacttcagcataatgtagcgttaatagttcggttggctgaggctgacatccaagagatcgatcgagatttgaggagagagagggagacagcacttagcttgaaaaacgaaaaagagaagttagaaactgaagcagcatttcaaaagaagcagctggatagtatggaggaaataatgagtgtgttggaccgtgttggagaggaaaacactttgggaacattaacattggattccctggctcaatactttagggacttgcgcaaaagatctgctgataactacaagttgtgtaacttgtcatgcattgcttgctcatatgctctacctctacttatcagagtgttccaaggatgggatcctcttcgaaatccatctcatgggttggagttggtgtcacagtggaaggcattgcttgaaggagaagattatgttgatatatgggatgtatcatcaccttatactcaattggtttcagaggttgtattgccagctgtcagaatatctggtatcaatacctggcaggcacgggatcctgagccaatgttatggtttctggaatcatgggaaaagttacttccttcttcagtccttgctaccatattagacaatatagtcatgccaaaactatcaagtgctgtagatacttgggaacctcaccgtgagaccattcctattcacacttgggtgcatccatggctacctttgctggggcacaagttggagggtatttaccaggtgattcgttttaaattgagtactgttcttggtgcctggcacccaagtgatggttctgcttatgctatattgtctccttggaagactgtatttgattctgcaagttgggaacagcttatgcttcgttttatagtaccaaagctgcagcttgtcttgcaagagttccaggtgaacccggcaagtcagaatcttgatcagttttattgggttacaaactgggcttctgctattcctattcacctgatggttgatatgatggagaaattcttctttgccaaatggcttcag

SEQ ID NO: 71053 - DNA, 468 bp, Glycine max
  Peptide Sequence Number=SeqID_162738
ttgaagacccctgaagaggcaactgagctaattgagaatatgtcaaccagcgatcatgccattctgtgcaatagagatgcaccatctgtggtgaggctcatgaaaaaggccaatgcattcccattgaagaacacactcaagaagccaatccgacaagggcctaacatctttcagaggactactaagctggaggagattttgactcagtttatgcaagtaacaatgtcaaataataaaagcaccgagttagcactaagaaaccttgaggacgaatgcaaagttgtgatgacaaggagtaagaggtttatggaggcggaggatgaggatagtgttgtgcccaagaagaaagcaagaagaaagctgctgaaaagaaaggaaactagaaataaccatgcccttcggagaagctttacagcaaatgccactctactccaagtttttgaaggatatgttgacaaggaagcacaa

SEQ ID NO: 71054 - DNA, 363 bp, Glycine max
  Peptide Sequence Number=SeqID_162739
atggctttcttgaacgagatgatgagtgaaattagtaaagacaatgtagatgaaatgtggcgacatatgaaggaaattttggagaatgtggatgaaatatatcaagagaaaatttcaaaagctcttgtaccacttgttgaacactttgccatggtattaggaaaaaagtcaaaccattctttaggggttgacagtgcaccaattacgaagaagttttcacaaaaacaaattattcaaaaacaacttgagaatacacaaaaccaagcaaataatttggagttgaaagtgcaaaagttgacgaatattacaaaaaagcaagaagatgtcattacccaacttcatattgaagtacaatcccaatga

SEQ ID NO: 71055 - DNA, 603 bp, Glycine max
  Peptide Sequence Number=SeqID_162740
atgtttaagaagggactgacaaccaaaggaaatgcacttaaagccttattttcaattcaagaagagagtgacaaagaggacttgaatgaaatagatgaatatgatgatttcagactctttgtgaagagattcaacaaatttctgagaaacaaaggaaatcaaaggagatcaaatatcaatccaaagaagaaaggagaagattcctccttagccccaaagttctacgaatgcgatcaacttgggcacttgagattcgactgtcttatctttaaaagaagaatggaaaaatctgacaagagaaatttcaaagaaaagaaagcatgcatcacttgggaagataatgacatggattcatcaagtgattcagaaaatgaaatcataaatctcgatctcatggccaaagactatgaaagcggagaagaggtaatgtcttctaactatgacttatctatttcttttgatgaactccaagatgcatccaatgacttgcataaagaatctgtcaaaattgccaaattattttcatattctaagaaaactatttcaagtttagaaaaagaaaaatttgaaattaaatgtagaattagaaaatctgaaatctga

SEQ ID NO: 71056 - DNA, 537 bp, Glycine max
  Peptide Sequence Number=SeqID_162741
atggcgatgaacgtgactaaaggaaataagtcaaggtggacggcagcaatgctaagtggagccggtaaaggtacagggtgttgcggcatgagtgtggggcgtggcgacagagttggcatgataatgggtgcagtaagcgtgggtgacggagtcggtggcagaggcggtattagagcggcggaggtggcggtggtgatggcacggaggaaggagggtagtggtggctggttctcggagctgttgtgggtggtagtggaaggtggtctggcagccatggaagtcagccatggaagctccgtttggcgagtagtgtgggtggtggtagtggaaggtggtctagaagccatggaaggcagccatggaagctccgtatggagagtggtgtgggtggtggtcatggaaggtggtctggcagaggttgtggtagtggaagttggtatgggtccagcacctccagaagaagaagaaaagaagatagcacttggaattcgaggaccaagctgcctcctaaagcaaggagaaggaaacaaattctga

SEQ ID NO: 71057 - DNA, 381 bp, Glycine max
  Peptide Sequence Number=SeqID_162742
atgaattatggaagagaaatacacagcaaaacaaagttgaaggaagtgcagcacacagcttcctcacgagatgcacctatctcgccactagagaaggcgagaccttcacatatctcgccagtccagaaggcgagaccttctcctacgtggacgtatctcgccaatggagaaggcgagagctcccttatctcgccagtccagaaggtgaggccttctcctacgtggacgtgtctcgccagtggaagtggcggtaccgtccacgtcacgccctataacgccaatgggaatggcggatcaaccattatcgccagcaccaccggcggcttccatggaaaacaaaccccctccgtaattacttttaaaagagacccctttaggtaa

SEQ ID NO: 71058 - DNA, 678 bp, Glycine max
  Peptide Sequence Number=SeqID_162743
atggccagggatagattggcagatggtcaagtcgataatatcatattgaaattgataactggtcgtgaaaaagatagtcgtgtatacaatatcccaaatgttcctgaagttgctgcacttattgttgatggatatagaatcgacatactttaccgctctacatcagccgacaaaaaaaggaagagaaatcgtctgacaatgagacagtggttcgcttataggcttcagtctaggccaaatgaagcacagactttattgcattctaggaaactatttcaacaattcattgttgaagcatataccatggttgaatcagagcggctcagctacatcaaaaacaaccaaaagaaacttagagttgacaagtattgcagcttacaaagttcattggatactggaacaagcaatggcttgactaaaggaaaaagagtcattttaccttcaacctttgttgggagcccacattacatggatcaactttattttgatggtatggcaatatgcggtcatgttggtttcccaaatctttttataactctaacatgtaatccaaattggcctgaaattcgtagattactttcacctttgaatcttaaaccaacagacaggccagacattgtctcacaaattttcaaattgaaatatgaacaaatgctttcaaacttaataaggcattag

SEQ ID NO: 71059 - DNA, 387 bp, Glycine max
  Peptide Sequence Number=SeqID_162744
atggcagcggaatggagaaggaaaagagagaggagacgccacttcaaggagaaaatgagtctagaagaagctcactaccataggaggccacggataagagcttggaagaaaaatgagatgaatgaagggagaggaagagatgagcacgaaattttgtgctctaaaagagctctgaaatatgaaacccaaccttggcccatgggcttagaaatctatcctgaggttcatgagaaccctagggccttcttgagcagctcttgcccaatcctcttggagcctcttgctcatggctctagtgattggtcccttcctagggagattgcatcagggtatgacagagtgactgctgttacggtttatgatggcaatgatggagttcagaaatag

SEQ ID NO: 71060 - DNA, 339 bp, Glycine max
  Peptide Sequence Number=SeqID_162745
atgactaatgagtgcattgacaggaagactatattgaacctcttggggaatagccctaaaggaatgaacccttttttccttcaggcaacacaggtgaggtataacaacaaaggcgcctatgttatccttgaacccccgaattttgacaatcctatatttcatggattttcagcagttactccaaggccgaaggcgaatccctattacgattatgaagaggtgatagactccgatgaagaattggatttggcctccatgaaatctgctggttctcaatccagtgcatgttttcagttagttttccttggtaccagactaccgtttcttgtggcaatttag

SEQ ID NO: 71061 - DNA, 621 bp, Glycine max
  Peptide Sequence Number=SeqID_162746
atgatagaggtagttaaaggagggctaattaagttgttggatgcaagtatgacgtatcctatttctaatagtccttgggttagtcttgttcaatgtgtccctaagaagggggacaccattgtgatggaaaatgagcacaatgagctcatagctcatgcaaggtgtttccaattgacatcaactatcaagccaagaaagagacttatgtctggagccaaaatatatttttgggatgattcatacctctttaaggtatgtgaagacaatctagtaagacagtgtgtgacttataagaagtttgatggcatcttggctaaatatgaggtgactcacaaggttaaaaccccataccacccacaaactaggggccaagtagaattgtccaataaggagttgaaaagaattcttgaaaaaacaagcacaaagccttttgcgctattaagtttcttaaatgtgatcattttagagtatgagaataggttgttgcagtactacaagcatggtcaattgacaaccacccatgctatcaccataaaaaacgagtatggatgtggtcaattgacaatggctcaggcagtcaccgctagtgatagtaacagtcgttgcccatgcccaccatga

SEQ ID NO: 71062 - DNA, 234 bp, Glycine max
  Peptide Sequence Number=SeqID_162747
atgaaattctgggacctattcttcgtggctctcatgccagtcttggagaccctcttgattactctccttggtttattaattgcaacccaacgatttaatctcctgcgaagcgttgaagcaaggaattatttaaataatgaacttatctggaaaggatcatccaaaattatgttgtgcttaccatcaattcaagaggaaggaattttcgcaagaaatcttttcaggtctatatga

SEQ ID NO: 71063 - DNA, 1124 bp, Glycine max
  Peptide Sequence Number=SeqID_162748
atgtcagaaaggtttgatgaagatggcaatgagatgatgaggggtggggtcgcgattgaagaggaggcaacaaggcaagatgactgtgtgggggaatgcaacaaaggaaagaaaaaggagaacgcaaccatcaaagtagtgacaagtgtgatattctttaaagaaattaggccttcaaaggttggactagtgcctatacagagagatgtatgtggtagcaattttgggatactagactctaaaggtgatcaattgcttcatgagacatcatcattagacttagacaacctagacaaagggagtgatatggcttgtaaggaggtatatgattcatttggggtccaaggatggggagctttcattttcaaagaaaagctcaaatttctaaagaaagaagtgaagttgtggagtgtgagcaagttgggtggttggtcatcaagcaagcttagaggaaaaggagcaacaacattaggggctcaaaagtggatggggagtcgtgtgaactttaaggaaatcaatgaggaagacaatttcttgcttattgattctttctccgagtttgagattaggaaggtcattaaagttgacatcattaaggatattcatgaatttcatgccaatggtaagttgcctaaaggattaaatgcttctttccttgctcttattcctaaaaagggtttgcgatgtttggtgagggaagcagaagcaaaaaggctcctatttggtgttagtattaggagtggcaatttaaaggactctactctactggtgattgtatcacctcgaaagcaattcttagggaattctttggagagaggtgttggtaaaaaatatgggttaaaggagttagataaacttgttgaaggttctttgaacaaaaaagggtttcaatggtggaatgatctcgttcaaatatgtgagattgaaggtgtacacaagtttttcaagattaaagatatgttggtcgatggtttgatggaacatggacatggaatttgtcttagaggttcccttggttcatttgggagcaataacttgtacaaaaaatgtgggctactattggtagacaaggacctcaacttggagctcaagacggatgggaatggagatcaaattttgggaaa

SEQ ID NO: 71064 - DNA, 409 bp, Glycine max
  Peptide Sequence Number=SeqID_162749
tgaagaacttcgtgactattatgaaggaaggcatatgccacatcttagacctcactcccataggagagaaaaggaaagaaagtctcaagaggctaacattaacctcccatacttccatgggaaggacaatgtagaggctaacttagattgggaaataaggaaagaccaaggtcaaggcatcttaggggtgacaccttctaagcccaaagatgataaggggaagacaatagaaaagcaacctcttaaggctagtatgcaagagaagactagctccatgagtatccaagatgaggctactacttcaccttcctctagtgaaagtgaagaagaaaaaggggaagaatctagtgaagagatctatccccaagaagaaggacaacctttaatggttaaggaggagtgtaaagag

SEQ ID NO: 71065 - DNA, 492 bp, Glycine max
  Peptide Sequence Number=SeqID_162750
atgttgcaggaaaggccacagaatcacttggatatgcaccaccgcttagattccaaaggccagcatcaaggaaagctaatcaattatagagttagcaaactaagagtcgttgaacttcttgatggcctttgcgaaaagatgcaagattatacactcaagataaatacaaatacctatgaatggttcaaagtggatagttgggataacctcacaacaaggcctgagcctaaaattccagaggatctataccatttgattaagaaggcagtttcaattaggaagcatcttgagaggaacaaaaaggacaaggactccaagttcaggttgattcttgtagacagcagaatctaccgacttgctcgctactacaacaagactaagaagctcctactagtttgggtgtattcttcatatattctagctatccattttaagaaattcatgtatagagaaggaaaaagggagagaaaaagaaagaaaaaaatcatttaa

SEQ ID NO: 71066 - DNA, 860 bp, Glycine max
  Peptide Sequence Number=SeqID_162751
atggtggccactagatggaggcaatttaagtcttcgctaaccactaaatttgtctatgctgacactgaaggtcgacaaaaacaagatccttctgtaaaatatggaatggatcgacaaacttgggatgaatttgctgcaagtcgcaagacccctacctggcaggcatcatgtggatctagtagttactctacatcaataacacaacaacagttggctgacataattggaagccttaaggaagagtggaggaatgagattatcgaaaacttgatggaagaagtaaggaatgagattgaagaagaaaacaagcggagtctggagaaattgaagcagaagttgaaggatgccataaaaattgatggtgtggtaagggttagtgttgaaaaagttttatatggtgatgcccaagtcccgttctcgacatcaaagatacagcatgtcaggcaagcccttcaaacattcattgcgtggccaacaaatcttgtgaaaattgtgtcacatgatgagtcctatattagtccaaagaaaccacctgaaacagttcaaagggcgaataatatttttgaagatgatctctcgcgtcagttgattaagagcctatatgacatttacgagaagcccgttgagctgatgtgggatgccagtaaatttgggattccaaatgttgatgtatccttcttcttgacatattctgatcgatgcatgtctgaaccaatgaaggatatggaccgcgctgatggctttggtggacaacctatggttgggaggatagaggatgatgcacttcatgatttgtttggtgcaaaaaggattttggctaatcatgtatcagctgctcgctcaaaagagaggaagatgcg

SEQ ID NO: 71067 - DNA, 155 bp, Glycine max
  Peptide Sequence Number=SeqID_162752
atggggcttaccaactggtatggcctaataccagagcttttccccaatgttaagtatgttcaagggatcatgactgggtcgatagtgatttccaaaggaacaaagtacctacctacctacctaatcacattaatgtatgtaccgttccaagacag

SEQ ID NO: 71068 - DNA, 663 bp, Glycine max
  Peptide Sequence Number=SeqID_162753
atgatacactatggggagttgctaggtgcacccagcattattgctggggcacccagcaaacaaaaaaaacttcttccggaagaagaatttgtgacttccggaagtacccacaaactacttccggaagaacgtcatccggaagtttccggaagaacgtcatccggaagtttccggaagaaccttcttccggaagtttccggaagaagcttcttccggaatttccattggtggtcccgtgaagtatttggagattcggtggtcccgtgttccgtatttgaagttttattagtggctgttgttcctatttcgtcggaggcactgaggcccattccggaagaagtgtttctggaaaacacttccggaagaacttcttccggaatgggctcagtaacttccggaagaccttctaatttgttgtgcaggtttcatatcgataagaatgtgaaggcgaagtgcaaatctttaatcggggaaaaaaatgcgtgggactatgtaatggatagctggggtactttggttgattgtccgtccgaacacgagttccatgagtcacatcagaagtttcaagttgcttgttcgccttggccgatgttcattgactatgttaatgacacatggattatcccccacaaggaaaaatttattacagcatggacgaataag

SEQ ID NO: 71069 - DNA, 504 bp, Glycine max
  Peptide Sequence Number=SeqID_162754
atgggctccacgatctcctacgttggacttgcagctatcatccaccggatgaatgaagagagcgatacacgtaaaaggaactccaacgcccaagctggtaaccttgacaagtttaggcgttgcggggttgtcgagcccctcagcctggatgataattgtctggactcaagtcaagaatcaagagtcaaacaagtttcaagaatcaaagagtcgttcaatcaagaatcaagattcaagagaagactcaagatatgcgaaagtgactttgagggttccatccatcaacccctggtagagaaggaagtcattcccattggcaattcttcaacaaaggagttgccccacgaggcttccgacgacgggtcatcctccttcgagaggctgatggactcgagcaacattggcgagggcagctcccaactttgtgaacaggcaacaaagatgaagttagggtttggcctaaaaataggcattggttttgactgggtgaggaacaatgcttga

SEQ ID NO: 71070 - DNA, 126 bp, Glycine max
  Peptide Sequence Number=SeqID_162755
atggggaaatggctgacgacagagtctttcggaagacccgttaggggttcttccggaagttccggaagaaccttttccggaaagtttccggaagaagtgttcttccggaaattttatgaaaaatga

SEQ ID NO: 71071 - DNA, 237 bp, Glycine max
  Peptide Sequence Number=SeqID_162756
atgaggataggagacaaggatgttggaatcatggacaagcttgaatatgattatatgatggaagaaaaggttgagaatgagaggccttggatcttcttcatcaatggagtcctttgcttcttgaagtttgatggcagcggaaaggagaaggagaaatatgattggagacgccacttcaaggagaagacgagtctagaagaagctcaccaccataggaagccatggataagagcttga

SEQ ID NO: 71072 - DNA, 2016 bp, Glycine max
  Peptide Sequence Number=SeqID_162757
atgttcaaacgttgcggtgcgcccagaagaaaatccaaatggaagaaggtgctagtagcacgtaaccgctacacgataatcgcatctcacacacatgggtcgggtcgggttgaaccgcaccagaacccaggcgctacacaagccgttgatctgtatccgttaaaaataaaaatccacggccacaaatgcaaccatgcaaaccaaaatagggaagctagcggtgaaccaaacttcgaaaccactgcacagagtggtggaagacaagttcatttccctgttacggacatgcggaacctgcgtgcggctgcaccagatccaagcccagatagtgacccacggactcgagggaaacgattacgtcaccccgagtttcatcacagcatgcgcgcgcctcggtggaattcgccgcgcgcgaagagtgttcgacaaaacggcgcaaccaaacggcgccacgtggaacgccatgttccgagggtacgcccaagccaattgccacctcgacgtcgtcgttttgttcgcgcgaatgcaccgcgctggcgcgtcccccaactgcttcacgttccccatgaaggagaagaggttcattgcgttgtagccaaacgcggctttaagtcgaacacgtttgtggggtgcgcgttgattcacatgtattcattgagagggggagtgtttgttgctgatgcttacaaggtgtttgctgaaatgcgcgacaagaacgtgttcgcttggacagctattgttgcagcacacgtggcgtgccgcgacatggtttccgcgcggaggctcttcgacctcgcgccgcagcgtgacgtggtgctgtggaacgtggtcgtttcggggtatatcgagttgggggacatggtggctgcgagggagctgtttgatagaatgccggaccgcgacgtgatgtcgtggaacaccgtgttgagcggttacgcgacaaatggcgaggttgaatcgttcgtgaagttgttcgaggaaatgcctgtgaggaatgtttattcttggaatgggttgattggagggtacgttcggaatggactatttaaggaggctttggagtgttttaaacggatgttggtgctggttgaaggtgaaggtaaagaaggtagtgatggtgtggttgttcctaatgattacaccgttgtggcggttttgacagcgtgttcgagattgggggaccttgagatgggtaagtgggtgcatgtttatgcggagagtattgggtataaggggaacttgtttgttggaaatgctttgattgacatgtatgcgaaatgtggggttatagagaaagctcttgatgtgtttgatggcttggatgtgaaggatataataacttggaacactataattaacggccttgccatgcacggccacgtggccgatgctttgagtttgtttgagcggatgaagagggcgggagagaggccggacggtgttacttttgttgggattttgtcggcctgcacgcatatggggttggtgagaaacgggcttttgcatttccaatcgatggttgatgattactcgattgtgcctcagattgagcattatggatgcatggtggatttgttgggaagagctggtcttatagacaaggctgtggatatcgtgaggaagatgcctatggagccagatgcggttatttgggcagcgctgcttggggcgtgtaggatgtacaagaatgtggaaatggcagagctggcacttcagcggctcattgaacttgaacccaataaccctggaaactttgtcatggtctcgaacatttacaaggatctaggaagatcgcaagatgtcgcccggttgaaggtcgcgatgagagataccgggttccgaaaagtgccgggatgtagtgttattgggtgcaatgatagtatggtggagttctactccttggatgagagacatcctgagacagatagtatatatagggcattgcagggattgactattttgttaagatcccatggatacgttccaaatcttgtggatgttgctcatgcaaactga

SEQ ID NO: 71073 - DNA, 300 bp, Glycine max
  Peptide Sequence Number=SeqID_162758
atggaagggaaaaaatttgtcacattgagaggcctaggggacaaacgtgtccttattattgcatttgaaggagataatctgaaagccttgttggatggtgtgtcattatggctaagtaagatctttaagtatcttgttccatggaaaccaggtgaaggtcatgacaataggctcagtttgacgcaatcctaccccacaagggcattggatagaagactccaagtagattgggccagagatgcaagagaaggccctagggttcttacgagctttagggtagattttgaatccatgggctaa

SEQ ID NO: 71074 - DNA, 465 bp, Glycine max
  Peptide Sequence Number=SeqID_162759
atggaggaaaggagagatgcaaacactaaccctttgggtgggagagatatgggagagttcaatatgttgagtagtcaaatggaggttcatattccattggtggggttgaagaaaggtcttaagctttggaactcaaaatactttgttgacttggataaacaatgcaaggatcttatggtgaacatcaatgaattggacctcaaagatgagaatgcaaatctttgtgaagcggaactaacaaggaggagagaccttgtaaatgatttttggaagatgtttgagagaaatgaatcattagtgcatcaaaaggcaaggtcaaagaggaggacaaatatagtgagagagatcctggtgggtgatgggtgggtggaggaacccattcaagttaatatgggtgttaaggaatttttctacaaaagatatgaagagaatacacatgcgttttatggaaatggacataaataa

SEQ ID NO: 71075 - DNA, 285 bp, Glycine max
  Peptide Sequence Number=SeqID_162760
atgggcctaccccttgttccagttttctgctttggccagacaaaagcctacaagtggtggaagcctccaggaaggttaatgcaaaatcttgcaagatctcctataccattcaaaaatccattgtatatcgtcgtgggtagaccaattgagctagagaaaaatccagaaccaacaatggagcaggttgccaaagtacatagtcagtttgttgaagcacttcaagatcttttcgaccgacacaaagctcatgctggatatacaaatctcgagctgaaaatattttga

SEQ ID NO: 71076 - DNA, 420 bp, Glycine max
  Peptide Sequence Number=SeqID_162761
atggtcattgatattgttgtgtggaaggaagtagctggtctagacatgggtggagtccgcaagttcgatgaaacgcttgatgggtacaatgagatgcagacctataggggaatgctttttgacccaactatgaacttgaggaatcgcttagaagttggtgggctgactacaaaagacataatattagtttacctcattacctacattctcacttcgagattcattgactacttcaatgctgatgtctctaatgagattgtggactttaccaaagcatctagtgagattactgaaaggcatttcaagaagcttggaatgagatttattgatcatgaatggataatggttggagagtcgccagctggaaactttgaccagatgcaagaagatgttgaagctaaaagctccacaagagcctag

SEQ ID NO: 71077 - DNA, 285 bp, Glycine max
  Peptide Sequence Number=SeqID_162762
atggatcctaatgttgatgaagttgtggaatgtgacaatgtggatggtgaggaaggagataaagaaattggtaggaaagatactcattatgagagtgatggagatgttgtttattggaaatataatcaattagtacctaagcccatgaccaagatcatagtgacactcgagtacctagtcaagttaatggtactaacaactctgcacaaacccagaagatggttaatagcactgttaagggaaagcgtaaaagaagacaatgatcaggggggcggcaaagcttag

SEQ ID NO: 71078 - DNA, 375 bp, Glycine max
  Peptide Sequence Number=SeqID_162763
atggagtgttacaaaagtcgtatacaacatcgattttttaaacacgagtataaggtcgggttgaacctgaatcaggaaggtgagaccctaacgaattcttcgaagtctaggtcttggggagagagatgtcagcaggttctagaaatagtgaatgaaagcaaggttttctggggtggtcttaaatctgataatgtcactatcgcaacctaccctttggcgggagagcgaggcgagattcaaaaggtgcatctttcaagaaggaaaacgcgtggagttgtcaccaatgtttattcgaggaaaacgttagtaaaaccaaaagacgaagagagaatcgttaaggtgttggaccttgaaacgatctcaagcgatatttga

SEQ ID NO: 71079 - DNA, 243 bp, Glycine max
  Peptide Sequence Number=SeqID_162764
atgttagtgaaaaatctcgtcgaaggcctaagagtacatgacaagacagaccacacacaggtaagtcaggtcactctcaccaggaaaaaggaagcaccgtgcaaggaacatttctcttaccacagacatagtttcataaatcctaatggtggtgttgtgagaaaatgcattctgaaccttctgttcaaattcatcgatgatcctacggttaacgagtatgagatcatagttttacagggatag

SEQ ID NO: 71080 - DNA, 120 bp, Glycine max
  Peptide Sequence Number=SeqID_162765
atgcaggaaaagcaagaagcaccaaaaactccgaacctcaaaattccggaaaaagctactatatttcaaagtgtagcaaaaggtaacaagtcctctaattccattgctggaagtgaatga

SEQ ID NO: 71081 - DNA, 2868 bp, Glycine max
  Peptide Sequence Number=SeqID_162766
atggctaaagaagaaatcacttcctttgcagtcattcatcatagcctctatatgtacattggacattctaatggtaatatttcagttttgaagcttgaccaagagccatcatggcatttggttcagatgaaatacaccatacctctctcagcttcctatgggaattctgaagtgtctgatgatactgttgtgacgcatatactgcctcaaccagcagctgaaagtaagagggttctcataatctttagaaatggtcaaatgatattatggaatattcgggaaagtagatctattttcaaaactggtgaaaatatgttgcagccactgcatactgaaacaaaaaaagtgacttctgcatgttgggtgtgcccttttggaagtaaagcaattgtagggtacaacaatggagagctcttcatttggagcatccgttctctaaatataggaaatggttcagcatctgaacatagttatcaaaatactcctttgctcaaacttaacttaggatacaagtctgacaaaatttccataggatcaataaaatgggtttatgctggaggaaaggctagtcgactatatattatgggagcctctgactgtgcaacttcaaacttgttgcaggtagtgttgctgaatgagcatacagaagctcgcacaattaagcttggacttcatttgtctgaatgttgtattgacatggagatcatatcaacttcaactgagcaaagcaagaataaacaagattctttcattttgcttgggaagtcaggccatctatatctgtatgacgatattttgattgaaaggtatctgctacaatgccaatctaagtccacaccatcacttccaaaggaggtaactgtaaagttaccactggcagaatcaagcatcacaacagcaaaattcatctccaacaatcccaatgtattaacatttgaagatgagtattacagacagctgatcacaagctatccactgtttgttcctgttgaaacaaatcaaaaagatgagattagcctgagttctgccaaatttacaggattttctaaagttcaaaacttgtacataactggacacagcaatggagccataaacttctgggatgcttcatgccccattttcactccaattttacaattgaagcaacagagtgaaaatgactgttcattaagtggtatacccttgacggcattatacttcgatagcaactccccacttcttgtttctggtgaccagagtggaatggtgaggttcctcaatttggtttgtgtctttagattcaaaactgaaccatatgccactaacagcttcatgtctcttactggaggtacaaagaaagggactgatcatataatccaaagtgtgaaacatgtaaagatcaatggtgccattctgtcattgaacatagatcccagcttgatgcatcttgctgttggttctgatcagggacatcttgctattccatgtattcaaagaaatgcgtttgaggtttcagtttttaacatagatggcccaactttgttataccagaaacatattgccagtgaaatttctgctggtatcatctctctgcagttcctaaccagcagtttacatggttttgaaaaaaacattttagcagttggaacaaaagattcatctgttctggcactagataaagaagctggaaacacactgggcacgggaactattcatcctaagaagccctctaaagctctatttatgcaggttttggatggacaaggtgcaccggtcaatggatcgattacaaaagatggattagagtcgagcgaaaggaatcatattgaggatgcaacaacaaagcaacagtacattttgctttgttctgagaaagctttatatgtctattcattggtgcatgcgattcagggagttaaaaaggtgctatacaagaaaaggtttcattcctctacgtgttgctgggcatcaacattttacagcccttctgatgttggccttatactcatttttacaagtggaaaagtagaattaaggtctttgccagagttgtccctaattgtggagacttcaattagaggttataattattctcctccaaaattgaagtcattttctggctgccagatatgttgttcatccaaaggagatcttgttttggtgaacggtaaccaagaattttttgtcgtctcgctgttggtgcaaagaaatattttcaggcttttggactctattagctgcatctacaggaaaaatatgatgctgtcgccagaagtgtttgttcctggcccagtcatctataaggaaaagaaaaagggtatattcagctctgttatcaaagattttgctggcagtaaagaaaagcatgctcccatattggaaaccgaagatactacagaaagcatccaggaactctcagctatcttctcaaatgaaaattttccatgtgatgctgataataatgataatctgactgttgatgaagatgagcttgaattaaacatagatgacattgacctagacgatcatgaagaaaaacacaaagatcaaagtatattgggagctcttaataagaagaaattgactggaaagtttcaggctctaaaaggtagattgaaggagatgaagggcaacatccagaaaacatcaagtaaggaagagcagcaagatgagcaagctggtgcagtcgatcaaatcaagaagaaatatggattttcttcttccaacgaaacaagctttgctaaattggcagaaagcaagctgcaggagaacatgaaaaaattgcagggtatcaaccttcgaaccacagaaatgcaagataaagcaaaatcattttcaacattggcaaaccaagtgctgcggactgcagaacaggaaagacgaaattag

SEQ ID NO: 71082 - DNA, 186 bp, Glycine max
  Peptide Sequence Number=SeqID_162767
atgtcagtgaaaaacctcgtcgaacgcctaggagtacatgacaagacaaaccacacactaggagaccaatcagggtcgcgctgttttgcgagaatgctccaaccatatgggatcaacataggcttaaaggagcactcaaaccaggtgtatttacccccaaggcctacaccccgaagagtctgttag

SEQ ID NO: 71083 - DNA, 240 bp, Glycine max
  Peptide Sequence Number=SeqID_162768
atggagaaaaatgaagaaacaacaatggaggagaatgtaaagctaaaaattaatcgagccagcacatgggaagcttccttgagaagcaaggaagttgtcttccttgtaggcctaggatcttcttcatcaatcgattcctttgcttcttggaagatgaatggcagtggaatggagaaggaagagagagaggagacgccacttcaaggagaagatgagtctagaagaagctcaccaccatag

SEQ ID NO: 71084 - DNA, 402 bp, Glycine max
  Peptide Sequence Number=SeqID_162769
atgatcacctcttatgtaaaaaagaaatcacttgataagaaagaactacgtaggtctgatttcctcatcgcaattgaggaatacgtagaagcaaagggaaacacccttgtcgaccacaaaaagagtaaaaatataaaaaggatcgcgtcttttccggtttttccgacgttttcctcaaataaacgttggtggcgactccgcgcgtattcctttcgtggaacacgcatcccgcgagtcacgcgtcgccctcccgccgaaggtgttcctcttggtgcgggggttcaacggcacacaacggcggctcgcggtggccaccggtggtcgtgggtggtggaggaggagtttgagagtgttggggaaaggaaggaggagaaatggctattttacgctgctaaatcgtaa

SEQ ID NO: 71085 - DNA, 2625 bp, Glycine max
  Peptide Sequence Number=SeqID_162770
atgagaggtggacctctatcgtggacgcgttgttgtcgctcgttcactctcacagaccctcgcacaagcctctctcgttctcgttctcgttctcgctcttgtagatcctcgttcgttctcactctcgagctcttgagcttcttctctgcaccagccccaaactcctgctcaatcctgtgtcaagcaaggattgggtctgttagcatttttctgttccatgtctatgagtttagactagtatggaaagaagagaaaagaagtaaaaagttgagactggggttttggcgctatttggcactcataagacatcctaggcagcagcagtatctatctattcacttctttgttgtacttccaactcactcatctcatgggagggtttgtctggttggttggggtaaagggcgtatggcttcatatgtatccatggtggcatcgttgcacttgcacataagaagaatcgtctttgggaacgcacatcccagacttcactcaacactcactaaaccccagctcaaggccctcgttctcgaccactactcccatggcaagttctccaaccttatccaaaacatcgtcgcttcgccccctgtcctccacaccgcatgccaaaacctctccccctcctttcccccccctgactgcttcagcattccggccacgtgccgggagctcctcgaaaaccgcttcgacgtggcatcatgctgcctcacactaactccctctttcgttttgcccaacttgaagctcaaggtcgtcattgaggccattcgaatggttcttgaaatcgtctacgacgaccgcttcgtcaccttttgctatggtggccgcgtcggaatgggacgacacaccgccataaggtacttaaaaaactccctcgagaaccctacttggtggttcactgtcaggttcaagcctcacaggtttcagcatttccatgtcgagaagctctgttctgttattgaaagcaaagtcaaggattccattttcattgatttgataaagaggttgtttcaatgtaaggctttggtcattgaattgggtgcggattggttaggaaggggacttcctcatgaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggatgggggttgtcaagactttggaacttggattgggtttgcgtgttgataaggtgaataccgctattcatagcgcggtgtcggagaagattgagtttcttgggatggaattgcaggctgttccgccttccattttgcgcccgccaatgtcggagaaagcaattagggcacggaagaagtacctcaggcagaaggaagtcagggctcttgaattgagaaatgctagagcaaggaacagaaggaaactggggttgaagatatttagtcatgtttataaaaagatcaagcaaagtgatgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagataaacatttgaatcctatagaagctaggaaggcgatagaggaagaagaaagaagagtaaaggaagaagaggaacaaaattattcaaaaggaacagttgaggatttaacaaagctctgtatgaaagttgaggcacccgaaatactcatacgaaaggctgtgaagttggttgggtttacaaatcatatgggtcgtccaaggccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgtattttcctacagaaagagaggttaagatgatgggagatagaaatctttctgatccaaaaccagtagatggagctttatctttggctgtagtaaggttggcatctgatgagcctccatgtcattgcattgcccatttctgtgacaagacaactaccgtcttttatcgggtccatttgctgcaaaacagattgaatgtcagcccattggacaaagaaaaatgggtacaagggatgggtgtaattcatgaaagcctaaaccgtaagtgcctccctctctgtactgatcatgtaaatgatttgtacatggggagaataacacttcaagacattgactgttcttattgtgtggatgtggactga

SEQ ID NO: 71086 - DNA, 981 bp, Glycine max
  Peptide Sequence Number=SeqID_162771
atgcaccatgtctctagaacatgccattccacgagtgataaatatgcaagaacgcgccaccatgtcttcagcacgtgctaccctacgagtgacacgtatgcaagagcatgccaccatatctttagtacatgccattccacgagtgacacgtatgcaagagcacgccaccatgtctcaagtaggtgtcattccatgagtgacacgtatgcaagagcatgccacaatgtctctagtacgtgccacttcaagagtgacacgtatgcaagaacatgcccccacatctctagtacgttgcactccgcgagtgacacgtatgcaagagcacaccaccatatctccagtatgtgccactctatgagtgacacatatgcaaaagcacgccaccacgtctctagtacatatcgctctaggagtgacatgtatgcaagagcatggcacatgcactacacacaccaggctcgtcaaacccaaggttcgcctttggctcgtcaaacccaagattctcccttgatgagtttaacaggttcacaaaacctaaggtccatccttggtaagcctcaacgcaaccttacatgcttgttaaaatccaaggcaaacacatccctagttcaaggctcgttaaacccaaggttcacccttgctgagcccctcttttgccaagtttcgtctccacaggaactcaaggaatacaaaacccaagacacccccttgtcctgcttactccttaataagcacgacgatcgcaatcaaaggtccagtcatactaactcctcaaaccatcaggggaaaagctccatatgtaaagatgacctatcaccagaatgtttgtgcattaactccagcagtatgagtaacctcctgagcagatacaatagaaggagatggagaagtaggagtaacaacaacaacaacaatagaagcaagagccttgacgatcattggagccggaggcacatcatgcaaaaccaaactgggagttaa

SEQ ID NO: 71087 - DNA, 129 bp, Glycine max
  Peptide Sequence Number=SeqID_162772
atggcggtgatggatcctagccttggggatcccttgtatcgaaagtcttcctggtggtgtgttcaagcagcgtgtcccgcagatggagcgagggtgcaagtgtacccctcgaatctccccaacaaatga

SEQ ID NO: 71088 - DNA, 615 bp, Glycine max
  Peptide Sequence Number=SeqID_162773
atggttaggaccagaggactagatcgtgccttaggtcaggttattgacagaggtgtcggcaaaggagatcgtgatgattccgatgatgctccgcagcgtcgacggcctactacatccgcacggaggcagcgagttgttgtgactgcggatcatgtcgatgagccagtcatccctttgccagatgttcaggatgacccgatggaggcacctgctgctatagaggacattcctgcggacattcctgcgggcacaggcacagagcctgctgaggacgcgcatgagggatttccgggtgatccgagcgacccatccgtgttgaccctgtatgcggatcacgttgcttgcagcgtatggacgggagatgagtgtcctgaattgaagctatcctatcatgggaggaaggtccacagtttaggcaggcctgtccctgccattgagggacttgttgctggtacaggactaagtcctctgatcgcgtgttcggtagacaccagcgatcagggacttttgtccacgcttgtggagcggtggcaccaggagacgtctagtttccatctcccggtgggagagctcaccatcacattggacgacgtctcctctcttctccatcttccc

SEQ ID NO: 71089 - DNA, 375 bp, Glycine max
  Peptide Sequence Number=SeqID_162774
atgaataccgtcaacgatgaggcaaacaacaaaatgataaggatagagaaaggtgcatgctacatattgtttaaaaattttagaagcccagtaatactgcatgagaaggatgcaggtcttaaaattctaaggaaagttgttcaggagttacaagagcaacatggtgctgattctaagtcacttaatgtagtgagatgtacatctttgaatcaagatgggatcattaaggatgaatgcgactttgcttttgaagaagggagaggtggaggtggaactttggaattttatcaagaggaacccaacaagttgtggtggaagaatataaagatgatgatattggtgggtctttcctttggcaaaccaacaccagggtag

SEQ ID NO: 71090 - DNA, 165 bp, Glycine max
  Peptide Sequence Number=SeqID_162775
atggaagaacaaatgagatgcctcctctacagcttctctacagaaaggacatcgcataacaggccagacaactaccttaaggggattattaatagtgctatcaagggtcttgatgatgctccacagcctaaatcaaaagctcctgctaggtggattgtcgtcaag

SEQ ID NO: 71091 - DNA, 195 bp, Glycine max
  Peptide Sequence Number=SeqID_162776
atgaatagggagtctactttgatttggcaggatgcgaagaggatgaatacgaagtgcagcatagaatgtgaagaagatgaagagatgtgtactatacgtagatatatttgtatagaagtgttttttatgtgggatgagaaagcggtttttggaagttcagaagacaatctgatagcagagcaagcggcgatatga

SEQ ID NO: 71092 - DNA, 495 bp, Glycine max
  Peptide Sequence Number=SeqID_162777
atggtggcttggttcgtcgaactttcaaagtttgacatccaatacgagtcatgcatccccatgaagacacaattcgtgattgactttctggcagaatttgctggaaatgacatagccaccctagactggtggatcttttatgtcgacagtgcgactaacgtaaaaggaagcaggctaacaagagaagtcagagccaagaggctacgatgctacacaggcttgctacttttccaaggacaggttgccaacatataccaaaccaaggaaatagtgttgctcaagtactattacatagaaaagtttttcattgataatttcaaaagtttcgaaatgtactacatcctaagggaaagcaatacccgagtggagctaccctccaagctggccagaaccaagaaggtagggcaccttaagaccattatacaagagacgctccaaactcttaacatagatgttgaggaagttatggccggagaaaaggaggaaccaaactaa

SEQ ID NO: 71093 - DNA, 183 bp, Glycine max
  Peptide Sequence Number=SeqID_162778
atgacaatgcacgacagtgtggagacttcagcccatcctgccaactcgacaggctacaaacgggtcgagtttaagctttctaaatacagcggtccaactcatcagcctgctgacctacctataggcagggtgggccaaaacgcggtgggtgggggggagggggcttgccttcccactttttag

SEQ ID NO: 71094 - DNA, 2454 bp, Glycine max
  Peptide Sequence Number=SeqID_162779
atgtcttcttttctatttgattctgccatcggtctgagtggcagtgactctggggttttgattgagcaacccatcatggatcaggaggtcatctcgataggaggttcctcgtctgatgatactctactaagagccttcgataatgagtcttcctcttctaagaggtttgtctcagttattatgatccttcccccattttcttctgggagtgtgaggagaggtagtggcagtggagatgtgagggtgtctccccgcgtgcaatgtagcctaagtgttgggtcgccatcgtccacctcaatcgttgctagctgtgagtgggtgaaggatgacgtgttgaagtacaagtcctgtctgacctcggggtcgaatgtcactgcgtttcaatgccaagtgaagctggcgaaccctaaggactcttgtaaactggctgtcttgggtgtcattctacccttgacctcttttcagtgtgctctgctggagcacttgaatgtggccccttccaagtttcacccaaacagttgggcaatgattggatgggtcacgttgaatagcgtgtccaagaagttatttgagtttgattcaaacatttttccctatttcaagaaccattttttcaagccacaaaaagtcgaaggccccgtgagtcttcgtgccatgaggcaagttgcagggttgatgcccactgggggtcatctttcgattgtgcaagatgtgcctccggctccatcgaccgtcgaggcttctgctgcaaatcttgctactcctgcttcttcacctcccccacagttgctcactagcatggtggccactggtgctctcgcagtgttgccttcttcctctacatccctagtgatttctccttatgctattttggcggcggtggcatcgtcttctttgtattctcgccatcatgtcttgcgtgatcagctgtacacctctagtgatgctgactcactatggggtgcaacttataagccaaagcagaagattctagttggctttgtgtcagccttcgacaagaacctaattaggagaacagactgcgacaccaagagattgtgtagaaggtggcatccttggaggtggagggctactactcgtactctttggcgagtggagcgccctaaggtggcaaatgccactgttgcttttgctgaggccttaaggtcaaaccgccaactgtctgttaaagctgagaagatggaccttggtggaaaagtggagagcatggcgactgagaaagacgggcttgccaaggtgatttttttatctaaaggcccagctgaaggagtcggagtccaggctggtggagtccatgccgtcaagcaagccggtttctttgcgaaggaccttgacttaggtctctttgatcccttcaaggatgtgaaggatggtgtcctgcttaatgaggaggagattgttgcggaagaggaggctattgatgaagggtcttgtcaccctctaatggggcttccttttgctttgtggagcttctcccctgatgattgtgaggagttttgtttgacttgcccctggttgaaggtcttgcctaaccagtgtagggataggtcgtttgacctgctaagttcctcctctgatggttatgaggattcgcttggtggaacttggacccttgacggtcatcatcatagttgctgcattcaccatggtgatatgttcttgcatgtatgtcactcgccatgggtgacacacactggagtcgtgatagtgagcaaccaaggtgatatactcttgcatatgtgtcacttgtcgtgggtggcacacactggagacttagtagtacattcttgcatacatgtcactcgttatgggtggcatgtactggagtcgtatgttagaagaagggcttatcaagggcaaaccttgggttttaagagcctcagagacttgagtaggaaaaagagtacaacatcgggtttcgagtgtaggtcagctaaagtaaaacttcaggttggatgtaaccctgaaaggaccttcccagttggggccaagctttcccgctcaaggatcttttctggcttcacttcgaactcgtcatacgagatcgctaggttgaaaggctcgtggttgaatctttgtattgtatcttctagctgctcaaagtttgacagcttcttctctaatcttcgccatttctcggacttatttggtggccctgaggatgactttcttagctgcctcttcttgtctattaatctgaggatgttcgatagagatgacaatggcgtatgggaaatcgtacttgcatataaggtatttccaggtgaatttttccacctcgctgggcctttggcagtggtcccaggatgttcgttcccacattgcgaagagccaaggggagctcagactgtgaaaattgttaatagggttgcatggcacccagctcataccgctttagtggctaaggagcgtccaccggtatggagaccgtag

SEQ ID NO: 71095 - DNA, 543 bp, Glycine max
  Peptide Sequence Number=SeqID_162780
atggttggagtattctcgcaaaacaacgtgaccctaattggcctccctatgattttacctagtgagagtgacctaacttaccagtgtgtggtctatcttgtcatatcctatgatgatcttgaactttgttgtaaggacttgccacataatggttatctattagctcaaaaaggtggatatggtagcatcggaattttaaaaaatgatttgtataacgatcttcaccgaaagaagcatcctgtaattaaagatggtgatgctcgtgttgcactgagttatttagaaggtgaggctggtaacgatccaacattttattctacaattgagactactagtgatgatggtgatggcgctatgagggtggcgataaagttagtgtttccatatgcaagacaccatctttgtgcatggcacttgcataaaaattgctatgagaatgtgaagaataaatactgttcagaagactttgagaaaacattatatgctaactttacccaagatgaattcgagtattttttggaaggatattgttgcaaaacatga

SEQ ID NO: 71096 - DNA, 60 bp, Glycine max
  Peptide Sequence Number=SeqID_162781
atgaagattcacaaaccacaaatctcgctacggaggttgcaggtctggccacagcagtag

SEQ ID NO: 71097 - DNA, 255 bp, Glycine max
  Peptide Sequence Number=SeqID_162782
atggttgctttagagcaaatgaaagctcatgaaaatgttatgagattaactgaagatcaaaagagacgttatacaaacaggccaattgttgaatttgagattgctgctcaggagcaaatgaaaattacagaactacgccttgcaaagctcttttcaagtagagaaaacatttcttctacaactgataagtattccactgctagaaaggcagaagtatatcaccagccatttagaatcaaccatcatgagttgtga

SEQ ID NO: 71098 - DNA, 306 bp, Glycine max
  Peptide Sequence Number=SeqID_162783
atgagcaaaaggctccaagaggatttggctagagctgctgaagaaggccctagggttctcatgaaccttagggtagatttctgggcccatgggccaagtggtgtctcctctctctctttcttctccattccgctgccattcatcttccaagaagcaaaggaatccattgatgaagaagatcctaggcctacaagttccaatggagcttacattaagtttgctccttcaaatcttcttaaacctccaaaggtagtcgttagagtggagcccacaccactgacatcttctggaggaagtttgaaaaag

SEQ ID NO: 71099 - DNA, 315 bp, Glycine max
  Peptide Sequence Number=SeqID_162784
atgacacataggctaaccatagagacacattcatcatggcggataaattgctatgatctagaaaaagtgttgccgaaaaagtgggcagggacagagagaaagagacaacataccaacaagagagagagagagagagagaatggattgtgcaacaagaaaggtcgagcgttgcagctagagagtgagcgtcctcggggaagaaagtggcttttcaaagtgttcccttggagaagacgattctgtactaaaagatacgtcataaagttccatcaaacatgtgctcacaatggcactatgagtggtaaagtgggctaa

SEQ ID NO: 71100 - DNA, 555 bp, Glycine max
  Peptide Sequence Number=SeqID_162785
atggaaattaaaagagtagggaagaaggagacaaacacacaagagtttttatactggttcgacaacaacccgtgcctacatccagtccccaagcaacctgcggtccttgagatttcttttcaaccttgtaaaaatccttttacaagcaaagatccacaagggatgtaccctcccttgttctctttgaacaacctagtggatgtaccctccactagaactgatccacaagagatgtaccctctcttgttctcagtcaacaacccaagtagatgtaccctctacttgtaccacaaaggatgtaccctccaatgtgttaagacaaagttctcaggcgaatcaaaagaattctcagactgtgtcattttgaattctttgacaagggagaagggagacacaaaagaattcaggcgggagaagggaatgaaaaagatgaatagcacagttttcaaggtttggaaaaccagaaaactttggaaagcttttggcaaaaagaagaagaagaagttcaaagagattcagaaatcaattggcaaaagtttgttgtctaaagaatga

SEQ ID NO: 71101 - DNA, 672 bp, Glycine max
  Peptide Sequence Number=SeqID_162786
atgaaagcagtgacatggtgcacaatcactgcagtcaagtatggacccgaagaacaatgtcaaatgcaatataccgaaatttcttcatatcatgcaaaagagaatccacctctacacacaacggaggaggagctctggcagcatttcaagaaagcggacgatgttagggagatttttatctcaaagaaaaggaacatgaataggagaagatatggttttggacacaaagatactttcaaagtagtcactcacacatcgatcccgggtctgaaacgtggattgtttgcagaggtggtggcgcggcgacatccaagaacagctatagagacaccgtcaacagctgtgggcaacacctcaacatcagaagcgtttctcgacattcccaggaaggggccgaaatggcttcaagatgcctgggtgggaagactcaaaaagctagcaatgctggacaatgtagaggaggacatgctctgggactggggagtgaatatagtgcctaaatacattggtgatgatatggtacttcttctcagcctcacagaaggcaaggctcgacaaatgatggagaacaacacgtcgttgttctactcggtggagaggtggaacagggaggtgtgtgcgggttctagactaacatggttgcattgttggggagtgccactaatggcatag

SEQ ID NO: 71102 - DNA, 225 bp, Glycine max
  Peptide Sequence Number=SeqID_162787
atgaagatcgagccaggattggaagacgaagtctgtcagtctaacgtgcaaccacaatgctctcctccactattgtcactgtttggcaccctcatccagccaccaatcacgcatcaagccactgcacctggtaagaatgttcaaactcctacgacccaacatcttattaggcttaatgttctctgcatgctctttgtttggttatcagaggatactatactttga

SEQ ID NO: 71103 - DNA, 147 bp, Glycine max
  Peptide Sequence Number=SeqID_162788
atggagcccaattatgggaatgtatgtctacccttggggggtgaagtgactatgatggacatccctggtgggggaaatagagtgattaaagagttttacgtatctctagaaggggatgacttagaatctttaattatccatggttag

SEQ ID NO: 71104 - DNA, 303 bp, Glycine max
  Peptide Sequence Number=SeqID_162789
atggcaaaaaagaagagctgctttagtctggtgaagaggctctttatatgggacacacattccacacaagataagtggccattgcctcagcagcagttgctgaagctgatgttactgctgctcatcgcctcactgggcaacgcaaggaaaactcagaagaatctcaacatgttaaaactaggaatggtgctccacaatccacataccaagtgccatagggagattaaagaatctgctgcagccatacaggatgaagaattttctgcactaagcttggaaacgatgaaaggggtttctacttaa

SEQ ID NO: 71105 - DNA, 1455 bp, Glycine max
  Peptide Sequence Number=SeqID_162790
atgagagaggactcaagggtgagcaacaaagaaagaaaaagagagcaggaagagagaaaggagagagagagagagagtagagagagaaacagtgggtgggagagagttaggactagaagagagaggagagagagtgccagattacgaatgacggagggttccggtctgaccattggagggagaacaacaggacaacatcatagctacatgcgagcgaattggagagaccataaggacattacctcgttctatttcaccaggttcccagaagacgcaactgcagaagaattatggtatcatttaaagcagacaagagacgtacgagaggttttcatacctcggaaaagaaacagacaaggaaggagatatgggttcgtgaggtttaaaggggtgcgagacatacagcagattcaaaagaaactggacagcatggtgtttggaggaatgaagatgtatgttaatgtgcctaaatatgagagagcaaagaaggaagagccacaaacagcagaagggggaagagcagaggccagacaaccacaagaggggaaaagatacatgtacctgagcaggaatgcagaaacgaaggtgggagtccaaagagggtcgtatgcagagatggttactcggaataaccaaagagcagaacagaggagagcaccagccaaagtcagtgatattcgtcacaattcgacatccgaagttaatcttgatataccgctaacaggccagcagtggctcaaggaggcatgggtgggcaggctgcaaaacctagcaagctttgacagcttagaagatgaaatatggtgggacagcggacaaaacatttcactaaaatacatcggagagaaatggaatcccaaactacggcctgggttcagattgacctggcttcaatgttggggaatacctttggtagcatgggataggcatcacattcaacaaatagtttcgggtattggcgatgtggtggatgttgaagactgcgtagaggaacgaaggagtttagaggtggcacggatcctagtcaaaacgccgtggaagccgctgatacaacacacagtgactgtcaacatacagggggagaaatttcaggtgcacgtagcggaagagtgtgggcactcaggagataggtggcagcaaaggagaggaagtgatttcagctcatctgaggagattaactccgaggaaggagatgacgaagtgtcgaatggaggagcgtttccgtcacggtggcacaaattccaagtactagactcgacagcaggcagaaaaacagcagatgaggacgtgggcgtagaagtaatagggatggaggaagatcccacgacgggagttaaggaacaagaggatgacgcccgccgtgggagggacagtgatgacccagcaaagtccgagacgagagctcgaagtgcgagggatatgactggcggcacagcggcggattccgacagatag

SEQ ID NO: 71106 - DNA, 795 bp, Glycine max
  Peptide Sequence Number=SeqID_162791
atgaagatccaaaatgagaaatacacgcagcgttgcaatgaagcatcaaaaagaaagaagagaggtgagagttacctaaggcttgctcaactgtgccagcgcccttttgcggcacgtatcctccttctcgtgcacgagccaccgctgcctcaaatgcttctttggcgaagaaggaggcccagccgtggtggagaggcagcgccggcgaaggagaataaacaggaggaaggaaaggaagaagcaacgttgagcgcagcggtgaaggtgaagtttccggcgtcaagctttgcggtggttggtggcggcaaacgagatgagtggatgtatgaaataatgtctgaacgagcggatatggattatgaaaatgcagaatcatgtggtgcgaagaaccacatgttgattgttcggatgcgttcaagacttctcagtcagatagttgtgaactccacattaggttttatttttccaaatggatccattgttcacaacgacggtggtgtttcctttcaagcttccactctagttcccattcgagtacctaacggcattgctagaaccccagatggtattttaaacttacttgaaactactatgacccctactcatgatgccctgctatattacaatgggaggtggaacatgtcacgccaaaatgagtttgttggttactcgttcacaggaaaaaatcccaaaaactttgacatttccaccggatgtaccatggatgaactgaaggatttgatcaaacaagttgcgcctcgtgggattcccccttatggtgttgatgaaacataa

SEQ ID NO: 71107 - DNA, 342 bp, Glycine max
  Peptide Sequence Number=SeqID_162792
atggccaaggaggaggcagaagttgtgacagtggctgcccccatattcagagcacggccgttaaacagaaaaattctaaatgctccttcgttgccactttccaagaggagcactccacgattgccagaatttcaagaatttcatctcaagacacaagagagggccatgcagcatacatctgcgacttcaacgtcttcacttcactgcaatgattctgataagatatatatgattagtgatctccggggaactgaagtttgctggttgcaggatttggacaaacatagagctatttctgttcaagaaaatagaatcagggatttgagaaggtggaaaatgtga

SEQ ID NO: 71108 - DNA, 288 bp, Glycine max
  Peptide Sequence Number=SeqID_162793
atgctccacgagctcagacggtatttcttgaagaagagaatcatcagcgtgagggaagagtcacgagttcgagaatgggatttcagaaacttttcgggtggaagagaggatgaagaatctgccaaaagattaaacgataaaaagtcgagaggaaattcaaacatgaatcctccaccagaccaattcaaatttagccaaagaggctgcaacctcgttcctttctctaaaagtatgcgagatgagaataaaactatgactccattccctatgtatctcaatatgtcttga

SEQ ID NO: 71109 - DNA, 270 bp, Glycine max
  Peptide Sequence Number=SeqID_162794
atgaatgaagaacagtggatatatgatagtatcatgtctgaagaagttgatatgaatgttgaaaatgaggaagatgttggcgtgaaagtagaacacgttaattgctctgatgtctttgatatttctcaagctcgatcggtggcttatgacaaaggatttgttgccgtgataatgaggtcagacactaatactcgtgttagaggaaggccttcatttctattaatagcttgcgaaaggagtggtgagtataggcctaagaagaatgatttg

SEQ ID NO: 71110 - DNA, 1401 bp, Glycine max
  Peptide Sequence Number=SeqID_162795
atgcctctatctgcgcctactcaagcagttctagcttctccttcctttgcgcctgctatgtcggccccctcaactgctcctgctactactcctccttccattgtcgccaaagaagagaagattcaagtagctgatgacttgctcaatgaggcagatccacttagcaagtgtcatccgcttagcgaggcatccaactcgcttagtggatgggaaacccaagaagagaaagagtcagagatgtgcttgtccagcgggcagccaacccacccaccgaggatattgtctcttctcgcacttagcacacccagtctcgttaagccaaaattcacttactctcgcttagcgagcctttggaagctgaaaggtccaagaacctttaaaacactgaatggatcttcttctttagccttgccaatttcaagtctgtctgtcttgccgttagcggcgcctgcctcatcttctcacccaagtgtctcactagaccatgtttatacttcttgtgacatgaattcaatgtggagcatgggctatagaccggagcaaaagactcctattgactttgtgtccccttttgaccaaaaccttaatcgacagttggggagtttggcgattttggaggagaatagacaaaggcaccaagaagctctaaacaaagttgggtctttagagactgaggtcgccaaatggagagtctcgaggctggataatgacaaggtgtttggacgatgtaaaaactttttgaaagagatgaatggtttggcaagtagtgtggagtgcattgctgaagagaaaaaaaagcttattgcgatagtggccgagtctgctaaagtgattattgacctattagcccaactaaaagagtcagagtccaagatgaaggagtttgagcttgaggcggcgaaggaaaaggaagtgaacaaagagcttgagaagaagttgttggcgtttaagaaggaggccatggaacaacatgagaatggattctacaaggccatcaaggagcaagatgctgatgaagaagaagatgatggggccaatgtgttaggcgcgactttagctttcttgacgggtttgtatgaaatagagaatgagataacgtctgataatctcgtgtttgatttcaacctagttgaaggagccttggagattcatcgagactcaccaagagtaaaccttgggtttgacgagcctttgagattcgtcgaggctcaccaagggagcaccttggctcaccaaaggcaaaccttgggtttgaagacccttggagattattcgttgaggctcaccaaaggagcaccttgggagccttggagattcattgaggctcatcaagggcggaccttgggtttgacgagccttagagagtcatcgaggctcaccaagggcggaccttgggtttga

SEQ ID NO: 71111 - DNA, 488 bp, Glycine max
  Peptide Sequence Number=SeqID_162796
atgactaggggcaatcaaggtgatttacaaccctttgatcctgaaatagatagaacctttcatagattagttagacatagtgtgcatcctggtcattttgtgcattgtgagcattctgagcattatgttgagggtgattctgattttgaacattccactactaatttttatactgagaacatggctcaacctccacctcgtgagaggactcttaaggatatggcagcacctgatttcacttatgaaagcttgtgcattcaatatcctgatgagggtgttccatatgttcttaagactggactaatacgtttgctgcccaagttccatggttttgcaggtgaagatcctcataagcatcttaaggagttccatattgtttgttacaccatgaagcccccggatgtccaagaagatcatatctttctaaaggcttttcctcattctttggagggaatgacaaaagattggctatactaccttactcccag

SEQ ID NO: 71112 - DNA, 192 bp, Glycine max
  Peptide Sequence Number=SeqID_162797
atgaatcgacaagaggagcaggaatggtctacgtgttgccaaactgtcgcacgaccctctccggtcgagcgttgtgtcccgacgtccttcagcacaatattccttaaagcagtttacctagtcatctgctcccccgaacacaaagttcaagatcatcacaggatccatacacaaacagcaaaccgggagtga

SEQ ID NO: 71113 - DNA, 1071 bp, Glycine max
  Peptide Sequence Number=SeqID_162798
atgtctagttctgagagcacaaacgcgagaactagaacagcgtcatggttttctaccccattctttgttatcgttctcccggtggccgtggctgcgcttctctaccggctcgaaccattcaagccggttcttttgccggtccagctgggccggtccaccgtggcggttccggctcgtaacggccacatgcaagatggatcggaacgtgtgggtgagggacacttggagggcccggaagacttggcctacgacgctgcggcacgtgtcgtttataccgggtgtgaggatgggtggatcaagcgagtcacggtgaatgactcggtggttgactcggcggttgaagattgggtcaacacaggaggaaggccacttggactagttttgaagccgaatggagaactcatagttgctgatgcggaaaagggactgctgagagtgtcaagtgagaaggagattgagttgctggtagatgagtttgaggggttaaaattcaaactcacagatggtgttgatatagcagatgatgaagggaagccaaatggaagattcttcagctataatccagcaacaaagaagacaaccctgcttgcccaagacctctactttgccaatggggttgcagtttcagcagatcaacaatttgtggtcttctgtgaatctgtcttgatgagatgcaataaatatttcgtcctgggccctaaaacaggaaccatagagaagttctgtgacctgcctggcatgcctgataacattcattatgatggacaagggcactatttgattgcaatgttcacggccctttctcccgaattggaattggcatatagataccctttcattaggaaggcttttgcaatgtttacaaagtatgtagggagtctatctatctcgaagaatggaggagttctagtcgtggatttagaaggaaaaccaactgcacattattatgatcccaaattagcattgactagtgcgattaaaattgggaatcatatatatgctggttccattttctacccctttgtaacacgttttgatgttgagaaatatcctgctctccccacagtttga

SEQ ID NO: 71114 - DNA, 138 bp, Glycine max
  Peptide Sequence Number=SeqID_162799
atgtcacttcgtcaaggcacttggcaaaaactcagccatgcgagagagaggcagggtcacgaagacgaagttgagacgaaaaagaggaaaagctacgaagacaaagctgagtcgaagaagagaacgcgaggaaaatag

SEQ ID NO: 71115 - DNA, 627 bp, Glycine max
  Peptide Sequence Number=SeqID_162800
atgaccggtagattactggtcggatcattaacctttgattgtcgcatcatgcactatattatcgttagaattttgcttccccgttcttctaatctggctcaagcctctgaggaggacttgattttgatgtgggctttccttactggtcgtcagatcgattggactcacttggttaggtaccgaatgcataaggaattacgggccaatgcacctcttccttatcctcaattggtcaccctttttccctgtcattttcaaattcctcttgatgatgaaccttttgttcaagtcaagagatcttttgctataggtgctggtgcagtaacttcatttggttaccgtaaggatcgtgatggacaatggctgaagaaggacacgctacctccgcaagacgagcgtactccctctcctcctcctcaacgagatgattcctcagcccttatgaatgaagaattaaatcgtcatcatcaaaaagggggagattgtagaagcaaagaccttgactttgatgttttgatgatgccatatgatcatgatgttttgataccatgtgaacatgcgcttctcaagttaagatcaagacaaaaattaaagagattcaagatacatcataaagaagatctctag

SEQ ID NO: 71116 - DNA, 267 bp, Glycine max
  Peptide Sequence Number=SeqID_162801
atggaagaggtttccttgtatcagctgtatgagagagtgggggtaagagatgttggccgcttgaacctccagccttgtaatacttgtgaagaattgcggggtagatcgttgttacgcctgcaagtggcttcattttttggggtgagaggagctaaatcttctgctgcagttctacctcgcatacacaaaaacaagcactactgtgcaaattatggaggaaaagattggagaagaaataataaaattaaaatgaaaattctaaaataa

SEQ ID NO: 71117 - DNA, 804 bp, Glycine max
  Peptide Sequence Number=SeqID_162802
atggcatccttcagccagatgcagtcccagttccagtctcagatgcattcacagggacttgcactgcctccagagccagaggttggttcctcaggtgctcgtgtcagcacaaaggagagttgtgttgctccctcagggaacaatccagagacgggtgactcagacaaatgcgggctatacattgaagaaaatccttcccgcctggttgccttaggaagactttatgagggatccacaacagtttacaacatccctttgttgcatggccaagtcaaggttggtgttgaggaggttaaagatgcggaggctctcgttcctgtacccattgacgaggcagctgtgtctccagcaaaacctccagaaagcccggatcatgaggttgatgatcccctatacctgatgacattgaccatcccacaactgtttttgaagtctctccaggttatgtgggatgctaccatgttccagcatctgactgagacaagtctgcgagcggggaattctgatgtgtatggattcctcgagccacagtccattcagagatctgggcaatcacaatttgaatcggaaagttacatcaagagttggatgcagagttcaaaacgagatgtctaccttggagcctacctgaatgggccagacaactatcttaagggaataattaacagtgctttgaaaagacttgatgatactccacaacctaaatccaaggctgctgctaggtggattgttgttaagtattttaatgaagttagaccattggaagcagagagactcaaggcgctacgcatccagtgggcatag

SEQ ID NO: 71118 - DNA, 222 bp, Glycine max
  Peptide Sequence Number=SeqID_162803
atggccagccattctacatttcttgttaatggcattcccatcaatgaggcatctaaccttgggtggcagcagcctcaaggtattaatggctccagagttcagaaggtgttggaatcagttcacattgcagctaacaaaaacacagttccaggagatgtgtcagctatggttcatggtggtatcagaatgggtataaggtctagacaaccaacagaactttga

SEQ ID NO: 71119 - DNA, 336 bp, Glycine max
  Peptide Sequence Number=SeqID_162804
atggcattaagacttttctactcaaggagttggtttgtggaactcgtggtcgctacaaggatttgctttgtgatagtcctggtcactgctagggctgtttggggtggtgactttgcagtccgttcgggatctcactcgtgctcgaaaggtgtcattttgagtgaggtaaatgaaagaagacaactatgggtttgtagggtttgcttttggtgttgtggggtttatgtaagggtttatagggttcatgtatggggttgtgtgagtccacaacagtcacacacagcaaattcaacttcactttgtgcaactagtatgctagctgttgcagctgattga

SEQ ID NO: 71120 - DNA, 360 bp, Glycine max
  Peptide Sequence Number=SeqID_162805
atgaggaccaaagatttgtatccgttggacatggatgttattctgaaggagaaactcagcttaggaacatggaaatattacaaggaaatcaatagcagtgcttctcaagtggattcactccaagctattattactagtcctggtaatgctaatgcagtagctgctgctgctctagaaaataaggatctaccattcctagtcgctgaacttggttcagattcacaccaaagcaacatcaacaacaatagtgatggtgatgataggcaattttatcctctcctacctttcaatcactccaccctaaaagaaaaaagttggacaataaagaaaatgaatagagaaatgggtgcagctgtgtga

SEQ ID NO: 71121 - DNA, 819 bp, Glycine max
  Peptide Sequence Number=SeqID_162806
atggcttctccaccttcctcccctcctcctcttcctccttctcatcctcctcctcctccttctaacgcatcggttttgccgtctgccatgaagcggacacggaaagcctcacatctacgatccttgtctactagaccacctggtgctgagagaccagtggtccatgttgattttgctatcggcaaggccgacggtccccacaggaagaaattaagaatatatttggggattatggcgcgtgataaggtggatgtgacgtacgagaattggaaggagaggcttctgacagtaggacgaaaaggaagttacttcagactgtcggcgagagatggaggcagtttaaatcagacctcacaaggaaataggcccttgcagccaatcaggacggtgtggacgactatctgtgagaaatacagcataagcaaggaaaaatgggcccagttttgccagactcgcagagacccttcttgggaggatgtgcggaaaaaggcacaagccatccagaaacagaacactgccccccacgttttgtctcgtgagggttatgaatatttgaagcaaaagctcctggttgagaagaccaagaagaagctagaggaagctgcacagtcaggaagcattgatggcgtcatcgatcctccatcccccgtcaaacgccacatgaagtggaagatggcccgtaccaagaaaataggggagatgacgactgaggccacaaaggaaatcgttgagaagatcgattcctttgaggagcaggcaacacagggatccttcgtcccccatggatgtctgtgtaacatctcatttttcgtaagctaa

SEQ ID NO: 71122 - DNA, 954 bp, Glycine max
  Peptide Sequence Number=SeqID_162807
atgggtaacatgaaattgtgtcctttgatgctatgcttgttattagcattcttgcttggggccgcagcacaaaattgtggtacccaagttggtggcgtgatatgcccaaatggtttatgttgcagtcaatatgggtggtgtggtaacacagaagcccattgtggaagaggttgccagagccaatgtacacctggctccacaccaacaccaacaacacctagtggaggagatataagcaacaccattagccgttctcaatttgaagaaatgcttaaacaccgaaacgatgcagcgtgtcccgggcgtaatttctacacctatgatgctttcattgctgctgctcgctctttcaatggctttggcacaaccggtgatataaccactcgcaggagggagattgctgctttcttcggtcaaacttctcatgaaaccacaggagggtgggcaagtgcaccagatggtccatacgcgtggggatattgttttatcaacgaacgcaaccaggcagattattgtactagcggcacccgatggccttgtgctcctggtaaaaagtattatggccgaggaccaatccaactcacacacaactacaattacgggctagcaggagaacaacttaatctaaatttgctaaacgacccggatctagtatccagagacccaattgtggcattcagaacagccatatggttttggatgaccgcacagggaaacaagccatcaagccatagtgtgattattggaacatggaacccatctagtgctgactggcaagcgggtcgggtccccggatacggtgtgatcaccaacataatcaatggcgggctcgaatgcggacggggcccggattctcgggtccaaagtcggatcgggttctacgaaaggtactgccaaatctttggagtgagccccgggaacaacttggattgcaacaatcaaaggccattttaa

SEQ ID NO: 71123 - DNA, 342 bp, Glycine max
  Peptide Sequence Number=SeqID_162808
atggcgatggcggtcttgacggtgttgggatggccaaccaagacaattgtgcggtttgcccaaccatgtcatccaagacagtgcatgactctagggaggagtccatgccaaggctgtgaatgtgtgagtgctctatgcgctccagggaggactttaagagagattaaactccaccgttgtagaaacggtgaagatggtgggaaggagaaaaagggtttcagatttcaagccaaagaagagaaagttcaagcagctgatgactcgcttagcgaggtagatccactcacgagaggcatcctcttagtgaggcatccagctcgcttagcggatgggaaaccctag

SEQ ID NO: 71124 - DNA, 186 bp, Glycine max
  Peptide Sequence Number=SeqID_162809
atgaggactaatgagccatatgtcttggctagtcaagctcaacaacctcgagatttgtatgatgtgcctgagaaagctacacttgagccttgtcaagaaaatgatgatattggctctattccttttacatctaatgtcctagataatgatcaaggattgtctttggatagaaatgatttagtctga

SEQ ID NO: 71125 - DNA, 816 bp, Glycine max
  Peptide Sequence Number=SeqID_162810
atgggtaacatgaaattgtgttcttttatgctatgcttgtttatagcattcttcttgcttggggccacagcacaaaattgtggttcccaagttgcaggagcgttatgcccaaatgggttatgttgcagcaaatttgggtggtgtggagaatcagatacccattgtggagcaggttgccagagccaatgtagaaatggctccacaccaacaccaacacctagtggtggaaatattagcaacatcattactcgttctcaatttgaggaaatgcttaaacaccgaaatgatccagcttgtcctggacatggattctacacctatgatgctttcattgctgctgctagctctttcaatggctttggcacaaccggtgatataaccacccgcaagagggagattgctgctttcttggctcaaacttctcatgaaacatcaggagggtggccaactgcaccagatggtccatacgcgtggggatattgtttcatcaacgaacgcaaccaggcatattattgtactagcggcacccgatggtcctgtgctcctggtaaaaaagtcagtaatgcactgcaaagaagtgaaacacctgcgaaaaggagccaaatcacaaatgtgagcctaaacttggagagatttcctgcaagaaaagaacaaatgagcattggcaaagggaacccttgttcaaaaaagcagctttgtcaagaaacacctaacagtaggcttgacacctctaatgtattcatagactttgccaacaagcaattgttcattggtgctccaagattgaatcctctttttggcctcttccgtacttag

SEQ ID NO: 71126 - DNA, 1149 bp, Glycine max
  Peptide Sequence Number=SeqID_162811
atgaagtatatggattgtgatcaagtgtttatattcaattacaattacgggcaagctggtacagcacttggtgtagatttgctaaacaatccagacctagtagccacaaatgtagaagtgtcattcaagacagcgttgtggttttggatgactccgcagggaaacaagccatcatgccatgacgttattactggaaaatggacgccatctgatattgacaagtcagcggggctggtccccggatacggtgtgatcaccaacataatcaacggcagaattgaatgccgatacaagccggatactcgggttgaaaagtcggatcgagttctacctaaggccaggcctctagctccgacaagtgaggaagatcctgctagttggtgcactaagaaagtgaagacacgagatagtgaggctgtagtgatagaaaccttgaaggtggaggaggagatgtatgtctcaccaaaagcttcgtataaagaaaagcttctgagtatgtcaggagtcaaaggaacaactccaggtttggagacaacagtgccagggaagattgatttccagagtgtgaaaacgaatagctcaaataaacagggcttgcagggccctgaagtgagcttccgattcttggaagcaaaactccaacgtagttggacaaagaacaacactatcaagattcttgatatgcttgatgactactacggaagccccgataatgagagtgcagacagtgatgatgttcccaagggcaaccgagtggtgaacgaagagaagagtaaggaaacgaaggtggagccttcggtagggtacgagccatggatgatcatcaaaaggaaacctaggaagaaggtagataggcatgagacacaaaaggggattactgccaacaacaaaaaagagtcagacaaaaggaaggatagtcctctcattcagaaaggaaatcctcggatggatcgagtcaaaaatgcattgggagggaaaaatcctcagcttaatggagggaaaagttctcaggaggaggaaaaatctcctagtagtgggaggaaagtcaactccaaggtgttgcctaataataaaggtgtagcaccatcgggtgctgggtcaccattgaaagctaaggtggcaaatgactttaggcccaataaggagtag

SEQ ID NO: 71127 - DNA, 132 bp, Glycine max
  Peptide Sequence Number=SeqID_162812
atgatggaaagactatttctctcacctccaacatgtcttcgtaaattccaacgaaaaaagagaggttttggaaagaggagaagggaaaacaaaattgagaggaagaggaggggtaggaagtatcgcaactga

SEQ ID NO: 71128 - DNA, 222 bp, Glycine max
  Peptide Sequence Number=SeqID_162813
atgccattgactatgaatggcagaatcaaagagtatcttgttctggcacttcctgggcaaatcgtgaagggcaagaactattttgggaacgatgtcattttcaccgccatagagggcaatgaagcgcgtctagatggaggtgtcgactttgtgcatgagttgccggcattgcgatggtccctgcggatgctaacgcaatgtgatttctgcccagtgctctaa

SEQ ID NO: 71129 - DNA, 141 bp, Glycine max
  Peptide Sequence Number=SeqID_162814
atggcaacacctaacgccccattagctccgcaatggaatatacccggagcaatacctgatatggggtttacagtttcaggtttagggtttgaggtttacgctttagggtttagggtttatggtttagggtatatggtttga

SEQ ID NO: 71130 - DNA, 759 bp, Glycine max
  Peptide Sequence Number=SeqID_162815
atgaagaagaatgccattaagttgatcacatctttgaagcaaatggatgctaaatttggggtgtccacacttttggatcttgatcaccactttgctgttgtgattagagtacttagggaagtcattctaatcaatttgtcagtcttccaatttattttgtcattcttgaccatggcttcatcaaattcaaagtcaaccaaatggttgctggtggcaaaattgacgcagaaggggggactattgttcgtgttccacaaacccttttcacctgagtgctcgtggccagtctcgctcccactcacggctagccttgctctaggtggccactctcgaaaggtcgccgtgacatacgagacctggaaggaagtccctgttgctcagaaggatttgatatgggaggatattcaagcgaaatttgaaatccctgaagcttctggcagtaggacaaagaagaaagttcttctgacgccgacaaggatggtatggacgacactgtctgtgaaaaatacggcattagcaaggagaaatgggtccagttttgttagacccgccgagatccctcgtgggaggtatgatgtgcggaaaaaaacacaggccatccagaagcaaaacaccgccccccacatgttgtcttgtgggggttatgattatttagaacagaagctgatggatgagaagacaaagaaaaaactagaggaagttgctcagtctggaagcactgagggcgtcattaaccctccatctcccatcagacgacac

SEQ ID NO: 71131 - DNA, 195 bp, Glycine max
  Peptide Sequence Number=SeqID_162816
atggcatcatcaaaacatcaaagtcaaggtctttgcttctacagcaagcctgaggagtcaaaagaagaagatttcaagtgctttagagcaaaattgatgcaaaaactagaagaaaaagccttgaagaaaagttggaagaattggacagctcgctcgacatgcacttcaggcttagcctacactaagcgtgcctag

SEQ ID NO: 71132 - DNA, 1035 bp, Glycine max
  Peptide Sequence Number=SeqID_162817
atgttcttggtaagggtaggaatagtgggggcaagatacgcggcccccacacttttcagacagctctctctctccctcacgttgccattttcttcttcttcattctccattgaagcttcaagcaaagcttcaacctttggccatcatttctgccccaaatcgcgaaaggagggcattttcggggtcgtgaagtgcgtggctacgagtgggacttcgaaatttcaggctgtggaaagagtagtacagaatgagttctggatgtttgctagtagatcccaacggtcacaatgtaggcttatgtactatagatttccacttgggaggattgatggggacccggtgttgagagaaacgaggatatgggctacatgggagtacgtgagctcagttggaggtgggcaacaggggatggtggagtggtacctggagatatgtcgcgggggtcaagagaccttggggacgtcaggtggggtgctattgcccaaaaccaagcttgaccaatcccgacccaacccgggcatagtcggtcagcttgaaaacgaagtcaggaaactaagggagcctctgagggatgggtcactggtaatcgattaccagatcgtgatggcggcgcagctaatccgtgatcgagtagagatggagtgcctagagggagcttgggagaccctcgaaggcaacacgaggtgccgatttcggggcactattcgatttacggcgacttctttagtgcatccagatgagcccgcacggacccttcagcgcacggtggagtggatactacccatgcctacaccatatcgtctagtagagaccgtccaagtgatcgaggtaacgtcatccgaggaagaccccgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgggggagatggcgatcagtggaggctcttcatcctag

SEQ ID NO: 71133 - DNA, 450 bp, Glycine max
  Peptide Sequence Number=SeqID_162818
atgttggctacctcggaacatttccactacttcaaaacttgtcttcttttgccaataatctttatgatccttccaatagttcaaccactctccttcaacataactaactttagcgaccctgaaatcgcaagccgtattcaatgcacaggcatagccaaaattgagaacggaaatatagtgctcaatccactcatcaacaatggagttgaacgagccatctatggccaacctttgcgcttgaaaaactcttctaacggaaacgtcagatttttctactcgtttttcattcacaataacatcgttgctgtcgaatttgacacttatataaacgagtatgaccaaccgatgcaccgcgtagggatcaataataactcggttgcatccctcgaatataagaagtttcgtattgagagcaacatagggaagatggggcatgcgttgataacttag

SEQ ID NO: 71134 - DNA, 786 bp, Glycine max
  Peptide Sequence Number=SeqID_162819
atggtggaaactttcaggttctccttccactctatcgctctcacaacttctccttcgacgctctctctatggttcccaagccaccacctcagcaccgctctaggaaaagccgtcctcctcaaggtgaccacccaacgccgccaacatattcactctctccagtccgtgctccaccaatccgtcgtcacctacaacactaacctcgctttcattttcatcttcttcaaaaaccttcgcttcaacacgctcgttagagagaaggactacgaggttgcggttgtggtcattaaagagcacatggcatgtgacaagtgcaaggccatgcacaacaacaccaccaccaccaacaacaacaccaaccccatggagaccgaggtgccccagttccttgtggaactccccggcgggccagcaaaaggtggtagtaacgataatggggctagtgttagggctcttgtttctttgtccaaagagggtaataacactacttctgatgctccactattgaacacttcttcccttgttggggatttggttgaaacgagatatggcaagggcaaggacacaaacacggacaagtttgagagcgaggatatgccatcacatgtccccaatgacatcaagaaggagaggactttgctgaggccacctattgttcctaacagtaagcatagcaaaggggattttgtcgagaattcgagttccaaggataggagtgggaagaaacaccttaggacttctgataaggaggtagatcccagcgcgtcccgagaatgtcacgactaa

SEQ ID NO: 71135 - DNA, 345 bp, Glycine max
  Peptide Sequence Number=SeqID_162820
atgaggccactcgatccaacaaatcacaatgtcaaaaacaagctcgcaatcataatgccaaaagaaaattttgcataccttgttagacaaagattgcagctaacgctcacgcaactcaaggtcgagagacaaacaataacagagaagagagggattggggaagaaatcagcgtcggcgacggcggaaatgccggagaggacaacaaagaggttttcaaaccaaaggtttggggaagatactggtggcattggcaacaacaccatcgacactcaaatgtcaagataccgccaacggagacagcagcgacgacactcaaatgtcaagataccgccaacggagactga

SEQ ID NO: 71136 - DNA, 591 bp, Glycine max
  Peptide Sequence Number=SeqID_162821
atgaattgtaatttttgtggaggagagcattacaatgacaactgtcatttctactccatgaaaaactcttggtggggacaggagttatacccttacaatcaatatgaagaagaaagaactcctaatcttgagagtgtgtttacggaattcatggcataccatgctagctctaaacctaatcaaaactcaatgcaaaatcaggaaattcatgttggcaagagctactccatggaaaattgtcagtgggagcaagagttacaaccctacaatcaatataaagaagaaagaatgtctaatcttgataatttgttgatgcaattcaaggaatcatttgaatctactcaacaagcatttaaaagtctagaaattcaagttggtaagctagcaaaagaagtggctaaatatgtggccacaagggaagaaaactttttagaggttgaagctcatgaggaaagccttatagaagagcatgattcaagagaaaaagacaaagaaaaaagtgaggagaaagcacaacaatgggagaagtgcttacaagtagacattcacaagaaagtattctccaagtcaataactttcctcatcaattga

SEQ ID NO: 71137 - DNA, 495 bp, Glycine max
  Peptide Sequence Number=SeqID_162822
atgtcatttttctgtctaatttcgccatcggactgggcgacaatgattccaggggcctctaatagcgagtccccttcctcgaagagggtgaagaccttgcgtcgaactggtgggggcacttctcgccctcggggaggggcactgccttttgctgctacaggggagcctgtcctggttactgtgatccttcccccatctatttttcggggtgtgagaagaggtactggcaatggagatgtgagagtgcctccccacgcacaacataccctgagtgttgggtccccgtcgtccaccccagtcgttgctggttgtgagtggggattcaagccaaggagaaaagacaccacctgttataaccagagacatgaagcaacaggaagcaaagacagagccaatatcagagctaaaactagtagcaatgtaagagaaggaaccaaaagcaaccataggaacaagcaaagaagagacaaaaaggccaaaaagggaaattactaa

SEQ ID NO: 71138 - DNA, 426 bp, Glycine max
  Peptide Sequence Number=SeqID_162823
atgttggtggatgtggaattggatgggtttggaattgagatagattgtgagcaccatatgtttgtgaatatgcatcaaagagaaatagagaaacaaatctctttgaatttctcaaactgcatgattttctgggaggttcaagggaattgttgtatttggcattttggatatttgttggtgttggtgaggagtagattctatcatttggggcattggggatctgtactattatggaatgtttcacattcaaatatcaagttttacacctatgaaagcttgaagcaagtgatgtcatctagtattctaaacttcgtaccccattacccagaggctcttcgctatgcgaaggtaatgtgtggaggattagttggatctacgtctgttttattcacaactccttttgatgtgatcaagactagattatag

SEQ ID NO: 71139 - DNA, 696 bp, Glycine max
  Peptide Sequence Number=SeqID_162824
atggcagaccagatccaacagtttgcaaccgttcacggcaatatcttgcaatatctaaacgacactgccgaggctacaattaacaaatctctcttccttataagtgcgggaagcaatgacatatttgatttccttttgtataatgtgagtaagaatcccaacttcaatatcacacgtgaggttcaggaattcttcaacctgctaaggactacttaccatacccatctcaagaatctacacaaccttggagccagaaaatttgggatattaagtgttcctcctgtaggttgtgtcccaattgttaccaatggaactggtcactgtgtgaacgacattaatactcttgctgcactctttcacatagaaattggtgatgtgttggaaaatttgagctcagagttcccgggcatgaagtactcacttgggaattcatatgctattacctatgacatgataaacaatcctgacccacttcatttgagtaacgtgacatcagcttgctgcggaaatgaaacggttattgatggagtaccctgtggctccgatacccaagtatgcgaaaatcgcagccaattcttgttctgggaccagtaccatcccactgagcatgcttctcggatagctgctcataaactatatagtggtgggaaagaatatgtagcacccatgaatttcagtctattggttcaggaatag

SEQ ID NO: 71140 - DNA, 915 bp, Glycine max
  Peptide Sequence Number=SeqID_162825
atggcagaaatacttctctgcctccagccaacattacaaggacttgaaaaatactttcaggttgcttatgtagctgtaatgaggaatactaccacagaaaataggactggattggaatccctattgagtttctataggagttctatagcatcaagtgcagatccaaatgtagttatagaagttctgaatcttttgttgtctgatgcgattccagatcaagatattatttatgtactagcaggaataagcaatgaaggcagtgaaactgcttggagatggagtagatcggaaaatagttctgacttcagagattcatctaaaaccaatgaggatttgataaagaccacactgacagtgcatgcaaagaaaccattgcaattcaaggtcagagctgtggtgacagtgaggaataagatcaaagaggatttcaaagagactatgttgaagcatttggatgccatcaatgatagcataggaacaagaaatgttgtgctggagcttatcagcatcgagattgatccaatccctggagctattactgtgacaaacaaacaccaaagagagttcttcttggaaagtataaccatcgaagggtttgtcagtggagcagtccatttcccctgtaagtcgtgggtacaaggagagaggatattgaggaaacaagaagacacattcattgagttatctaagttgcttgaagaagcaacaacaagaaaccagactgagggaaataaggatcttaaccacaatgagaaggactatttgcttcctaaagtagttgaattctctgaagagaatagacatgggggaaaagacacatctaaggtagagctttcagccaatgaaggactcaactcaaacaaagcttacaggaataaatcattgatgacagagaagtggaaccttggaacctga

SEQ ID NO: 71141 - DNA, 531 bp, Glycine max
  Peptide Sequence Number=SeqID_162826
atggtttttgtcattgagaatattcattggaatgaacttggacttcttttcgctgtctggatcatgatacttgcattagagattggaaaagttgaattacacaacaacttgctctggagtatattgggtgatcaatctactacagggttgttaatctgtcgcaatcttgacaaatatttctgtgactgcttttatgaagaacaggaagtagaagtaaggtggagcgagagcaagctttcaaaacatcagactcagagtcattggcccaattcttatttaaccaacgcaacgaaaatcagaatttgtttgttgaatttctctctcttccgtggcggcggcggcaatgtcacggacgatggagtgggcggcgagggcggagcacctccgcggcatttcgagaaaggtcgtgatcgcggcggtgggcgccttcgccaaaacggtgtcgtctcttctcaacaccgccgccgttcacaacgccgacactctcctccgcctcgtccgctccagacccaactgcgtccccctcattaa

SEQ ID NO: 71142 - DNA, 2583 bp, Glycine max
  Peptide Sequence Number=SeqID_162827
atgatcactgatgtgcccccatctatgactcaaaacggtaggtcaagcagatattcctttggctcaagcaatggcaatggtgatacccctgcacaaaatggctctgctgttatcaatgttgatgattatgatagtgatagctccaattttgcaccatccacgccatcaactatgtcaatggctgttccagcagaactaggtggagctgtacccttgatcaacagattccaggtggatggatttttaaaattaatgcagaaacaaattcaatctgctgggaaacatggatttttttctaaaagatctgtaggtccccaagttcgagaaaaagttacatttgaggacatgttgagttttcaaaaggatccaattccaacatcattgctcaagttaaatgttgattttgtaagtagggcaacaaaattattccaaataattttgaaatatatgggaattgatccatctgatcgtgtaactccaataagcttagatgaacgagttgagcttgtagggaaactgtacaagcaaagtttgaaacgaccagaactccgagatgaactttttgttcagatatcaaagcaaacaagaaataaccctgagaggcaatacttgattaaagcatgggagctcatgtatttgtgtgcatcctcaatgtctcctagtaaagatattagcagttatctatcagaatacattcataacatagcaaatggtgtggctactgattctgagattcaagtccttgcattaaatacattaaatgctttgaaacattctgtcaaggctggtcccagacatataattcctgggcgtgaggagattgaagctctgttgactgggagaaagcttacaactatagtgttcttcctagatgaaacttttgaagaaattacgtatgacatgtcaaccacagttgccaatgctgttgaggagtacattgggttagatgcaaacaaatatattggggatctcctggcagaatttaaagctgcaaaggatcggagtaaaggagaaatcttgcactgtaaactgatattcaagaaaaagttatttcgtgagtcagatgaagctgtgacagagcctatgtttgtgcaattatcttatgtacagatgcaacatgattatattttgggaaattaccctgttggaagggatgatgctgctcagctttctgccttacaaatcttagctgagattggatttcttagcacaccagaatcatgcattgactggaattcacttctggagcgtttcctgcccagacaaatttcaatgacacgagcaaaacgggaatgggagtatgacattctttctcgttatcgttcattggagaatctgacaaaagatgatgcgcgacaacaatttctgcgtatattgagagcacttccttatggaaattctgttttcttcaatgttcgcaagattgatgatcctattggactcttacctggccggataattttgggaattaataaaagagggattcattttttccgtccagttcctaaggaatatttgcactcagctgagttgagagacataatgcaatttggaagcagcaatactgcagtcttttttaaaatgcgagttgcaggtgttctccacatattccagtttgaaaccaagcagggagaagaaatttgtgtagctcttcagacacacataaatgatgtaatgctgcgtcgctattcgaaagcaagatcagctgctggtggtggtagtggttctctgaatggagacatttctaataattctaaaactcctaatatggaattatatgagaagcgtgttcaagaattgtcaaaacatattgaagaatctaaaaaaaatgctgatcaattgcttgaagaattacgtgtgaagcaaaaacaagaagagaaaatgcaagaagaattggatgacttgaaagaatccttaaaagccaataaacaaaatttggatgccgttacaagtgaccgtgatagtcttgtatcattatgcaatgaaaaagataaggaactacaggctgctattctagacaaaaggaatatggaatctaggatggccaagttaaataatgcggtgatagagaacactgccaaaaaggatcttgctaatgctggaaatagacaagtgactcaaaagcttgaagatgagctaaaagtttgtaaatatgagctgctatcagccaacgaaactatcgaaagcttgaagagtgaaaaattgattttggaacagaagttatctgcacttgaaaagaggaatgctggagagattagttcccttaagtggaaacttgagcaagaacgcaaagttgtgaagtctgaagcgtacgagcttgaaagaaggctagaagggtgtaggcaagaattattgactgctaaggctatcatttcagtcaaggactctgaatttgatgcattgcagaataatttgaaggagctagaagaattgagagaaatgaaagaggatatcgatagaaagaatgaacagacagctgccatactgaaaatacaaggggctcaattagctgaaatggaatcactttataaggaagaacaggttttaaggaagcgctattttaatgtaatagaaggtggatga

SEQ ID NO: 71143 - DNA, 573 bp, Glycine max
  Peptide Sequence Number=SeqID_162828
ggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggattttacaaggttgaaagaaatctcaagaactggtggttgcttggggactggatgtaggcacggattgtttccaaaccagtataaaattcctgaagctttagctgtggctaggcaagaactgcactcactcactctcgattcaaattgctcaatgaaacgaaagacggagaacacaatgcttcaaaacaatgaacatgttgctcgtggcatgttccaccatggaattcaccatcccctccagtctctgatgcaatttgaaactctcagcgagatcggtgattctccgatgaccataaaccgaaccaccggtgcaatcggagaacacgattctgacactgcatgctttctctctctctatcttgttggatcaagtggcctcggaataattaagaagggggcttga

SEQ ID NO: 71144 - DNA, 354 bp, Glycine max
  Peptide Sequence Number=SeqID_162829
atggacgagttgcgcgaacgaaccaaagactacatccagatggaagaaatgtccagattcaggaacaaagtcagacaaaagagcgacaagcaagaaggaagcaccaagtacgaaccatacaagtcggacaagaggcacaagtcgaacaagtgccaacttctcctaaaaaggtcaaggtatgggcgttacacaccccagatggccaatcacactacaatccttaaggagactttcaacttggaggtacccatcaagctacctttgatgaaacctcccaggtcggggttagatgcggctaaatactacaaataccattgcggtatcgttataacacaaaagactgttgggccctaa

SEQ ID NO: 71145 - DNA, 1350 bp, Glycine max
  Peptide Sequence Number=SeqID_162830
atggtggcgtgctattgcatacgtgtcactcatggagtggtggcatgctcttccatatgtgtaactcatggagtggcatgtagtggagacatgggtattgtctgtcctgggttttggagagactcaccaagggcagaccttaggtatgatgagctcgtggagcttgaaaaagatgatggaagtcacaaaccaagaggggggggcttgtggttgaacctttgcgttgtatctccttgctgctcaaagtttggtagcttcttctatgatcctgactatttcttggactttgtttgctgtatcgagctctatccccatgttttcttcattttgctattgttggaacaacaatctcttggtcgatggttccccgacttgaacgggaatcatggcgtctgtgtcatatgtgagtcgggccctgaggatgattttattggctgcctctgtttggtcgttggtctcaagatgttcgatagaggtgaaaaggtgtttaatgcttaccctcgtcaggaagtcttcataggtatgagttttgaattaggtgttattgtcgatgacaacggcctttggcagtggtcccagtatgtccatttcccacatggcaaaaggtcaaggggagctcagactatagagattgtcaggagggggggtcatcctgtctggttcctcctattgtccaaccataacttctttagtgtctatggtggaagtttggagtgtctcctagatgatagtcttgaggtttccgatcattttagtggttgtcagcttgaagagcatgtttgttttggtgttgctctccctcgccttttggccccaacttctcttgctagttttagacctgcaatgagtcggtgctttcctttctcttctaaaaaggctaagctaacagcttcgtcagctactgagagatataggagtcgaggtaatcttggcctgggtcgactatggattggtgggagaaacctagacagggatgctagtcttcaattccatttctggacttcctggacgttagtaggagcacatgtcatatttgcggagctctccaaagacttcttccaaatctgccacgtgttgggctatgctctgagacttcacgaccatgtcgttgacatagacctcgacgtttcgtccgatatgtttcttgaaaatttggtcgatcaatccctaagtaagcgtccaggaagctcaacacctggaacccggacgcgccatcaactagcccttaaatgctgggtagagggtggagtatctgacttctctaatgaagttggcattgaggagtttgtccacttcttctttgacagcttttcatcgttcttctctcatcttctttttcatcttctgtga

SEQ ID NO: 71146 - DNA, 231 bp, Glycine max
  Peptide Sequence Number=SeqID_162831
atgggagacccatcctctgtagcagaggaagacataaggcaagaagctaagaacaaaggaatgaagtgtgtaacccacgaacttggcacgtactcaggaatcacatacgaatctctatcattcatagtgaactcagagctcggggggttatgcaccgttcagcctaggaatttgacatgtactcagctcgtggccctcaactgcaacctatggactcggcacaacacatag

SEQ ID NO: 71147 - DNA, 240 bp, Glycine max
  Peptide Sequence Number=SeqID_162832
atggcagcgacgctggcagtgaaacgtacctcaggtcaccacgaaactgccaacagaagccaaaaaacctacttgggtaagttgcagatgaacaaccaaaaggcgagtcctcacgatcttcagcgcaatggagaacaacaagcttcgatggagaacaaccttaggatgcaaagggtacacacacagagaagaaaaaagcgtgagcaaaataggttgcgtctaataaaatttaaattgtaa

SEQ ID NO: 71148 - DNA, 453 bp, Glycine max
  Peptide Sequence Number=SeqID_162833
atggtggttccaaagtcagaaaatgatgcaaggataagcttaaactaccaaggaaaaagcttagaatcacgggttcctctcggtgtggggtttcaacgaagaacaacgacagtccatggtggctactggtggatgtgggtgatggagaaagagcttgggatgctggaaatggttttggaagaaggaaggagaaataaattgcatttttccaaggttacacgaaaagcaaaggctgaaacactcaagtgcttctgctcgaggaaaggaagtgttcctcacatgctagacatcttatccaagatcacaacgggtgttacagctaagggttgtagccgtgtggctttgcgtgtccgctttaaggtagacggagacattgatgctactttaggaggaggaggaggagaaggaggaagaggaggaggcgagacagttggagtagccatggtcctgtaa

SEQ ID NO: 71149 - DNA, 351 bp, Glycine max
  Peptide Sequence Number=SeqID_162834
atgcagatggcaaacagagatagaggtggtggtcatagaacatttaatcgtggtagaagacgtggtcttattttgggagctccaattaccactaacccttccacctcctccattcacatatcaaccttagagtcgatgattcatgtcattgcaccgactccaaatacacttcctacagctcgagaccaaccaaatccgacctttgtaagggagtcaattcccactacccctattagagatgcttcaccttcagcaccagatgattctcttacacctgagtacccaccagatccaaattttgaacatattgttgatcagaggccttttattcgtgcatataaaggagagtaa

SEQ ID NO: 71150 - DNA, 384 bp, Glycine max
  Peptide Sequence Number=SeqID_162835
atggaaagtgaacaacatcctccacaacaaagcccaccaatcattatcaacattcatgatgaaggactagaaccacatgctcaatcatatgaattcacactacaacctcatcatcatcaagaagattatgggtacaatccgcagttcttcattgctagcaaagaagactttatgagcaacctcatggatatagatcttcgaacaccggagtcggcttatgcgtacatgcaaagtatgcccatactttcatttgcatcctttcaccacaatattgccgatagttcttccactaatgactttgtttggaagagcaacatgttgttcttgataaacaacttgaaccacaagaacatggcaagtacgtcgacaaccgacaataaacag

SEQ ID NO: 71151 - DNA, 732 bp, Glycine max
  Peptide Sequence Number=SeqID_162836
atggtagtggacatgagggacaatattgatgtagcagagtgcataataaagcttattccacaatggcggtcttttggtgaccggattacccttgacggaaataagtcggtgccgaggttacctccagattcaatgcctgttgttgaccttgttgctagtgaccaagaaatggagttgtatccattggggaaagtactcgggcttggggaactacattggaatgatgaagtagtttggggcatttggtctctaataatgtcaggtgtgattacgcagctggggtattctttccctattaccagggctgacaacattgggagttgctctgttgaatacccaggtgatgacgataggatatgctcccaaggttggaaggagaatgtagaagttttgaaacctaaaccaactaactcttatgtggtaaaggagaaaagcctaacccctacgaagaaagaggctcttaaaagaatcaccgatccatcaaaagaatttgagtattacgtcccctacaagttaattcttatatcttccactgagaggtggaatgcaaacttagttgtagaagcaaacttcatgatgatgaaccaagcaattttgatgatgccaaaagcccaagtgattgattcaagcttgattcaagacttcaagatcaagcatcaagaatccaatccagtattcaagattcaagagaagaaatcaagaagcaacaagtcaagacttcatataggataa

SEQ ID NO: 71152 - DNA, 549 bp, Glycine max
  Peptide Sequence Number=SeqID_162837
atgtcagttctggaattgtatatagaaaaggatgtggctggtggttcaatgtttcattctgcaaattcgcttacatcatgtggaaattatttatctaatgatgagacacaatcgacaagaaatatgagcaatttacatattgacgaagacgatgatgatgctgatgatgattatcttgtgtctaactcatacgtagaagagtctttagacgaagatgacagtgttgacggtatatctgataccgacgatgaagtcaccaacattcctcaaccagtaaggattgttcacccagtagaaggtgcacaacggattgaaaatccatttcggaatgatgctttgcattataacattatcaactggagttatcctgatgaggaggacaattgcggtttggagatgccgtcgacctttaatattggccaagaattatatgttggcatggaatttgataataaagatgcggtcaaaaatgcagtcaaacaatatgttatgaaggtgcatcaaagttttaaagttgttggaagcaaatcgaacaagtatatggcatga

SEQ ID NO: 71153 - DNA, 681 bp, Glycine max
  Peptide Sequence Number=SeqID_162838
atgaggcatgtaaagcatgaaggacatgcacaaacccatgggcccgaaatctaccctagggctcatgagaaccctagggctttctcttgcatctttggtccaatcttcttggagtcttctatccaatgcccttggggggtaggattgcatcaaacaccgccaaggtccccttctccgcattcagatggtcaatcaaaggcgacgtctacgaggagtagacagtcgacacgcctaagatggttgactttaagaaccttggatcagcccaggcctacagttaacgtcaatccgacgatgggaagaggatcatgccaacataaagagaagttccataactatctaagggtcatagtgcaagaaaagattcccattgtacacaacaattggaaagatgttccagaatctctaaaggacctagtatgggatgacattttagaaaaatttgatatccctaaagcattgaaagccaagaagaaggtcatgtcaacggtggcgaccagatggaggcaatttaagtctaccctcaccactaaatttgtgtatggtaacactgagggacaagataaaaaagatccttctataaaatatggtctagatccagaaacttgggacaaattttctacaacccgccaaacacctaattggcaggaaaaaggcacaggaaattcaaaaatacaatga

SEQ ID NO: 71154 - DNA, 440 bp, Glycine max
  Peptide Sequence Number=SeqID_162839
tcccttctacctcaaatgttttttatggctcctcacaaatgtttgccaccactttcaacactccaccatctacatataatcttgcaccatcgagttcttgttattgttcatcattacctactcaaatatgtgacatgagtcaagaagatgaggacgaggatgaggataacaacaataacaacgatgacaatgatgatggtgatggtgttgatgatgatgacaacaatggtcatcatgttcctcaacaacaacggacaattacacgtcaacatcctagaacaagaggaggtagaggccgtagactgagaggacaacaaacatgcaagtgggttttggagggtctacctcgtttaaggcgggttgaaagtaagggtgggtcaaggcaggttggcttgctctgctatcccaagttgaaggttaaactcctatggacttattga

SEQ ID NO: 71155 - DNA, 504 bp, Glycine max
  Peptide Sequence Number=SeqID_162840
atgtctggtttttcaaaacaaatgccttcaatgaatgaagctgatgaagtggatgatggacatgcaaatcgtatcatggacacacggccgacgtctcctccgcagtctgatggtcaatcagaggccacttcaaagaggagtagaacaacgacacagcttagaacgctaactttaagaaccgtggatcagcccagaccggcatttaatgtggatcctgctaccgggagagcatcgggaccaatgcgtgaaaacttccacagctaccttggcgtagtcgcgcgagaaaaggttcccattatccacaatacttggaaagacgtaccggagatgctaaaggagatagtgtggaatgacattctagcccccaagttgtttgtaaatgttcttcgagaaagcctcatagaacttgatgtaatcctccttgttctctgcaatttcaaagatgagctgaaggcacttcttaaccaagttcttccggatgaccttcaagctcaactgctgcat

SEQ ID NO: 71156 - DNA, 342 bp, Glycine max
  Peptide Sequence Number=SeqID_162841
atggcgaaaagcactgatgtacttttggtgcaaggaacactcgaaaggtggcaatgccactcaaaaaggcacgacttcgactacgtgggggtaccggtggtgggagcagcaagtccacttcggcttcaagtacttggcggcgagaaacaaaacgtcagggtggtagcgggacggacttcacggcaggatgaagtagttcaggcaatagcgggggagctaggtttttggagggatggtctacctacaagcatcgtctttgatgacttccatcaaaactacaacggcggtgttgtagacaaacgtcgttgtacaacaaacgcgccacttaaaaaacttatataa

SEQ ID NO: 71157 - DNA, 252 bp, Glycine max
  Peptide Sequence Number=SeqID_162842
atgactccttaccgaggccttgaacaacttggcgcaagttatggccaatcagggaggcggtggaggagtaactatgtaccatggtttagatcactttcagaggaacaacccacctaccttcaaagggatgatgacaaagatgatgacaaaaagctcaaagatcaatcaaagaacaactcaagtgaatcaagagcaatccaagagttcaagataagaatcaagaagaattcaagactcatgaagaaagtctag

SEQ ID NO: 71158 - DNA, 423 bp, Glycine max
  Peptide Sequence Number=SeqID_162843
ggacctggaagctcaagtagctccccaatgatgaaaagggagatgataacaatgatagtagacacattaccagtgttctactatgaaaaaatggtggattacacgccttcaagctttgctgatttagttttcaccggcgaaagaatcgaagtgggtctaagaagaggcaaatttgattatcctgctttgatgaatggaaagcctagggcaaatggagagaatgagaagaagggagaaacccatgttgtgattgtcgttcctacatggccaaacttcccaccaggatatgacttgaacgcaacatgtgcttatcatggaggagttccagggcattccgttgagcattgtataaccctaaagcataacgtgcaaggtctaattgatgcgggctgcctaaaatttgaggaggataatcgcttgtga

SEQ ID NO: 71159 - DNA, 219 bp, Glycine max
  Peptide Sequence Number=SeqID_162844
atgaccaagttggatatcacttgtgggggaaatagagtgcttgtaggcctaggatcttcttcatcaatggattcctttgcttcatggaagatgagtggcatcagaatggagaagaaagagagagaggagatgccatttcaaggagaagatgagtctagaagaagctcaccaccatatgaggtcatggataagagcttagaggaagaaggagatgaatga

SEQ ID NO: 71160 - DNA, 564 bp, Glycine max
  Peptide Sequence Number=SeqID_162845
atggtagaaccctttaagaagagaaaaggctcaacctccacaaccaccgttgtaggacaacatcgccacgacacttccggtggcccaccagcaccacctaatccttccttttcctccctatggtctttaactctattttcttttgatgaacagtatcaaagggatggtgttattttctctaaggtggataaaattccaattgtggttgatcaatctttgttttattcattgacaaaactgagtagtcaaggtgtaccttttgagggaactttggatgatgattggaagcatatctattcaactcatcatgcacataaaatggatgtcgatggccaatgggtacggaaacaagacctttcccctccgattcctaacaaacgaacaccctccccaccaccacaatgggattcctcgtcttcactgctgaatgatgttctcactgaacttagggatcttcaggaatttgttggtgatcatttcaatgttatggattcacgaatcacgcatcttgaggatgatatgagcttcattcgtcgctgctttgatcctctgatggattcatag

SEQ ID NO: 71161 - DNA, 1347 bp, Glycine max
  Peptide Sequence Number=SeqID_162846
atgttgagtgtaggattgacctctgttgatgttgatgatgcttttgattcggcttctcaagtgaatgtccatgggtggactatcaacaataagtactacactgctgatgtttctctttggatggctcatcttcacgacgatttttctgctgccaacgtgaccctgtctcgacgaatgactgcactggtgatggtttttgacatgaatgaaccatcttccctagctgcacttcgagaatgggtatctcgcactgatattcagaactttgagatattactgtgtattggaaacaaagtggacctggttcctagtcacccagcccatgctgaatacaggagacggttgctgaaacttgaagactctgctgcagatttttattcggaagagtatggaatatctgaatcggagggaactagtttattgggggatgaagaaccgtcgtgggacatcagaaggtcctgcttggactggtgcactgatcacaatattgagttcattgaggcatgtgcttccaatgctgattttgacaaatgtttgtcgattgatggtgatttacaaggagttgagcgtctctacggtgcactttctgctcatatgtggcctggaatgcatgctgattgctgcttttgtcaacatagaataagtgctgattttgttttatccttctcctctcctccccccgcccttgcccccacaccagagttatcttcagaagaatctgattatgaacaagagtatgaagtcttatcagctggctcagccgattgggatgaaagtgaacaaggatggatttctgcatcgtccttagattcagggggatcagctcctcaaaacaatcctggcacagttggtcaacatgaggatggaattaaatctgataaagagtcacatcccacaacctcaagcactgcaattcaggatgagagtgaaaaggatatggtgcacaataccatggattccgaaggtgatgggaaggaaaacgagggtaaatgtctcgaattagaggatttggaacacttgatgtctgagattgggaatatgcgtgcaggcttgcgattgatgcctgattttcaaagaagggatatggctgcaaagctggccatgaaaatggcttccatatttgggggggagaactcacagcatgctcctgggcgtggaggaggtggcaacgctcatggtggcgctcgtggcggcgctcgtcggtgtcgtagcatcgccgagtgttgcagcctcgcagcggctgcgccaaccgcgacgttgaaccgcgctgctatgtccatcccagtcgcggatgggggacgcgccgctccacttcgccgcaatagcggccgcgacggccacgattga

SEQ ID NO: 71162 - DNA, 346 bp, Glycine max
  Peptide Sequence Number=SeqID_162847
atggcacaatgttgtcatttgtgcattctctcattcttttctatctccggtgcgcagtgcttccctgttttattcgtttcagtgaaggtgaaggtggaggtagcggcgatgttcggtgttgcagtggtcggcggcggcggcatacgaggtataatgtctgaagaagtggatatggatgatgaaaatgaagaagaatgtgatgtgaatgaaccacatgttgattgttcggatgcattcaatacttctcaggtgtttgacagtcgagaggatgttttgcggtgggctcgatccgttgcttatgaaaatggatttgcggcggtgattgtaaggtctgacacaaacacag

SEQ ID NO: 71163 - DNA, 411 bp, Glycine max
  Peptide Sequence Number=SeqID_162848
atggaagtttttcaagacaaattctgcattcagaagcaggattaccagaaggaaaggtattcaaaagctggaaagacagatcaacatgttttatgcgtcaaagtgaagataataaaagttgtgtatgatcaaatgcatgatgctagggatagctttagtcaatgggtagattcacactctcacgctctcatcctctgcggcggcgcttcctctcgctcccactttcgctctcactctctacggcaatgcttcctctcgctctcactctccgcggcggcgcttcctctcgctcttgctcttggtttgactctcattgtcgctctcactcacaaccgtctccacggcgacaacgaggttctatttgcggggattaaaaaagtgtcagagtgtgggttgatgcgtgagagatga

SEQ ID NO: 71164 - DNA, 192 bp, Glycine max
  Peptide Sequence Number=SeqID_162849
atgccaaagcttagaggtattggtgttggtggtcgtgatattgttggtagatgggcttttatcctttccaactatcaagtgaaaaaggccttccttcaagaaggtgatggtggtggagtgggaggtggagtaagattgtcctcaccagatgagtcggaggtagtcatagggagatggcgactggaagcttag

SEQ ID NO: 71165 - DNA, 688 bp, Glycine max
  Peptide Sequence Number=SeqID_162850
accatcgaacttgtctcagaaaaatgacgatctcggactcattcaccgtttgatcgtcatgaaatttaagaaccaggttcgcaaccctgttacgagtattctcaccattgggaatttggatatcatgttgttcacgatccaattccgcataccttcaccgttgggatttgtaaaaaaatgtctgtggatggagaaatatgcatcgcacgaagcagtacagaatgaaagcttcaatcccttctctttctctctaacgtttgggaactctatcagaacaatcagaggaaaaattgaggaatctcagaaaattgctaaagatgccgctatcgctttcagaagacacgtgagttcgcttaaagcattctcgcaaaacatcgtgaccttgactggtctccctatgatcttacttagtgagagtgatctaacaaacccattgtgtggtgtgtcttgttatgtactcctaagcgccccagggtggtttttcactgacatggaatgtgacaactcacttcctgtgtgttatttgtgtttggatcctgtgatgatcttgaactttgtgttcgggggagcagatgaccaggccttggacattcttcgtcaatggagtcttttgcatcttgaagatcaatggaagaagaatggagaaggaagaaagatgattggagacgccacttcaaggagaagatga

SEQ ID NO: 71166 - DNA, 762 bp, Glycine max
  Peptide Sequence Number=SeqID_162851
atggggtctggggtgacaataagtcaatactatggaagggcttcacatggctctagcagctcctccacatctgtcagccaacaacaattggctgacataattggcatccttaaggaagacacaaaggggagtaacgctgaaattgcaatcaacccagcaggggaagaagatggtgctcatgtgatgccgagtatggagttgtatgtgcaagatgatgtggttagggtcagtgttgaaaaaatttatgacgatgacgctcaagttccgttcttgatgtccgaaattcagtatgtcaggcaagattcacatattagtgaaaagaaattggctgaagctgctgctgacgatgatcccttgcgtggcctgattaaagccctatatgatatttatgagaagcctattgagctattgtgggataggactaaatttggggttccaattgtggatgcatcattcttcttaatttatactgatgtaaatgaaataatagcagctcaagcttgggtcatggttcagtttatggattccttgagccttagtccatacacaatgcaaaggataaacatgttgaatgtcaacattacattgaaatatggggcccattggcagctagttgtgttgtgtcctacgaaggacattgttgtctggttttgttcgtcgcgtaagaagcctgatattcatatcaaagctgcaattaacaacagtggaatgaagacattgaagactactttggacggtaaaatagatcaacctgcatcttag

SEQ ID NO: 71167 - DNA, 315 bp, Glycine max
  Peptide Sequence Number=SeqID_162852
atgtataacatgggcacggtaaaaaaagtagattcagtgggtaacatggacatgttttggaagagtcatattattatggtagattcatgcattaagagggagtcccaatctgaaccatttgatgtagaaatgggagatcgcttagaggatatgattcatgatcttggactagagccttttcaacaagaatatgcccctatgtatgatacattgcaaactgattcaaataagcctttgtatctagggtgcaacaattccttgacgctattgtcagcagtcttaagtctagttaatgtgaaggccagatatgggtga

SEQ ID NO: 71168 - DNA, 1116 bp, Glycine max
  Peptide Sequence Number=SeqID_162853
atggcttctccaccagcctcgcctcctcctcctccttctcctcctctttccgacgcattaacttcgccgtctgccgtgaagcagacacgcaaagcctcatgtggacgtcacgtacgagaactggaaggaggtccctatttctcagaaggacttgatttgggacgatattcagacctcgcgaggaaatgggcccttgcaacggatcaggacggtgtggacgacactgtctgtgagaaatacgacataagcaaggaaaaatggacccatttttgcaagactcgtagagacccttcttgggaggatgtgcagaaaaaggcacaggccatccagaaacagaacactgtcccccacgttttgtctcgtgggggttatgaatatttggagcagaagctcctggctaacaagaccaagaaaaagctggaggaagttgaacagtcaggaaacattgatcccgtcatcgaccctccatcccccatcagacgccatgtgaagtggaagatgacccgcaccaagaaaacaggggagatgatgactgaggccacaaaggaaatcactgagaagatccactatggacgtgtccatgctgctggagtcggtgtcaccatcaagcaatacttcggatcggctccacggacgtcccacagctcttccttgctacctcctgaagaattgcagcagctgacccagcaaatcagggaccagctagaggagtcgatcacaaaaaaaccaaatgcaatctcagtttcagtcctagatgtaatctcaggacttgcactgcctccggagcatctggttggtccctcaggtcctcgagtaagcacaaaggagagttgtgttgatcccttaggaaatgatcctgagacgggtgactcagataggtgcaacttgtacattgaagcaaatcctgcccgcccggttgccttggggagagtttatgagggattaactgttgttcataacactcttttgttgccaggccatgtaaaggtgggtgtggaggaggttaaagatccagatgctccagttcctatacccagtgaggaggtttccttagtggggcaggcaattcacaccttccttggttggccgacacatctggtcaagtttttatcatag

SEQ ID NO: 71169 - DNA, 996 bp, Glycine max
  Peptide Sequence Number=SeqID_162854
atgtttgtctccgccatcttgctacttgttggaatattatcgtccattcgagtactagaatttacagctgcacaaacacaagttgtaggaatttgctatggagtaaatggtaataatctaccatcaaagcaagaagttgtggatttatataaatctaagggtatacccagaatgcgcatatactccccagatgaagaaacacttcaagcccttagaggttcaaatatagagttgacgatggacgtgactggagaaacccttcaatctcttacagatcccaatgttgctactgattgggtccatcgttatgtaacatcctattcacaagatgtcaatttcaagtacattgttgttggaaacgaagttcaccccaattacgatgttgccccgtacattttacctgccatgaccaacatccagaatgcaatatcatcagccaatttgcaaaccaaggtgtcaacagcaatagacaccacgttggttaccgattcctacccacccaacaacggtgttttcaccgcagatgcaagcccatacatagggcccattatcaatttcctagtgaacaatggagccccacttcttgccaatgtgtacccttacttcgcttatgttaataatcagcaagacattagtcttccctatgctctttttactcagcaaggaaccaatgatattgggtaccaaaacctcttcgatgctatgttggattcaatatacgctgctcttgaaaagataggcgcgcctaatttggagattgttgtatctgagagtgggtggccatctgcaggcggagacggagccttggttgacaatgcacgcatttattactataatttgttaaaccatgccaatggtgagattggaactccaaagagacccggtaggcctatacaaacatttttgtttgccatgtttgacgaaaaccaaaagccaggtgcggaaactgagcgacattttggtctattcaatcctgataaatcatccaaatactga

SEQ ID NO: 71170 - DNA, 450 bp, Glycine max
  Peptide Sequence Number=SeqID_162855
atgaaaaccaagggtggttcaaagaataatgtcaagaacaaagatgttgaagatgggaagttccatgatttggtggagaacgataaggaagccttgtctgacattggcaggttagaaaagaggataaagatagcaatttggtgcattcaagagcatcttgaaatgaggccaactatggggaaggtcaaacaaatgatggacggaatgatgggtggtgagcttccaatgaaggaagccaagatggcaattgcggcattggattctgatggagatgggttgctaagtttggaggatttcattgctctcatggaagctaggggagaggagcagaagttgaatgacttgaaggtagcttttgacatgtatgacactgaaagctgtgggtttataacccctaagagcttgaaaaggatgcttaagaagatggctttgaagaactcagaattatga

SEQ ID NO: 71171 - DNA, 1011 bp, Glycine max
  Peptide Sequence Number=SeqID_162856
atggctgaaagagaaggaagtagaccaccaaggaggactctaggtgactattcttatcaacaaggcccaaaacattacaatagcatagtaattcctcctttcagcaataaggtcgtggaattaaaatcagcattgcttagtctaattagctcacatccatttgctataatggatcatgaggatccatatacacatttgtctaccttcatggaactatgcagtactataagagcttctgacgaatatgttgaagcaatctacctcagagcttttccattttcactagtagatttatcaatgcaaaatccgccatcacgactttctcccaaggatctaacgaacctttctgtgagacatgggaaagattcaaagctttgttgtggaggcactatgatgtccaaaagcccagaggaagctattgtaatcattgactccatagtagctagtgattatcaaagtcatcatgatagagctatgactcagagaaaatgtataatggagttggacactcagagtgcaattctagctcaaaacaaactcttcgcgcaaaaaattgaggccttaacaaagaggataggccaacttcctcagcaatatcaccgagatgtcattgttgtggtggtaaccatcagaatggctactgtgatggataataagaagaggaggcccattcataatctacaaaaccaagctagacctcaacaaaactttcaagcaagctaccatggctatagaggtggctcaagttcaaatcagtcttatggctggagaccacacaattctggtcccgctaacacttcttttgtaggtccttctaacaactcttatgggggtttatcaaatagaggtccacaacaacaacaagctcagccaaatagaatgtcaaagatggaagatattttaacacagtttatgcaggtatccattgcaaaccagaagaacactaatgcatctattaaaaatatagaagttcaagttggacaactggctaaacaactatttgaacattaa

SEQ ID NO: 71172 - DNA, 684 bp, Glycine max
  Peptide Sequence Number=SeqID_162857
atggcacaagggcttctttgtcttctctcatttaattcctcccgaagccttcgcttggccccaaagtcacaagctgcacaaacacaagttataggagtttgctatggggtaaatggtaataatttaccatcaaagcaagaagtcgtggatttatataaatcaaagggcatacccagaatgtgcatactctctcaagatgaagcaacacttcaagcccttaggggttctaacatagagttgatgatggatgtggctggagaaacccttcaatcactaacagatcccaatgttgctactgattgggtccatcgttatgtaacatcctattcacaagatgtcaatttcaagtacattgttgttggaaatgaagttcaccccaattacgatgttgccccgtacattttacgtgccatgaccaacatgcagaatccaatttcatcagtcaatttgcaaaccaaggtatccacagcaatagacgccacattggttactgattcctacccacccaatcatggtgttttcaccgtagatgcaagcccatacatagggaccattataattttcctagtgaataacgaagtcccacttcttcccaatgtgtacccttacttcacttatgttaatgatcaacaaggcattagtattgcctatatatgccctttttacttagcaaggaaccaataa

SEQ ID NO: 71173 - DNA, 96 bp, Glycine max
  Peptide Sequence Number=SeqID_162858
aagcaaaggaatccattgatgaagaagatcctaagcctacaagctccaatggagcttacatcaatggtgctaatgcattggcaaccaacaatgtag

SEQ ID NO: 71174 - DNA, 435 bp, Glycine max
  Peptide Sequence Number=SeqID_162859
atgagaaagcgccacgcttcccgaagggagaaaggcggacaggtatccggtaagcggcagggtcggaacaggagagcgcacgagggagcttccagggggaaacgcctgggggtcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccacaccttcgagaacagaagttgtgcacacaaatactcccaccctctcaaccccaaccccaccacaccacctcataccctttccggaagcacttctagaggtgcttaa

SEQ ID NO: 71175 - DNA, 324 bp, Glycine max
  Peptide Sequence Number=SeqID_162860
atggtggttgacgtctgtcaatgtttttgtggcggctggcaatcccgccacttgcccttaacggtagaattgattgaaacaaagacggcttctaccgtgtggtcaagtgtttcaaatgatttaccgtggacaaattttttaacaccgttagattcacctcagtatacaatccgcggtgtcttcatggacgatgtgcggaagggtagagggagaagcaaattgtgggtcaacaaggcggtcgttgcacttgacgtcgatgtagatccgacagcgagggaggctggtaccgtagaacttgccgaggccaaagacaacactctctga

SEQ ID NO: 71176 - DNA, 135 bp, Glycine max
  Peptide Sequence Number=SeqID_162861
atgggcctcagtgacttccggaagacactcttccggaagatactgcggcctattccggaagaaatggttccggaagtgtcttccggaagcacttcttccggaatgggcctcagtaacatccggaagaaggtataa

SEQ ID NO: 71177 - DNA, 531 bp, Glycine max
  Peptide Sequence Number=SeqID_162862
atgggcttactctgtagcagaaatcgccggtataatgatgctgatgctgaagaaagtgcacaggaaattggggaaaagttatcagaaattggaggcaggctggattacccatatctcaccaaggagcttgcacaggaaattgagaatctgtggaaggatcctgcaattcaggagacatatgcccgtggtagtgagcttcaaattccagattgtactgattatttcatggaaaatttgcaaaggctgtctgacacaaattatgtgccaacaaaggtcccacttaatgtatgcgagtggttcaaagattaccaaccagtttcaacagggaaacaagaaattgagcatgcttatgagtttgtgaagaaaaaatttgaggagtcatatttccagagcactgctcctgatcgtgttgatcgcgtctttaagatctaccggaccactgcccttgatcagaaggttgtgaagaagactttcaagcttgttgatgagactttgaggcggagaaatctatttgaggctggcttgttatga

SEQ ID NO: 71178 - DNA, 156 bp, Glycine max
  Peptide Sequence Number=SeqID_162863
atggtgaagaagataaagaaatcatttttcaggcatgattggatgattcatggagtgctttcaagtgttgtccaaaaagtggtttctgagtggttgggatgggttgttgatcttgggttgaacaagttagcttatagtgtgtttggctcggtttaa

SEQ ID NO: 71179 - DNA, 306 bp, Glycine max
  Peptide Sequence Number=SeqID_162864
atgggtcctattggtgcaaaaaagcacatggcaccatttttaccttcacactctgtggctgggttagacaggttctgggatgctcttatttccatcagagcagatattcctgagattgaaaaaggaaaggctgacattaacaaccttactctagggaatatgcagccttcccagcttcatgtctgtgtttcaaagttctggcctagcacaggacctgttgataatgtgtacggtgacagtaacctcatttgcgcccttgtcccagaatcgcaggctgttgaagaacaagctgctgtcacagcatag

SEQ ID NO: 71180 - DNA, 297 bp, Glycine max
  Peptide Sequence Number=SeqID_162865
atgtctgaagaagttaatatgaatggagacaatggagagaaacctggtgtgtttgaaaatattgattgttctgatgtcttgaatacttctcaggtgtttgctacccatgatgatgacgttttgcatcaggctcgttttgttgtgtatgatattggttttgtggaggtgataatgaggtcaaacacagatattggaaaaagaggaagggattcatatgatcagcgtataacgttaacactgatgtatcatggggtccgtctggaaaacgctttgtatcaggacctacatgatccataa

SEQ ID NO: 71181 - DNA, 747 bp, Glycine max
  Peptide Sequence Number=SeqID_162866
atgaagagtggaaactggaaagcatcttcggttcaatctttgtgcagtgtgaggtttcgaaaaaaatcatcatcagcacctgccccagttgatcatgattcacatgaagtgacaaatcttttgaatattgaatctactaccccaccaacaacaacatcgttagaacatgaacaacatcctagtacctcggagggaccaatgttggagaacacagcacaaacaacacaaacacaaaataatgacacgttggtaaaggagttacctcttccgccagcattgcagcaacaccctaatgtggaccccaagattgtgaagagagcaacttctgaacgtaggttgtctttcaatttgagcatgaagatgccaaggagtttttcagtggcaagaaacgatcaaaagggtaatttcaatgatggagggaataaaggaaagttgttaaaaacaaatgagtctatgtggatgaagacaaaagggaagttgaaaaatgaagattctgtgtggatgaagacaattatacttgggggaaagtgtgttcctgatgaagaagaagatgttgtcatttatgagggcaaagggaagaaaatctcagcataccatcctagaaagtctacctctatgtcactttctaggcaatgttcttacattaaccctggtgccttctctgtaccccaatcccatgaagaaagaatcaaatcaatcaataacacatgtgaggacaacaaaatgaaattagaaaactctttctag

SEQ ID NO: 71182 - DNA, 249 bp, Glycine max
  Peptide Sequence Number=SeqID_162867
atgaacatgctttataaccgttatagtaataataggtttgttcgtgaatattttactaagtatggaatgaccttttcagccttagttaataaaatttcaatagttactaaaagaaagggcgtgagagggaagctagggattatgaaggttgaaagaaatttgcagcaaggatcattggcattgagaaggacccagatcgtgtttaccgttggaatcagttcatcaataatgaacgtaaatcaacactag

SEQ ID NO: 71183 - DNA, 682 bp, Glycine max
  Peptide Sequence Number=SeqID_162868
gactatgtggacgaggaagagcacctcaaaatgtttgcacgtgcttggattttgagatttattggaggtgtcttgttggtggataaaagtagtaaaagagtccccatgagatatttgcaatttctagtagcttttgaagggtgcagtacttatgcgtggggagctgctgcaacagattataatgtgcaatctattggcagttacattctcttaattcaattgtgggcatgggaacgatgccctaaattagtcccatcgattgtgcctccacaacaacaaaacaatccacttggctatagcaaacgcttagtgaatggaatagtcgctatgaaagacggtttcaagaaacgccaccacaaggtgtcaaatttggacgatttggcaccgtgccttgataagatgactcttttaactgaggaagaggataaaattattgaggcacgtgaagaagctccttctttggttccacaatttgaacgtcaacagtttgatatgttgggtaggagtgtggagacccaaggtttagggcaacgtagggaaagtgtggatgcagaagcacatgttattcctgcgatgccagagcgccaacatggaatgtattacacacctgatcagttcacccaagagccgtctcaaatgtcatccctgtatccgtacccatatcaaagcggaacttcatcag

SEQ ID NO: 71184 - DNA, 516 bp, Glycine max
  Peptide Sequence Number=SeqID_162869
atggagaccagattgcaagccactgagaagaaacagcagcaaatgatgagtttccttgcaaaagcactgagtaacccatctttcacgaaacaattagtccaaaagaccccccaaagcagagaagtgttgggtgttgaaatcaataggaaaaggagactgactgctagtccaagtgttgagaacttgcaacaagatgatcaagatttggcaactttggattatccaagccatgatcgagatttggcaactatggagactgatatggacacttttttctcaccggcttatgataatgaacttagcagtgaaaccaatgagcctgcatcaatttcggttgaggatacaatcttggaggactttctcaacaaagacttggttacttggaatccggaggatgaagttataattggggatagttcccaagtcgatgtgccggtggaggatttggttgcaaaccctgatgattggagtgagcaattgcaggaccttgtggatcatatggactatctaggctaa

SEQ ID NO: 71185 - DNA, 348 bp, Glycine max
  Peptide Sequence Number=SeqID_162870
atgaagacaaaagctcacaacagaatcactaacaatatagtaagtgaaattgagcaagaggctccataccaagatgatgagcttgtaggacttcaagaagtgttggaagttgaccctgatttcattaatgaatctcttacgaatgttgatggaggtggagaagagacgacatacagtgatagaggtggtggtcgcagaacatttaatcgtggtagaagacatggtgttagtttaggagctccaattaccatcaatccttccacctcttctattcacatatcaacctcagagttgattattcatgtcgttgcaccagcaccaaacacacttcctacagctcaagactaa

SEQ ID NO: 71186 - DNA, 378 bp, Glycine max
  Peptide Sequence Number=SeqID_162871
atgaggtgtgaggagggttctatgacatgttggtggggaccacaccccacttcgtctaatcccccgataccagccaaaagaggaacgccacgtggcacattctcattggcttggcaccccttcattgcagcccaaaagcttggtggaagtggaacccttcgtccaaagcccgcaaaaactacctaccctaatgaaagtaaaagattcttaggttcgtgtgataccacaactaacttgaatgctgaattagtctcaatttttcatggtctacgtgttacaggggaagttgggcacagaagaattatttgtgagccagattttctcaaatcaagaacgaattgtgcaacaatttcatcagtatgcagcgctcattgctaa

SEQ ID NO: 71187 - DNA, 3186 bp, Glycine max
  Peptide Sequence Number=SeqID_162872
atgaagctttggtgctttccatggctatgcttcactgaagaagaagaagaagagcgcaacgttccaaaacctatgaaggaagacgacattttcggaaacgacgtcgtttccgacgacgacgacgacggaaacaatacccgcggcggcgacgacgagcaattcgcgacggcgcgcaccgatgcattgggctcgtggcccggcgagagcagctccaccgccgccgccgcatgttcggaaacccccgccgccggcggcgagagccgcgattcgagccacaagcgcgccaagttctacgcggatttcgaggagcgtaacttttcaacgcatgccggaaagtgcggtgcatctaatgaatacggtgattatgaccatattaaaggtactcttcgacccaacggtgagacttgttatgatgcatttgcattgatgggtgctgttgaggagagtagtagtggctttgattccagcattgtgaaagagggtgagggagatgatagtgatatctcgaaagttgaagatgtagaggtcagaatggatctcaccgatgacctgttgcatatggttttttcgtttttggatcatcccaatctctgcaaagctgccaggatttgtaagcagtggcgaggtgccagtgctcatgaagatttctggaaaagtttgaattttgaagatcggaacatatctgtcgaacaatttgaggacatgtgtaggcgttatcctaatgccacagcagtgagcatatctggttctgctatttacttgcttgtcatgaaggccatctgttcattaaggaatctagaggttctaacattaggaagaggacagatagctgatacttttttccatgctttagctgattgttctatgttgagaagattgaatatcaatgattctacactaggcaatggcattcaggagataactattaatcatgacagattgtgtcatcttcaattgacaaaatgccgtgtaatgcgaatagcagtcaggtgtccacaacttgaaactatgtcgttgaagcgcagtaacatggcacaggttgtgcttaattgtccacttttgcatgagcttgatataggctcttgccacaaacttcctgatgctgcaatacgagctgctgcaacttcatgtcctcaactggtctcactggacatgtcaaattgttcatgtgtcagtgatgaaactctgcgtgaaatcgcgttgagttgtgccaaccttagttttcttgatgcatcatactgctcaaacatatctttggagtctgttagactgccaatgttaacagttttaaagcttcatagttgcgagggaattacttctgcctcaatggctgcaatagctcatagttatatgttggaggttttggagcttgacaattgcagcctgttgacttcagtgtctttggatcttcctcgtttgcaaactattagattggtacactgtcgcaaatttgctgatttgaacttgaggactatgatgctttcttctatactggtatcaaactgccctgcactccatcgtatcaacatcacttcaaattcacttcaaaaattagcattgcaaaagcaagatagtttaaccacgctagcactgcaatgccaatctttacaagaagtggacctctcagaatgtgaatctttgacaaactccatatgtgatgtttttagtgatggtggaggatgccctatgctgaaatcactagttcttgataattgtgagagcttggaatcagttcggttcatcagcaccactttagtcagtctttcccttggtggttgtcgggcgatcactgctcttgagctcacatgccctaaccttgagaaagtcattttggatggttgtgatcatttggaaaaagcctccttttgtcctgttggccttcggtctctcaatttaggaatatgtcctaaattgaatatactcagcatagaagccatgtttatggtctcacttgagttgaaaggatgtggtgtactgtctgaagcatcacttaattgtcctctcttgacatctttggatgcttccttttgcagccaacttactgatgaatgtttgtctgccacaacggcctcatgcccattgattgagtcattaatattgatgtcatgcccatcaattggtttagatggactttgttctttgcgtcggctcccaaatttgaccctgctggatttatcatacacctttttggtcaatttgcagcctgtttttgagtcttgttcacagctaaagagtgccaccacaccacctgcgcgctcaagaatagtgctgccaattttagtcagacaaataattttaatagcacctaatgaaattgtgatattaatttgttatgatgttgcgagccctggtgcagcggtaaagttgtgccttggtgacttgttggtcatgggttcgaatccggaaacagcctctttgcatatacaagggaatgtaaccagtatactcctcttatatgacatgtgcaatcctcctcccttaagtcagcttttgggagtgagtcaggcatgcaaatatctcactgactcatcacttgagcctctttacaaaggtgctttaccagcacttcaggagttggacttgtcttatggaacactgtgtcagtctgccatagaggaacttctttcttgctgcagacaccttacacgtgtgagcttgaatggctgtgccaatatgcatgatttaaactggggatgcagtcgtgggcatattgctgaattgcctggtgtaaatgtcctatctattgcaacttcccatgaaaatgtccacaagttaagtgagcaacccacccggttactgcagaacctaaactgtgtgggatgtccaaacattcggaaggttttcattccatcaacggcacattgttcacgtttgttgtttttaaacctttctctatcagctaatttgaaggaagttgatgtagcttgtctcaacctaagctggcttaatctaagcaattgttcctctttggaagttttgaagctagagtgcccgagattgaccagtctgttccttcagtcttgcaacattgatgaggaagctgttgaggctgctatatcaaaatgcactatgctggagactcttgatgttcgcttctgtccaaagatatgctcaatgagcatgggaagattacgtgcagcatgttctagtttgaagcgtatattcagcagcttgtcatcttcataa

SEQ ID NO: 71188 - DNA, 393 bp, Glycine max
  Peptide Sequence Number=SeqID_162873
atggcactcccttgttctgcttcagttccactgacaacactaacatcccctcttctcttcatgttcaggaaaaggtttggagaagaagttgatcaagattttatttacattattgccgtggatcggatactccaattggaagacattcaggaggatggcatatgggtcacctcttcagattacaaaaatgctcaacccgatcctcttcgggactctgcacacaacttagtcactgaaatcaacaccaacaatatggaagacattactcgcttttgcaatgtctacgttgatttggatttcctggtttgttactatttcctggtttgttactacttactgttaaccctatctatgcctaatgtcatcaaaatcacattgctaaatgctaactaa

SEQ ID NO: 71189 - DNA, 234 bp, Glycine max
  Peptide Sequence Number=SeqID_162874
atggatcatttgcgtaaagtcttaagagacacaggtgcttatgtcaattgtcttttgcgtcgggaatgttgcactttctcaaatggtgaatatgtgaagtctggtgtagcggaactggagaaatggatagtcaatgcaacagaggaggtaatacatcagaagaggaagaaatctttggaagagattcggctagatctttgtccggcgaagcaccttacttgggaattgggataa

SEQ ID NO: 71190 - DNA, 288 bp, Glycine max
  Peptide Sequence Number=SeqID_162875
atgtgcaaagcgcgacttgaatggaagcctcacacgctaatgaaaggtgttttttggcgcgtttatgggtggatgatgatgccgtcatcgacgttgaacatatcggaaaggtcgttggaattatggaggtcgaatacgattgtcgaaaaagtcgcgaatgaagaagaaaggttcgacgaaaagcggaagcaagtcccaagaataagtgcaacaaccaaaaaggtccaccccggtgggggaaggttttccttatttcctcaaccttgctctggataccatgtaaaatga

SEQ ID NO: 71191 - DNA, 1116 bp, Glycine max
  Peptide Sequence Number=SeqID_162876
atggacatactcataccgcttccattaaggtggagttactaccttattttgtctgtgaatgggcaccatatgtggtcattggatgatctcactctcaaggcaatgggtctccaacttcttctccatgtggatccaagcaatggaaacttggatgtgttgattggagagaaaggcttcttggtctgcactggtgatggactaaatggttgtggagtaggagttgaagttgcctcactatcagacgacctgctcagcgatctatctttgactccttctaattggagtgttgatttcttcttcttcttcttctttttgggcttccttcttggtatggactttgccttactactctctaaggatcctttgaacctttttggcaagtccaaaggtctccagagctttgtcttcattagcaacaatcctggccagctaattttgcctcctttgttggatatcatcttgatctactggaagaatatgcatgtttctccttatgtcaaccttcatttccttcaggttgaaaacactaaagcattgttgtctgacaacgaaagttcccttgctgattgtgaaatgcttggagtcctcgtccaatctttcgaagacatggaatacttggtgttcctaaaggagatcgttgacaagggcaacatagttgatgtcatctattcctcccaggatcttcatgttgtattgaaccttctttttcccatctacctctttggcattcttcctatagagagtttttgtaacgtggctctcatatgtcttctcccagtcttcttggtacgtgtttccttccctgatgcacctagtgacttgtgcgatggtctccatggacaacatgactttttttctaagaaccttggacacaatggtctttcaatccttaagttaagcattcctccagaacatcctgatgagttatggatatatttattatggatcattgaagccaagaccttgcaacatgttgatgtcgaagaaatgttcaatgtgaacaataggtctccatcagtgtggatggtcatggtgtctgtggtgatggtgatggtggtggtggcaggggcaatgttttcgctgaattttgacatggtgactaaagaaaaggattag

SEQ ID NO: 71192 - DNA, 129 bp, Glycine max
  Peptide Sequence Number=SeqID_162877
atgtaccctcctcctagttctcagtataactatccccaagtagatgtacccctctgcttgtaccacaaaggatgtaccctccaatgtgttgggacaaagaattctcaggcggaattaatgaagcattag

SEQ ID NO: 71193 - DNA, 327 bp, Glycine max
  Peptide Sequence Number=SeqID_162878
atgcagagccttcagggcttgggcctgccatccatcaagagcatggatgagtttgacacacaagtggcctggccaagagcccagacttctccttctggagggggtggggcctctacagcccaagagcctgaaccagaggagcccgcatcagcaactgaggagccagcagagggggaggatgagctcactcctcctgagaccttttattatgatacagatgtacacatggctcaggaggagacttctactgatcagataccaaagccatctcatgcacctgctcctaaggagaccttgctatcttcaccagtcatggagccagagtag

SEQ ID NO: 71194 - DNA, 177 bp, Glycine max
  Peptide Sequence Number=SeqID_162879
atgacttttgggggactctatggactccaaacctatgttggtgaaaggtttgatgctttggaacaacaagtggacatgcgattcgatgcaataaactcaaggatcacaaaggttgaagaagatgtcaccattatttgtgactgccttgatttacctctaccaccaccatcagtttag

SEQ ID NO: 71195 - DNA, 399 bp, Glycine max
  Peptide Sequence Number=SeqID_162880
atggcagcacagttaatccatgatcgcgtggtgatggtgtgtctagagggagtttgggagacccttgaaggcaatgagaggtgccgattccgtggcacaattcgactcactgctacttcattagtacatctggaggaacccacacgcacgcttcagcagcctgtggagtggatactacctacacctactccatatcgactagtggagccatttcaagtgatagaggtgtcatcctctgaagaggatcctgaagaggacccagaagagttacctcctgaacctgttgtggatgcccttgactttccaaaggatgatgaggacccactccctgaggtggattctccagaggatatcatgtcagcatctgaggcagactctacagaggagagcgacccttga

SEQ ID NO: 71196 - DNA, 285 bp, Glycine max
  Peptide Sequence Number=SeqID_162881
atgtacaaagataattggacccaaccttggcccatgggctcagaaatctaccctgaggttcatgagaactctagggccttcttcagtagctttagcccaatcctcttggagcctcctgctaatggctctagtgactggtcccttcctagggaggattgcatcacgcttagtgcggctcgcgctaagcggaagagtcgtttgattatgcgctcagccccatggccctcaattctggtcgcaatgaataacgcttggcgacatagggtcacgcttagccaagggtag

SEQ ID NO: 71197 - DNA, 520 bp, Glycine max
  Peptide Sequence Number=SeqID_162882
atggtggaaccatcaaagaagcgaaaaggcacttcgagtcggagtcaacgacatttccagtcacaggaaacgccgattccttcctctattccctctggatcattgttttcatctgaggaacagctgatacggtacacaaatctattttcatctcgttccattattgatccaaaattcattgatatggatttcttttcaaatgagagttttgaatgcattcaagcatttgaaaactccaatcttattcctttcatgtctttaaaattgcatgtctattctgatttagtcaaagccttctattcaaacctagaaatccaagaaggcactttaatttctgaagtttatgggattaagatggtcattgaccaatccctattctatgatttaacccaattgccaagagaaggtgtaccatttgaaggtacactgattgatgattggaagtttgatttttctgtgcatgatgcccgccggttggtttgcaccaaccaagcggatatgaccggaaggctttttgccg

SEQ ID NO: 71198 - DNA, 435 bp, Glycine max
  Peptide Sequence Number=SeqID_162883
atggatcgtcgtcccttgcctagctttggacaaatggaaagcgccgctgcaaggaagcctagggttcgagtaagcgaacgccgacccatagaaagccttacttatttcttccccaaaaaaaagaaaagtgcaggtgcctgggcaagcaatccttgcacgagagtggttaaaaggggggagggagaagtttttctgcaccaaaaactcccccctcctcattcaaaagcaagagctcacagatttcacgagtttgcaacccttaggtcaccatttttcgcgtttttgattccgttttgcactattattcatctccaacaaggggttgtaagggatggccctaggcctatggtgcattctgaagcaatggggcatgccacattgcccccattcccttgctattcatgcctaaacatgcgcccaccaagtgctcggtga

SEQ ID NO: 71199 - DNA, 420 bp, Glycine max
  Peptide Sequence Number=SeqID_162884
atgaagcttgtcaggttcaggcgcaggtgctgctactggtggaggcacttcaatttgcttgccagacctcaagactctgaatggaggctcttgtctcttgctgaaattgcatattctggatggtcatttgcctcactaactcctcttaggaaggttgagaaggggcctcaatttcttgttgtctttgttgttgttgttgctgctactgaattggaggaggaacatatggcctgcttggaccaacaacattctggaaaggagggacagactgttgttgttgtggaggacttgcccatctcagatttggatgattcctccaacctggattgtatctgttgcttgaaagatcataattattctgctgttattgattttgctgctgagggggtctattgtaaatgtttgcagcataggctttag

SEQ ID NO: 71200 - DNA, 847 bp, Glycine max
  Peptide Sequence Number=SeqID_162885
atgaaactaaaccagttgatgcatgatcttaagagtggacatgtatttggtcccattcttgcatttgtttacaccattgagtggcaaaaaagaggattgcctcatgctcatatcttaatctttttgcatccttcaaataagtatccaaatccagaagacattgacaacataatttctgctgaaataccaaacaaggacacagatccagaattgtatcaaattgtctctaaccacatgatgcatggtccatgtggactggctaataaaagggcaccatgtatggccaatggcaagtgtttcaggtatgtgtcggctcctgaagcatgttggaagatttttgcattcccaatgcatgggcgtgcactggcagttgaacatctttatttccacctagaaaatcaacagcctgtttattggaaagatagtcaagaaattggcacagtactggctaagagtacaatcaaagaatcaatatgctggaaaccaaggaaacaaggaaatactattggcaggctgatttgggtgcccctttccagtggagagttgttctacatgaggatgatgctttcctctactaaaggatcacaatgttatgaagatattagaatagtagaaaatgttgtctatcatacattcagagaagcatgctttgcaaaaggttttctaggaagtgatcaagaatttgttggtgccttacgagaagcaaacacttggggaactccacactatcttaggaagttatttgtgaaactgctatttatgaataccatggataggcctgaatatgtgtggaaacaaacttggcaatggatggcagatgatattgtatttaatcatcaaagacaag

SEQ ID NO: 71201 - DNA, 448 bp, Glycine max
  Peptide Sequence Number=SeqID_162886
atgcccgtcgtcatgctcggcatcggcatccagaaccgtcctgacattgaaggcgaagacggcctgccagcgggcacgaagaagcttttggaagtactcaaatcccgcgagcattatttcctcacgcgcggtgaaaatgctgccggatatctccgcgatcaaggcttttcctatgttcgtccggtcggctgtccgtcgctctatttccgtccggataatatgcgcaaggcgatcagccgtctgcccgatgtgaaggtgggcgagggccgtaccgttttcaccggttatatgggggcggaacttgaaaccattggcgatatgaacgcgctgagttcggatgacggtcgttcagcctatgtggttcaagatgagctgctgcacttcgacatgcagcttgaatccgatgccaatggccgcgcctacgattccacaaccggcgaactcgtcg

SEQ ID NO: 71202 - DNA, 636 bp, Glycine max
  Peptide Sequence Number=SeqID_162887
atggccccgaggaagcttgcctcaaagagatccaggaaggataaagcggccgaaggaaccagttccgctcccgagtatgacagccaccgctttaggagcactgaacaccggcagcgcttcgaggccatcaagggatggtcatttctccgggagcgacgcgtccagctcagggatgatgagtatactgatttccgggaggagatagttcaccggcggtggacatcactggttacccccatggccaagttcgacccagacatagtcctcgaattttatgccaatgcttggcctacggaggagggcgtgcgagatatgagatcctgggtgaggggtcagtggatcccgttcgatgcggatgctatcagtcagttcctgggatatcctttagtgctggaagagggccaggagtgcgagtatggccggaggaggaaccggtctgatggttttgatgaggaggccatcgcccagttgctgtgtataccagggcaggattttgcccggactgctgcagggaggcgagtgcgaatcatgcgcaccaacatgaccaccctaacccagatatggatgacgttgctgctcagcaacatcctgccctgcgatcataattccgacctccctctgccgaagtgtcagctg

SEQ ID NO: 71203 - DNA, 396 bp, Glycine max
  Peptide Sequence Number=SeqID_162888
atgaaaaccgcaaaaggaaacaatttcagcaggagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagggggaccgctacacttgccagcgctgatgtccggcggtgcttttgccgttacgcaccaccccgtcagtag

SEQ ID NO: 71204 - DNA, 801 bp, Glycine max
  Peptide Sequence Number=SeqID_162889
atgcagcgcatccgcttccagcgccgcactgtcggtcgctttggcgacgcggttgagcgcccgcacgcggaagaaatcgacgcagatggaaatcaacagcaccgcgatcaccaccggcgcggcgacgatctcatgcggctgcccgagcaggctgctgccggcctcatagacaatccaaccggcggcgcccagcaacagcagcacctcaaacagcgccgccaggttttccaccttgccgtggccgaagtggtgatcgtcatcggcgggcttatcgctgatgcgcaccgccagccaggtgatgctggtggcgataaaatcggtgaaagagataattgccagacaacggcgatcagcagcatactgccagagaatgtcagcatgaggctagccggtgccgtcgataaaggtggcgataaacggcgccgacaccaccgccggatcgatgccgagccgtttcaacagcatcggaatgatcgacgagacaatcgcactccacacggtgatcgccaccagcgacaggctgaccaccagcgtcacctccatgccgacgcccatgatccaggcgcgcacccaggccgccaggccaatggtgacggcgatcagcagcgaggtcgtgacctctttgcggatcaccgcgccaagattgcgcaggctgacctcgcccagcgccatggcccgcaccagcgtcgaggtgatctgggtgccgctgttgccgccggtgccgatcagcagcgggataaagaacgccagcgcgatcgccgcttcgagttgctcttcaaacgccttgagcacgttgccggt

SEQ ID NO: 71205 - DNA, 1137 bp, Glycine max
  Peptide Sequence Number=SeqID_162890
atggttcagaatggtcatgtgagattctccagaagttattcgctgtgcgacagtcgcagcaaccgatttacgttcatccagcgggcaatcctgccgtgcgctgagcgtgttagctggataaaggtaaagtggccgtcgcgtctgactgagatgtttagccgtccagatgtttacaccgctataatctgcgggtactgtatgtgtctcaagcgcaatttgttcaatctcgatgtgaaggactctcatgatcgaactcaaacacctgcggacgctgcaggcgttacggcacaccggctcgctggctgccgccgccgcccagcttcatcagacgcaatcggcgttgtctcaccagttcagcgacctggaacagcggctgggcttccggctggagagattctgttgcagctggcggagcagattctgccgcagatccagcaggcgctgcaggcctgtcatgagccgcatcagaccacgttgcgcatcgctatcgaatgccacagctgcatccagtggctgacaccggccctgaacaatttccgtcagagctggccgcaggtggtgatggacttcaaatccggcgtgacctttgatccgcagccggcgctgcagcagggcgaactggacgtggtgctgacgtccgatattctgccgcgcagcggtttgttctatgcgccgatgtttgattttgaggtgcggctggtgctggcgccggatcaccgtctggcgcagctggcccatatcacgccggaagatttggccgatgaggtgctgatgatctatccggtacagcgtcagcggctggacgtgtggcgtaacttcttacagccagccggcgtcagcccggcgctgaagagcgtggataatacgctgctgctgatccagatggtgtcggccggcatgggcattgccgcgctgccgcactgggtggtggagagctttgagcaccaggggctggtggtgacgcgcacgctgggcgacggattgtggagccgtttatacgcggcgatgcgcgacggcgagcagcggcagccggtgctggaagcctttgtgcgctttgcccgtcagcacgcctgcgagcacctgccttacgtgcgcgatgcctcgcgccccggttcactgcagccggtctcgccctga

SEQ ID NO: 71206 - DNA, 276 bp, Glycine max
  Peptide Sequence Number=SeqID_162891
atggtgaaagttggaaccctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 71207 - DNA, 568 bp, Glycine max
  Peptide Sequence Number=SeqID_162892
gtgctccagtggcttctgtttctatcagctgtcctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctcagtcgtgtcgtcgctgctcgtcaggctctggcaactgtctcggatccggcgatccatgctgacatcgttgctcagattgatgacctcgtcttcgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 71208 - DNA, 246 bp, Glycine max
  Peptide Sequence Number=SeqID_162893
ccataaccccaaccaaggttcatcaacctccatttctccgagaatacgactcgaacgcaatgtgtgcttgtcatggagaagccccagggcattccattgagcattgtaggggcctgaagcgtaaggtgcaagatgtctctaatgactcatcaggattttcaactttcaccggaattgggtgcaagccattggtctatttgctcaagcgacctgtgaccattcaatcagagattactcgtcttgcac

SEQ ID NO: 71209 - DNA, 479 bp, Glycine max
  Peptide Sequence Number=SeqID_162894
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatgttcgggggagtgaaagagacactgaaagacttgctgcttacggttgggcttgttgtggtggagttaagattccgagtgcccatactaactctcaacctcccctggtggtccgggttgctgccatctcctcgagtgagaagcctccaaaagcagcatatagtcgcttgtctctcccgcatgggcaattgttgagtcgcaagcagctcttctctctctgctgtgtgaggactggtagtagtggactgaaacaagaagttaccgaactagcaacgacagaagcttccaacttgggttgtatgggtgcacgaatctcgatagtggccttgtag

SEQ ID NO: 71210 - DNA, 210 bp, Glycine max
  Peptide Sequence Number=SeqID_162895
atgatggcttctaggaaaagaaaggcaccatctacacccacacaagttagatttgacaaatcaagatttacttcccaagaggcttgggaaagatatatagacattattgtgcctaggaagcttctgcaagagaggaacgtggtggtctattatacagagttcgatgagttcaaggaggaactcaaagacgccactgggacgacgagttga

SEQ ID NO: 71211 - DNA, 609 bp, Glycine max
  Peptide Sequence Number=SeqID_162896
atgcagttggttgtggacatgaaaggacggcccaaaattatgggaatgtcattatcttcttctatatccacaactacaaaatctactaggagtgaaaggtgtttcaccttcaccaaaacatcttcaatcactccaaatggtcttgcgatggagcgattagctaactggagggtcatgcatgtaggtattatctctagctccccaagtcgccagcacatggaaagaggcattaagttgatactagctctccagtctatgagagcttttcttacagcaacctcaccaatggaacacagtatcatgacaactccaggatctttatgcttagaagcaaagcttcatggtgaatcaaaggtaattcaaaggtgttttgatgataacaatgatgatgacaaaggtgatgacaaaaagctcaaagatcaatcaaagaacaactcaagtgaatcaagaacaattcaagagttcaagaatcaagaagaattcaagactcaagaagaaagcctagaatcaagaatcaagattcaaggttcaagatctcaagaatcaagatcaagattcaagactcaagattcaagaatgaagaaaagactcaatcaagataagtattaa

SEQ ID NO: 71212 - DNA, 291 bp, Glycine max
  Peptide Sequence Number=SeqID_162897
atgcgcgctaagcacgaatacaggcacccgcgcttagagagcagtgcagacttagtgcgagtacgcagacccaagtctactccagcaactataaaaagagagtcaagccaaggagaaaagacacaccgagtcttagatcactctaatacacacccaaagtctgagaactctcccttagggaattctttcttctcttccattattttctattcccttttttcatcccttctcttccatcagtttctaaaccccttttcaagtataagaccccttataattatgagaggctaa

SEQ ID NO: 71213 - DNA, 306 bp, Glycine max
  Peptide Sequence Number=SeqID_162898
atgccggagatcaagctgaccggcagcaagggcgtactgaagtttggcacttcagccgtaaccgagccgttttccttcatggatgcctcccatacggtcgtcggccttgatattgaaatcgcccgttatgttgcccgcaaactcgatatgacccttgaagtcgtcaacatggactttggcgccatgatcccggcgttaacggccggcaaggtggacatgatcggggcctgcatcaccattaccgacgaacgcgcaaaaaaggtgctgttctcagaaccgtactacgtcaagggcgaattcgtttaa

SEQ ID NO: 71214 - DNA, 270 bp, Glycine max
  Peptide Sequence Number=SeqID_162899
atggctaagcgcatgaacaattctggaagaaggatgagctgtatagaggcactgagcgaaagccaactcgctaagcgcatcatcttcaccttctggctgaacgagtgtgactgctgtggagagactaagagagagctgagcttgaagaggaagccatcttgcggagctttagatgagattttgagagattgtgaggtttctagaggtggaggagacatccccgctacttgtatttcttctatctttcatcttttcttctcattgttgtaa

SEQ ID NO: 71215 - DNA, 552 bp, Glycine max
  Peptide Sequence Number=SeqID_162900
atgccaccgaatagcggtggcctggcgggtttgggatggcggcgccatggcggccgccatagccatggcggtcgtggcggttatggcggggtggcggaaaatggcgtccctcccgcaccccacacgcccacccagccgcgacagccgcatgcgcacgcagccgcgacgacctccggcagcgacgcaccggcacaaacggcggcgacaagctccggcagcgacgcacctgtcacgaacggcggcctgcagcgagaagttctcgcggagaagacgaagctgtcgcgaagaagaagaaggcgtagtttatataataaaaagagagctggactacccatcagcttaagcaaattcaaagcaagttccgatcttcttaaaaccaagatttggaaacttcagaagaacagtggaaacccaaaattattcaaacttgaaaaagagcaaatagtggcagaaatgcacaaccagcaaagcacagaagtcaccaagaaacatgcggaaaagtacagtgatagagaggcaaccgaaaagttttcgccagaaaatgagcagtaa

SEQ ID NO: 71216 - DNA, 90 bp, Glycine max
  Peptide Sequence Number=SeqID_162901
atgccaacagagttattggtgcacccaataatcaatcaaactcttctaggcatccatgatataatctcgtgcatttttcttaccaattag

SEQ ID NO: 71217 - DNA, 1050 bp, Glycine max
  Peptide Sequence Number=SeqID_162902
atggagcattgtaactgctacatgttcacgctgagccttcttcttcttcttcttcttactccgccttctctctccgacgatctcggattcgattttccggcgaagaagctgataagagaccttaacctttttccttctgaagatgtcaacatcgttcctcgccactccaattctcacgccaacaaaatcgtcgagaaaccgcttaggttcccaaacttagtgccttcagactccggcatttccctcgacgacttggctcaccgcgctggctattatcttattcctcattctcatgctgccaagatgttctactttttctttgaatcaaggaacagcaagaaggatcctgttgtgatttggttgactgggggaccaggttgcagcagtgaattggctgtgttttatgagaatggccctttcaagattgctaacaacatgtccctagtgtggaatgaatatggctgggacaaggtttctaaccttctgtatgttgaccaaccaactggaactggctttagttacagtactgataagcgtgacattcgtcatgatgaagaaggtgtgagcaatgacctctatgactttctacaggccttctttgctgaacatcctgagtatgtaaagaatgacttttttattacgggtgaatcatatgctggacattatattccagcttttgcagctcgtgtccataggggaaacaaagctaaagaaggaattcatataaacctaaagggatttgccattggtaatgggcttactgatcctgggatccagtataaagcttatacagattatgcactggacatgggcataattcagaaggctgactatgaacgcatcaacaaagtgatggttccagcctgcgaaatggcaataaaactatgtggcactgatggaaaaatcgcatgcacggcatcatattttgtttgtaatacaatattcaattccatcatgtcacatgctggtgatatcaatgtgggtaacacaattgcttcctcttctttgatttacatgttagtactaaatgttgctgacttgtcagagtaa

SEQ ID NO: 71218 - DNA, 651 bp, Glycine max
  Peptide Sequence Number=SeqID_162903
atgttatctgctattgcctttggattctcagcgaattggtggttgcgctgtcacgggcgaacgcctcctcctttatcttttccggtttcagtgtcttattcttcctctttcaactccaactcaactaagttcaactatattcatagagcatcctctgaaggacttcctaatgagttggttgaagactcaaaatttgttcctttgaatgaggaggatcctatatatggtccacctgccttattgttgttgggctttgaagcagatgaagctttgaagattcgacagcttttgaaagagttggatggtgaattcctaaaggtcatctattgtactgaagacatgattatgcgttcgctttgggaggcaatgcatacaacacaacccaatgtagaagatgtcaagatagccaagtcacttcctcggatatgcttcttatctggtttaagtggagaggagatgatgatgttcatagattctttccccgaaactggactaaaaccagctgcatttgcggcacttgttccgaacagtgctaataaaccactggaggagttgatagatgaaataatgggagaccatgagatgttgaaaaagatcttttatgactgcagactggagaacagctatgaagagattggaaaagagatctga

SEQ ID NO: 71219 - DNA, 5364 bp, Glycine max
  Peptide Sequence Number=SeqID_162904
atgaaagtaaacaaacttattacagatgtgaatattgctgttgcagttgaagctgtccaggctattggcaatcttgctcgtggattaagaactcatttttctgcaagttctcgttttttattgcctgttttacttgaaaaattgaaggagaaaaaacctgctttggctgaggcattgatgcagactcttcaagcaatgcataaagctggatgcatcagccttatagatattgttgaaggcaggctacaggttaaaggatttaatcactggatttacagaatcttagaatctacagcatacttttttctaatagtcccacattaccatgggcttgccctttttggtgtttttcctgatgttaagacagccacaaaaaacaaagtccctcttgtgcgatcgttaaccttgacctgggtgactttttgtattgaaacaagtaacaaggttgttattacaaaggtgcacaaggattatgtgccaatctgtatggagtgcctaaatgacggtactcccgaagtcagggatgctgccttttcagcattggcaggaatagctaagtcagttggcatgagacctctggagagatcgttggagaaacttgatgatgttagaagaaagaagctttcggaaatgatttcaggttctgaagatgctgtgcctggtgcttcttctgcagcttctgtgcaaaatacacgcgtaagtgcatcttctgcagagacctctgaaagtgtacttgtcaaaaggtcggcagcaggcatgcttagtggaaagagacctgttcagtcagttcctgctgttaagaaagtgggggttgtaaagttggggacaaacaaaaaaacagatggagttccacaggtgaaggctttaaaatcagttgaaccacctgaggatgttgagcctactgagatgagtcttgaagagattgaaagccgaataggttctcttatagagtcggatactatcactctattaaaaagtgctgtgtggaaggagcgtctagaagccatttcttcactgaaacagcaagtagaaggcttacaggaccttgaccaatcagtagaaattttgattcgtttagtctgcactttacctggatggggcgagaaaaatgttcaggttcagcagcaggttattgaagttatcactcatataagttcaactgcaactaaatttccaaagaagtgtgtagtactttgcctttcgggactaagtgaacgtgtagcagatattaagacacgtgcacatgctatgaaatgtctgagtaccttgtctgaagcagttggtccaggattcatttttgaaagactttacaagatcatgaaggagcataagaatcccaaggttcttagtgagggaattttgtggatggtttctgctgttgaagattttggtgtctcacatataaagcttaaggatttaattgattttcttaaagaaattgggctgcagtcaagtaatgctgcgactagaaatgcatcaattaagttcttgggtgttctgcatagatttgttggtccaggctctaaggtttttctccttgcagacattaaagggtttcttactgatgtaaagcctgcactgctcagtgccctggatacagagtatgagaagaatccatttgagggagcttctgcagttaccaagagaactgtcagggcaaaagactcatcttcaactgttgttgctggtggactggatagcttgcctcgggaagacatcagtggaaagatctcaccaactctcctgaagagcttggaaagccctgattggaaggttcgtatggagtctgttgatgctgtaaacaaaatattggaagaggctaataagcgcattcaagcaactggaactggtgagttgtttggggctcttaggggacgactccttgatagcaacaaaaacattgtcatggcttccttgacagcaattggcaatgttgcatcagcaatgggtcaagctgtagagaaggcaagcaagggtattctgtctgatatattgaaatgtcttggtgacaacaagaagcacatgagagaatgtgtactgaataccttagatgcttggctggctgctgtccatctggataaaatggttccgtatattgcaattgctttgatggactctaaacttggtgcggaagggcgtaaagatctttttgattggttatcgaggcaactttctgggttaagtagttttgctgaagctgcacaactgctgaagcctgcctcttctgcaatgacagataaatcttccgatgttcgcaaggcatcagaggcttgtattaatgagatactgagagttagtggacatgaaatgatcgaaaagatggttaaagacattcatggaccagcactgacactaattgttgagaagttgaaaccatatggagcttttcaaggcacgttctttggttcattcttctttgcgaatgttggtgaatttgtgtggatatcttctcttaactcctcctttttttggtctttagagtcatttgagtcaggtagagcagtttcagtgggtgcaatatcaaaagcaaaggctgggaaatcaactgccaatggtgtttcaaaacatggaaatagagctgtatcttctagagttgtggcaacaaaaggtgccaagtctgaatcaatatctgttcaagatatagcggtccagtctcaagccttgttaaatatcaaggattcaaacaaggaagatcgagagagaatggtggttcgaaggtttaagtttgaggacccacgtattgagcaaattcaagatcttgagaatgatatgatgaagtatttcagagaagatttacataggagactcttaagtgcagattttaagaagcaagttgatggacttgaaatgctgcagaaggcactcccatccattgctaaggaagttatagaagttttggacattcttctgaggtggtttgtgttgcagttctgcaaatcaaacacaacatgtctattgaagttttcttcttttcctttccttccttgtcatggagatgtgctggaatttcttccggaactgcttgacactttgaaggacgaggggtactctttgaccgaatctgaaggggcagtgtttcttccatgcttagtagagaagttagggcataacattgagaaagtacgagaaaaaatgcgggagctgacaaaacaatttgttgccatatactctgcgtgtaaatgtttcccttatatattagagggtttgcgctcaaagaataaccgaactcgaattgaatgtgctgatcttgttggatttattattgatcatcatggtgcagagattagtgggcagctaaagtcattgcaaattgttgcaagtttgactgcagaacgggatggtgaaactaggaaagctgcattaaatacactagctactggttataagattctaggtgaggacatatggagatatgttgggaagctaactgatgctcaaaagagcatgttagatgatagatttaagtggaaggttcgggagatggaaaagaagaaggaaggaaagcctggtgaagcaagggccatttcaaggcgctcagtcagggaaaatgggtctgatgtcgcagaacaaagtggagaaatgactagatctcttgctggtccaatattgaggaaaaattatggtcaacctgatagtaacattgatagacagttgatgccccgtcccatgactgttgctagtggccccacagattggaatgaagcactcgatattatttcttttggttctcctgagcagtctgttgatggaatgaaagttatttgtcatgagttagctcaggccactagtgatcctgaaggaagtgctatggatgaacttgtgaaagatgcagataggctagtttcatgccttgctaataaggtcgcaagaacttttgacttcagtttgactggtggtgcctcatcacgatcttgtaaatatgtgctgaacactctcatgcagacttttcagaataaaagattagcgcatgctgtaaaggagagcacacttgacagtctcattactgagcttcttctgtggctcttggatgatagggttcctcatatggatgatggaagccaattgttgaaagctttaaatgtattgatgcttaagattctggataatgcagataggacttcatcctttgttgtcttgatcaatcttttacggccactagattcatccaggtggccttcaccagcatcaaatgagtcccttgcttccagaaatcagaagttctctgatctagttgtgaaatgccttatcaagcttacaaaggttcttcagagcactatctatgatgttgaccttgatcgcatacttcaaagcatccatttgtacctgcaagacttgggaatggaggaaattaggagaagggctggtgctgatgacaaacctttacgaatggtaaaaactgttctgcatgaacttgtcaagcttcgtggtgcagcaataaagggtcatctttcaatggttcctatcgatgctaaacctcaacccatcatccttgcctacattgaacttaatcttgagactttggctgctgcaagaatgttgactgcatctggacctgggggacaaaaccattggggtgattcagcaaccaataattcagcctcgggcacccattcggctgatgcccaattaaagcaagagcttgctgctatatttaagaagattggagagaagcaaacttgcacaattggtctatatgaactatatcggattacccaattgtacccaaaggttgacatatttgctcagcttcaaaatgctagtgaggcatttcgcacctacattagagatggtcttgctcagatggagaagaatgctgcagctggaagaactccttcgagtttaccgatgccaacccctccaccggcatctttaaatatatcttcccctgattttgcacctctctcacctgtaaacgcaaatccattgggtgatgctaaattaaatgtgaaacctgagccaacaaattttaatttacccccttcatcatacaatgaggagaatagggctgtgaatgccattacttctagagcattaaattctgactatacattaggtgaccaaagaaatgatagatttatgacaggagtaaccagtggaacattggatgccatcagagagaggatgaagagcatgcaattagcagctgctgctgggagtacagaatctggtggtaggcacttaacaagtgcaaatgacaacttcaatcaaggacttcctcctcctagtcagattcctcatgcatcagagcatgttggtactgagaatacaatgcacggtggcgtacttcctatggatgagaaagcattgtccgggcttcaagcgcggatggaaagattgaaaagtggatctcttgaacctctgtaa

SEQ ID NO: 71220 - DNA, 2097 bp, Glycine max
  Peptide Sequence Number=SeqID_162905
atgggtgggagcgagagctcgaagggtgtggttatgagtcgtttggttgagtgcatcaaggagatttctgggttgccagagagtcagaacttgtgcaagaaggtgtatgggaatttggttcgcagggtgaagcttttgagtcctctctttgaggaattgaaggataatagtgatgagtccctcagcgatgaacaacttcaaagctttgactctctctttgttgctttgggttcagctaagacccttttaaaggatgtgaaccaagggagtaagctttatcaggctttgcggaggaatgatacagcagataagttccaaaaagtaactgaaaaaattgaagctgtgctcagtgaaattccttacaataaacttgacatatcggatgaagttcgagaacagattgaactggtgcatgctcaattcaaaagagccaaagctcaaacagaatttgctgatatacaactagacctggatatggcagtggcacaaaaagaaaaggaccctggtcctgctgtactgaagagactttctgaaaagttgcatctaaggacaataaatgacctaaggaaagagtctagtgaattgcatgaattgttcatcacaagtggtggagaactcggcgattcttttgaaatgatcacatcccttctcagcaaactgagggaatgtgtgctcacagaaaatcctgaagttgattccagtgaatgtgaaaaattgtcagttaagcacaggtctcccatgatcccagatgattttcgatgtcctatatctcttgaactaatgaaagatcctgtaattgtctccactggtcagacatatgaaagatcttgcattcaaaaatggcttgatgctggtcacaaaacctgccccaagacacagcagacacttgtgcatacagcccttacccctaactatgttttgaagagtttgattgctttgtggtgtgaaagcaacggtattgagctaccaaagaaacaagggaactgtagaacaaagaaatgtggtggcagcagtctttcagattgtgatcgaactgctattagtgctttattggataaactaacgagtaacgatatagaacagcaaagggcagctgctggtgagctccggttgctggctaaaaggaatgcagacaaccgagtatgcattgctgaggcaggagcaataccacctcttgtagatctgttgtcttcttcagaccctcgaactcaggagcatgctgttacagcgcttctcaatctttccatcaacgagagtaacaaaggaactatagtaaatgctggagccataccggatattgtagatgtactgaaaaatggcagcatggaggctagagaaaatgcagctgcaactctctttagtttatcggttctagacgagaacaaggtgcaaataggtgcagctggagctatccctgctctaataaagttactttgtgaaggtactcctagaggtaagaaggatgctgctactgctatcttcaacctatctatttatcagggaaataaagcaagagctgtaaaagctggtatagtagccccactgatacaatttctgacggatgctgggggtggaatggtagatgaagcactagctattatggcaatccttgcaagccaccatgaaggcagggtagcgatcggtcaggccgagccaattcatattcttgttgaggttatacgaaccggctctccacgcaatcgagagaatgctgctgctgtcttgtggtcactatgcaccggagatccactgcaattaaaactagcgaaagaacatggtgcagaagcagcactgcaggagttgtcagaaaatggaactgatagagctaagagaaaagctggaagcatattggaactcttgcagcgaatggaaggggaacatagccatctttactctcttcaccatttctttaacaacaagctgtttggacttctcctagcttgtcacttaccgatggataaggatgtccttgttcctgttgatgtccttgtctatagatatcaattcctgcccttgtgttacaatgaaggtccatgcatgcctcaaatgggaattcaagccgtagcagtactagcactccaccacaacacaacctag

SEQ ID NO: 71221 - DNA, 1329 bp, Glycine max
  Peptide Sequence Number=SeqID_162906
atgggtgcaacgacggccattgccgcactctctcttcactgcttctccaaatcccacacacacttttcaccctttcgcactctccctcgcctcacatgctccttctcttcctccatcaaattcaacatctccttcgctccccctaagcccaagcccaagcccgaacccgacgcctcaaacgagcccgacgggccgctcctcatcccgtggatcgtccggggcgaggacggcaacctcaggctccaatcagaacctcccccgagcctcctcaatgccatcgccaccgcccaaaccggaaccaaaaaggacaataagcaaaccaaaaccaccgccgccaccgccaccaacaccactaaacctcaaaaggctcgctccacagcgccgccgcagcattcgaaggcggcgcggcggttctataaccaaaacatcaaggaatcctccgccgcgcgcctcagcaaggttctcgccgcctccggagttgcgtccaggagaagctgcgaagagcttatcttcgaagggaaggttacggtgaatggtaccgtgtgtaatacgcctcagactaaagttgatcctgcgaaggatgttatctatgtgaacgggaacaggcttccgaagaggcagcctcagaaggtttatctggcattgaacaaacccaaagggtatatatgttcatctggggagaacgagtctaaatctgtgataagtttatttgatgattacttgaacagttggggtaaaaagcatccgggagtacccacaccacggttatttactgtagggcgccttgacgttgctaccactgggttaattattgtgactaatgatggagattttgctcaaaagctttcgcatccttcatcaaatttatcaaaagaatacattgcaacaattgatggtttagttcacaagaggcacttaatagccataagcgagggaactactgttgagggtgtcctttgtgtgcctgatgttgtggagttacttccacgtcagccagagatgcaaagaactcgaattcgcattgtgttcaactcttgggtcaaggaagacagagtcttgcattgtaggcctggggacaacttcactcagcacttctccttggctgcttcgagggcttctaatagaaagtggaagatttggtggataacagcaacaatatctatttggaactttagaaatgatatgatctttaaaaatcaaccgttcgttatctctaagttggtggataatgcaatctttcttacctggtcttggttgagggggtgggaaaaggactttgctgttccttttcagcaatggtcctcatctatgtctcttgccttcacctag

SEQ ID NO: 71222 - DNA, 513 bp, Glycine max
  Peptide Sequence Number=SeqID_162907
atgtgcgcggtgaaactgcgccgagcacacactgaatctcaatttcgagcttatttctcgttgtccattactgcatcgatattaactgaaacaccaaaaacacgattcaactactacgatcagaagaagcagatcctgattcccggtcacgcgcacactacagttgagctctttagcaattcactcgcacgaaacagtcacgcggtgcaacatcacagaagcattcgaaattcagagtggaaaactatggggggaaaaaaagcgctggtaacaattcggaatacgcattcagaattggaagatctcgagaaaattgagctcgaaattgagattattcagtgtgtgcgcggtgaatcgaacgtttcgcgaatccaacctggagctggaggtgtgggaagaacgaatcgaaaacgacgaatccaaagcgttgagaacgacgcacagcatacaaggtggagacagcgcgtgagaaacagtcgaacagaaacacacgcttcacggcttcaggaatga

SEQ ID NO: 71223 - DNA, 303 bp, Glycine max
  Peptide Sequence Number=SeqID_162908
atggcttcccaatttgagagtgttgaaacaactcctattactaatgtgcctcttaatgatactactcaacccacaccagaagctaatggacatgacaaagacaactccaaagttgatgaagaagaagaaaaatgtgtcatcacctataaagaaatagagccacattataactatgctcctttacctgaagattgggataaagttcacaaagtgaaacgagtacttgatgctgcagctgaggatgaagatctctttatgagagaaatgacaattcctataagagctaagttcgataaatattag

SEQ ID NO: 71224 - DNA, 1617 bp, Glycine max
  Peptide Sequence Number=SeqID_162909
atggatccttttgatgatgttcttccagtggctcctgctgcacgtagtaagtgcttcactctttttgaagctcggccgggtgccaagtttattccaaaggccaaatcaaaacagctttctccaaaggaaataccagtttttcaccctgctaatgctatgcattctgaggatgcagttcataatggaactataggtaaatcatccggagaggctgcagacattttttctgccactgatacaggaaaaccagcccttcattctttaaatgagaagggtgctgagcaaaattttgttacacctgcttctagttctattaactcttttgggaatgtgatattacccaagttcaaaggtgtcccaacttttcatgtcatttactatgcttgtcaagattctaataagagaaaaaaggatggctcaacgtcgtgttctctaaggaagaacagaagatcttctattgctggtgagggtgaggaggataaaggtggtaaaacctcaaggcagctgagaaaacaagcagctcgtaaacctgcaaacagttcattcaatgaggatgttgaagataataatgaccttgaccctccttataattctaatggagatgaacttcaagaaaatgacgagactatgaagctgattatccatccaagaaaaaaagagtatcaacaagttcacagaagaaatttgtggctaaaagtggaaaaacatcttgaaagctttttctttttcatagtggacaaagctctgctggaaattcctgaggatgaacttgatcttcgacaaatacctattaaggatattattttacttgaagaacatagggagtggctggcgaaaaatgaggtgatgacttcgaatacgtcttccaccaatcaaagtggtggagattctcttcacaaggccactgcatattatctactggctgttgttactgtctcttttgagtcacatgtggactatggtggagtttctctttatgaggctggtgcttataatgaaggggagttctcaggttcagaagatgcatatgatgatcaagccaatgaagggattatatcaacttcccatttattcaatcaccagtgtttaatgaaaaaggcacctggggcaatatggtcagaacaagacactcaacagttttatgaggctgttagaatgacgggcacaattttttctctgtttgaaccgcttttccctggtaaaacaccccatcaaattaagttgaagttcaacaacgaagatggaaagtattgttcacgggtagatgatgctgtatatcactttgctaaagatcactctcgtgatttgtggattgagccagtgaaaccagtttccaccaaggcagaagaagaccccggtggagatgcctcagatttcgtgatggcagaggaggttgtggacctaacagctggaactcatatcaatgctgatatctttggcttcaaagctcagatggccaagttacttaagtatgttgctccaagggaggttgcaacaactaaggaggatgccgatgttaaagcacaggaagattctgtggcagttcatagtccagagcaacctgatgacagtgacgatgactttcaaaaatggtctcagtatgaaagtgcactttag

SEQ ID NO: 71225 - DNA, 630 bp, Glycine max
  Peptide Sequence Number=SeqID_162910
atgacaaaccacgacaagtgtcctaccacctgtacacgaaagcacacgtgcatgaccttgctgattgacacgtgtcttcaaggcaccttgaagagtctctatatatatggcttcacaatgccaccgtcaacaagcaacgaagcacgacgtgagagagattgtgaagtagaaatcggtgcaagaaattctccactttatctaaaaaaattcggttttggtggaaatggtgcaaccatgtttttcttaaccttctccatactagcagctgttctgggcatcgtgtccaaacttttgggtgggaatcacatgaggacatggaggagtgacagtttagcatctgcaggagccacatcaatggttgcttgggcagtcacagctctagcatttgggttggcttgcaagcaaatacacttaggagggcatagagggtggaggctgagggtagtggaggcattcataataatactaacattcacacagttgttgtacctgatactgatccacgcggggctatatagcagcagatatggtcccgggtaccatgacactgactatggtcatggacatggtgtgggagggactacaggagatccaatgcacaagcctgctactgcaggaactcgtgtctaa

SEQ ID NO: 71226 - DNA, 441 bp, Glycine max
  Peptide Sequence Number=SeqID_162911
atgtggcagccaagctctgcacttcttcttgtcgcgtcacttctcactgctctcccagtcaacgctgatgggctgtacactaaaaaatcgcctgtgctgcaggtggatcacaagtcttatgatcggctcattgccaagtccaatcacgcatcggtaagattttacgctccctggtgtggccactgccaaaatttgaaacctgcctacgagaaagcagccaagaacttggacggtttggccaacgttgccgctgtcaactgtgacgatgacgaaaacaaacctctgtgtggccggttgggtatacagggcttcccgaccctcaagatagtgacaccttccaagaaacctggcgcaccaagggtggaagattaccagggccagaggaccgccaaagctatagtcgatgcagtggtggaccgcatcccaaaccatgtgaagagg

SEQ ID NO: 71227 - DNA, 267 bp, Glycine max
  Peptide Sequence Number=SeqID_162912
atggcctgggaaattattgatttaagtgaaaaaccggtaactattgtttatgaaaatccaagaggcttacctgaagaactgttggcagaagatggaacaaattttagcggagacaagagtccgttaaaattttcggatatctctccggagatcattaacatggttgattatgcagtggaagaagacagggaaaaggtttccaagtattccggatcttcagttatcaaaatctggagtgataatagaatcaaggtacttcgggagtag

SEQ ID NO: 71228 - DNA, 477 bp, Glycine max
  Peptide Sequence Number=SeqID_162913
atgttcgatcggcgtcatccggaaaagattagcccacctcggaaaaaaaaatgtgattcaccggcactgatcgaaaacaatgcaaaccgacgtcggccaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71229 - DNA, 397 bp, Glycine max
  Peptide Sequence Number=SeqID_162914
cggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggttgttgttgtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactgtcttactatgttggcactgatgagg

SEQ ID NO: 71230 - DNA, 456 bp, Glycine max
  Peptide Sequence Number=SeqID_162915
atggggaatcagcagaggcaagggtatactcaaggaagattttcaggcttccagcaaggtccttataatcagcaaggacagtgggggacacaccctgacaaccagttcaataaagaccaaggtggatcctcaaacaccctgacacaccctaacatatttcagaggaggactaagttggaagagaccttgactcagtttatgcaggtaacgatgtcaaatcataagattactgagttagcactaaagaactttgaggtccaggtgggacaactggccaagcagatagctgacaagtcatccaacagttttggagcaaatacggaaaataatcctaagaaggaatgcaaggctgtgatgactaggagtaaaaagtttgtgaaagctgaggatgaagagagtgtggtgtataaggagcaaatgggtgaacagataggtgctgatgttgaggaccatgat

SEQ ID NO: 71231 - DNA, 618 bp, Glycine max
  Peptide Sequence Number=SeqID_162916
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccattcctcatggagaattactcagttatgtacaccgtggctacggatctatttttgaaaagaccttgctgcttagcattgagcagggaaatctggctcagacaccgcaacggcattggctaccccacacaatttcaaaccgctctcattaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 71232 - DNA, 260 bp, Glycine max
  Peptide Sequence Number=SeqID_162917
gtgcacccctttgccccggccgaccagcagcagggctatgcggaactggacaagcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 71233 - DNA, 1943 bp, Glycine max
  Peptide Sequence Number=SeqID_162918
ctgcgcgaggtgtttcccgccacgctggaactgtgcgtgctggcgtttatgctggcgctgctggtcgggataaagccatcagcgcgctgggcgctgctcggcttctcaatgccggtgttctggctggcgctgctgtttaccctgctgttttcgctgacgctgggctggctgccggtttccggccgattcgacctgctctatccggtgcagaacattactgcgcgctgacgcacctgattctgccggtgatcgtgctggctgtggcaccgaccaccgaagtgattcgcctgctgcgcaacagcaccagcgacgtgatggataaaaattacgtcaaggcagcggcaacgcgcggcttgtcgcgcttcaccgtgattcgccgtcacgtgttgcacaacgcactgccgccggtgatcccgcgtcttggcctgcaattctccaccatgctgacgctggcgatgatcaccgaagtggtgttcaactggcctggactggggcgctggctgattaacgccatccgtcagcaggattacgcggcgatctccgcaggcgtgatggtggttggcgggctggtgattctggtcagcgtactgtcggatattatcggtgcggcgctcaatccgctgaaacacaaggagtggtcgcaggctggagtagaactttcaaatcataggcttcagattatggatgaagcggatttgcgagatttcgaatgttatgtttcagtgcgtggtgaccacacaaagcagttggagaatggaatcatggcacgtaacatcgcccccggatattgtgtagtagaacgcgccggatctctggattatcaggcaagggagatcttcagggacattcgcagcccagccgtaaacatgtttatgcaactaaatgccgatacgccctggttaaggccgggacaaatactgattgtagctgacccggatacacccgctcctctaactatgcaggcactcacaacattaaaacaggcaaaatcacgcactaataacgcattaatcggcgttaatgtcgaagaagccggttttatgcaaaagcactacggcatgattgcggcgctaaccagtgccgtagataaaattttcggaaccgccggagatgccggtgaaaaatatttcaatgccattgagcagacgctaaagaaaattgaggcaagttatcagaatcagtttcgcacccagggaacgctgattgggcagcagttttttgtcgagcgaaatcagttgctgaatcagttaaaggaattagtaaataagcccttactcaaaaatctggcccgatactccataaaattccagcagtacgagagtatgaaacgtgcgctgaacttgtccagtcgttcgatagttcacgagtggtcgacggtgggtataggcgctataccaggatattcttattatgtaggcaatgcagctaaagccgccagattcatgaaaatgggaggttttattggcattggattttcttttgctgggaccacgaatgatgtggtggatgcttgcagtaaaggccgggaaggtgaatgtgggaaaattgcggttaaagactattcaaaatttgcgtttacaacaggtgggggcatgctgggtggcgtatggggtagttctgccgcattagctggttgtgctgctataggaattgtaacagcgggtgctggaggggttgcatgcgcagttgttggttcagtcgccggtggggaatgtgggaaaattgctgtaagggactactcaaaatttatagttggcagtgccggaggagtagttggaggggcatatggcggtgctgcaatggccggtgtttgtgctgctgtaggtattgctaccgtgggtgtatgtggggtggcatgtgctgttgtaggatctgtagcaggtggttaccttggcagcactggtgcagaagcgatcgtcaataaagtaacagagctactatga

SEQ ID NO: 71234 - DNA, 648 bp, Glycine max
  Peptide Sequence Number=SeqID_162919
atggccgcagggcgacaccatgacgcccaggccaacctgcgcactctgaatcagctgcattaccgaggcgctttccacaatcacccgcggcagcacgccggtttcacgcagctgtccgtcgaggtaacgccggaaatagcgcgtgggctcggccaggcacagcggctgattcgccagcgtgtgcagcgacagccgctcatgctgcagcagcgccgggaaatgatcgggatggaaaatcgcttcgacgccgcgatcctcaaaaaagccgataccgccgtccacggtgtggctgttgagcgcttccagcagttgatcggcgctcatggcggaaacgcgatacgccacgctgcactgcggcatcacgcccagccgcagcgtgccgttgacgccgtgtttgagcgactccacttccagcttcagtccctgatacaccgaaacaatttcgcgcgcccacgtcagcacgcgttccccttccggcgtgaagccgtcgaagttgttgctgcgattgatcagcgacagccccagctcgcgctcaaggtttttaagccgcatcgagagcgtgggctggctgacgaagctggcctccgccgcgcggccaaaatggcgttcgcgctccagattgcaaaggcggattgctcaggcggatag

SEQ ID NO: 71235 - DNA, 93 bp, Glycine max
  Peptide Sequence Number=SeqID_162920
atggtttacccaggattggaagactttggagatcccaatgagtctttggagaaatcaagcttatcgataccgtcgacctcgagggggggcccg

SEQ ID NO: 71236 - DNA, 239 bp, Glycine max
  Peptide Sequence Number=SeqID_162921
atggcagaaccatcaaagaagcgcaagggttcttcgagtagaagccaacgacactccgaggctcaagatactccaattcctttctccatttcctcctcctcattgttctcatcagaagaacaacgtacacgtgacggtgtaccatttgaaggtgcactggatgatgattggaagtttgatttttctgtgcatgatgctcgccagttggtttgcaccaaccaagcggatatgatcggaag

SEQ ID NO: 71237 - DNA, 539 bp, Glycine max
  Peptide Sequence Number=SeqID_162922
atgatggaaatcgctcctgaactgcggaaagtccaggagaagtacaagggcaagcgcgaccagctcagccgtgaggccatgagtcgcgagaccatggcgctgtacaagaagcacggcacgacgccgatgtcgagctgtctcccgctcctcgtgcagatgccggtcttcttctcgctcttcagcgtgctcagcgatgtcaccaagcaccacgcggccggtatcggcggtgtgggcctgctcaacgccgagctcaccgagcagttctacgacgccaagcttttcggtgtcgcctcgctgcatgagacgctcggcaacgcgatcgacgccggtaacaccacggcgatcatcatcctggtcacgctcgtcgtgctcatgatcggttcgcagttcttcacccagctgcagatcatctcgaagaacctgtcgcccgaggccaagacgggccaggcgtaccagatgcagaagatcatgctctacgtgctgccgctgggcttcatcttctcgggtatcttcttcccgctcggcgtcgtcgtgtactg

SEQ ID NO: 71238 - DNA, 240 bp, Glycine max
  Peptide Sequence Number=SeqID_162923
atggaagcagtccatatgaggcttagattgagtctctcatcttcttccgacactcagagtgagagtcagcaacacaacaactcgtccgtatcatcctactactacttactaccgcaaaacaaaaaccctatttttatccgtaaagtagtcgcggtggagactatgaagccttcttggtcgatgcggtgtggggctctaaccacagtatgggtgttttctcaaggtggaagagagttgtag

SEQ ID NO: 71239 - DNA, 552 bp, Glycine max
  Peptide Sequence Number=SeqID_162924
atgcacttagcggataggaggaacccggaaaggaatctgtcacgcaagcacgcgctcagcacgtcatcagctcgctcaacaagtcatttgtcaccttccagtcttagcgcgagtttggcgctgagtgaaaattcacttactcgcgctaagcacgagaatgacgctaagcatgacgtcgaggagcttccttgctatggaaggctaaatcctcagttggggattcttgctgagggctttagcattgaaagatgtattgtctccttagaacttgatagagcaggattaggttaccgtatgtctggacacggagtgtgtgtttgcatgcgtagatcttctccaggtgaattggttccattggatttagaaattgtagcaaccttcagaagaaacaacacagagagaaaaataaagcttttgcacgacaaaacagtagcatcaatccttgaagaggctcacttttttgagtcatcatcttctaattcacctacatcctgggaatctcaaacaacagaatttgaagtcgaagtcatggctgaagagcaacctcgatga

SEQ ID NO: 71240 - DNA, 508 bp, Glycine max
  Peptide Sequence Number=SeqID_162925
atggctccgcacaacctgggctataccctgatgggcgcggccatgctgtgggtcggctggttcggcttcaacgcaggctctgccgcggctgccaacggcaccgccggcatggccatgctggtgacccagatcgccaccgccgccgcggccctgggctggatgttcgccgagtggatcggtcacggtaaaccgagcgccctgggcattgcttcgggtgtggtcgccggcctggtcgccatcaccccggctgccggtaccgtaggccccatgggtgccctggtgatcggcctggtctcgggtgtggtctgctacttctgcgccaccagcctcaagcgcaagctgggctatgacgactcgctggacgccttcggcgtgcacggcatcggcggtatcgtcggcgccatcctcaccggtgtgttcgcagctccggcgctgggcggcttcggtgccgtcaccgacatcgggcatgcaggtctggatccaggccaagggcgtgatcttcaccgtg

SEQ ID NO: 71241 - DNA, 415 bp, Glycine max
  Peptide Sequence Number=SeqID_162926
atgagatataactctcgtctgaaggtccgctgctcaggggagaaaactggctgtcaacgctgcgctaatcttggctcggaatgtatcttctcgatctcgagaattgggaaggtgccggggaaacgaagcaaggccaaccgtgccgcagcagcagctgccgccgctgccgccgttacggctcccccatcatccatatcgctcacgtcgccctcacgcctggagtccgcaaatgggacaatcacagcttttcagccgttttcaaacgccatcaaggatgaaggcggctcaggggtgactccttcagcgcgccatgttccgtcgaacttcgctgtagatcccatgatcaccccgttgatggtgcacgattattcgagcagcataccattctactcaggggccagctatgcaccggatg

SEQ ID NO: 71242 - DNA, 807 bp, Glycine max
  Peptide Sequence Number=SeqID_162927
ttgtcgcccggcgagatcgccagcctgctcgagcgcactgcacaggtgcactggaactatgacgggcgctattacttcatcagcaacaactgcgcggtggaaaccgccaagctgctacaggcgggcgtgccgcggctgggcgaggccgggctggcccagctgagcccgcgcggactgaagcggcgactggtgcggctggacgtactcgacgagggggtgctgacggaccgcaatgcagcgcaggcgcagggctactactttgcttcggcgcgcgatcactatcagcagttgttcgccgtggcgagctcacagctggggctgccggtgcgcgatgtgcgcggctggttgacgttgcccgcaccgcagcgtgcgccgtggctgctgcagggtgacctgcgtgccagcgccgggttgctgctggtggaacaggcggcgcaacgccgcgcccaggtgcgtgcgcgcgatgtgctgaaacgacgcttgctggccgcaccggacagtgccgagacgcgcggcctgcgccagctgctggagcagggtgggcaatggttgcgcccgggtacgctgctggcggacggtggctatgggttgccgctggtcgatgagcaggtggtgctggccgaagcggttgccaccgccagcgcacaggcggtgccggcctggcaggcgctgcgcgtgcagctgcgccagcagttgccggcaggccagcgcaacgagatggatgcgatcgatgccaacctcgctgcactcggcgcgcgcctgcggcaacaggcagccgcgcccgctactggcgcggcagttcgatga

SEQ ID NO: 71243 - DNA, 276 bp, Glycine max
  Peptide Sequence Number=SeqID_162928
gagttcaatattcacttaggatcaacatttcagccagcaattcaatcaccaaaactcaaattcacaatagacacaatcataaggaaacctaaaagttcaagaaaaggctcatacttagcccatgggctcaaaatcaaccctaaggctcatgagaaccctagggccttcccttggatctctggcccaatctacttggagtcttctatccaatgcccttgcggggtaggattgcatcaaatcttggagaagattgtgcagccgaacaaaaaggattag

SEQ ID NO: 71244 - DNA, 225 bp, Glycine max
  Peptide Sequence Number=SeqID_162929
atgcagcccaaacagaccttaagcgccacagccatttctggccaaacatttgactacatcgtgtgtggtggaggtacctctggatgcgtcattgcagcgggtcttgcgtcgattccagatgtatctgtactgctgatagaagcgggcagagattcaggccttgcacccgatgttctagtgccaggcaaatatgtcaagcagctacaagacaaagatggtttatga

SEQ ID NO: 71245 - DNA, 240 bp, Glycine max
  Peptide Sequence Number=SeqID_162930
atggccaacgatgccgaagagcgtgcaatcgtgacggctagcatgaacgctatcggtcaagccatgtccgcttggacgcaattactgcaatacccggcagcggaagccccgaacttcaggggaggttttatctcgaatctggcaactaccgtggcgcagttggcggttgttgcgattatggttttgctcactcgttgggatgcccgaaagacgagagggtcaaatgtgtcggcaatatag

SEQ ID NO: 71246 - DNA, 513 bp, Glycine max
  Peptide Sequence Number=SeqID_162931
atgaaggcagtggctggattaactcagcttaacaatgcaaagcctattgctgattccagtttttccaagactaaaccagaagattctttggactcacaattcaaaccgccagaagcttcacaactactttgtcacagcttagagggcaatgctggtgcactcacaaattttgaggtccttgatttcttacgagctaaaggagcttcaaaggatccaaccagagttattgccaaagtagcgcagtctgaacatatcacaagatgtttctactctacagcagttggaggattgagatgctatgagaatccaaagaataagattactgcagtacctgccgaggaagagcaaatttggggtgcattcttcaggaacagagaatcagtgatcagtcccaacagtaatataaggttaatgtcagttgagactgcattaggtacaaatggaaaatgtgaggtcagagacaatagaataggagttcataaaaagccaacacatacagctaaatttcactaa

SEQ ID NO: 71247 - DNA, 705 bp, Glycine max
  Peptide Sequence Number=SeqID_162932
atgccgctggtgttcgcctctattctgagcgccgttgcgcgcctgcataacgccactcaactgggcaaaatcagtttcctgaccatcggtacgctgctgtttaccacgctgattgccgcgctggtgggtgtgctggtgaccaacctgtttggcctgacggcagaaggtctggttcagggcagtgctgaaacggcgcgtctgaccgcgattcagaccaactacgtaggtaaagtggctgacctgaccgtgccgcaaatggtgctttccttcattccgaagaacccgtttgctgacctgaccggtgcaaatccaacctccatcatcagcgtggtgattttcgccgcgttcctgggcgtggcggcgctgaagctgctgaaagacgacgcgccaaaaggcgagcgcgtgctgaccgccatcgataccctgcaaagctggttaaccccgtatggcgtgctggcgctgatgaccaaagtggtcgctggctctaacctgcaggacattatcaagctgggaagtttcgtcgtcgcctcttacctgggtctgggcatcatgttcgtggtgcacggtatcctgctgggtgtgaacggcgtcagcccgctgaaatacttccgtaaagtctggccagtgctgacctttgccttcaccagccgttccagcgccgcgtctattccactgaacgtggaagcgcagacccgtcgtctgggc

SEQ ID NO: 71248 - DNA, 459 bp, Glycine max
  Peptide Sequence Number=SeqID_162933
atgaccatgattacgccaagctcgaaattaaccctcactaaagggaacaaaagctggaataatcaccaaacttcaatcctcacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71249 - DNA, 882 bp, Glycine max
  Peptide Sequence Number=SeqID_162934
atgagtaaactacaatttttgcattttcctcatcatggttgcgttgataattttcctcacaggcttcaatctttttcagttgagctaagccgggtggaaaaactttgggatggagtacagaatttgaagaatttaaaagaagttaaagtctctggttctaaaaacttgaaggagcttccaaacctttcagaagccacaaatcttgaagtattggatatcagtgcttgtcctcagttggctagtgtgattccttccattttctctctcaccaagctcaagataatgaagctaaattatggctcctttacccaaatgataatcgataaccatacaagctccattagttttttcacccttcaagggtctacaaaacataaattaatttcactgagatcagagaatatcactgttggaccttttcgatgcatttgttacaaagaaaaaccctcgtcttttgtatgtcaaagcaagctcgaaatgtttaggataaccgaaagtgacatggggtgcttgccttcaagcttcatgaatcttagaagacagcgatatctgagagttctagatccgagggagcttcgcatgatagaaagtggctctgtagatgtcatagattgcaaatcattgaagcacgtattggttcttgctgaacaattcaagtatatcagcagtggcgttggctttcagaattaccaaggattggtcgaagaatcggtggtggtggcattagatgcaatttcatcaactgttgaaactgtgtttgaccattcagagcttatagatgacaagagatatattagtattgatgaaagaaaattgaagccagtgaagagaattgatgaatatttaatgaaggtactaggtcctcaacaatgctttgaataa

SEQ ID NO: 71250 - DNA, 697 bp, Glycine max
  Peptide Sequence Number=SeqID_162935
atggagattattatttccgttccactaataacttgtgatttttgccgaagggagcattaccaggataattgttatatgtactccacaaataactctgggtggagacagttaactccctataatcagtatgaagagcaaagagtccccgatcttgacattgtgtttgcagaattcatggcatatcatgctagttctaaagctaatcataatgcaatacaaaagcaggagattcaatgtgctaaagttttttttgaagattatcaaggggaaccagagtcacaattctactatcaaaatgaattagaaaggagtttcaatctggacattttgttaatgcaattcaaggatacaattggatcaattcaacgggcatttaaaagtgcagaaattcaggttggtaagctggtagaagaagtgactcaagctatgagcagaagagaagaagagattgtaaaggttgacactcaagaggagagccctgtgaatgagcatgatttagaagaagaagataaggagaaagcgcaacaatggaaacaatgcttacccccacacactcaacaagaagataatttccaagttaacacatgttctcatcaactgactatcaaagaagaaaggcatgaagaccatgaggcttcaatcattctaggacaaccctgtctgacatttgctagttgtgttttcgacatgggtaaag

SEQ ID NO: 71251 - DNA, 235 bp, Glycine max
  Peptide Sequence Number=SeqID_162936
atgaataagttgcaaaaaaatgttgagaggaggacgagagagagatttgatgagatacaaagaagcactcaagagttgagcgagataatggaagacatagagaggaggaggcatcataggtcacctcattcttctcaaggaagtgatgatggctatgaagaaggtagaagacatagacatatgaggaatatggatggaatggatgatatgaagatcaaaattcccaagttcctag

SEQ ID NO: 71252 - DNA, 881 bp, Glycine max
  Peptide Sequence Number=SeqID_162937
tgcgctggtggagatattgatatgaaactgcgcggcgaaatgctgcagcaccgtcagcttctgttccagcaggccgcggatttgcggataggtatcgctgaactcgcttaccgaactggccagcaccccgaccagcagcagcatcacaatgaagatcaccgtgatcaccagcgagatcgccacgccgcgccgcagaccccggcgcatcagcagggtcaccagcggattaagcacaatcgccaggaagctggcgacgaagcgaacccgataagcaccgccggagataccgccatcagcccgccgcgaatcgacggtgcgcacggcgagaaaaggcgtataattctctccatcgtgaagttcaacttcgccacctatctcaccattggcctgccgctggcggtgctgccgggctttgtccatgacggcctgggctacagcgctttctgggccggcgtgcctggtgagcgggctgtgtattttgctgtcggcgctgatagaggagcaggaggtgctcagcctggcgctgctgtgcctcgggcgcgtgctgctgggcgtcgggcagagtttctgcggcaccggcacctcgctgtggggcgtggcgaaagtcggctcgctgcatattggtcgggtgatctcctggaacggcattgtcacctatggcgcaatggcgattggcgcaccgcttggagtgatgatctttcgcagcggcggcctgctgctgctctccagcgtgattatcgccatcagcgtgctggcgatagtgctggcgctgccccgcgcgccggtgaaaggcagcaaggccaaaccgctgccgttccgtgcggtgctcggcaaggtgtacggttttggcctgctgctggcgatgggctcggcgggctttg

SEQ ID NO: 71253 - DNA, 513 bp, Glycine max
  Peptide Sequence Number=SeqID_162938
atggcatgcagagaccatcatggtcatccgcaccttttttactatccagagacaatcaagtctgatgagacaaattatggtcatctgcccctattcaaagacgacagtgtctttagtcaatgcatgctttcaaaaggtgacaatgactttcatttacattttgaagacgacaatgtctttagtcattgcatgctttcaaaaggcgacaatgaccctcatttacatttcaaagacgacaatgtcttcagtcattgcatgctttcaaaaggcgacaatgaccctcatttacatttcgaagaggacaatgtctttagtcattgcatgctttcaaaatgtgacaatgacccttatttgcattttgaagacgacaatgtctttagtcattacatgctttcaaaaggcgacaatgaccctcatttacatttcaaagacgacaatgtcttcagtcattgcatgcttttaaaaggcaacaatgaccctcatttacatttcaaagacgacaaatgtctttag

SEQ ID NO: 71254 - DNA, 405 bp, Glycine max
  Peptide Sequence Number=SeqID_162939
atggcgttctgcactcaaacatactgcattgagctacatcgagctgctgaactcaaacatactgcgtggagaagactacttaggcacgtcgttcctgtgagtccagttgtgttcttcggtcgccatcagcctgatagagttttctttttcttttttcagcgaaaggtatctgacatcattttctatcaaatgttggtcgggtttgtgccgtttcggggcgattctcccatggagattttcgaggccgtgcttcgagccaatttgaggttttcaactcatgttttctgctccatctcacctacggccaaggatcttcttcgtaggatgctgtgcaaagagctttctagaaggttctcgatagaacaagtcctaaagatgagttgtatattctctggcgaaggatga

SEQ ID NO: 71255 - DNA, 132 bp, Glycine max
  Peptide Sequence Number=SeqID_162940
atggagtctttagatgaagatgatagtgttgatggtatatctgatacagacgatgaagtcaccgacatgattcaaccagtaacaattgttcacccaacagaaggtgtagaaggaattcaaaattcatcttga

SEQ ID NO: 71256 - DNA, 195 bp, Glycine max
  Peptide Sequence Number=SeqID_162941
atggataagagcttgaaggtaggaaaagatgggtggagggacagggagagaaggagcacgaaattttgtgcctcaaatgagaaggaggaaatgcttttcgatgcaagtgatggcttcagagattggggggcaaatgcttttcaagaaggaggaaatgatgtggacatcaaagcccaagcccattacaaccactag

SEQ ID NO: 71257 - DNA, 249 bp, Glycine max
  Peptide Sequence Number=SeqID_162942
atgggctcagaaatctaccctaaggttcatgagaaccctcgggccttcttcagtagctctagcccaatcctcttggagcctcttgctcatggctctagtgattggtcccttcctagggaggattgcatcatttacaaaaggaacaaaaaaattaaagttgccccaccaattcaatgcatggtagtgcactactcaattatcgagactagagggaagaataggttctttcctatgagattcaaaccttga

SEQ ID NO: 71258 - DNA, 270 bp, Glycine max
  Peptide Sequence Number=SeqID_162943
atgaatgctcatccggttagcaagccaaaccctcatgacctccttgctttcgaggaaaatatgttcaatagttttttcaacctttttacaacaagggcatattggatcaatgttgggcatcttcctttggaggttctctctaactgggataatattcttacaagctcttgggttccatttgtgcagattgggttaaagcttgatggtagccaggttttgcagcatatacctctcctccgaatattgccaaatgagcttatcttgatctag

SEQ ID NO: 71259 - DNA, 360 bp, Glycine max
  Peptide Sequence Number=SeqID_162944
atgagtggagggaaagggagagaaggagcacgaaattttatgcctcaaatgagcccactaatccaagatcaagtccaagattctccactaagtgtgcttaggtgtcatgaggcatcctatgggctcgaaatctaccctaaggctcatgagaaccctagggccttctcttgtatatctggcccaatcttcttggagtcttctatccaatgcccttgggggggtggtggtgattatcatcaactggacggatctcagcatttcttattggacgtaatgaatacacagatgcaacgattgttgaaccgtaacaatgaagatctctatggacaaattgagggtttggagaaccaactgaattag

SEQ ID NO: 71260 - DNA, 968 bp, Glycine max
  Peptide Sequence Number=SeqID_162945
aactcaaaagatttgtgaaattcttgaatgataagcttttgaagaatcaagaagttaagggtcaacctcaagatgttgtcaaacttcatgaggaaattagaaccttgaaaactacattagccaaatttgtcaatggaacgaataatcttaacaaactgttaggatattgtagatgttccttagacaaatttggaaatggatatgatggaaaggtatatgttcatgataaggataccattgtttgctacttctatggaaaaactggtcatatgacattcaagtgtaaagatcgacttaagaaagatgtccttgataataagaagcagacacttatcatggtacttggacagtggttgctcatgacacatgatacaagaaaggtgtatgttccaatgcttgactccctatcatggtggaacaatcactttcggaggaaatcaaaagggaaagataaccacagtggtggatataatgtctccttcaacaaagatgagtgtgccatcctatgtaaagatgggtctcctctattcaatgccaagagaaaaggtaacctctacaaaattagactgggtgatctcacagatcaaaagaatctaccttttgatcttccgcacaccatctacatcaaaatcttgagaaacctaaaaggcgtgggtggtctagacgacatctattacgctgctctcatcaacaagatgttgtgggatcaaggcgtgtatcatgtcttcaacaagatggatgatgattctaagcacaccttaatagacaagggtttagccattgctaaacaaaaaaaatttagccaaactaacctaaaatctaggaaggttgctttagaacaaagccaaaagaaggctcctcaggtggacctggacgccataaacaaaaggaagcaaaaaaggctagccaaagccattgctgacaaagatcaaggtctgaaaaactttggtatctccaaaaagatatag

SEQ ID NO: 71261 - DNA, 560 bp, Glycine max
  Peptide Sequence Number=SeqID_162946
atgactaactgcctgaattcttttatgtctcccttctccctttccaagagaattcaaaaggacacagatacatcctttgcggtaaaagtagagggtacatctacttgggttgttgtaactgagaacaagaaagggtacatctcttgtggatctgttcaagtggagggtacatctactaggttgttcaaagagaataagggagggtacatcccttgtggatctttgcttgtaaaggtttttacaaggttgaaagcaatctcaaggactgcaggttgcttggggattggatgtaggcacggatctcccacaggcaatttagttcctctggacttagaaattgaagctacattgagaaggaactgggatgagagtagaaggaaacttctgcaagacagaacagtcacatccattcttgaggaagaaactcatttttctgattcattgtcacctgattcaccatcatcaagggaatccgctactcaatttcctgaagccactatcatggcagacgagcaacaccagaggatcacccttgaggattattcaagcagctcagtgcc

SEQ ID NO: 71262 - DNA, 123 bp, Glycine max
  Peptide Sequence Number=SeqID_162947
atggtagtaggcatacttaacaaggcccaagtagaaaaggatgaaggcctaaagggggggtctgtttctggaggggactcgccaatggagttggcgagttggacacgtggcggcacctggtag

SEQ ID NO: 71263 - DNA, 450 bp, Glycine max
  Peptide Sequence Number=SeqID_162948
atgtatcctcccttgttctctttgaacaacctagtggatgtaccctccactagaactaatccacaagagatgtaccatctcttgttctcagtcacaacaacccaagtagatgtatcctctacttgtaccacaaaggatggaaagagaagaattaaaagaattctcagaatgtgtcgttttgaattctttgacaagggagaagggagacacaagagaattcaggcgaaaactttagaaagctttttgcaaaggaagaagaaaaagaagaagaagaagaagaagaagaagaagaagaagaagagattcaaaggttgtaaaagaatatgtggaaaagttgtttgtaaaggttgtaagtattgtaagttctcttcaaatgcaaatcaaggtattgcttttatagactcttcaagtctggtcaagaaaatcattggaagagttataaccttttag

SEQ ID NO: 71264 - DNA, 633 bp, Glycine max
  Peptide Sequence Number=SeqID_162949
atgggtaagggttggggtcctggcactactggtgcagggtatactggtaaaagctatcattcagctgcacctgacccctatggttggccgccttctggtcagccaaatgctgcatgtagagctccatcctctgcatgtgagctgaggtggactctagagatggtggctgctgtagaggtggcgggagggggggtgcgtctgtggccggctgttgctaccggtccaaccccagctcctgtgtctgccttggcatgcaatgagctttatgggagtaaccagcaccccatagaactggcagagacgtgtgatcaaggccggaaatctcaatgctctgttgggcttttctgggtccactggatgccttggaggcgtgatacctacaaactgataaacactgacctaggtcagaatagcatagaccagctggcatttaggcagcaggagatcagaattatggttgcggggaaggatgttgctaaggagaagcgtcatccagatctgtgtcaaggtggtcatgctagtacatgtgatccacacccgccttccatcacgcttcgtgcaaagtcttgtcccagggagcacaacagtttgcttatggtctcctcatcaaatgctgagaccttctctcgctga

SEQ ID NO: 71265 - DNA, 186 bp, Glycine max
  Peptide Sequence Number=SeqID_162950
atgggattgggaagtgaacgaggcaggttgggaatgagaggtgttggggaagggaagaagggaaagagagaagaggttgggaggagaagggagacgaaagagggagagttgaagaagacttgtacctttgtctatagacacttctctccggtgcactttgatttcatgggaaaaagagagaaataa

SEQ ID NO: 71266 - DNA, 216 bp, Glycine max
  Peptide Sequence Number=SeqID_162951
atggagcatacttcgataagaaaggaggataagatctccatgatagtgaactctgtcatcgcctctatggaaaaaccattgccttgtcagatagagcattacttcttgtttccacaacatgggatccatctatatcagcaagaaatgaatgaggctacagaggtctggatgatgccacttccaaagagggaagataagtcagggttgactccataa

SEQ ID NO: 71267 - DNA, 246 bp, Glycine max
  Peptide Sequence Number=SeqID_162952
atgaacggtggtcaccgtacggaatccagcacaccacgtcaggggtcagtctatctagacacctgcgatacatggaaacaagtagtgccttgccagaggtccatcgacatgcacacgcagtgccccaagcgtaacacccgctctgcgtcaagtcacgcaatgcatccaacaatactgtttcactctccgggatactacttgtttgtgtggatgcaaaatctaccggcaagtgcaccggattgttaa

SEQ ID NO: 71268 - DNA, 390 bp, Glycine max
  Peptide Sequence Number=SeqID_162953
atgcgaaggcctattgcatcaacccgtagacagcgacaacaagagcgtgttgttgaggaccctcctacgatcgcgaaggaattgaatgaagagcagccagaagcacctattgaagaagttgttactgatgttgagggttttctaggcggaccccatgacacatcagttctcatagattttgaaaatcacattgctttgagagtctggaatcgagaggaaagtcctgagctgaagctatcttcccatggaaggaagatgactaagttcgggaggcctgctctagagattgaaggccttgtggcggccagtggactaagtcctttgatcgcctgttccctagatacaggcgatcggagactaatgtctgccttttgtggaatgctagcataa

SEQ ID NO: 71269 - DNA, 330 bp, Glycine max
  Peptide Sequence Number=SeqID_162954
atggagagtgaatctgttgttgcgtattgtagtggtgacataacttcatcatctgaagagatgttgtttgaatgtcctagtggttctaaagttgtcacaataagtgaggacatgtcgcttgatgctttaaggaaaacatatatggacgccatcggaggttgcaagattttacttgatcttttttaccatcaatcaaattacctacgtgatggttgtgttaaatatgagtgtatggagcttaaacatgactcttcttcctttgtctctgtgtgtttaagctacccccaagtgctaatgcctcatgcagcaattgcaaagcttgttgaatga

SEQ ID NO: 71270 - DNA, 309 bp, Glycine max
  Peptide Sequence Number=SeqID_162955
atgattgagcatgtcgcagatctcgatgttcatggcccaatcaggccctatgagcatgtcgctcgtggcgcgttccaccatggaattcaccatctcctccggtcaccggtgcgattcgaaactctcagcgagatcggcgattctccgacgaccataaatcgaaccaccggtgcaatcggagaacacgattccgacaccgcgctctctctctctctctctctctctaaagaaacgaagattgatgcgagagtttggtggattccgttgctgagggaaaggtttggaatggggttagaattggaagtttga

SEQ ID NO: 71271 - DNA, 87 bp, Glycine max
  Peptide Sequence Number=SeqID_162956
atggatgttcttgcagaaatgctcaatgccttagaccctagtaacaaagaaggtgttgaaaaatgtttatgggacaaggccaaatag

SEQ ID NO: 71272 - DNA, 234 bp, Glycine max
  Peptide Sequence Number=SeqID_162957
atgtggtttgaggatgaactaggcagaagcaagtgggtatgtaacaccccgatgaatcacgccaaaaagagacagatccagaggttgtgcagaaagcgtgtgagaggacaaagcacactaaaagtctcgtgttggtttgtgcgaatagtcattgctcttaaagcagtcaaagaagattgtctaggtctcgaaaaagactacttacgaaggattctgactggtagaggattctga

SEQ ID NO: 71273 - DNA, 498 bp, Glycine max
  Peptide Sequence Number=SeqID_162958
atgtctgccagtgatagagtgcatcaacccactaagaagagtttactagagttatcatcacaagacactgtgttggcacaaaataagttgctctctaggaaacttgagatcttgacagaaaccttgagttgcaccatatgtggtggtacttatgaatccggtctttgcattccttttgaagagcaaatgcaagagggtccttacaaccaacaaggacagtggagatcacaccctggtaatcaattcaacaaagaccagggtggaccttccaacaggccgtctcaacaagggcctaacatttttcagaggacaaccaagctggaggagactctgactcaattcatgcaggtgaccatgtcaaatcacaaaagcactgagttagcattgaagaaccttgagatccaggtgggccaactagccaaacaattagctgaaaagtcgtccaatagctttgggcgaacacggaaaagaatcccaaagaggaatgcattgttgtga

SEQ ID NO: 71274 - DNA, 204 bp, Glycine max
  Peptide Sequence Number=SeqID_162959
atgaagaagatcaaaggcctacaagctccacataggagctacatcatgtggtgccaagagcatcttcgtcgaggcctaagatcttcttcatcaatggattcctttgcttcttggaagatgaatgacagcggaatagagaaggaagacagagaggagatgccacttcaaggagaagatgagtctagaagaagctcaccaccatag

SEQ ID NO: 71275 - DNA, 357 bp, Glycine max
  Peptide Sequence Number=SeqID_162960
atggagctcggccttaggtgcaacgcattaaatggcagcttgtccaaagtagctttgggcatgacattgagggaagagccattgtcgatgagcactttggcccctatgttgtccaaacatttgacagacacgtgcattgtgtcccctgccctcgacgagtatctctttgtcagcgaaagtgaggtaattgttggtcgtgatgttattgactataccctcgaaaccctccacggatatgtcttgtgctatgttagtcggttaattaggcaagctttgaaaagtgttgtttttcaccttctcgctaagccaatctgttggcttagcgagcgtccgctaagcgcaacactcatgggctaa

SEQ ID NO: 71276 - DNA, 321 bp, Glycine max
  Peptide Sequence Number=SeqID_162961
atgacggtgacgtacaacaactgcaaagaacgatgcacgactttggctccaaagaggactcctcctgtaatagaaaataaaccactcggacacaggtggttgcgacgtggaaatcagcatattggcaatgatgatctgatagtttttcgtcgcaaattggatatcatgaaacaacatgagtttctgtgggagccttacacaacaattgttatgtcagcgttgcctccaatttgtttggttggaagtgtagcatggtgcgcggtggtgccactcatctgtttccatgttgttgagtggcaccaacccgatagagttttgtga

SEQ ID NO: 71277 - DNA, 249 bp, Glycine max
  Peptide Sequence Number=SeqID_162962
atggcttttcctgggttgcgctccgtcgcaacaaggcgcgcggtcatccccgtgcgaaggagcttctctacctcgccatccgtgagagatgctgccggctccacgttgcccgctaaaaaacctgttggggcttttcgcggaggaatatttggcttccttactggtactattgttgccggtgcttccgtctactattatatccttggggagtacagagtgaccaacgagatgttgacagaggacatatac

SEQ ID NO: 71278 - DNA, 633 bp, Glycine max
  Peptide Sequence Number=SeqID_162963
ggcgaattggagctccaccgcggtggcggccgctctagaactagtggatcccccggagaacggggcgccgacggcaggcagcgcggggaccgagaaataggcggtggccagcccgagccagcccgtgatctgggactcgaagaggttgatgcacaccagtgcgacggcgccgagcagcaacggcgggatcagcgcgtagagcggacccttctggcggatctcggagcgaaaccaccgggggccttcgatgacgtatcgatgtcgagccatgacgaaacggcacacccacaccgagagttcgaggcgccgggccgaaagtctaggggcgacggttccgtggggggtggcactcggtcgggcgccgccgatgcgtgggcgttggcgacggtggcgatggtggtgacatcgaccatcgcgacccagtcgtggtggccgatgagcgtgggtgcgatcgtctgggtcctcgcccgtcgtccggcggtcgcactcgccctgctggcgctcggctcggtcgcagccgtgcgggtcgaccacgagttggcgcggctcgtgccggatcaatcaagcttatcgataccgtcgacctcgagggggggcccggtaccagcttttgttccctttagtgagggttaa

SEQ ID NO: 71279 - DNA, 1087 bp, Glycine max
  Peptide Sequence Number=SeqID_162964
gccatcccggcgccgcaatggcgcgtcgaccgccgccgccaattcccagggcgtccaggtggccatgccgtccaggcggacctcgccaccggcaaccagcccgtgggcgccggcgtcctgcaggcaaaccagcatgcgctcgggcggcgtgtcggattcgaacggcagccaggccgcgcccgccttggcgatggccgcctgcatgacgagcagttcgtcgccgcgcggcaggcacaggccgacgatgtcgcccggccgcacgccggcctcgatcaggtggtgcgcggccaggtcggcgcggcgcccgagttcgtcataagtgagggattgatccagccagtggatggcaatggcggcgggatgccgcaggatcgtggcttccaggatatcgggcagcgtttccgcctgcagcagatccggccgacgggggccttggagaatcataggtacggcgacaatccggcaaatgggatgcgcgcaacacaggggttccgggttgccggccccggcaaattcgcggcgggccggcggccgccggccgcaatccggattgacccacaaccgctccttgggcaggcgggcggcggctttctgcatcaggccgaccatccagtccacttccggaacgttgggcgaatggatgtcgtagacgcccgggccgatgtcgttcggatagcggaaatcctcgaacgccttgagcagttccatgttggagcgcgacgtctcgatcgtgatcacgtccgcgtccatggcggcgatagactcgatgatgtcgttgaactccgaatagcacatgtgcgtgtggatctgggtctcgtcgcgcacgccggcggtcgacaggcggaagcaatccacggcccagtccaggtacgcctgccaatcggcgcggcgcagcggcaggccctcgcggatggccggctcgtcgatctggatgacgctgatgccggccgcttccaggtccaccacctcgtcgcgcaaggccagcgccagttggcggcaggtctgttcgcgcggctggtcgtcgcgcacgaacgaccactgcaggatggtgaccggacccgtcagcatgcccttgacgggcttgtcg

SEQ ID NO: 71280 - DNA, 905 bp, Glycine max
  Peptide Sequence Number=SeqID_162965
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgactgatatcaatggctgttatcgtgattctatgtacagcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71281 - DNA, 309 bp, Glycine max
  Peptide Sequence Number=SeqID_162966
atgaagaacggtggagaatcttcacgaaatcgctcacggaaatgtctcggaagcgttacggaagcgcctcggcttggattttcttcacggaaacaatttttctcactaatttcaagggaaaaaagggaggtggttgccgcccagctcgcccaggcaagctgggttgcttccactagaaggcatcgccttctgttggaacaccctggaagatattttgatgataacaaaggtgatgacaaaaagctcaaaggtcaatcaaagaatgagttcaagatgttcaagatagaatcaagaacacttcaagattaa

SEQ ID NO: 71282 - DNA, 558 bp, Glycine max
  Peptide Sequence Number=SeqID_162967
atggccggcgcgcagctgggcaataatccagccaatgcccaaaccggccagcgccagcgcgccgctgatgataagttgctgatccataatccccccgcggatcgtctcgctgaggagaagggcgcgcacggtcaggtcgccggctttccaggcgtcgatcaggaaaaacggcatcggcagcacccattcgctgtcgcttttcaccttcgccggatagcaccagctgttgccgccgtaggtcagctccacctgctgctggccattttcggcgttggccactttgccggccatgctggcgaaaccggcgttgctgccgacgtggaagctgtcggtctgccagcgaatcggcgcatgcgccggccacggctgcgcgtggtggaagtgaaagatatcgtcgtgattgaggatgctgtcgcgcaccgtcggccacagcgctaccttgaggaagtactggtcggtaaagcgctcgctgccgtcatactgcgcgataaagtcgcgcatctgctgctccacattgtgaaacacgccgtgacagccgccccacatgccggccagtaa

SEQ ID NO: 71283 - DNA, 336 bp, Glycine max
  Peptide Sequence Number=SeqID_162968
atgctgcattctatgctccagagcctacacagggggcaatccatcatcaagcagagcctgcagggcttgggctcaccatccattatgagtatagacgagtttgacctgcaggtggcctggccaggagcccagccttttccttctagaaggggtggggcctccgcagcccaggagcctgctcctgaggagccaggagcagcagcagagggggaggatgagctcacccctcctgagcccttttattttgatgcggatgtacacatggctcaggaggaggggacttccacaaatcagatacctgagccatctcctgcacatgttcctaaggagacctag

SEQ ID NO: 71284 - DNA, 1152 bp, Glycine max
  Peptide Sequence Number=SeqID_162969
tcaccgttgaaaccttcagcgaatggattgtggataaaacccagtttaagggcgagctgccgaacatcccaggaatggaattaaccgataacctgatggcatttgtcgagcgtaagctattcaccttaaacaccgggcatgctataaccgcctacctcgggaaactggcgggccatcaaacgattcgcgacgcgattctcgatgagcacattcgcgccgtcgtgaaaggcgcaatggaagagagcggcgcggtgctgattaaacgctacagctttgatgcgcagaaacacgcggcttatatccagaagatcctcggtcgctttgagaacccgtatctgaaagatgatgtggagcgcgtcggccgccagccgctgcgtaaattgagcgcgggcgatcgtttgatcaagccgctgcttggcacgctagaatacggcctgccgcaccggaacctggtaaaagggattgccgcggccatgcatttccgcagcgaagacgatccgcaggctcaggaactggcggcgctgattgccgaaaaagggccacaggccgcgctggcgcagatttccggtctggatgcggcaagcgctgtagtggcggaagccgttaacgactacaacgcggcaataatggaagaaacacaggcatttgaaaaccgcgtacttgagcgtttaaatgctggtaagaccgtaagaagtttcctgatagccgccgtcgaactcctgacggaggcggtcaatattctggtgcttcaggtattccgcaaagacgattacgcggtgaaatacgcagtggagccattgctggacggcagtgggccgctgggcgatctttccgtacgcctgaagcttatctacggccttggggtgataagccgcgccgaatacgaagatgccgagctattgatggccttgcgtgaagagctcaatcatgacggcaatgagtacgctttcaccgacgatgaaattctcgggccgttaggcgagctgcactgcgtcgccgcgcttccgccaacgccgctgtttgatgagagcgataaggaactgctggcaatgcagaaactgcgctaccagcagatgcttaaaaaaagccttccagaaatcaacgctctgactccgcttcttgctggtcgcacgtcggccggtacagctgccg

SEQ ID NO: 71285 - DNA, 564 bp, Glycine max
  Peptide Sequence Number=SeqID_162970
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgcccccatctggccttaaccaaatgaatcatccaacctcaaatatgcacgccttcccatcatatggcttgcctcccaactatacaccacccaatgtggcatacactctcaatgaaaatctcaataactccactcccatactcattgagagccagcaaccccaaactgatcatgcacatgtctctcgacccatggaggagacacatgaaattccccaccacgatctagccgacttcgagccttggctcgaatatgccactgaagggcaagcagttggtggtataccccttgcaaaacactttggagggccctcagtatcacccacagcgtttaaaaaccctcatgactatggcaggaatgggaaagttggatcatctagaggaaaggctcagggccattga

SEQ ID NO: 71286 - DNA, 1332 bp, Glycine max
  Peptide Sequence Number=SeqID_162971
atggaaggcgccgaaatccttgaaagattgcagcattatcattcggacgaggcccaacatctcgaatatgcggagaaggcgcgggccgcgcttgcgcggctggagctgacgaaaacaaagatcccactccctgccgatgtcatcccgctcaccgtcaaaccgaaaacggcgggcaagcgctggcacccgccaaaggacatgctcgatctcatcgagcttcgccacgatttgcatcgccatccggaaatttccggagaggagaaagaaaccgcccgccgcgtccgtgcctttcttgagcaggcaccacctgaccggcttcttgccggcctcggcggccatggcgtggcggccgtttatgacagcggcagaagcggcccctcggttctgatccgctcggaaatcgacgcgctgcctatccgcgaaaagggtgaagttgaataccgttcgagcgtcgatggaaaaggccatctgtgcggtcacgacggccactccaccattctgacggcactggcgcttggccttgcccgccagcggccggagacaggacgggtcattctactctttcagccggcggaagaaaccggtgccggcgcagccgccgttattgccgatccacgctttgcggagataaaaccggactattcattttcacttcacaacctccccggcctgcccttcggccatgtcagcgtggtggaagggccggtcaattgcgcatcgcgcggcatcaaaatcacgttagcgggcaagacggcacatgcttcctcaccggaacacggcatttcccccatgcgggcgattgccaggctgatgccgtccctgagcgatctcggttccggttttccgccggcaccggatttttcgatggtgacgatcacccacgcgatcatgggggaagcggccttcggcatttccccggctgacgcggaaatctgggcgacactcagaacgctgaccgacgaccggatggaaaacctgtgcaacgccgcggagacgctcgcaaaaagggtggcagacgaagaggggctaacgctcgatatcacctatgacgatattttcctgcattgcgaaaacgccccggacgccgtcgatcatatccggcaggcgctggacgacgagaaaatctcccacggttctgaaggtctgcccatgcgcgcttccgaggatttcggccgtttccgcggcgtctcgtcgtcggcgatgttctttctcggcgcaggccgggactatcccaatctgcacaaccccgattacgactttccggacgcactgatcggtatcggtgcgcgcatcttcatgcgcctcattcgtaatctcactgacgggaaataa

SEQ ID NO: 71287 - DNA, 580 bp, Glycine max
  Peptide Sequence Number=SeqID_162972
aacccgacaaggacgtcgaccccgtggatcgataaatacattttccccaacggctgtttaccgtcggtacggcagattgccgatgccagcgaatctcacttcatcatggaagactggcataacttcggcgcgggattatgacaccacgctgatggcccggcatgagcggttccaggcggcatggccgcagctggcggagaagtatggcgagcgtttcaaacggatgttcagctattacctcaacgcctgcgccgccgcggcgccgaaggcggtttgcgcgtggcgcgttgatttccgtgcaatgctaaaaggcgcttaccgcgccttttttattcgcgattactccgcgtccggcagccacacgttcgacggtgtcgacaatcgcctgggtatgcggatcgatttcgatattgacccgatgccccagcttcttcgcgcccagcgtggtgcgctccagcgtttccgggatcagatgcacgcagaacttacttttggtgacatcaccgactgtcaggctgataccatcgatgccgacgaatcctttatgcagaatatatttgatctgctcagcgtcctgtaa

SEQ ID NO: 71288 - DNA, 1185 bp, Glycine max
  Peptide Sequence Number=SeqID_162973
atgcagaatggcggtaaagctaaaggcaataatcatcagcagagcagcggcggtggtggtcaatgccagtttcaaatcgggcgcaaaaccattagcagacgcaaacgtttaacaatatacttatcagtaagttgcgataagcccaggagtaccattttcatggcaaccattaaagatgtggcgaaacgcgccggggtctcaaccaccacggtttcgcatgtcatcaacaaaacgcgttttgtcgcggaagagacgcgtaacgccgtatgggaagcgattaaagcgctgcactattcaccgagcgcggtggcccgcagcctgaaggtgaatcacaccaagacgctgggcctgctggcgacctccagcgaagcgccctacttcgccgaaattattgaagccgtggagaatcactgctttgagcgtggttacacgctgattctcggcaacgcgcataacgatctgcaaaaacagcgcgcctatctgtcgatgatggcgcaaaaacgcgtcgatggcctgctggtcatgtgctccgaatatcccgacgatctgctgcagatgctggaagagaaccgcaatatcccgatggtggtcatggactggggcgaatcgcgcggggactttaccgataccgtgcaggacaatgcgttccacggcggttacctcgccgggcgatacctgattgagcgcggccatcgcgatatcggtgctatccctggccagatggagcgcaacaccggtggtggccgtcatgcaggttttctgcaggcgatgcaggaagcgggcatcagcgtccgtcccgagtggattgtgcagggtgacttcgaaccggagtcaggttatcaggcaatgcagcagatcctgaaccagaaacagcgcccgacggcggtattctgcggcggcgatatcatggcgatgggcgcgatttgcgcggccgacgagatgggactgcgcgtgccgcaggatatttcggtgattggctatgacaatgtgcgcaacgcgcgctacttcaccccggcactgacaaccgtgcaccagccgaaagcgcagctgggggaaaaggcactggaaatgctgctcgaccgcatcaccagcaaacgcgaagagccgcagaccattgaagtgcagcccacgctgattgagcgccgctccgtggccgatggcccgttccgcgattaccgccgttaa

SEQ ID NO: 71289 - DNA, 333 bp, Glycine max
  Peptide Sequence Number=SeqID_162974
atgagtactgttgaaaaaattcagcgccagatcgcagaaaacccgatcctgctgtacatgaaaggttcgccgaaactgccaagctgcggtttctctgcgcaggcggtacaggcgctgtctgcctgtggtgagcgctttgcgtacgtagacattctgcaaaatccggatatccgcgctgagttaccgaaatacgccaactggccaactttcccgcagctgtgggtggatggcgagctggtcggcggctgtgacatcatcgttgagatgttccagcgcggcgaactgcaaccgctgatcaaagagaccgctgagaagcacaaagaagcagaataa

SEQ ID NO: 71290 - DNA, 612 bp, Glycine max
  Peptide Sequence Number=SeqID_162975
atgactggaaggctgcttgccagttcattggctcttgaaagccacatccttcactatcttattgttcgtatcttactcccaagatcttcaaaccttgcacaggtttctgaagaagatgttatagtcatatgggcctttcataccaggggacaaattgattgggcacatttagtccggtatcgcatgcataaggcattgcgattaaatgctcctttaccctatccacacttagttactttgttccttcaacattttgatatcccttttgattctgaaccatatattccaatcaagagatctttcttgatcggtgctgttgtggttgcctcctttggttaccgcaaagagtgtgatggctcttgggtaaaaaagggtgctcaaccaaatgatgatgaaggacacttaccagttgaaggggactcttatctccttcagagtattttggacaggtttgatggacttcaaacctatgttggtgaaaggtttgatgctttggaacgacaagtggacatgcgattcgacgaaatggactcatggatcacaaaggttgaagaagatgtcaccatcattcgcgactaccttgatttacctccaccaccaccatcattttag

SEQ ID NO: 71291 - DNA, 408 bp, Glycine max
  Peptide Sequence Number=SeqID_162976
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatgggacgctacgccaagcgtattatataa

SEQ ID NO: 71292 - DNA, 189 bp, Glycine max
  Peptide Sequence Number=SeqID_162977
atggctccacctaaagaaagtgcggccatcatttaccacaatggtcacattgtagatgacccagttcaaggatcgataggcgcgatggaaacaattctccagaattctactgaattctatgactttattcctcaaccacaaccattgtctccacaaccctcatgtccacaactacaacctccacaatag

SEQ ID NO: 71293 - DNA, 848 bp, Glycine max
  Peptide Sequence Number=SeqID_162978
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaagaaacagctgctgatgatgtagttactaatgtcgaggatattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71294 - DNA, 894 bp, Glycine max
  Peptide Sequence Number=SeqID_162979
ggtacacgccctcgccttcagaggactacacgtcctcaccatcagaggactacacgtccgcaccatcagagggctacaggtcctcgccttcagaggactacacgtcctcgcctttagagggttacacgcccttaccttcagaggactacaggtcctcgccttcagaggagtacacgtcctcgccttcagtggactgcatgtcctcaccttcaaaggactacacgtcctccctttcagagggctacacgctctcaccttcagaggactacacgtcctcgccttcagagggttgcacgccctcaccttcagaggactggatggatacacgccctcaccttcagaggactacacgtcctcgcctagaggactacacgtcctcacctttagagggctgcacgccctcgccatcagagggctacatgccctcgccttcagaggactacacgtccttaccttcagagggctgcatgccctcgcctttggaggactacaggtccttgcctttagaggactacatgtcctcgccttcagagggttgcacgccctcacctttagaagactgcacgtcctcaccttcagagggctacgcgccctcatcttcagaggactacacatcctcgccttcagagggctgcacgccctcgccttcagaggactacacgtcctcaacttcagagggctgcacgctaaggctgttgcttctggaggaagcaacctggctcgcctgggcgagctgggcggcaagcttctcccctattttgctataaataggggaagaagtgaagaagaaaagccgaggcgcttccgtaacgtttccgtgagaaattacgcgaagattctcgaccgttcttcaagattcatcgttcgttcttcgttttcttcagtcttcaacgg

SEQ ID NO: 71295 - DNA, 183 bp, Glycine max
  Peptide Sequence Number=SeqID_162980
atggtgaaagttggaacctcttacgtgccgatcaacgtctcattttcgccaaaagttggcccagggcttcccggtatcaacagggacaccaggatttatttattctgcgaagtgatcttccgtcacaggtgctcccagtggcttctgtttctatcaagctgtccctcctgttcaagctactga

SEQ ID NO: 71296 - DNA, 455 bp, Glycine max
  Peptide Sequence Number=SeqID_162981
caaccgatccagacacgggtgactcaaacaaatgcgagttgtacatcgaagaaaatcctccccacctagttgccctaggaagagtttatgagggatccacaatcattcacaacatccctttgttgcatgatcaagtgaaggtttgtgttgaggaggttaaagatgtagatgctctcattcctgtacccactgacgaggttattttagtggggcagacacttaacaccttccttgcttggctgacacatctcgtcaagtgtttatcagaacatggagttgtgggaccaataaaacctgcagataggtcggatcttgaggtcgaggatcccctacatctgatgacattgaccatcccacaactttttttgaagccgttgcaatttatgtgggatgtttccctattcgagctgtttaattcagacttccccttattcatgaagttctgtctgaaatag

SEQ ID NO: 71297 - DNA, 78 bp, Glycine max
  Peptide Sequence Number=SeqID_162982
atggcgctcagcgaggggttgaatcgctcagcgcggcctatggctcgcttagcggatcacaactatgcactcagctag

SEQ ID NO: 71298 - DNA, 705 bp, Glycine max
  Peptide Sequence Number=SeqID_162983
atggatagagctaggttggtttacggcttggtcacatgcatgaacatgaatatcggagccctaatctcaggtcagatttctaccattgcccagagtaactcctctaggctcggattcccatccttgatcactgctctatgcagagctagaggagttacctctgacagtctgaccaatgagagcctgagcccggccattaacttggcctacattaagaaaaattgttggaatatggatgatctgacagttaacttcagaggggctaggaagagcttgcatgtggtagctcctccagggtccattctgtcggcagagcagttcattgagaaggtatcctggcctagaaccttaccttttgctgtgagagagggtgaggtccccagtgctcaggtacctcaacaggtacagggtgcgtcttctgaggctaccatccctggagcttttgatttttctggtgcaggagtagagatgaggcctaatgaggatgttctttctgagccaattgtagcagctcctcctacaccagtacatgagagacaagcagatcctcctacacccatcatggagatgctagaagaccctaccacgccagtcctgagattgtcatccactccttcagctaccccagttttacatctgacagatgaggaggatatgcaggaccaggacacacaaggcacacaggaccagtcgcaggaattctaa

SEQ ID NO: 71299 - DNA, 744 bp, Glycine max
  Peptide Sequence Number=SeqID_162984
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgatgccgttaacgcatcctagtcaatccaccgatggcgaccctggcagaaaatacgaggtgacttggctagatctcgggcaccttcaccccagtcggccgggactcgtcactatcaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71300 - DNA, 399 bp, Glycine max
  Peptide Sequence Number=SeqID_162985
atgggctccccggccaagcccgggcagaccttcgcgctgttcgacgaggccaacgacgagtggctggattgggcgccgaagatcccgttgggcaaggcaaatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71301 - DNA, 468 bp, Glycine max
  Peptide Sequence Number=SeqID_162986
atgaagcacttcactgacaccctcatcagtgccaacatactacgcgccaatgacaaccaccgcatcaggttagcaatccaacccacttggcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71302 - DNA, 612 bp, Glycine max
  Peptide Sequence Number=SeqID_162987
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaagtcactgtgactcaccttgctgctcccatagtctatagttctacaactgagaactgcttctctctggtccttctccttgcttctaaggcgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 71303 - DNA, 101 bp, Glycine max
  Peptide Sequence Number=SeqID_162988
ggaccactgaacctcaaccagaggctgaatggcacagtcttgagcttcatcttccaggtctgttccgaaacggccgtgtcaaatgcctcgacaattcgcgg

SEQ ID NO: 71304 - DNA, 744 bp, Glycine max
  Peptide Sequence Number=SeqID_162989
atgacctctaggaagaggaaagctactgcctccggaccctgggagccctatgacacctctagattcatatctgagggtgcctgggagagatatgcacagaacattcactcccggaacatccttcctgagaggaacgtcatcttatacatttctgagtatgacgagttccaccaggagctcaagaggtggaactggcataaagccttgaccaggcagcctgatggtcacattgatgtggccctggtcaaggaattttatgctaacctttatgatccggaggataaatctccgaggcaggtcaaagtgcgggggaagcttataaagttcaatgttgagtcccctcaacaccttcctggagaccccggtggtcttggagcatggggaacactacaccacaattgctggaacccggattatcccacgatcacctttccggggacctgcaagactagggctaggggacctgacacttctgctccttcttcttccactcctccagctccagctcctccaccaactcccactcttgccactccagtaccctccggaacctccgctcagagcgtagagattctagtgccgatgttacagagtctccaccatggcttatgcctggtgatgcagagtatccatgatctggctcagcatcggcccattatgagcatgaaggcatttatggcccaagtggcctggccaggagtccaacattctcctctggggggaggtaaggctcctacagcctag

SEQ ID NO: 71305 - DNA, 705 bp, Glycine max
  Peptide Sequence Number=SeqID_162990
atggatcctttacccggtatagctaaggtcttttcttatgcagttcaacaagaaagacaaattaatagcaatgatatgataggaaacaatagcttgatcaatgcagcaagcacatcttcatcgaattcaggactttcatgtacttactgtggcaaagacaatcatacagttgataaatgtttcaagaagaatggtttccctcaaaactatggttccaaaggaggaaaaagtaaccatagtggctttggcaaaggaaattccagtgggaaaggaagaaaactttgtacttattgtggtttcattaaccacacagttgatgaattttacaagaagcatggttatcctcctaaacataaatacaataagtctcaaagctcaaatatcaataatatgaatctgttgaaaaaagaggatatgcagaacctgaagaggattggtacagttgatatggtggaaggtctttataggttgaagatgcttcctttcaaccctctcaaggagtatgctccaagttctatcatagcttatgttcttgttgcttctgctagtgtttcagctttttcatgggagaagggaaggactgaaaaggagaaaggatgggttcgattgggtcaaaaagggaaggaaaagtttgggttggacgaggataagaagaaagatacaagggatgaggaatttgaaatggaggaaagaatgacttcttag

SEQ ID NO: 71306 - DNA, 490 bp, Glycine max
  Peptide Sequence Number=SeqID_162991
atgatcgttgcttcctctctgttgcctgatagtggttgccgatcaatgatagcaattgtgacggaaacaaccaagatggtgtcttctcagtttagaggaggcaatgaaagcagtggtagcaatggcattagaagagggaaaggggttaagccaaacgacatgaagaaagaagaatggaacttgctagatcgactggcttttggtgtgatcaaattgacattagtcaagaacgccgcgttcaacatcgtaaatgagaagactactacaaacttaatgaaggcgttatcagatatgtatgagaagccgtcggcaactgacaaagtctacttgttggagtcagtgcacattaaatttgaggatgaggtgaatgcattgattctattgtcatcactaccggataatgttcgtaagagagattcaggagaatcttctagtcatgtttccaattcagcattgaatactgaaggcaggggaaagactacccaaaagg

SEQ ID NO: 71307 - DNA, 249 bp, Glycine max
  Peptide Sequence Number=SeqID_162992
atgaggatcactcgcatgagaaagatcaagtttggccactcgacttgtggtggcattacactcgactctatcccattcgcaatagttggtgatgttgttgtttacccaagaatgaactcagggttatatataagattatacctactattttgtgactcaatcattgccaaagttacaatgcggcatggcatcaaacttcaaagaagttgccttccttatctcaaagactttatgcgtatggaaagttga

SEQ ID NO: 71308 - DNA, 480 bp, Glycine max
  Peptide Sequence Number=SeqID_162993
atggcttctccacctgcctcccctcctcctcctccttcttctccttcgaacgcatcggcttcaccgtctgccgtgaagtggacacgcaaagcctcacgtctacgatcgttgtctactagaccacctagtgctgagagaccagtggtccatgtagatcctactaccggcaaggccgacagtccccacaggaagaaattaaaaacatatttggggattgtggcatgtgataaggtggacgtcacctacgagaactggaaggaggcggaatttgaaatcctagaggcttttgacagtaggacgaaaaggaagttacttcagaccgtgggggagagatggaggcagtttaaatcagacctcacgaggaagtgggtccttgcagcctatcaggacggtggggaggacactgtgtgtgagaaatacggcattagcaaggaaaaatgggcccagttttgccagactcacagagacccttcttgggag

SEQ ID NO: 71309 - DNA, 768 bp, Glycine max
  Peptide Sequence Number=SeqID_162994
atgaaaatcgacagggaaggaatgaccaagtatttgcactatcaggtcattacaaagttggtggcattcgaggtctcaagtgcaatatggcctgataaagcgtgcaggctgatttgggtcggggacagatcttcaattggttcgggtggatctgggttcagggtcgcgagggaaggttctagagaagcttcatcctcatttgagactaacaagaacaatttggaagaacacttatggccaggagtgaatttttcatcacaattgaaacataatcctttttcccaccgcatagcaagctcatcaggggaaaggcgtttgaagggaatggaaggagaaggttgtttggtgggggtggagagcaagggtgcagaagaaatgggtggaggtggtcgtgggcctagtgaacccgttgggagcagaggggtgatcttgaagatccacccagtcggatcggagccgtcgaagcatgaaacttcgagcttcaaacgatgtggagatttcgaaggtgtaaaagtagaagggctggcggtagatgaagctaaccgtgaccgtgctaggtctgtttctggaactcgtggtacatttcacctgaggtacaatctcgtcggcattgtcgctgttgtgttcgaggtgaagctgaattactttgttgtagttgaagttggtttgtccattggtgttcttgtggaagctgtttcattatatcaagtccagtccttgaagcttcaagctgacagagacttcagaagtttgtataatctcacttga

SEQ ID NO: 71310 - DNA, 198 bp, Glycine max
  Peptide Sequence Number=SeqID_162995
atgattctattacccacgcttcagaggtggaacagtagcttgaacaagtggagcctagacgggttcgcggtcgcggtgggtgacagctatccaggagtttctcctcatggagacgcgccagacctgcggcctggaccaaagtcatcggttggtgcgcctgaaccttccgacgtatctccggtaaaaatatacggataa

SEQ ID NO: 71311 - DNA, 147 bp, Glycine max
  Peptide Sequence Number=SeqID_162996
atggcttttcttatagatgaggattctaatggaccaatagatcaagaggagttgaaagagtgtacgtccaacgatgttctaatggctaatagttgtgtttatggcttttcaacggtgttcattcaccttgagcatcatctcgggtaa

SEQ ID NO: 71312 - DNA, 390 bp, Glycine max
  Peptide Sequence Number=SeqID_162997
atgaaaactatatccaaaagatttgaagaacttgatgtttgtggtaagtttactctgaagactaagctttgggagattgcataccctgatcaaaattcgatgtgtcctcctccagcaaaggttaacacaaaaggtgcaccgaagaaaccgatgaatagaaacccaagatttgaggaattaaggatgtcactacatgttgatgggttaacccaggccactatggataagtggatggatacaactgacatgggatatgtgattgcatcgaggtataatatttatttaaaagaccattgtcctttaccgccggtagcactgttatggtctagcaattgtcatcctcaggacactataagacttgactacgtgacaggacactgtaagacttga

SEQ ID NO: 71313 - DNA, 231 bp, Glycine max
  Peptide Sequence Number=SeqID_162998
atggaggatatagaagatgaggcagtgctaatccacgtagaggtggaaggtggtcacgagattgttcatgttaggctgggtgttgggccttgtcgcaacctacccttcggcggaagggcgacgcggggctcacgggtgcgtcttccaagggaggaaggcgcgcaaagtcgccaccaacgtttattcgaggaaaacgtcaaaaaaaccaaatgtgtggtctacaaactttaa

SEQ ID NO: 71314 - DNA, 660 bp, Glycine max
  Peptide Sequence Number=SeqID_162999
atggctgatgttaaaactgaggttaccttgaagcttgtggtaatcataggtagaaatgaagttctctttgtggaggcagggaaggactttgtggatgctctgtttagctttctaaaattacctttgagaaccgttgcaagacttgtgcttaaggagccaaatgtgcagccaattgaagttgcatcactgagttcactctatcagagaaaagaagattttgctgactttatttctagtttgctgactattcctttaggaggaatgctacacttgacagaaggttgttcttctttgggcagcgttgaaggattgtataagagtgttgttgattttgaagaagttattggacttcaaaggaactacacaaatcttagccacgctcattatatccgagctgtaatcaccatatctgagacagctaatagtaaaggatatgttaaaggaccaataatgtacatggcaacagatgatttggtagtgacactcatgtcctccatttctgtcatatctttactaagcagtgtgtgcattcatgttaatgacttggaagagaaagtggtaaacattggcatcaacgttggtgtcctcatactacaagcatctttgacatctacatcagtcctatcagttggtctcggccacttattaaccccacgttaa

SEQ ID NO: 71315 - DNA, 717 bp, Glycine max
  Peptide Sequence Number=SeqID_163000
atgaagatgaaaacgaagagcctacgagtgattttaatgatttttgtttcaatagaagtgatgcactgtgaagggtgttggaaggaacagacagatgctcttttgggcttagatctccgttttgagtctgacacagattgttgtcaatgggaacgaatcaagtgcgactcctccacagggagagtggccagactcaatctttatcacttgttgcttgatggatttgaagagtctcaactggggatagctggttgcgcatacaatgaaggggataaaggaggatgcagtgctgacttcgaggacaccaacctccagcagaaagaagaaaaagacagagcttccaaaaataataccggggtcccaaggcttattccgatgaacctgcaattccacaaagtacccgtaaggaaggaatttcatgcggaaaagagttggagcggtctgacaaggacccaatgggtttgcgggttcctcattctctgcgatgaagggatgaaccctagaggcctcgcgatggccgctatggagcttctcctcgccttggtcgcggcggggagggcagcaaagggggcaaggttgcgatgggaggaggaaccaaaggggctgacggtggagctacccgcggtggggttcacagtcgcggtggatgcagaggaaggtgcgacgtctgctgctcctggagcttcgcgaggctggcggcctggtccacagtcatag

SEQ ID NO: 71316 - DNA, 423 bp, Glycine max
  Peptide Sequence Number=SeqID_163001
atggctgcttcttcggcatctcttgctggtgcttctgcttcggattttctgaggagttcaaccagcagtttcaatgaggaggattttacagttgctgctaagctgaggaaggtgaagaagcatgaatatctttggcctgctaaccctgatcccaatgtgaaaggtgaggtgctgagccacctttcccagttcaagccactcaaggagaagccaaagcctgtcactttggattttgaaaagcctcttgttgatctgcaaaagaagatcattgatgttgtgctgaatgctaatgggctaataggaatggtatttatggatggaaacagaaaactggattacttgaatgagcaaactgatgatgataagagttctcatgagaaaattgccatcatgcttctctctgattgtcacttgcaagattga

SEQ ID NO: 71317 - DNA, 126 bp, Glycine max
  Peptide Sequence Number=SeqID_163002
atggtggcggtggtcatattaatggtgacaatggtggccaacaatgatgacaaatatgttaatgatggtgacaacaacaaaaacaatggtgacatgaatggtggtggtggtgacaattgtgattga

SEQ ID NO: 71318 - DNA, 2916 bp, Glycine max
  Peptide Sequence Number=SeqID_163003
atgggtagtatagtatattcaaagaccaaaaagtttcaagaagaaagcaattctgttagccatactattgtccctgaacaggattttgaacagttgcctgccctgcctgatgcagttgcctgtcagttttcagccttagaaaagattgtggtcatttatggagatcatagtctctacatctatgacatacatgatgtgaatcgggtcacaaagtgttttgtgctagtttcacattcctcatgcatatgggacatcaagaatctatgttgtgaaaacatgcatgatccatctcttgcatgcactgctagaggttgtttggggggaatttcttttgcaacttgctctgctgatggtacagttaggatatgggatattgctttgcaatctgattttttaaaagatgctgaagagttgaagactgaattattgagttcttcatgtttagtaactgctgggacatttgaacgtgatgcagttaaggcagatcttaccaatcaagagtttcgatcacttgctgttagttcagatggaaattatcttgctgctggtgattgcaaaggaaaccttcatatatacaaccttcatacatcagattacacatgtttccagggtgctcatgatgcagagattcttacattaagctttaccttgtccacccaagatatatctaaggaaattgcaaaagacaattactttcttgcctcagggggacgagattgtatgatccatctctatgatgtgaaaagaaattttgatctcattgacagcattgatgatcattcgggtgcagtgacttctatcaaaattagcagcaatggttgcaggatcctcagttgtagttctgatagtttcctggtgcttcgtgatgtggtgatagcagatagtggctataaatttttgcagcaacatcgtcaaagggctttacaacgtggaactgtctatgacatggctgtggatcggacatgtgagactgttgtcactgttgggcaggataagaagataaagacgtttgacatggctgctcagaaactaattaggtcttacaatcatgataaaaattttggagaacctataaaggttataatggatcctagctgcacttacgtggtctgctcattctctaacaagtccatatgcatgtatgactttatcactggagagatggttgcgaaggccacagggcatgctgaaattgttactggtgtcatcttcttgcctgattgcaagcatatagtttcggtggacggtaatggttgtgtttttgtatggaaattgcctgctccattgtctgctagaatattggagagaataatggaaaaaaataatccattgtctccaagaagttctgttcaacgtccggcttataattatctatcgttttgcaaagaagaatgccgacattccaagatcaatcctgaggatgtttggtcactgaggaacaacagccaaagtggggatggaatgctttatcctgaaagcagtcatagtgaggcttcatcttttaaatttagtgtttcaagacttcccaaatgggctcaagcaaaagtgaccagttccattaatgtcaacaagaatcttaattgcaattcattagagtttcagaatgtgcaagagttgtccaggttccttgtcatttgtaggagagaaaatctagtcactgtcaaactgtgtctggagtatgctccttcatcccctgaagttcaaattccatccgatcatgcttctccattgcctgatactctgaactctcaagattcttcaaggtttggaggaacttatagttctttgctcattaagtcactaaatttcagcaacattccattggacaaccattggcactctatttatactgtttgtatggaagcactttcctccccagagatgcagaatttatgtgagacaaagtttccagagattcccttgagtctaagacaacataaggctgtgatttgtgaggaccagaactcctttgggcctaataaccttagcaagaatgaaaagaggggtgttgctccagaacatgttggctgtaacaataatgatgtttcttggtgttctgaagaagtttctgagagtaaagcagagcagttgtatttaagtgaatctggaagtgtgtcagaaacaactactgaaggcaatttgggaagtctaccatctgaagaagacagtgacatgtttaagcaacattttggtagcttatcaaatacacacaaggtaaagtcgaggaattcattagttagaaggttttctgcaagatatactgtgcaatgggattacccaggggattgcaagaaactttttagcagtcctgttgggaataaaagtggtagaaaaagctctgaggataaaggtgcaactcatactgtatcagaagacagatccttgcaggttaaggaaactgaggaagtgacaaattcttctgaacaggacatcaagaattcagaaccttgttctgcagattcaacatgtgaactaactaaatttccagtcaaagaaaattcagttgataaagggagtgaactgggagaaaccatagccgtgtgcaaggaagcattcggtagcttggatgcagcagctgagagtgtgctgcagttatttttaaaattggaaaatgttcacggcaaagaggtcgcaacgggagctggagctcaatttttagacgaggccactgagctacttcccctagttgttaataaagttaatgctgttgctagattggtgcaatgtaggaagaacagtaagtgtgaaactagtagaccaagtgtccaagaaattgaccagtttggtagatttgccgcaggcagaggcacaagggaaaggattggtggcggcaacgagaacgggtgttgcggtgaagaggaagatagagagaagaagagagtgagcgaggggagaaggggaagatggggacattaa

SEQ ID NO: 71319 - DNA, 543 bp, Glycine max
  Peptide Sequence Number=SeqID_163004
atgagggatgatgagaaggggagttctaagaagtcatcgagccggtggagggcgtggagtatatggggattgatacaccggaggggaagtaaggaggaggagggtggagggaacgggaatgggaatggggtggagaggtcgtattcggagtcgtggcaggagtatagaggaggaggaggaggggagaagaatggggatgttaggggtggtggttttaatcctaagttgatgaggagtaatagcagtgtgagttggaggaatgggcagagtatgataggtggtggtggtggagggtttgggaatgtgagtatgaggaagagtgatgtgcaagggaatgaacttggacttgggcttggtggaaggaaggggagggatgagtttgttgggttggagaggaaccgtagtgccaggtattcctcgccgaacagcatcgataacaatggtctcttgaggctctacttgggtggcaggagaaacgggtccgggaaaggaaggtcgaaccaggcacattctatcgccagaaacgtacttcgattgtattga

SEQ ID NO: 71320 - DNA, 253 bp, Glycine max
  Peptide Sequence Number=SeqID_163005
atgggttcacactttgtaatgtacctagctaaggtgaaagatttatctttgtgctccaaggtgctgtcaccctcactaatgttgctggtgttagccaactacttaagatttttaaattctaacagctttagtggactaattccggcttctattggtaatctatcaaaacttaattggttagatataggtgacaatcagcttcaaggacccattcacatattaagtggcagtacaccattgatgttgccaacag

SEQ ID NO: 71321 - DNA, 1328 bp, Glycine max
  Peptide Sequence Number=SeqID_163006
accctacgatgcaatatgttgggactagcaattctggaagtatcattgatatagatgttgacaagttatcattctttgaagcaattaggattttagaagaagactttggatatgacgatcaaccaatgaggctatggtggaaaggtggtgatggtgagtataaggagattactatggacaatcgtgcattagagttgtctgattatgccattgctaacaattatgagctggagttgtttgtggaatgtgctggtggtaataaaggggttgtggatgacaatttttatggtgattctgaagacagtagtgatgaatcggtgaaagatgtccaattagatgagtctgaggaggaaagggcaattggattggataatggtgcgagggaggaaggtgattcatgtgatgatgcttatgctaatcaagaggaaaacttaaacctaccaagtgaagtgcagagcgatgcacattttagggtggtggacaaggctgctggttgtaagaaggctacttgtggaggtaagaaggttgctagtaggggtaaaaaggctagtagtggaggtaaaaagcctgctggtaggggtaagaaggttgaacacaattatgtgaatctcagtgatgaagaggtatatgaaagattcaacaacgagttgctttatatggaatttaaatggaagttcggattggagtttgctttgctaaaagagctcaaagaagccatactgaaatacaatgtgttaatgggagagaaatcaggtttgatttcaatgataagagacgagcaagagcaaggtgtaagcattgtaccaactatctggtatatgttagtaagaaaaggtcctggtaaaccaaagaaattgggaaagagagagctcgatgaagaccttaacatgacaaggctaagaagggatccaactccttataaatgcaaccaatgtggggtagcatgtcataataccaggaggtgtacattgccacctcaagtagtacctgaagaaactgagcaactcaatgtagttgagggaggcactgaaggagtagctgagggtggaaatgagggtgcacctattggagttcatactaggcaagtcaataatgttgagggttacactaagggagcaagtgaaggtggaattgagggtggaggtggtggagttcaaattgggcaactcaatgttgttgaaggtggcactgagggagcagttgaaggtgaaactaagggtggaggtggtggagttcaaactggtcctattcaacaccaaaagaatgacattacacaaatcaaatgtacaaataaaaacaataagcttatgggaaaaggtgtgcaatag

SEQ ID NO: 71322 - DNA, 292 bp, Glycine max
  Peptide Sequence Number=SeqID_163007
aaaattgggggagaagcttgccacccagctcgcccaggcgagcaaggttgcttcctccagaagcaacagccttctggagggcccaagtgggcccgctttcgaagaagttacggaaactcacggattgcgcaaaaacacctcttttcgacttccgccacattacggaatttcacggatcgcgcaagcctgcttccttttgatttctgagacgtctcgggacttcatttattgtgcaacaaatgtcgccaagtatctcaaagcggctaaccaaaggttgcattttatcaagtaa

SEQ ID NO: 71323 - DNA, 195 bp, Glycine max
  Peptide Sequence Number=SeqID_163008
atgatttctgatgttgtattctttgactgctcgaatacattgtgctttttcatcgaagaccatgtcaacctcgagtacaccggttggtggttgtacatggtgtcgatcaatgtagtgttggtaactgttgtggaggcggtagttgtagttgtggacatgaggattatggaaacgatggttgtggttgaggaataa

SEQ ID NO: 71324 - DNA, 459 bp, Glycine max
  Peptide Sequence Number=SeqID_163009
atgcaaagaaggtcttctgcaggtgttttgattcccatagacttggaatttaatgcaacttgcaggaaaaggaacgcaaaaaggaatagaaagtttttgcaggacattgaggcaacaacaattcaggaagaacctctatcttctgaggcatcttctagttttccaaaacaaggggaatctcacacagtattatttgaagccaatatcatagttgatgagccaagaagagttacccttggagattactctagctcaagtatgtcgcaattctttactagcattgcacgaccggaggttcaagcacaaaatataacccatccacattcattaattgagttgattcagaacaatttgtttaatggtctgttcaatgaagacccgtatgcacatctagccacttatattgagatttacaacatgtcagactggctggtgtgcctgaggatgctgttagattga

SEQ ID NO: 71325 - DNA, 306 bp, Glycine max
  Peptide Sequence Number=SeqID_163010
atggctactccacctacctcgcctcctcctgctcctcctgcagacgcatcaacgtctccgtctaccttgaagcggacacgcatggtgacacggctacgatcgttggccactagaccacctggggcagatagaccagtggtcaacgttgatcctgctaccggcaaggccaacggtccctacaagaagaaattaagaacatatttggggattgtcgcttatgataaggtcgacgtgacatacgagacctggaaggaagtccctgcagctcagaaggatttgatatgggaggatattcaagtattttag

SEQ ID NO: 71326 - DNA, 767 bp, Glycine max
  Peptide Sequence Number=SeqID_163011
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggccaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71327 - DNA, 234 bp, Glycine max
  Peptide Sequence Number=SeqID_163012
atggctgtcgtgtttggaatattgggacagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 71328 - DNA, 453 bp, Glycine max
  Peptide Sequence Number=SeqID_163013
atggatttcttgaatgtgagtaatgcaggttttgatgatgctgagaagaattcacttgataatgattgtcatcatcaaaaagggggagattatgaatgttgctttcaagatcacttcaacaaacattcaaaggttaagcattgcttcaagattaagacaaggttgcatcaacaaataagcattgcttcaagatttattcaagatcagtttttgcctcaaaacacattgtttccaacatatcaaggctctgatatctctaagatatgtttctacagactgactgttgggatcttgaaaataataaattttggtctctcgctaagcgagtatggcgcgctaagcgcaactccaaccaaggggaattacgctgagcggccaaaagctgcgctaagcccaactccaaccgagggaaattgcactgagtggccaaaaggtgcgctaagtgagccctag

SEQ ID NO: 71329 - DNA, 1191 bp, Glycine max
  Peptide Sequence Number=SeqID_163014
atgggttccgtgttggtggaaagcgccggtgaaaccatgggcgacatcgtcaacgccgtcacccgcgtgaccgacatcatgggcgaaatcgcctcggcgtcgagcgaacagagccgcggcatcgagcaggttggccaggcggtagcggaaatggaccgcgtgacccagcagaacgcctcgttggtggaagaatccgcctcggcggcggcggcgctggaagaacaggccagcatgctgacccagtcggtggcggtattccgcctgagggcggaaggccaggaagagtttaaagcgcctgtcaccagcaaggcgacggtaacaccgctggccagcagcggcctgtcgtattccgcgtttcgctccgataaccacaacctcgacatcatcaccctcggcagccagcagcgcgattcgctcagcctgagctgggtgtcgctgttgcaggcgcgcaatacgctgaaccgcgccggcacccgtgcggcgctgaaactgccgcaggagcaggtgaacgaattgatgagcagcgctcgcagttcgctgcagaaggccgatctttatttcaatcagttcatggcggttgagcgcagcagtgagcaacagagtcagcagacggcaaccaccaaggccagctacgagcggctgcgcggcgcgctgcgcgagctgatcggctttctggagaaaggggagctgcaggcgtttatggaccagccgacgcagaaaacccaggacttgttcgaagccgacttcgtgcagtacctgcagttggtcaacggcgacatcagcgaagccagagacgccaaccagttctccttcaagctggcgggcctgatgctggcgggggcggtcttgatgctgatcgtggtgaccggcagcgccatgtggtggttacgcaccatgctggtacagccgctgaaccagatccgcagccactttgaacgtatcgccgccggcgatttggcgacgccgattcaggtgtatggccgcaatgaaatcagcatgctgttcgccagcctgcaacgcacgcagcagtcgctgatcggcaccgtcggcgcggtgcgcgacggggcggagtcgattctgatcggcctgcaggagatcgccgaaggcaacaacgatctctcttcccgcaccgagcagcaggccgcgtcgctggaacagaccgccgccagcatggaacagctgaccgccacg

SEQ ID NO: 71330 - DNA, 165 bp, Glycine max
  Peptide Sequence Number=SeqID_163015
atgtcgggtcaaactgaaactgggaataaaatcacttatagtgtattaaaactcacaccggcaagttttagcattcgttattcgctctcccttgaggagattctgctgtcattttcttcgggggaaaggatgaggattcttttcatgggccaaggttcaaagtag

SEQ ID NO: 71331 - DNA, 99 bp, Glycine max
  Peptide Sequence Number=SeqID_163016
atgtgggataccctacaggaacatgaaatggaattgatgagattgaatcaacatgaggagaatgataagaaaaagaaaggaattgctcttaaagattaa

SEQ ID NO: 71332 - DNA, 945 bp, Glycine max
  Peptide Sequence Number=SeqID_163017
atgccttcgccttcagaggactacacgtcctcacctttagaggactgcaggtcctcgccttcagaggactataagtcctcaacttcagaggagtacacgccctcaccttcagaggactacacgtcctcacctttagaggactacaagtcctcggcttcagagggctgcacttcctcatctttagagggctacatgccctcaccttcagagggctacatgctctcaccttcagaggactacacgtcctcgccttcggagggcaacacgccgtcgccaacagaggactacgtgtcttcgcctttagagggctacatgccctcgcctttagaggactacacgtcctcaccctcaaagggcagcacaccctccccttccgtggactactcgctacacgccctcgccttcagaggactacttgtcctcgccttcagagggctacacgccctcgcctttagaggactacacgtccttgccttcagtgggctacatgccctcgccttaagaggactacacgtcctcccctttagatggctacacaccgtcgccttcagaggactacatgtcctcgccatcagagggctacacgccctcgccttaagaggactacttgtcctcgcctttagagggctacacgccctcgccttgcgaggactacacgtcctcgccttcagaggactacacgccctcgccttcagaggactacacgtcctcaccttcagagggctacacgccctatccttttggggattacacgtcctcaccttcagagggctacacgcccatgccttcagaggactacatgtcctcgcctacagagggctacacggcctcgcctttagaggactactcgtcctcgccttcagagggctacatgccctcgccttcagaggactacacctcctcaccttcagaggactacacgtcctcgccatcagaggactacat

SEQ ID NO: 71333 - DNA, 1408 bp, Glycine max
  Peptide Sequence Number=SeqID_163018
ccagcgacttcccgaatctcgacgactggcagagcgaagtggaattcacgttgccgcaggccacgcttaaacgcctgattgaagccacgcagttctcaatggcgcatcaggatgtgcgttactatctcaacggcatgctgtttgagaccgaaggcgaagagctgcgcaccgttgccactgacggccatcgcctggcggtctgttcgatgcctgtcggacaggcgctgccgaaccattcggtgatcgtaccgcgtaaaggtgtgattgagctggtccgtctgctggacggcggtgaaacgccgctgcaggtgcagattggcagcagcaacattcgcgcgcatgtcggcgacttcatctttacgtcgaagctggttgatggccgtttcccggattatcgccgcgtgttgccgaagaatcctgacaaagcgctggaagcgggctgcgatctgctgaagcaggcttttgcccgcgcggcaatcctgtcgaacgagaaattccgcggcgttcgcatctatatcaccgaaaatcagctgcgcatcaccgccaataacccggagcaggaagaagcagaagagatgctggacgtgtcgtacagcggcaccgagctggagattggttttaacgtcagctacgtgctggatgtgctgaacgcgctgaagtgcgaaaacgtgcgtctgctgctgaccgattcggtttccagcgtgcagattgaagatgtagccagtccggctgcggcctacgtcgtgatgcccatgcgtttggcctgcgcgctggccgtggccagactgcctgcgccgccaacggcctggattgttaatgccgatctcacgctggcgccgggctttaattttcttgtgggcgccaacggcagcggtaaaaccagcgtgctggaggcgatttatacgctgggccacggtcgtgcattccgcagtttgcaggccggacgcgtaattcgtcacgatcaggacgcgtttgtgttgcacgggcggattgaaggcagcgagcgcgaactggcggtcggcctgagtaaaaaccgcgccggcgacagcaaagtccgcatcgacggcagcgacggccacaaagtcgccgagctggcgcagctgctgccgatgcagctgattacgccagaggggtttactttgctcaacggcggccccaaataccgtagagcctacatcgactggggctgctttcatgcttatcccggtttctttctggcctggagcaatctgcgtcgcctgctgaaacagcgcaacgcggcgctgcgccaggtcgtgcgctacagccagatccggccatgggatcaggagctggtgccgctggcagaacagatcagcgcctggcgcgcggaatacagcgcagccattgccagcgaaatcaccgccacctgcagccagtttttaccgga

SEQ ID NO: 71334 - DNA, 810 bp, Glycine max
  Peptide Sequence Number=SeqID_163019
atggcgataaaactgattgcgatcgatatggacggtacgctgctgaatccgcagcacgaaatcacggcgggcgtcaaagcggcgatttgccgggcgcgggataaaggtgtgtcgatcgtactggccaccggacgcccgtttgttggtgtggagcgctacctgatggagctggatctgcgccagccggggcagtattgcatcagcaacaacggcgcactggcgcacagcgcggacagcggtgaggtggtggccgagaagacgcttggctttgatgactatctctacctggaacagctggcgcgcgaccttggggtacattttcaggcgttcgacaaatccttcctctacacgccaaataaagacatcagcgaatacaccatccacgaagccagcctgaccggcattccggtgcgctatcgcgccgtagaagagatggacccggcgacgcgcttcccgaaactgatgatgatcgacaaaccggagctgctggataaagccatcgccgccttaccggcgcgcgcccgcgacagttataccattctgaaaagtgcaccttactatctcgaaatccttaatccgctggtcaacaaaggctacggcgtaaaaatgctggcggagaaactcggcctgcagccgtcagaagtgatggcgattggcgatcaggaaaacgatctggcgatgattgaatacgccggcaccggcgtggcgatgggcaatgcgattgattccgtgaagcagattgcgcagttcgtgaccaagaccaatatggaagatggtgtcgcgcacgccattgaagagctagtgctgtaa

SEQ ID NO: 71335 - DNA, 119 bp, Glycine max
  Peptide Sequence Number=SeqID_163020
atggcgccgatcgcgcgcgccgagcacatgggcggcacgcacttcaaacagcgcgccagatggatgggtcatgctgcatctgcaaacgtcccggacgcgtccgactggcttctgctcgg

SEQ ID NO: 71336 - DNA, 1293 bp, Glycine max
  Peptide Sequence Number=SeqID_163021
atggatctctctgctgttcaggcgaaacctacgcgtcgccgttatattacgctgctgatgatttttattacggtggtgatttgttatgtcgatcgcgctaatttagccgtggcctcggcgcatattcagcaggaatttggcatcagcaaagcagaaatgggatatgtgttctctgcttttgcctggttatatacgctgtgccagattcccggcggctggtttctcgatcgcgtaggttcacgcctgacctattttatcgctattctcggctggtcggtggcgacgttattgcagggattcgccagcggcttattatcgctgataggtctgcgcgccattaccggtatttttgaagcgccggctttcccgactaataatcgcctggttaccagctggttcccggaacaggagcgcgcttcggccgtcggtttttacacctcaggtcagtttgtcggcctggcgtttctcacgccgctgctgatctggattcaggaactgctgagctggcactgggtgtttatcatcaccggcgggattggcattatctggtcgctggtgtggatgaaggtttaccaggcaccgagccagagcaaaggcatcaatcaggccgagctggattacattcgtgccggtggcgcgatggttgacggcgatgcgcccggcgagaaaaaagcacgcgttaaactcaccgcggccgactggaaactggtgtttcatcgcaagctgtgcggcgtgtatctcggccagttcgcggtgacctcaacgctgtggtttttcctcacctggttccccaactacctgacgcaggagaaacatatcgccgcgctgacggccggctttatgacaaccgtgccgtttctcgccgcctttgttggcgtgatcctctccgggatggtggccgatcgcctggtgcgcagcggccgctcgctcggctttgcccgcaagacgccgatcatctgcggcctgctgatctccacctgcattatgggcgcaaactacaccaacgatccgctgtggattatggtgctgatggcgctggcctttttcggcaacgggttcgcgtccatcacctggtcgctggtctcgtcgctggcgccggtacgcctgatcggcctgaccggcggcatgtttaactttatcggcggcctcggtggcatcacggtaccactggtggtggggtatctggcgcaggattacggctttgcgcccgcgctggtgtacatctccgccgttgcgctgattggcgcgctctcttacatcctgctggtgggggatgtgcagcgcgtgggctaa

SEQ ID NO: 71337 - DNA, 675 bp, Glycine max
  Peptide Sequence Number=SeqID_163022
atgcacgcagtcgccgtcagacgactacacgtcctcgtctttagagggctgctcgccctccccttcaaaggactacacatcctcgccatcagagggctacacgccctcaccttaagaggactacacgtcgtcgccatcagagggtcgcgtaccctcaccttcagaggcctacacgttctcgccttcagaggactacatgtcctcgccttcagaggactacacaggactacatgcctcaccattagaggactacacgacttcacctttagagggctacacgtcctcgccatcagagggctacacgccctcaccttgagaggactacacgtcctcaccttcagaagactacacgtcctcaccatcagaggactatacatactcgccttcagaggacttcacgtcctcatcttcagaggactacacgtcctccacttcagagggctacacgtcctctccttcagaggactacatgtcctcaccttcagaggactacatgtactcgccttcagagggccacacgccgtcgcctttagaggactacacgtcctgaccttcagaggactacacacctcgccattagaggactccacgtcctcaccttcagagagctacccgtcctatctttcagagggctacacgctctcgtcttcagaggactacacgtcctcaccttaa

SEQ ID NO: 71338 - DNA, 885 bp, Glycine max
  Peptide Sequence Number=SeqID_163023
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccgcgtttgtctcattccaccgcctgacactcagttccgg

SEQ ID NO: 71339 - DNA, 183 bp, Glycine max
  Peptide Sequence Number=SeqID_163024
atggtggaatcctcaaacaaagagtacatggtcaagatcataaaaatactgatgcctcctaaggtgtcaagctcttccgggagaggaggaagatcgagaagtaaaggaaaagaagttcttttagctctaccaaagcaaataatcaagaagacaacttcatcatcctctgggtcacctacctag

SEQ ID NO: 71340 - DNA, 231 bp, Glycine max
  Peptide Sequence Number=SeqID_163025
atggaatattccagattgatgatgggaggaaaagctttagacattttcatcattggaggtgggggaacgcaggccgaacaggaagagaaaccaaaggttgtacggcgaaccacatcgtctcccgcaggcagtgatataattggcgtgttttgcagacgcgttgttgttgacatcatcaaaatggccatggtggtgggagggttcatcataaaaaactctctaatagtctga

SEQ ID NO: 71341 - DNA, 693 bp, Glycine max
  Peptide Sequence Number=SeqID_163026
atggagttgctgaagaagttaaggttgaacaagggggggactgtggagtcctcctctgtccagcagcatataccacagtctcaaggggtaataatttgttgggagagctatacataccagtgcatgcccaagatgataggtgtatttttcaagagggtggttcaaagtcaggaggagaaagcacttattcaggtctttctagcaaaactgagcaggaagcaagaatctcccataagtaaaaaggcatattcttcggatcatcatcaggattttgatcagcaacatctgcaccatagacaacaacttcaacaggagatggccaggaatgccccaagagcagcctcttcacagaatcaatcagcaggaaaatcacctcaagaaaagagctctttcacctttccgttagcccaaaaatcgaaagctgggaatgcacgaaatgccatagagtctcaaaaagcaccaagagccgtttcaccttcccgcttccccaaaaatggtaccggtcacaacatgaagcctgaaaattgtcaaagacccatggatgatagaagctttgaggttattgcatggctaaaacttggccaagaaatgaccatggaggcacctcggaaaaacgattctttatttgacaggtgtagctctgaaattgggaaattaacaacttgttatgatgatttcacgatattgaaatag

SEQ ID NO: 71342 - DNA, 135 bp, Glycine max
  Peptide Sequence Number=SeqID_163027
atgggtgcaaatgattcatcattcatgaataggggaccagtcactagaggcatgagcaagaggctcgaagaggattgggctagagctgctgaagaaagccctaggattctcatgaacctcagggtagatttctga

SEQ ID NO: 71343 - DNA, 363 bp, Glycine max
  Peptide Sequence Number=SeqID_163028
atgcatcaccaaaagaagaaaactctaaatgaggcttcactgttatcaagcaagtcggagacccagcatgactacagatcaacctccactccttatggctcacatagacctagacaacaagggtgttgcccttcctcctttgtatcctcaagtgcgatgaggaattcagaccctaatttcgtttgggaactatcattcgctgatattttgattctagctaaccgaaaggtgttgttcaacaccggtttctgcacaaggcgtgagatcgttcaacgttttggtcaagcatgtgaaaaatacccaaggagaggggcaaaagggttattccaggaaattttctggactctggctcgcctaggctag

SEQ ID NO: 71344 - DNA, 231 bp, Glycine max
  Peptide Sequence Number=SeqID_163029
atgccatatgttgacttactcccctgtctgttcgataatgcaatagcagtcataagcccaacaaagatttctcaacctctgtttcccaaaggatacaaccctaacgtgacatgtgcttatcatgggggagttctggggcattccattgagcattgtatgagcttgaaacataaggtgcaaagtctgattgatgcaggctggccgagatttgaggaggagaatcgctcgtga

SEQ ID NO: 71345 - DNA, 700 bp, Glycine max
  Peptide Sequence Number=SeqID_163030
ggttgagtctactcattgggccttaaagagactactgcaaaatagccttagagacctacatagtatttgggaagccatgaacaacatgatcacgtatgctttaaaccagattgttgttgagtttgagtgtgtacattatgctggcaaaaacagttctcattgtggatgtataatgagaactactcacggtcttccatgtgcatgtttatctgagctcgaagtcagcataaccgaagagatagaaaccatatccaagcaatttgaagagcttgataaactgatgagcaaacatcaaagatcaacgaagcgtgattcatcttactgggagtatgtggatgcattgcattctatgcaaaatcacaattctttagtcaaacgagctgcaacattatctgaacaaccaaaaccaagaaggaactttcccgtgttggatcaatttcattcgtgcattcatgatttcattgaaaacattatcgatgtcaaacctgatgataattttgaatatcgtgcaattgctgccttattaggcatagatgaacatccatggtatttggttcatatccatatgcttaaagaacttgaaaaatggtctgatgagtatatcaacctgcttggtggcatagacagatttaaggagttaaagcggtcgctacttgttgatggattatccatggaatataaatttcttgttacgttttga

SEQ ID NO: 71346 - DNA, 507 bp, Glycine max
  Peptide Sequence Number=SeqID_163031
atggctaccataagattaagtcctctgattccatgttccttggacactagtgagaggggatttatatttgcttttgcagagaggaaaggtcactacacccttgatgatgtagcatcgttgttacatctgcccattataggtgccttccatacctttgatgctcttgatgtagacaaagttgtggacttgatagttaagttgcttgaagtgcagtattggatctacaagcatttccatactattgcttcgtgtgttgctaatgaggattatcatgagaggaaaccacatgcttgtcgatggaaagaatttaagcttatctccttattttctggacaaatcaaatggggttcatgtattgtgatagaccaaccagagagggtagtacgacagtttggttatgtgcagaccattcctccacaccttgctactccatctgtatctatagaggagattgacaatagatggatgcagttttctgaataccttgcacttgtggatcatatttga

SEQ ID NO: 71347 - DNA, 1641 bp, Glycine max
  Peptide Sequence Number=SeqID_163032
atgggatcaaatccggcgcctttggttaaaaagaagttctatcaagtcaagatcaagaacctgggagacctaactatggtagaggtctccatgaaggccattgcctccctcacccagtattatgaccaacccttaaggtgcttcacctttggggacttccagttaacacccacggtagaagagtttgatgagatcctgggatgcccgctgggaggaaggaagccatatcttttctcaaggttctatccctccttggctagaatttctaaaatagtcaaaatctcggcacaggaattggaccaggggaagcaagtcaaaaatggagtggttggcgtaccaaggaaatgtttggaagcaaaggcaagagccttggcaagtcaagacgaatgggctctgttcattgatgtcctagcactcttgatcttcagagtggtcctctttccaaacatagatgggttggtggacctggcagcgattgacgcttttcttgcctttcacgacctcaaggaaagctcggttgtcgctatcttagccgacctatatgacacattcgaccgaagatgtgagaaggacagtgcgaggatcgtttgttgtacaccagccctctacgtatgtttggtcgcacaccttttctgcctagaaaggaggcatgtttgctcgctagaaggtcgccgctcgtgcaccgagaaaagagaggcaaattgggatcgactcttagcaaacaaagaaggagtgtctatcaattggttccctcgatggaaggaaggaagagttgggattcttttctcatgtggaggatttccaaacgttcccttgatggggatgagggccctagcgggggtccttcaaggagtccgcaaggcatgggaaatggtgcaaaagaaggacaaagaacttaggggaagtagcaatggggccgtcggcggctaccataggttgaaagccgctaaggaggaggaggttgaagccccggaagaaagcaaagaggtgcaagccctcaaaatggagcttgagaaagcccaagcggtcaaggaaaagttcaagtcaacagccgttaggatccgaaaggagaatgccgaactaagagacgtcaacatagccaccgccaaggccttggagcaagagaccaaaagggcccgcaaggaagaatacggtcggaacaagttccgaggggccttgtggggcagtaacagcgaacttaaactccgaagagaggagagggaccagtcacaagtagaaggcatgattctgaaagacgaattgaagacttgcctgaggtcaaaaaggagcttgtcccaaaggctgagcgagaccgaaacaaacatgttggccatcatcagcaagtacaaagaagaattagatttggccaccgcccatgagcacaaggtggtggatgaatacgcccaagtgtacacagaaaaggaggctaggggaagggtgattgactcattacaccgagaagcgatgatgtggatggaccggtttgctcttactttgaacgggagtcaagatcttctccgattactagtaaaggctaaagcaatggcggacgcatactccacccccgaagaaatccatgggctcctcagctattgtcagcatatgatagacttgacggcccatataattaggaaccattag

SEQ ID NO: 71348 - DNA, 501 bp, Glycine max
  Peptide Sequence Number=SeqID_163033
atgaaatcttcaattgtctcatataagcaatcattgcaaaaccaagggggagtaaactatatgcaaatagatatttttgttgttgttgctcctaacctacaagtggttgtcatcatcaaaaagggggagaatgtaaatcatgaagattttgatgatgtcaagaagatcaagccttggataatggttgtcatcatcaaaaagggggagaatgtaaatcatgcaggttttgatgatgtcaaaaagaatttgcttgacaaagggggagaatgtgaaattgtgaatcatgcatatcttgatgatgtcgaaaagaaatcacttgattatcatcatcaaaaagggggagaatttgcttcaaaggataagcatggcttcaagattaatacaagattgcttcaacaaacaaatccttgcttcaagattaactcgagatcaagccttgccttaaaacaaagtgctttcaagacatgcaaggctctggtaatcgattaccaggcagtgtaa

SEQ ID NO: 71349 - DNA, 273 bp, Glycine max
  Peptide Sequence Number=SeqID_163034
atggcgttcttgagtgatggggagaagttttgggtgaagaaactcaccctccctcctctttttaaactaattcatgcagggggatgctcgcccaggcgagctaaccctgtgcattttttttttgcaaaattctttgcgaagaaattgcgtgttccctttgggtcagcgctcgcttacttgaagtccctaggccggacgtgggatgatgatctacggaccacgagcctagcgtctgctcgtactcgtccccaagcatctgaaagcaggaaatga

SEQ ID NO: 71350 - DNA, 285 bp, Glycine max
  Peptide Sequence Number=SeqID_163035
atggctacaccaccaagctaccttcctcctaattccccagcttctttagagtctacctctaggaggactagacaatgtacacggctcataagattgactattagacacttagatcaactgaggctagtggttcatgtgaacccttccgttaggaaagctttaggcccacttaaagagaatttccacaccaatttgggaacaatagctcaatataagagccaatttgagattccaaaagtgtcaaattccagaaagaaggtcatttcattggtgggtacaagatga

SEQ ID NO: 71351 - DNA, 186 bp, Glycine max
  Peptide Sequence Number=SeqID_163036
atgcaatcacaaggactcgcactacctactgagcctgaggttggtcttttcactacacgtgtcaggacaaaggagagttgtattgatccctcagggaacgaccttgacacgggagttgtgggactggggaaacctgcagataggtcggatccttatgttgatgatcccctatatctgatgacattg

SEQ ID NO: 71352 - DNA, 747 bp, Glycine max
  Peptide Sequence Number=SeqID_163037
atggagagaggcagaaaagaaaggcctaaggaagtggaatcttatttctctcctctttcaaggaaatcaaagtgcaccggagagaagttcctatggagaaagacacaagtcttcctatggagaaagcttttgaaatctcgaaagatctcaaagatcgattttcgcattctaataagtttcacattgctgatcttcaagatcaaatccagaattgtaagcaagcatgaaagagagtttgttggtgattttacttcacaatcacctacagatactgttgctttttcctcaatcaatgacaatatcaatgtcacctcctcccataaaagtttttccaataatcacaaggttcctagtaattctggtaaaggacctaaagacaataagtttggtactcattgtggaaaaaccaaccatactgttgaaacatgttttttcaagtatggatttcctactggttataggaatcgtggtataggaggatcttcaaattttaagtcttttgctagcttggctgaagtagattatgatataacttcacaaactattgctttggaggatggtttaacccgagatcagtttcgtttgtcgaaagaccagtacaatgccatcatagctcttcttcaacagaccaaggattcttctacttctattttaatcacattcaacattctgtggttaattagtcagacctccaacttcaagatgattggagtagctaagcaacaccatggcttttttcatctgtag

SEQ ID NO: 71353 - DNA, 609 bp, Glycine max
  Peptide Sequence Number=SeqID_163038
atgaccggaaggcttcttgccggttcattggcttttgaaagccgcatcctccattaccttatagttcgcattttgcttcctagatcttcaaaccttgcccaggtttctgaagaagatctcattgtcatgtgggcctttcataaaggtttacaaattgattgggcacatcttgttagatatcgcatgcataaggcattgcgattgaatgccccattgccttatcctcatctagttactcttttccttcaacacttcaacatccctcttgattctgaaccttatgttccaatcaagagatcattccttataggcgcttcagtcatagcatcctttggatatgttaaagagcatgatggatcttggataaagaagggtgctagaaatgttggtgaagaaggacatgagggagaagattcatctcttctttctaagattttggaaaggtttgatggtcttcaaacctttgttggtgagaggtttgatactttggaactgcaagtggatatgcgcttcaatgaaatggagtcaagaatgactaaggttgaagaagatgtatcttacatctggtcaagctttgatcttccaccgccgtcgtcaccatcatcttag

SEQ ID NO: 71354 - DNA, 282 bp, Glycine max
  Peptide Sequence Number=SeqID_163039
atgaatgcgatgccacccgtggaggagttgggactggcggtgaggtccgagatgttgctaatgaagaagttgttgagtagggaggttattcggggtgacgaaaatcagaagagcaatcgcataagggagagagtaaaggaggtgcaacaaaacgcactgaatgctttgtctgagggtggttcatcctatgccacaccgtctcactgttcgcaaaaggtgataggaacaaagctctgttattttgaagcaaaggaaattgttgtttcagctgtaactctgtaa

SEQ ID NO: 71355 - DNA, 582 bp, Glycine max
  Peptide Sequence Number=SeqID_163040
atgaaggacaaaagtattgggaaggatatataccatagtgttgtcctccctaaggtatttgaaatcaatggagtcataaggaagttcttgtatgagacactcatagatgtgcaagacaaaatctacctagacaaggctgatgtgaataaaagaagagagatggatagaggaggaaaattggataatggacatagaatgagggtttctcctattagagatactcaggctaggatgtattcattagagagctttgagtctccggagagggtactgaagaagaaagagtggacacaggtgaaaccattgcttaagctgagcaaagaaccaagaaaaggatggacacgcctttgtccaaggcctacacctaagaagctaacacaaaatccttcgtccactattgaacacctaaaggcaatcagtgagcctaagagtgacgctaaaaggcctattgtcttcaagaagaaaaaagttgcaccctcttcggatgagacttatatgcctcaagcgaagaaggtgaaaccaacgcaagaggctcctcctcctcctcctcctcctcttactcaacctcgtactagcaaatga

SEQ ID NO: 71356 - DNA, 318 bp, Glycine max
  Peptide Sequence Number=SeqID_163041
atgaggaccgccgagattcaaccaaggaaggaatttcacacagggctcaagcttgaggaatcatccggggaaccaattcaacaaggagcaaaaaagagagaaaatgttgagaaggaaaagagaattgaggaggatgtgcgtgatgaggaagaagaaaagaaagaagaagaagaaaaagataagagtaaggagagtggtgatgatctcaaccaccaaaaccaagaccatgagccagttaactcaggaggccagaaaagagatactactagcctcatcaagggagacactgtaccctttgatgccataaaaaaaggataa

SEQ ID NO: 71357 - DNA, 390 bp, Glycine max
  Peptide Sequence Number=SeqID_163042
atggtgcttcttattaggccggccttggattcattcagttggggtggtcccttcaacgctacaccaaaagttgaagtttgtggtagaggggcagttaattatagtcttgggagaagaagacattcttgtgagttttccttcttctacaccttatgtggaggccgcagaggagtccttagaaatgtcctttcaagccttagaagtggtgagcaatgcttatgtggattcttccccggtacaaccacgctcatctggggccacattgatggtagcttgagtaatgttgggaaatggatacgagcccgaaatgggtatgggccggaacagcaatggtgtagcaagtttggtggagttcacacggaaccgcagaaggtttggactgggatatga

SEQ ID NO: 71358 - DNA, 228 bp, Glycine max
  Peptide Sequence Number=SeqID_163043
atggatcttttcatggcaatacagcttgcggcgttcttggccagttcaaaatccaaagaaagtcttgcccagaaccttaaggaagttctccagctacttcaacaagaagaagaggaggaatcttcaaagaaggatgtcggatcttcaaaagacattgatgaccaagatgatgatcctttctaccagaatgaggatgattgttttggcatctcattagaagatgattaa

SEQ ID NO: 71359 - DNA, 706 bp, Glycine max
  Peptide Sequence Number=SeqID_163044
atgaagaagatccaaggcctacaagcttcacatggagctacatcaggaagtaatgtagaaactactcctgctgacccatcatgcggcaaatatgtgagtttaaaacccactatggggttatacttgcaacgacaacgtactacggtgttggtggccatagggaaaatatgtgaggggggatcttccattcacaatgtcacttatgctgatgatgttgtaagggtgagtgttgacgaatttatagaaggtgatgccgaagtgcccttcccaacatcagagattcaatatgtcaagcaggctcttcaaacattcattgcatggccaaaaaatcttgtgaaaaaagtgtcacatgaggagtcccatacaagtccaaagaaacttcctaaaacagatgaaagggggatgaatgatattgaacatgatccattgcgtcaacttattaagagcctatattacatgtacgacacacctattgagttgaagtgggatggcagcaaatttgggcttccaaatgttgatgctttgttcttcttgacattctctgatgtaaatgaaatagtagcaggatacaaatgtttgaacatatctatactacaattatggatgttgtttttggatgagtggagctcaactttgggtcatgcttccgtgtatggattccttgagccacaatcgatacaccatgcaaaggaccgacgcactgaat

SEQ ID NO: 71360 - DNA, 516 bp, Glycine max
  Peptide Sequence Number=SeqID_163045
atggagggatctggaagctcaggcaaaaggattgaagtaagcctaagaaggggtaaatttgattatgttgcttcaacgagttctggcaataggaggcctagggcaggtggagcaaagaaaaaggagggagatgcccacactgtgactgcaacacccacatggccaagctcccaacaaacccctcatatcccaatgtatcattatcccacgcaccaatataattactcggccaatatcggatctcccccctgcccgacgcctctccgaccgagaatgcccaatcaaccacaaagacctccccaacatcacccacaaaatccattccctacactgcctagaccgagtgcaaatcccaaccccaatacaaacaccaacccaaagaggaacttcccagagagaaaacctgtggagttcaccccaatcccaatgtcatacgccaacctgctaccatccttactctataaccaaatggccatagtgagcctaggaaaggtctatcaccctctatttccctga

SEQ ID NO: 71361 - DNA, 611 bp, Glycine max
  Peptide Sequence Number=SeqID_163046
atgaaaacgttaggcgaatttatcgtcgagaaacagcacgacttctctcacgccaccggcgagctgaccgcgttactttctgcaattaaactgggcgccaaaatcatccaccgcgacatcaacaaggccggcctggttgatattctgggcaccagcggggtgtccaacgtacagggcgaagttcagatgaaactggacctgtacgcgaacgaaaaactgaaagcggcgttgaaagcgcgtggtgaagttgcgggtatcgcttccgaagaagaagatgaaatcgtgatattcgacggcgagcgagctgaaaatgccaagtatgtcgttttgatggatccgttggacggttcgtccaacatcgatgtcaacgtctcggtcggtacgattttctctatctaccgtcgcatcacgccggtcggcacgccggtgaccgaagaagacttcctgcagccgggcagcgcccaggtcgcagcgggttatgtggtttacggttcgtccaccatgctggtgtacaccaccggttacggcgtccacgccttcacctacgacccgtctctgggcgtattctgcctctcccacgagaaagtgcgcttcccggcgagcggcaacat

SEQ ID NO: 71362 - DNA, 561 bp, Glycine max
  Peptide Sequence Number=SeqID_163047
atgggtaaagtagaggaggcgcaagagcagatgaaggtcgacatggaggccacgaaagagcaaatggacacaatgatggaggccatgatgagcatgaagaagataatggaagccaatgcagttgcagttgccgctaccagcgctgttgctaaggtgaacccgatgcccccatttggcctcaaccaaatgaatcatccaacctcagctagggtaggcaaagatttggaaagtacgggcgacccccattatgcgcaaattcaaaacaagcatgccttcccaccatatggcttgcctcccaactatacacaacccaatgtggcatacattcccaatgaggatgtcaataactccgctcccatactcattgagagccgacaacctcatcatgcacatggccctcagtatcacccacaactgcacttcttgcattccacaacaagtaaaaaccctcgtgctatggcggaaatgggaaagttggatcatctagaggaaaggctcagggccattaaaggaggtgaagattatgcctttgctaatatagaagagttggggatcctctag

SEQ ID NO: 71363 - DNA, 216 bp, Glycine max
  Peptide Sequence Number=SeqID_163048
atggagaattggactaagcatgtagtcactacgcatagctcaaaactcgaaggtggaggacacatgaacgaaaaggcaattcatggggctccgaaaaagggtgagattggagaattgcactatgcaatcactacgcatggctccaaactcgaaggtggacacatgaacgaaaacgcacttcttggggctgctacaatattgagaatggagaattga

SEQ ID NO: 71364 - DNA, 2524 bp, Glycine max
  Peptide Sequence Number=SeqID_163049
ctgaaggatgcgcaggaacaattcgatcaggtcaaaccgttgctcggcagcctggccggcgcaggctatcagggcgccatcgacgccgcgcgcaaaatattctggtgctgttcgccgccggcaacgacggcaactacaaccagccggatgtgatcagcgggctggcctacttcgtgccggacatcgcgccaaactggctgtcggtcgccagcgtggcgcaggatgcggcatcgaccaacagcgtgccttacaccatcagcagcttctcttcccgctgcggctataccgccagcttctgcgtctcgtcgccgggcacccgggtatacagctcggtgattgaaggcaccagcgtggagaatctgacgaccggctacgccaaatacagcggcacctcgatggcggcgccgcacgtggccggcagcgtcgcggtgctgatggagcgtttcccgtatctgaatggcgcgcaggtggcggaagtgctgaaaaccaccgccaccgacatgggggcgccgggcatcgacgcgctctacggctgggggatgatcaacctgggcaaagccatcaacggccctggcatgttggcgaccgtcgaggatattcccgaagaattccgcatcccggatccgacgggcgtggcctacggcccgacccagttcgtggtggatctgccgggcgtcggcgcggtgctggacaagggcaaaccgaccgagcgcgtctgcagcgatgtgctgtgcggcctggacttctggagtaacgacatctccggccacggcggcctgaccaaagaagggatgggcacgctggtgctgacgggtaacaacacctattccggcccgacgctggtcaatcaggggcggttggcagtcaacggctcggtcacttcggccgtcagcgtgcagagcggcggcatcgtcggcggcagcggtacggtcggttcgctgaccgcccgtcagggcggcaccgtggcgccgggcaactcgatcggcactttgaacgtggcgggtaacgtcagcttcgagccgggttcgcgctacgcggtggaagtggggccgaacggccagagcgatcggatccagagcagcggatcggcgacgatcggcggcggcgaggtggcggtgacgctggagaacagccccaacctgctgacgcaaagcgaggtgcgcagcctgctgggccagcagtacaccatcctgagcgcgcagcagggggtgagcgggcagtttgacgcggtggcgccgaactacctgttcctcggcaccgggctgagctaccagccgaccggggtgacgctgagcgtcgggcgcaacggcaccagcttcgccagcgtggcgcagacgccgaacgagcgagcggtggcggcggcggcggatgcgctggcggcgggcaacccggtgtacgagagcctgctcggcagacggcatcgaaagcgggcgaagcgcggcggcattgcgcggcgacaagcagcacacggacgcgacggtgtcgacgctgggcctgcgtgcggacaccgaatggcaggtgagcgcgggcacgacggtggcgctgcgcagcgagctggggtggcaacaccagtacggcgggctggagcgtggcaccgggctgcggttcaacggcggcaacgcgccgttcgtggtggacagcgtgccggtctcgcgcgacggcatggtgctgaaggcgggggcggaagtggcggtgaacgagaacgccacgctgtcgctgggctacggcgggctgctgtcgcagaaccatcaggacaacagcgtcaacgccggttttacctggcgcttctgacgttcagcgatcatcgcaatgaccacggagccggcatgccggctccgtttttatttgcggctgcgggattagcgctaaaggctcaagccccgtttgatttgcgcagtccgagcgatgtgctcatcgtctcagtagcggcaacggaacaaattttccctggtgttactatggttattattaaaaaacgtgctggtgttattttttatagtgtattgctgtatgtctcttttgataccatgtttgacgatgcaacatgggagctgtttttacattacgggattggaaaacgtcagcatgcccgcgagctcagccgcatcttggatctgagtttttcacatgcgcaccgcaaactgaaagggcaaagcccctggacgctggaacagatcaacagcgtcgcggccgcgttgggagaaacgccggcggcgatcgccgatttgagcgccgaacacgagaccaccgagccaaacatggcgcgcgatgccatctttttcgtggcgggggtggcgatgccttgcgtcgggcacattggcgatgagcttcctgccgggcggccggcggaatttgtggcgctgcgcgtggaagggcagtggcgtatctatcgcgccgatgaggcaccggcaggcccgcgttacggcgtcgatctgatcgaaatccggcccggcttcggcgacgacgagcggctgagcatcgcggtattggacgattcgcataaggcggccgatgagctggccaa

SEQ ID NO: 71365 - DNA, 495 bp, Glycine max
  Peptide Sequence Number=SeqID_163050
atgattatgcgtaaattgacggctttatttattgcttccacgctggccctgggttctgcttccgcggcgttcgctgcagacaccactgccccggcggcggatgcggcgccgatgaaaatgatgcatcacaagggtgaaggcaaaggcggcccgttcgccgggctgaacctgaccgagcagcagcgccagcagatgcgcgatatcatgaaagagtggcaccagaagcgcgggccgggcatgaaagaggagcgccaggcgctgcacaatctggtcgcttccgacagctttgatgaagcgaaggcgaaggcgcaaattgacgcgattggcaaagcgcaatccgaacgcatgctggagcgcgccaaagcggaaaataaaatgtataacctgctgacccctgagcagaaaaaacaatacaatgagaattatcagaaacgtgagcaaaagatgatggaccatatgaataaaatgaaggcgcagatgtcctccgatcagtaa

SEQ ID NO: 71366 - DNA, 138 bp, Glycine max
  Peptide Sequence Number=SeqID_163051
atggttaacaaatcagaacgaagagaatgttattggggcagggacgaggataagggctatgtaggagtgcgtgagctcaatgtaaaggtgggcaactggggatggtgtgcttatgcctggcttgtggaagtgggatag

SEQ ID NO: 71367 - DNA, 399 bp, Glycine max
  Peptide Sequence Number=SeqID_163052
atggcaatcccaaaggaagaaccacctaaaaaatgggttttcctttgccggcagtcacttactttgccgaaaatttatctggccaaggttcaaagtagtctaaggttgtgtctcaacggggtcttttatcgtgggagcccgatcttgatatctggggcacaacaaattcgtgtgtcaaggtatcggtctcgggttgaacttccatatcatttccacaaggcacgttgtcgcaacatgcccttttgcgggcgagcgaaggcgaggctcacgggtgcgctttccaaaggaggaaggatgcgcggagtcgccaccaacgtttatttgtggaaaacgtcagaaaaactgaaggaaatcggtcaaaatgaaaattctaagttcgagagttgtatttacgcttga

SEQ ID NO: 71368 - DNA, 360 bp, Glycine max
  misc_feature (258)..(258): n is a, c, g, or t
  Peptide Sequence Number=SeqID_163053
atggatgggcaatggttgaagaaggacgcgcaacctccgcaagacgaatgtactccctctcctccgcctcaacgagatgactcctcagccctcatgcatgaagttctttcgaagttacgaggcctccgcacctatgttggtgaacgctttgattccttggatggtcgtattgatgccattgatgctcactttgaaggaatggatacccgcatcactcagcttgaggaggatgaaattaaaattgtcatcattaaaaantggggagattgtacaagtaaagactttgatgttttgatgatgccaaaggaccatgtgcttctcaattttaattcaagaggatcacgcgcttctcaagtttaa

SEQ ID NO: 71369 - DNA, 378 bp, Glycine max
  Peptide Sequence Number=SeqID_163054
atggttccccgcatgtcatcgggcccaccgcctctggatgacaaaaggtacagaatgaccataatttgtctatgcgtgccatcagacttgatcgtctctggatggcggaaaggtgtgcggatgaccataatttgtctccgcctatcatcgggctcgccgcctctggatgacaaaaggtgcagaatgaccataatttgtctctgcgttccatcggactcgatcgtctctggatggcaaaagggaaaggattatggtgagttgggactttggctcaaggcttgtggaacggctggacatgatatttgtcagggtttggccagcggttcagggataaaggggatgtcccacattatttccatgatacacatgcaacaatga

SEQ ID NO: 71370 - DNA, 237 bp, Glycine max
  Peptide Sequence Number=SeqID_163055
atggctgagaagacaaagaaaagattggaagaagttgcccagtccagaagcactgagggcgtcattgaccctccatctcccatcagacgccacgtgaagtggaagctagcccacaccaagaaaattgggcagatgatgcctatgacagcaaaggaaatagctgagaagattaggattctttggacgagtaggcgtcatagggatcgttcgtcccccatggacgttaggatgtcctaa

SEQ ID NO: 71371 - DNA, 699 bp, Glycine max
  Peptide Sequence Number=SeqID_163056
atgtaccctctcttgttctcagttacaacaacccaagtagatgtaccctctacttgtaccaccaaggatgtaccctccaatgtgttaagacaaagttctcaggcggttagtctattgaatctttatgaaggggaaacaaaagatatctcaggcgcttgcttctacatgttggtcctcctttggttgttgcgatgcctggccctacacctacctggggacgaagtatttctcgatgaaggccctattaataggcagctggatgaccttgctgggggcgacgggttctccgtagaactggtagaggctcgtgatcatagcgtgaaacccagggccctattggacttctccgagtccacaggaatcatgctaagtagcaatgtcatccatatctgtgtaagggttgtcatgctggtgcgcatgatccgcaccccgtctccttgcggcatccaggcgaagttgatgcaatccgaccccccaagggtattggatagaagaatccaagaggattgggctagagctactaaagaaggccctagggttctcatgaacctagggtggatttctgagcccatgggtcaagctctagcttctcatctcaaggaggtgaacttagctattagtgagcttctcaaggaagttttctcaaagaagcttctcaaagaagttttctcaagaaagcttctcaaggaagctacctag

SEQ ID NO: 71372 - DNA, 249 bp, Glycine max
  Peptide Sequence Number=SeqID_163057
atgatagaggtggcgagtattacggaagataggatgaaaccgggcaacacccaggtccatttgctaagcttcttcagaaacatgacatttgtgcgcaatacacaatgcccgatacaccacaacaaaatggtgtatcagaaaggcgtaaatagaactttactggatatgggttctagtaaggcagttccaaagacaccttttgaactatggacaaataggacacctagtataaggcacttacatgtttag

SEQ ID NO: 71373 - DNA, 327 bp, Glycine max
  Peptide Sequence Number=SeqID_163058
atgtctgctagcgatcatgccattttgttacaggttgtaccatttatagtgaggctcatgagtcaggtcattgtattcccattgaagaacacactcaggaagttcattacatgggaaatcaacagagacaaggatacaatcaaggaggattttcaggattccagcaagttagttgagaagtcatccaatagctttggagtaaatatcgagaaaaatctcaaagaagagtgtaaagttgttatgacaagaagcatgaagcttgtggcggctgaggatgaggatgttgttgctttgaaggacactctgttaaaaagaggaatggggtaa

SEQ ID NO: 71374 - DNA, 1119 bp, Glycine max
  Peptide Sequence Number=SeqID_163059
atgcctcgatcctcgctgattttcctgcctgcgttgtttattcccttttcgctgcttgctgcgccagaggcggtcagggttgagatgctgcaaaacagactcgatcatccctggtctctggcgtttctgccggacaataacgggctgctggtaaccctgaagggcggccagcttaaacactggcaggccgggaaagggctttccgatccgatcgtcggtgtaccaaaggtttgggcaaacgggcagggcggattgctggatgtcgtcctcgccccggattttaaacaatcacgccgcatctggctcagctacgccgaagcgggaaaagacggcaaagccggaacggcagtaggctatggccggttaagtgacgatctgacgcgcattgaggctttccaggtggtgttccgccagacgccgaaactctctaccggtaaccattttggtggccgactggtgttcgacggcaaaggctatctctttatcggactcggcgagaacaaccagcgcccgacggcgcaggatctggacaagctacagggtaaagtcgtgcgtctgacggaggacggaaacgtgccgccggataacccgtttgtgcgtacgcccggcgcgaggccggaaatctggtcttacggcattcgtaatccgcagggaatggcgatgaacccctggagcgatacgctgtggctgaacgagcacggtccgcgcggcggtgacgagatcaacattcccgagaaaggcaaaaactacggctggccgctggcgacgcacggtatcaactacagcgggctgaaaattccggaagccaaaggcgagcacgttgaggggaccgaaaaacctctgtttgtctggaaagtttcaccggcggtaagcggcatggcgttttataacagcgacgtttttccgcagtggaaaaacaagctgtttattggcgcgctgaaggagaaggacgtgatcgtgctcagcgtgaaggataacaaggtcacggaggacggacgcattctgggcgaccgggatcaacgtattcgtgatgtgcgggtggggccggatgggtatctgtatgtcctgaccgatgagacggacgggcaactgttaaaagtcagcccgtccggggcgtga

SEQ ID NO: 71375 - DNA, 812 bp, Glycine max
  Peptide Sequence Number=SeqID_163060
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttccagagaagctacgctgaggttcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71376 - DNA, 138 bp, Glycine max
  Peptide Sequence Number=SeqID_163061
atgtcagcctcttctagccgagactgcgaaaaagtctcatttgctatctgtcgtaacctacccttcggcaagagggcgacgcgagactcacaggtattagcaccccacacgtctatcgcaagagacgatagcctttaa

SEQ ID NO: 71377 - DNA, 186 bp, Glycine max
  Peptide Sequence Number=SeqID_163062
atggtggaggatatgcacgaaccgcacttggcaatcaattgttggcactccggactcgatggtggaggatgcatgaatggcaatcaatttatggggctccgaataatatttgatgatggaggttccacgaacagcgctagggaatcaattcgtagggcttcggacacgttggtggaggatacatga

SEQ ID NO: 71378 - DNA, 224 bp, Glycine max
  Peptide Sequence Number=SeqID_163063
atggcgaggacatatagtcctctaaaggtgataggtactagtacccaagggtccacctttatgagaaagcagagatcgactcatcgagagggccggtcatccacagattggacacgagatgtagaaatctatgcagttagcatgattttagggatgcccctatgttcacttgaggttccatgcacgattgcccctcatttgcccccaagtgtaaaggctttgag

SEQ ID NO: 71379 - DNA, 138 bp, Glycine max
  Peptide Sequence Number=SeqID_163064
atgtcactcattgatgcaatcctcactaggaaggcaccagtcactagagccatgagcaagaggctccaagaggattgggctagagctgctgaagaaggccctagggttctcatgaacctcaggggctccatattgtag

SEQ ID NO: 71380 - DNA, 282 bp, Glycine max
  Peptide Sequence Number=SeqID_163065
atggaggaacaagagaagggtttgtctggagtatcagaaaccacagtgactcacgaggagaaagtgagggttgaaaccctagaagggtctgtggattgtcggggtgtagttctgatggagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 71381 - DNA, 558 bp, Glycine max
  Peptide Sequence Number=SeqID_163066
atggacagagcgaggttggtgtacggacttattatgaagatggacatggatgtgggctccatcatctcaggccagatctctcagatggcccagcccaactcctctaggttgggctttcctgctcttatcacagccctgtgcatcgccagaggagtagtatctgactcactcaccttcgagtccctcagcccgaccattaacttggcctatattaggaagaattgttggaacccagatgatcccactattacattccctgggtcccgcaaggccaaggctagggctccctcatatgcttcaacttcagttcccacttcgacaccagcccctccaacaccagtctcagctccagctggcctttccatgcagagcacaaatgcattcgtgtcgatgctgcagagccttcaccccggccttttcctggtggcttggcctagagtccaaccttcctttttggggggaggtgagactcctgcagcccaggaaccgcaggcacaggacatgccaaaggctggggaggctgaggagactgatcgaggccgtacccgaatcaaataa

SEQ ID NO: 71382 - DNA, 498 bp, Glycine max
  Peptide Sequence Number=SeqID_163067
atggagctcattgagaatatgaccgctagtgatcacgctattttgtgtgataggacacacatacccaccaaaagaagtctgttggagctttcttcacaagacgcattgttggcacagaacaacctgttagctaaacaacttgaatcactcacggagacacttagcaaattgccaacacagctgcaagtggctcaacaatctcattcagcggttatacatgttggaggctgcaatatttgtggaggggctcatgaatccggttgttgtatagcccaagatgaggcaactaaagagctggccaaacaaatagctggaagttcttctaaaggttttggagcaaatacagagcagaatcccaaagaagagtataaagttgttatcacaagaagcaaagggggattagttgtggagaatgagagtggcaccaatgaaggagaattaggagttgaagaagagaaagaaaaagagggaaatcaaatgggagagagagaaaaatga

SEQ ID NO: 71383 - DNA, 210 bp, Glycine max
  Peptide Sequence Number=SeqID_163068
aaaatagaagaaaatgatggcacatcagagacccctgcaagcacacccatggaggtcactgcagaggagggcgcagcaaaggcatgcatcgacgaggactatatagcggatgtgactacgacacagggaacttgggacccatggcccacctcagctcaggatgaccctactccacctcaagatgatccagctccagcaaaggatcattga

SEQ ID NO: 71384 - DNA, 84 bp, Glycine max
  Peptide Sequence Number=SeqID_163069
atgagggttcaggagttgtttacacacgaggaaggggtcgacaagggtattgccctcgcttttacgtattctcaggtgcgatga

SEQ ID NO: 71385 - DNA, 405 bp, Glycine max
  Peptide Sequence Number=SeqID_163070
atggagagtaaggaaccaatggttctattccatctgcaagaaggtgagattgcgttgagaaaatggatgatggatagagttacactaggtataatgggtgaagagcttgaggatcaatgtatattgtattcgtatatggcgatcactcccaactgtcatccatgtaattgtataagaccattaagacctaggaggcttggtggcaaaggttgggccctactacgtgataagtgtgctagttatgcgctcaggatctcaaaaccagtcggcatagctgaagttatcaaggatagaggagaccattctaatatgacgtccgagaagattgggaagtacaaagaactattatgccagttagagcctttgttcgaggagtatgactatcttcctaaggacatgtcctag

SEQ ID NO: 71386 - DNA, 255 bp, Glycine max
  Peptide Sequence Number=SeqID_163071
atgtcccatgtatggcgtcgcttgtcaatgtcaggattcacaagcgattctcctcaaatttcagccagcccgcatcaattagaccttgcaccttatgcttcagggtcctacaatgctcaatggaataccccggggttcctccatgataagcacatgttgcattcaagttgtatcctcgaaaaaatggaggttgaggaaccttggttggggttatggctaccattgaattatggagtagatatgggagcaagttag

SEQ ID NO: 71387 - DNA, 318 bp, Glycine max
  Peptide Sequence Number=SeqID_163072
atggtgcaactatggtttggaattagggttaaagaacccggtggaccattcggtggaccattcgtgcgtcctccaccttcaagtccagagccctatgaattgattgtcattcatgcatcctccaccatcttatccggagccccacgaattgattgcctagcgctgttcgtgcgtcctccaccatcaagtccggagccccatgaattgattgtcattcatgtatcctccaccatcgagtccggagccccacgaattgattgcctagcgctgttcatgagtcctccaccatcaaatcatatccggagccctatgaattga

SEQ ID NO: 71388 - DNA, 402 bp, Glycine max
  Peptide Sequence Number=SeqID_163073
atggacccagagaagtccaacatggcactgggatttccagtattgatcacagatctctgccagttctacgaggtactggtctcgcccacaaagctcatctggcccctcattaataggtccttcattgagaagtactacatgccaaggcaggcacaacagctagggcaagaccagcagcagctggcgatgcacgcatacatgcaagatttggctgaccagcaggcggcaaaccataggggtcaggtgcagttgaacaataacttctatcagtatacacttcaccagcagcaccaggaccccaacccttacccgtggcctactcccaagcagttcggagccattatcgcatggcctggggacaggcctaattttcaaggagtctcggattacaactttgtctag

SEQ ID NO: 71389 - DNA, 237 bp, Glycine max
  Peptide Sequence Number=SeqID_163074
atggcagctcggtctggcgagccaagacttacacctgaagtaactggctcacctaagagagctggttcattcaggctgaagtcttttgagggcccatgcgagtcagaggctagcttgggtgatctagggtccaaaaaacttagaaaaaagacccttttgcccctcctttttggtatctttcacattcctgatcaaaacgttgaacgatctcctgttttgtgtggtaactggtgttga

SEQ ID NO: 71390 - DNA, 978 bp, Glycine max
  Peptide Sequence Number=SeqID_163075
atggcacctacacctcgcacacacattgagatattaggccctatacctgggtctatcttttcttcttccctattccgcgagcctttcttcttctcctttcttcctcgagcctcttcgtttctttcttccgctggcagccctttcttcctccttcctcattgtttcgcgagcccctttgcttctccaacgcgaggtggttgttcttcttccatgcaagctgctgcttctccctccttcgagtgcgcttcttcttccgttctctcgcgaggtgctgctcttctattcttcatcgaggtaagaatgtcacgctctcgtgcttcgtcatcatgttggactagtgtgaatgaggaactcgaacacatcgttgcgcatatgcccaaattaacaatcgaagagcaagggcaatggaaggaattggcatacaagttgcagcatgttgcggctccaccagagggtttcttccagacgattttcggtgaagttggtaaggtatatgctgccaagtggaaggacatacttggtagtatatggcatttggttgacaaggatggaaattatcacaatgttatgtacaaccaagatgtggatcaaccagccatcgtcgcagggtggacaacactacgcgacttttaccaacggaccggagatcatctcatatcgttgcatcattatggtaaaagtacattttttcttactatatgcaagacccctctcctgcccagagcattcccaagatggcactctttatatcatcaagtgccaggttttgtgatcttcaaggtttatctcactgagcaaaacgttttttgtagcagtctgggcgttccaagtagcatgtattatttcttgaaagacaaaggctggactcatttgcactttggagacgttgcagaatgccagctcgtgttcaatcactggagaaagttactgaaaattggagccgggttgaaagttactggagaaagcggatcaggttga

SEQ ID NO: 71391 - DNA, 387 bp, Glycine max
  Peptide Sequence Number=SeqID_163076
atgatgttgcggtacggctacgagcccggaatgagtttgggcaagaacaacagcggcagaaccagcctagtaagcaccagaggaaaccgcgggaagtttgggttaggctataaacctacgcaaactgacataaggaaaagtatctcgcaaaggaagaacagaggccaaggctcgcggttaggacaacaagccgaaggggtcccgccctgccacatcagtagaagctttataagtgcaggtctaagacacaaaggccaagttgctgcgatatgcaaggatgactccccgaggagatcggatttggtatggccatgtcctcctggtttccgactaggaaattggcgagtggaggagcgcccagacatttacgcgacaagcataatgtaa

SEQ ID NO: 71392 - DNA, 585 bp, Glycine max
  Peptide Sequence Number=SeqID_163077
atggatccactcagtgggagtcatcccctccacgctccaccaaaagttgaagtttgtggtggggggacatttggtcatagtattaggggaggaggatgtcctggtaagttgtccttcctctatgccatatgtggaagccgcggaggagtcattggaaatggctttccaatatttgaggtagtaagcatcgcctctgttgattccctccctaggcggccccgcctatctgatgcggcaatgatggtggcccgggtgatgctggggcacaactacgagcccgaaatgggtttgggcaagaacaacggcggcaagaccagcctggctgacataaggaaaaacatctcagaaaggaagaacaaaggtcaaggcccgcggtcgggacaacgagccaaagaggctctgctgtgccacatcagtaggagcttcgtaagtgcgggtttaagacgcgaaggacaagttgccgcaatatgcgatgatgactccccgaggagatcggatttgatacagccatgccctcccggtttccaactaggaaattggcgggtggaggaacgcccagatgtttacatgacaagcataatgtaa

SEQ ID NO: 71393 - DNA, 1335 bp, Glycine max
  Peptide Sequence Number=SeqID_163078
atgccctctgggggaaaggaaaccatattctatcccttagctagaatttctaagatagtcaaaatctcgacacaggaattagaacgcggaaagcaagtcgaaaatggggtggttggggtaccaaggaaatgtttggaagaaaaggcgagagtcttggcgagtcaaggcgaatgggccccgttcatggacatcctgacacttttgatcttgggggtggtcctctttccaaatgtggatgggttggtggactgggcagcaattgatgcttttctcgccttttacaaccacaaggaaagctcggttgtcgctatcttagccgatctatacgacacattcgaccgaagatgtgagaagaacaatgcaaggatcgtttgctgggattacaatcctgtcctcgctataagacaacttggttaccctatgagaggggcaccattagaggaaggcctcatgccttttattacacgaggtttcaatagcaccaacgcgggggtgcttcagaggatccacaaggcatgggaaatgtcgcaaagaaaggataaggaacttagggggagtagcaacgggcccatcggcggttaccgtaggtggttgaaagcctacgcacaagatctggattggctcctgagtttgagaaccactaagggggtggaggttgaaactttggaagaagacgaagaggtacaggtcctcaggacagaacttgagaaagcccaaacagtcaaagaaaagttcaagtcagcagctgttaggatccgaacggagaacgccgaactgagagacgtcaatttagccaccaccaaggacttagaacaagagaccaagagggcccatagggaagaacatggccggaacaaattccgaggggctctgtggggcagtaacagcgagcttaagctccgaagagaggaaagggaccaatcgcgagtagacggtttgatcctgaaggatgaattgagggtttgtctaaggtccaaaaggagcttgtctcagcggttatgcgaaaccaaaaccaacatgttagccatcattagcaagtatcaagaagaattagatctagccacggcccacgagcacaaggtagcggatgaatatgcccgagtgtacgcggaaaaagaggctagaggaagggtgattaactcgttgcatcaagaagaaacaatgtggatggaccggtttgctcttactttgaacgagagtcaagagcttccccgattgctggcaaaggccaaagctatggtagacacctactccgcccccgaggggatccacgggctcctccgctattgtcagcacatgatagacctgatggcccatataattaggagctgttag

SEQ ID NO: 71394 - DNA, 558 bp, Glycine max
  Peptide Sequence Number=SeqID_163079
atggcgcacaaggtcacgatggacaagtccactgtcagatctgcaaaaaacgtggccatgaagcctctatgtgttaccacaggtttgctgtggctccgcttggcaactttggatccccatactctttctttggaccatccttctctcagattggtctgtacggttttcagcttcaacacagttttgcaccacccaaccttggtgctccacaattttttggcaacatgcagcaaccacactttgctaatggcactactcccactccctggatgccatacttacctagtccacactttcagaacccagcgcctccttttggttatcaacccactatcccacccaatgatggcaccaccctccagtagcaacaaattccacctactgctaacatttcccaggcttagtttccaaattcaggattcacataaagtttttcttcaaggagctcttggagaagatggcttatacaagctttacccttcacttgcaagaaccacttctcataacaacaacacacactcctctgctaatgtccacaacagtctccttagtccataa

SEQ ID NO: 71395 - DNA, 546 bp, Glycine max
  Peptide Sequence Number=SeqID_163080
atgttcagcccttttggtattttggattctctcgaaactagtgaggaaaattgtttcagtgaaaaaaatccaagccgaggcacttccataatgcttccgagacgtttccgtgagcgatttcgtgaagattcttcaccgttcttcatcgttcttcgttcgttctttgtcgttctttggtcttcaaccgtttccttgaatgaattgactaataaccaaagtgaaactaaggctaaaatcaactcacaaatcaagctttgtccgcaaaagtcactaaaaaccgttttaagactgtcgtcccttgtgacggacgcgtggggtgctaataccttccccgtgcgtaaatacatttcccgaacctttcacacttcaagttcgtacactacacctttccgatttttccgacgttttcctcaaataaacgttggtggcgactccgcgcatcttcctttcttggaagacgcacccgtgagtctcgcgtcgccctcccgccgaagggtaggttgcgacagttggcaactccactggggactgtttttagagagttag

SEQ ID NO: 71396 - DNA, 132 bp, Glycine max
  Peptide Sequence Number=SeqID_163081
atggccaagatcatgttgaaggtcacgattgcatcagaggctattttaaacaccattaatgccaaggaccagctctatgtggagcttgtaggcattgaatcttcttcatcaatggagtcatttgcttcttga

SEQ ID NO: 71397 - DNA, 147 bp, Glycine max
  Peptide Sequence Number=SeqID_163082
atgccaaaaatccttagctttgtcaacatagaagacccatccttctccatgagaggttgtggctctactaatgacaacccattaagggtttatattcttagcctcttccaccctgaatttatctacccccttggcctcagtctttaa

SEQ ID NO: 71398 - DNA, 219 bp, Glycine max
  Peptide Sequence Number=SeqID_163083
atgggtgccaagcaccttgtaaggaccaaagaaaagtcgcatgtcatcaagcaaaggtccccagacgaaattaggactcatcttctccttgaagtcgcgtctcctctctctcttcctttctccattccactgccattcatcttcctagaagcaaaggaatccattgatgaagaagatcctaggcctacaagctcaaatggagcttacatcacatactaa

SEQ ID NO: 71399 - DNA, 759 bp, Glycine max
  Peptide Sequence Number=SeqID_163084
atgatgattggatgtggaattacctggatgttgtggaagcttgagaggattgatggggacctggcgttgagaggaacgaggataagggctacgtgggagtacgtgagctcagttggaggtgggcaacaggggatggtggagtggtacctggagatatgtcgcgggggtcaggagaccttggggatgtcaggtggggtgctattgcccacaaccaagcttgaccaatcccgacccaacccaggcatagtcagtcagcttaaaaagggaactggaagattgtggaggcctctgaggaatgggtcactggtaatcgattaccagatcgtgatggcagcacagttaatccatgatcgagtggagatggagtgcctagagggagcttgggagaccctcgaaggcaatacgaggtgccgatttcggggcacgattcgatttacggctacttcattggtgcatccagatgaacccgcgcacacgcttcagcgcactgtggagtggatactacccacgcctacaccataccgtctagtggagccagtccacgtgattgaggtgacgtcatcagaggaagaccctgaggaggaccctgaggaactacctcccgagcctgctgtggatgctcttgactttctagagggtgatgaggacccactccctgaggtggattctcccgaggatgtcatgtcggcatctgaggcagactctacggaggatagtggccctggagagatggcgattagtggaggctcttcatcatag

SEQ ID NO: 71400 - DNA, 439 bp, Glycine max
  Peptide Sequence Number=SeqID_163085
atggggtccaatcaaacaccttcgcttaaaaagaggttctatcaagtcaaggtcaagagcctagggatcaccaatctaagcgagttagggcaattgatgggtcagctccagcgacaagcgtttcgcaaagcttacggtaaaatctgggacctagccatggtagatgtctccacggaggccattgcatccctcgcccagtattatgaccagccgttgagaaaatgtttggaggcaaaagcaagaatattggcaggtagaggcaaatgggccccgttcatagacatcctcgcacttttgatctttgggggagtcctctttccaaatgtagatgggttggtggacctggcagcgatcgacgctttcctcgcctatcatgaccgcaaggaaagtccggttgtctctatactagtcgatctatacgacaccttcgaccgaagat

SEQ ID NO: 71401 - DNA, 414 bp, Glycine max
  Peptide Sequence Number=SeqID_163086
atgtttgttctaactcttctgaatcctgaaatcaaaaacatttttcaaaagctaaatggagaagcctcacgtgccaagaagcaactattcgaagaaggatcctctacaagttcatcaaccgaagcaactgaaatagacaacgaaggaatgatgaaagtagaacaaaccatgacaaaattagcaaccggtcaaggaaccgacgtgagccaacccattagactaccaaacatcaggggcaaccaaataaatttcccttcatgggtccatgacaacctcaaccacaaccaactcatgggagcaagcattgaggacccctatgctcatctcataagatttctacaatcatgcgtatcggggggggggggggggggagtacagctgattggctcaactcgcacccacatcattcactaa

SEQ ID NO: 71402 - DNA, 999 bp, Glycine max
  Peptide Sequence Number=SeqID_163087
atggcagaatcattgaagaagagaaagggaacatcctccaccaccgctgctactggccatcgccgccacggaccatctgaagcacccagagcacctattcatccttccttatcatctccacgatcctctactctattttcttcagatgatcaacgtctacagtacaactctcaattttcttctaggatcatcttagaccctaagtacctagacacagatttgtttaatgatgagacatttgactgttatcaagtgtttcaaaactctggattggttgattttatgtccttaaaattgtcttactatcctgaacttgttaaattcttttacatcaatttaaaaattcaggatggtattatttcgtctgaggtgcatggtatttctatgattattgatcaatctctgttcttttcattaactaaattacccagtcaaggtgcaccttttgagggcaccattgttgatgactggaaattcaactattctagtcatgatgctcgctgtatggtttttcatgaccgaattttgcttccccgttcttctaatttggctcaagcctctgaggagtatttgattttgatgtgggctttccttaccggtcgtcagattgactgggctcacttggttaggtaccgaatgcataaggcattacgggccaatgcacctcttccatatcctcaattggtcaccctttttctccgtcattttcaaattcctcttgatgatgaaccttttgttcaagtcaagcgatcctttgctataggtgttggtgtagtcacttcatttggataccgtaaggatcgtaatggtcaatggctgaagaaggacgcgctacctccgcaagacaagcgtactccctctcctcctcctcagcgagatgattcctccgcccttctgaatgaagttcttttagagttacggggcctccgcacctatgttggtgaacgattcaattctttggatgttcgctttgaaggcatgaatacccgcatcacgtag

SEQ ID NO: 71403 - DNA, 216 bp, Glycine max
  Peptide Sequence Number=SeqID_163088
atggataagagcttgaaggtaggagaagatgagtggagggagaggaaaagaaggagcacgaaattttatgcatcaaatgagactgatgcaagctccattggagcttgtaggcctaggatcttcttcatcaatggattcctttgcttcttggaagataaatggcagcgtaatggagaaggaagagagagaggagacgccacttcaaggagaagatga

SEQ ID NO: 71404 - DNA, 456 bp, Glycine max
  Peptide Sequence Number=SeqID_163089
atgtgtcaacaacaaaatcttcggtccttgttgaaatttgcatcaggcaagtcaaaccttggaaagaccgatattgattatgttccaaatcaacctatacatttcaacttcaagtcattacaaaagtcaaaagaatgcatgaatggaattaatggagggagtgactacaggaaaggagaatatcagcccaacaatcaaatgcaattaagtgcatctaaagctttgtttggtagcttaatctctgtgagagaaagtgaggttttgattcctcctcaccttcatttcaagttggcatcagagcaggtgtcatccgccgtcgtccgccgtcgccgtcgccgtcgccgccgtccgccgttcccttcgttgacttctcctgagtccgttccagccctcagtttccagtttcgttacctggaatgctacagccctattctctccacctttttgctcccttaa

SEQ ID NO: 71405 - DNA, 342 bp, Glycine max
  Peptide Sequence Number=SeqID_163090
atggttagaacacgaggtttaggtcgtgcgttaggagctggtagaggcttactgcctcagcacgcacgtaggcaacgggttcgtctgcgtgaggacgtcactgagagacatgaggatgtgcctcagttgcatgaggatgttcctcatgtgtttgatgccaccccagagatgacaggtgtcgccgatgctgttcagacagaaggagtggctactgatgggagcttggggtcacctgctgcagatgagggattccccgatggaccacgcgacccatcgattttgaccgattttgctgagcatgtcgaacacagcatctggagtagacaagtacatagtttttaa

SEQ ID NO: 71406 - DNA, 756 bp, Glycine max
  Peptide Sequence Number=SeqID_163091
atggctagcaatcccactagggttcaaaagaaatccaagtcccaaaaaaaggaagcaaggagaacgttctcaagcagctctcaacagggattcaactttctcaacatgctagaagcacagggtctatcaaagtttgtgcagatgaaaggaacattttacccaaagttggtaaaagtcttctacacatgtgctaaagctgatatggaaagtaacttgtactttactatcaatggtgtagagatggtgattgatgttgcaatttggaaagcaatagcaggaatagacatgggtggagtctacaagtttaaggaatttacggatgactatagcaaaatggccacatacagaggtatgcttcttgacccgacaagattgttaaggaacagattgggtattggtgtcttgacctcaagattcattgattatttcactatcgatatttctaatgagattgtagactttaccaaagcctctaatgagataactgaaaggcatctcaagaagcttggcatgacatatgttgatcatgagtggatcatggaaggagagcaaccaccaccagcaaacgttgatcagatggaaaaagaagctcagcaaaagctagctcatcaatggagcccttttgagtcccttatgattcaaaagatggatgttatccttcatctccatcaagagcatcaagctaaagataaggcaaaggatcatgtttccaatccaatctcaagactctccaaatgcactcaatgtcgcattcat

SEQ ID NO: 71407 - DNA, 122 bp, Glycine max
  Peptide Sequence Number=SeqID_163092
atgccactggacttatgggtcacgatagcaaaaggtggggtggtcgacaaaagcggggcttttgctcctatatatcctcaatttgtgatgaggagctcagacctacgtagttcttgcaagcg

SEQ ID NO: 71408 - DNA, 436 bp, Glycine max
  Peptide Sequence Number=SeqID_163093
gaaccttaggatagacgatattagtgacctgtggtgttggaggttgaagacgaaggttcttccgcgagaagaaccttcttctgcgcgtaggaaagggcttctgggaactcccgcagagaagagtggaaccttcttccggtggatcacgcggaatatcctgcagaagctttttccgcaggaatccacggaagaaccttccactcttcttctgcgggagttcccagaagcccctttcctacgcgcagaagaaggttcttctcgcggaagaaccttcgtcttcaacctccaacaccacagccatttatgccatttacgccattcaaacagttacgaggaggttagaagactaaccttgatggcagaggacacgaacaacaacttcaatggaggatgtcaacttcaatggaggacacgaggtcgcggaggaaggaaatga

SEQ ID NO: 71409 - DNA, 90 bp, Glycine max
  Peptide Sequence Number=SeqID_163094
atggtgattttaggaggtgttggtgtgattgaagaagggtttagggtggcaggagtgaatgctagagtaatggaggttttgatgagctga

SEQ ID NO: 71410 - DNA, 258 bp, Glycine max
  Peptide Sequence Number=SeqID_163095
atgacgggcataacacacgggctcaaactttctctcacccatactttttctatcaagttctccacttgtctttggctctcttttgtgtcttccggattacttttatatgctaacctatttggtatggaaactcctaccatgagatcaatttggcactgtatccctctcaaaggggtgtctttggggaagatgttcccaaacttcttcaataaatcttccacacctagaggaaaagaactagcaatagaagacaaatag

SEQ ID NO: 71411 - DNA, 356 bp, Glycine max
  Peptide Sequence Number=SeqID_163096
atgaatcacttcttccggaaagttcccggaagaggttttccgggagtcttccggaagacgtttggttacttccagaagaacacttcttccggaaactttccggaaaatgttcttccagaacttccggaagaacccctaacgggtcttctggaagacaccgctgtcatcctttttcaccattttttccggcgtactctaatcttctcccctctcgtcttctaccctaaggttactaccctaagtaaaagcaatggagagttagggagactaacctcgaaggctgttcgcagagaagacggagaagaagaagaagcttggctcgtggtgtccggaagaagacgaaagcttggctcgcg

SEQ ID NO: 71412 - DNA, 351 bp, Glycine max
  Peptide Sequence Number=SeqID_163097
atggagctcggcctgaagtgtgacgcgttgaaaggcaatttgtccaacgtgcttttaggcatgacattcaatgacgagtcgttgtcgataagaaccttggccacgatgtggtccaaacacttgatggacacatgtgaggtaattgttggcggtaatattgttgatgatgcccctgaagccctccacggatatttcttggtagatgaccgctgccccgaccaagctttcttgaaagaaatgcatcagcagtttctcatccctagagtatgcccccattttttggcaatacatcttcaggtgatttttggggcaagtggtgatgcaatcctaccccgcaagggtattggatag

SEQ ID NO: 71413 - DNA, 261 bp, Glycine max
  Peptide Sequence Number=SeqID_163098
atgatgagaatcatgaaactggccaaatacaggctaaaggcccaagtggagaagacgaaggcccaagtggagaaggacaaagcccccgagtggagaaggatgaaggcccaaacttatcaaggtaatccttgtggcgtctacccagacttatcttccttcactggaagtggcgtctacccagacttatcttccttcaccggaagtggcgtctaccctgacttatcttccttcactggaagtggcgtcatccaacctctgtag

SEQ ID NO: 71414 - DNA, 201 bp, Glycine max
  Peptide Sequence Number=SeqID_163099
atgaatattctctattcatatctgtcgaaacctaccttcgagaggggtgtgaaaaaggccataatagatgggccaaagcgtttgtctccaggggagaaaacgagcggagtcgctaccaacgtttatttgagggaaacgttagaaaaccaaaagaggtctgcgaattttgaaaatgagggttcgggagttgtttacacatga

SEQ ID NO: 71415 - DNA, 315 bp, Glycine max
  Peptide Sequence Number=SeqID_163100
atgacaaaaggtgcggataaccataaggtaccctcgcatgtcatcggactcgccgtctctggattacaaaaaggtgttgaagacgacgttagcctctgtgtgtcagcggacttgcttgcccctgtgacatcttggaatttctacccggaattttgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 71416 - DNA, 921 bp, Glycine max
  Peptide Sequence Number=SeqID_163101
atggtggaagaatttgaagagatcctaggatgtcctctagggggaaggaaaccatacctcttctcagggttctatccctcattagctagaatttctaaaatagtccaaatctcggcacaggaattagacagcggaaagcaagtcgaaaatggggtggttggaataccgagaaaatctttggaggcaaaagcaagaatcttggcaggtagaggcgaatgggccccgttcatagacattctcgcactgttgatcttcgaaggagtcctctttccaaatgtggatgggttggtggacctagcagctatcgatgcttttctcgcctatcatgaccgcaaggaaagctcggttgtcgctatactagccgatctatatgacaccttcgaccgaagatgtgagaaaagcagtacgaggattgtttgctgtactctggctctctatgtatggttggttttgcacctttttcgccaagtgaggcatgcttgctcgctagaaagccaccgttcatgcacagagaaaggaggggcaaattgggaccgactcttagcaaacaaagaaggagcgtctgtcaactggttccctcgatggaaagaaggaagaaccggagttcttattttgtgcggaggattcccaaatgttcccttgatggggacaaggggttgcatcagttacaatcccgttcttgctataagacaacttggctaccctatgagaggggcaccactaaaggaagagctcgcacctattattgcacgaggtttcaataaaaccaacgtggaggcacttcagaaggtccgcaaggcgtgggagacggtgcaaaagaaggagaaagaactcaggggcagtaatagcgagcttaggctccggagagaggagagggaccaatcacgagtagacagtttgatcttgaaggatgagttgaag

SEQ ID NO: 71417 - DNA, 216 bp, Glycine max
  Peptide Sequence Number=SeqID_163102
atgtggaccaccacgggaattttacggaagcattacgggtgtcccggaatcccatttttcaacaaaacggggggtgtggtggccaccttgctcgcccaggcgcactcagctcgcccaagcgagctaggttgcttcaaccttaagcaagaaattgcccagaaacctctagaagggcccagattcgaaaattactatttacaccacccattttactaa

SEQ ID NO: 71418 - DNA, 792 bp, Glycine max
  Peptide Sequence Number=SeqID_163103
cctataactctaatgctagggagaaggcaccagaagctcccataaaccacgttataactggtttcgggccccatctaggatataccattgaagggcatgcattttttggcgtccctatgctgaacactcctagagcctctcaatatcgcccattatcacaacccttgcatttcgtgagaggagaaggatctctcgtagtatttgagaaggaaaagattaagcatatagaggagaggttacacaccatcgaaggaaggggaagttatggttttgccgacatgtcagagttgtttggtacccgatgtgactattcccctaaagagttcaaggtgacagattttgataaatacaaagaaaccacttgccctaagaaccacctaaggatgtattgcaaaaggatgggggcttatgcgaaggacgagaaggatctgatggatactttcattaggcaataccaatacaactttgacatggcaccagaaagaatgcagctgcaaaacctgtccaagaaagacaatgacaacaacccgtgcctacatccagtccccaagcgacctgcggtccttgagatttcttttcaaccttgtaaaaatccttttacaagcaaagatccacaagggatgtaccctcccttgttctctttgaacaacctagtggatgtaccctccactagaattgatccacaagagatgtaccctctcttgttcttagtcaacagcccaagtagatgtaccctctacttgtaccacaaaggatgtaccctccaatgtgttaagacaaagttctcaggtg

SEQ ID NO: 71419 - DNA, 489 bp, Glycine max
  Peptide Sequence Number=SeqID_163104
atgccttttagaggtttgaaaagtgcgagaaaacaagctgtgttttttgcgttttctggaaaacgcgatgaactcgctaagcaagcatgctgcgctaagcaaattcatcaatactcattgtatatgtcttctagaaaaagaaagagcattggtacaaggcccacatctcagtatgacacaaggagattctcttcattagatgcttggaccagatacactgataatgttctgagaagaaacattttacctgagaggaaagtagagctaaatcacactgagctggatgactttaaggccgagcttgagaggcgtaatttccataaatccctcactaatttagtcgatggaagcatagaccaggctttggtgaaagagttctatgcaaatttatacagttctgaggaccgtccaccaaagcattccagagtcagaggtcgtttggtgaagattgatgctgacagtctcaacacaattttagagacaccatcg

SEQ ID NO: 71420 - DNA, 231 bp, Glycine max
  Peptide Sequence Number=SeqID_163105
atggcagcggaatggagaaggaagagagagaggagacgccacttcaaggagaagatgagtctagaagaagctcaccaccataggaggccatggataagagcttggaggaaaaaggagatgaatgaagggagagggagagaagatcacgaaattttgtgctcacacatcccactaatccaagatcaattccaagattctccactaagtgtgcttaggtgtcatgaggcatga

SEQ ID NO: 71421 - DNA, 342 bp, Glycine max
  Peptide Sequence Number=SeqID_163106
gtgtcataccttaatttcatctggggactattgtttgttgatcttttgatcctcgctagtcgacttaaggtgttgaacaccagttacagtctaaagcaaggaaccattcagtgttttgatcaggaaggcaaaagataccaagaaaggagggcaaaagggtcttttccttggttttcctggaccctagagactagcctgggccaccaaataacttcaaggcatactaagggagctgagaaggttttccaaggttcagaagttaagggaattgagagaagagataaagatgaagaagaaagaagaaagaagaggaagcgaggccgatgcgctaccgaatcgtga

SEQ ID NO: 71422 - DNA, 426 bp, Glycine max
  Peptide Sequence Number=SeqID_163107
atgacattgctactaagcaacattttgcccagcgaccgcaatgccaatctccccctgcaaaagtatcagttggtctgtgtcgtcccgacgtgggtaaggatcgcacccacaaagacacccagtggacctgaagaagtccaacagggccctgaggtttccagctctggttacgggcctctgtcggccctacagggcgcccgttccccccagcaaggatcgtgcccgcaaaacactgtggacccggagaagtccaacggggtcttggggttgccagctctgattacgggcctctgtcgattctacggggtgcctgtcgcccccagcaaggtcatcaggccccctattaaccaggctttcatcaagaagtactgcgcccctaggcaggcgcagggcgaaacaccacagcagcattgggatggccggtag

SEQ ID NO: 71423 - DNA, 306 bp, Glycine max
  Peptide Sequence Number=SeqID_163108
atgaaaggcgcatgttgtgttgggattgtaccatcgaggaaagggagattgatagaccttcttggggctcaccacaaccatttgttggtcgaggttgtgcgggaaatggattttatgggggagacctttgtggttgagtggacaatctttgttggatgggcgccggattgggaggagtttcgatgttggctgaataattgcactaatgcggggaatatgggtaagtggggttgtgaggggtttgttgggattttggccatgtgggagctgaagttatggcatgggcgtctccctccttcttcttag

SEQ ID NO: 71424 - DNA, 117 bp, Glycine max
  Peptide Sequence Number=SeqID_163109
atgggtacttggggacggacacaaatagaggctagggtcacgaccgacaaatcgtcgtcccttcccagctctggacaagcggaaaacgccactgcaagacagcctagtatcctttaa

SEQ ID NO: 71425 - DNA, 342 bp, Glycine max
  Peptide Sequence Number=SeqID_163110
atgacaccaaccccaatcaacccctcccctgatcatgggttctccacctgcctcccctcctcctcctcctcctcctcctgctccttcggacgcatcggcttcgccgtctaccgtgaagcggacatgcaagcctcacgtctacgatcgttgtctactagaccacctggtgctgacccaccagtggtccatgttgatcctgctactggcaaggccaacggtccccacaggaagaaattaagaatatatttggggattgtggtgcgtgataaagtggatgtcacctatgagaacaggaaggaggtccctactgctcagaaggacctgatttgggaggatattaag

SEQ ID NO: 71426 - DNA, 129 bp, Glycine max
  Peptide Sequence Number=SeqID_163111
atgaacaatggacgtgtctttggcatgccaggtaagtctcgcaacatttcagaaatcaaaacaagcattgttgcgcaattcgtaaagatctgcaacattccggaagtcaaaaagaggattgttacgtaa

SEQ ID NO: 71427 - DNA, 803 bp, Glycine max
  Peptide Sequence Number=SeqID_163112
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgatcgtgcgaccggcacggtggtcggtacgtcgacgtcgatgccggcctcgatcggcgggctgaacttctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71428 - DNA, 658 bp, Glycine max
  Peptide Sequence Number=SeqID_163113
atgttgaaagggatatgcagggtatcatgttaaaggcaaagcatcctgtcaaagacagctttctagaccaggcccatttgacttacactattgtggatacccaacataggccagaaaaaggtcccacagaggacaaagaggaagctttgccccttgaggcaaatataccttatgaagttcaagtcacggataaggacaaggatacagctacgcaacttccctctgagttggtagctgaggaattgggccagcttataggcccaacctcttcagttaataagccccacgctgagtttttgcctcctttacaagacaagtcagatttaatcacaggctctaaggatgattttctgacccatatatcgaaggactcttttcatatgcaaagtgcccttctaaaggaaatgggcttatcctgtggggatcaagacagcaaggccatttggggggattctattgctcaatgggactatgttccctctgtgcaagctgctgggggggtgaaaagtaggagctttttaatgcttgaagggagatgcattctaaatgatcagaggctggtgattgtaaatgtatatgcaccatgtgaccttgatgggaagaaagctttatgggatgacctaaggcagttgaaagtctctaacccagggggactgtg

SEQ ID NO: 71429 - DNA, 198 bp, Glycine max
  Peptide Sequence Number=SeqID_163114
atggagtcaccaactatcgcaacctacccttcggcgggagggcaacgtgagggctcatgggtgcgtcttccatgggaggaagatgtgtggagtcgccaccaacgtttattcgaggaaaacgtcggaaaaaccggaaaagggtgtttcccttgctcctacgtattcctcaattgtgataaggaaatcagacctacgtag

SEQ ID NO: 71430 - DNA, 758 bp, Glycine max
  Peptide Sequence Number=SeqID_163115
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataacaaagggccttgtgagtattctgagctctagaaagacgcgaagatcacaattgggaggaattctcaccaagactccttctcttttagttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71431 - DNA, 930 bp, Glycine max
  Peptide Sequence Number=SeqID_163116
atggtgaaagttggaactctttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcaaaatgacaaaaaaagacgaaaatgcggccatagttctaaagaaattaataagccaaggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 71432 - DNA, 723 bp, Glycine max
  Peptide Sequence Number=SeqID_163117
cattctcagccagggttcgcagctggccggcttcagcgcccagtacctgctggagctgatcggccgctttatcaactggcaaatgatcggcgcggccttcgtgctgtttatcgcctacctgttcgtcgcgcagtgggtgcgcgtcacggtgttcaccgtggcggcgctggtgtggctcaatatcgtcaacatcgccggaccggcagtctcgctgctgcccgcgacctccacggccgcggccggcggcgccaatacgccggccacgtctgcgccggcggcgggggatgctgcgccggcagacagcctgccgccgaccagcgccaacctgacggcctacctgaaccagttctacgagcgagaaaaaggccgcaccaccgcgttcccggccagcttgcccgccgatgcccagccgttcgatctgctggtgatcaacatctgttcgctggcctgggccgatatggacgcggtcaacctgcaaaatcacccgctgtggtcgaagatggacatcatgttcgacaacttcaactcggccaccgcctacagcggcccggcggccatccgtttgctgcgcgccagctgcggccagctttcgcatcgcgatctgtatcagccggtgaaccagcaatgttacctgttcgacaacctggcgaagctcggcttcaaggaacagctgatgctcgatcactccggggtgttcggcaacttcctgaaagaactgcgtga

SEQ ID NO: 71433 - DNA, 2035 bp, Glycine max
  Peptide Sequence Number=SeqID_163118
atcggcgtgaaagccaaaatcgtgacctatgagtggggtgaatacctcaagcgcgccaaagcgggcgaacaccagacggtgatgatgggctggaccggcgacaacggggatccggacaacttcttcgccacgctgttcagctgcgcggcggcgaaagacggctccaactactcccgctggtgctacaagccgtttgaagatctgattcaaccggcgcgcgccgaatccaaccacgacaagcgcatcgaactgtacaagcaggcgcaggtggtgatgcacgatcaggctccggcgctgattgtcgcacactccaccgtgtacgagcctgtgcgtaaggaagtgaaaggctacgtcgtggatccactcggggcgcaacaggtttgcgcccctgctgaccagtctccggcgtatggccgtcgaatcgttcaaaggcatttcatactccgacgtttggggttagttatcccaacgtttatcggcattacattgctgacttttgcattcgtccatatgatccccggcgacccggtgaccatcatggccggggaacgcggtatctccgccgagcgccacgcgcagctgatggcggaaatggggctggacaagccgctctatcaacaatatttctcctacgtgtccaacgtgctgcaaggcgatctgggcacctccctcaaaagccgcatctccgtctggagcgagttcgttccgcgctttcaggccacgctggaactgggcatttgcgcgatgatcttcgcggtgctggtgggcattccggtcggggtgctggcggcggtcaaacgcggctcggtctttgaccataccgcggtgggtatctcgctgaccggctattcgatgccgattttctggtggggcatgatgctgatcatgctggtgtcggtgcagcttaacctgacgccgccagccgctgaccggcttcatgctgatagacaccctgatctggggcgagccgggcgacttcgtcgacgcggtgatgcacatgatcctgccggccatcgtgctgggcaccatcccgctggcggtgatcgtgcgcatgacccgttcctcgatgctggaggtgttgggcgaagactacatccgcaccgcgcgcgccaagggcgtgagccgcatgcgggtgatcgtcgttcacgcgctgcgcaacgcgctgctgccggtggtgacggtgatcgggctgcaggtcggcaccatgctggccggcgccattctgaccgaaaccatcttctcctggccggggctgggccgctggctgatcgacgcgctgcagcgccgcgactacccggtggtgcagggcggggtgttgctggtcgcctgggccgtggtcggcctggtgtatatcgttctgatgctggtgatcgcgctcggcgccggcgtgctggcgccgcatgcgccggcggaccagttccgcgacgcgctgctcaagccgccggtgtggcaagagggcggcagctggcaatatatcctcggcaccgacgacgtgggccgcgacgtgctgtcgcgcctgatgtacggtgcgcgcctgtcgctgctggtcggctgcctggtggtggtgctgtcgctgatcatgggcgtgatattcggcctgctggccggttacttcggcggcgtggtggacgcgattatcatgcgcgtcgtcgacatcatgctggccctgccgagcctgctgctggcgctggtgctggtggcggtattcgggccgtcgatcgtcaacgcctcgctggcgctgaccttcgtcgccctgccgcactatgtgcgtctgacgcgcgcagcggtgctggtggaggtgaaccgcgactactcaccgcttcgcgggtggcgggcgccggcgcgctgcgcctgatgttcgtcaatattctgcctaactgcctggcgcctttgatcgtgcaggcttctctcggtttctcgaacgccttctggacatggccgctctcggtttctgggcatgggcgcgcagccgcctacgccggagtggtgcaccatgctctccaacgtgctgctgttcgcgctaagcgcctggtgg

SEQ ID NO: 71434 - DNA, 1250 bp, Glycine max
  Peptide Sequence Number=SeqID_163119
gctttggccggtttcagcgccggcgtctgcgcgcgcaggaacggcagcaggaacagcgccgacaggcaggcggcgatggaaatcaccacgaagaagccgttccagtgccagatctccatcacccgcgcgatcgggtagccggacagcgccgcgcccaggtaggcgaacaggctgatgaaaccggtcgccgcgcccgccgcatccttgtgcgagcactccgccgccgccatgccgatcagcatttgcgggccgaagatgaagaaaccgatggcgaagaagcagcaggcctgcagcaggtaggtcacgcccggcatcaaccacagtgccgccaccgacaggaagataccgatggcgaagatcaggttcatcgggccgcggttgccgcggaacaacttgtcggaaccccaaccggccaccagcgaaccgataaagccgcccacttcaaacagcgaaatggccgagttggcggtcatcagcgaatagcccttttcctgcgtcaggtagaggttgccccaatcgttgatcgcggtgcgcacgatgtacaccagcacgtaagagaccgccagcagccagatgtacttgttggtcagcacgtagcgtttgatgatctcgcggttgctcagcccctggccttccgattcctgcaccagctccatggcgtcgttgcgccatttgccgacgctcggcagccccagggtggatggcttgtcgcgcaggcgccagcacatcagcaggccaagcaccacaccgatgataccggggatgatcatgccgtaacgccagctgaagtgcagcgagataaagcccaccagcagcgggatcagcgcgcctccgacgttgtgcgaggtgttccagatagcccaccagccaccgcgctcggagcgcgaataccagctggtgaggattttggaacacggcggccagccccagccctggaagaaggcgttgaggatccacagcgtgcccagcatcagcagcgacgaactgaggccgaagaagatattcagcaccccggtcatgatcaggcccagccccataaagtaacgcgggttggagcgatcgctgatcatgccggaaatgaatttcgagcagccgtaggtgatgtagaacagcgtgccgaggatgccgacgtcggacatcgtcaggcccagatcgctcagcatcgccggcatgatgaagttgaaacttttgcgcgtgaagtaaaacgcggcgtagccgatgtacatggtggacatcagctggatgcgcca

SEQ ID NO: 71435 - DNA, 444 bp, Glycine max
  Peptide Sequence Number=SeqID_163120
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattggattgctgacgaagtaaatgttgatgaagagtggaacgagaatccgaaagcggatgaggaacagcaaatgaattga

SEQ ID NO: 71436 - DNA, 264 bp, Glycine max
  Peptide Sequence Number=SeqID_163121
atggccagggataaattggcagatgatgaagccgataatatcaaattacaactgatagctgctcggggaaaagatggtcgtgctcaaaaagagatattattgttgaaactcaaaatggagaattgtaaagaatccatgaactgcaccctagctatctgccactatagtaccctctactctttccttatggagaagatggacatagagctgacatacttcaccattctacttcacccagcaaaaaaagaaagcgaagccgtctga

SEQ ID NO: 71437 - DNA, 456 bp, Glycine max
  Peptide Sequence Number=SeqID_163122
atggacatgaatgtgggacatatcatctcgagtcaaatttctgtgatagctcaacatgactgctcgaggctgggtttccctaccctcatcactgctttatgtaaagcccggggagtcacttctgattcacttactttcgaaagcttcactgtagccattaatgtggcatatgtgaagaaaaactactggaacctcgatgatgccactgttactttcagagggcctcacaaggccaaggggaagaggtcagaggctctcccatcttctgagattcccctttctgtagctctttcatcttttgatattcctcctatatcagcttcagctcccactcccttaccagctcctcctacaggaccatcctcttttacatctgagacattatttgttatgctgcagaacttgcacagaggccagatcatcatcatacagagattgcagagctctggccagtag

SEQ ID NO: 71438 - DNA, 375 bp, Glycine max
  Peptide Sequence Number=SeqID_163123
atgggtattgatattatcaagcattcattcatcgccaaattcaacaacattgcccccattgcatattctgagtttcttgaagtcctatgtaaacagactctacatatgcaaactgagggtgcaaagaaaaagttgacttttgtcccccttgctccagcatgtgtggtcattcgagttctggctccagtttacgctgctaaccttccttacaatccccttcggtggaggcttttttggattctgttattttcagcaataacctacattatgctcacaagcctcaaggttctaattggcatggttctacagaagcatgccagatgcaccaaggaagcacatacacttatgctcacgcgagagttctttgaagcgtag

SEQ ID NO: 71439 - DNA, 375 bp, Glycine max
  Peptide Sequence Number=SeqID_163124
atggctggtcgctatgacagtaaccccttcgatgaggaagaagttaaccctttctctgatccatctgtaaggggaaaagcatcaagccagtcaaacttcagtgggggtgcattttacaccacaaatcctggaagtgttcccgctgccactaattcaaggcttccacctcttaagccagaacctgttgattataattatggctttggtgcgacagttgatatacctcttgattcatcaatggatttgaaaaagaaggagaaggaacttcaagccaaggaaactgaattgagaaaaagggaacagagttacaatttgaaaagtcttggagatagcatttccagtttgggaacattttactggatgagtggttattaa

SEQ ID NO: 71440 - DNA, 450 bp, Glycine max
  Peptide Sequence Number=SeqID_163125
atgaagacatacgagaatgatgatctgaaagtcactgttgtaacaagtgagatcaaccctgaagacgaaagttatcctagtgagaggaaggaggcagcagtgatccctcaatctgttgtgtctgataaaaggcaaggggtacccataagtaacaagaaatctttcaagaaggttgcaaaacagaggtctcggccaaggccatcaagtaagagagataaaaagaaaggaaagaagcgaggcaagaataatttggctatacctagaagtgagaactcatgcttgcatattgcaggatttggacgtgtttcgtttagttggttacctacctggttcctactgtccatgacaggattttcttcttcagggctattcctgtcttcccattttggggatccaagagttaagaaagaaacacctaatttttctccttttcttttggttaatcggtaa

SEQ ID NO: 71441 - DNA, 1167 bp, Glycine max
  Peptide Sequence Number=SeqID_163126
atggaggaggaggatcacaaaatgtttggtcttgtctcagaaccagaggaatattgcaaagagttaggtgttgctgtcagagcagttcaaatggcatgcttcctctgtcagaaacttcaagacactttgatttccaagtctcggagcaacaataatctcaattctcctctcacagttgcaggttggagtgtcaaagcaattgtcagctggatattgtttgagtgtttagggaatgaaaatgtctcaattgtaaccgaaaaagaggttcggacactatccagtactaatgcatctgaactgttggaagctgtggttaaaactgtgaatgaatgtctagctgaagcgcctcgatttggagttgaagaaccaaaatcaacccttggaacttcagaggttcttgaaatcattagtcgctgcaactcagttggagatccttctggaagattctgggcacttagtcctcttgatggagggtcttcatgtggtgatcaacatgttgtagctttatcactcatagaggaaggagaagttgtgcttggagttcttggctgtcctaactaccctatgagaaaggactggtttagttatcatcacagctatcttaggatgatatctaagttggctcctccaacctctcaaacttggaataaaggttgtgtaatttatgctaaaaggggtagtggcaaggcttggatccaaccactgctccatgtcaatgataagtttgtgtggccaaaccatgcaaaacaagtttctgtctcttccattgacaacctagaaatggccactttctgccaaccagttgagaaggccaatttaagccactcttttgctgaagggctggctcacagtgttggtttcagtaatcagccactgagagtatacaacacgatgaaatatacggcaatagcatgtggggatgctgaggttttcataaaatttgcaagagctggttacaaggagaaaatatgggatcatgcagccggtgctatcatcatacaagagactggaggaatggtaacagatgctaaggggcatccactagacttctcaaaaggtttatatttcgaaaggcttgatcgtggcatagttgcttgtgctggagccacattgcatgaaaagatcattgatgctgttgatgctagttgggcctcttcttgtctttga

SEQ ID NO: 71442 - DNA, 1701 bp, Glycine max
  Peptide Sequence Number=SeqID_163127
atggcattggcaaggattgctagggccaacctgagaagatcaggaggtgcttttggcagttatgctcatgagaaggatacgttcaatgtaggaggatacacaagcagatgcaacataccttcccatgcaaattttgaatcagatggaaagttttcatatgctccaagaattaaggaacagaactacatgaacttttcaatgaggggaatatcaggaacgccacaccatcagtttccttctgctagcacacagacggttatagaggaatctgagtatgagtttgagaatgatcggcaaagatatgctggactagaggcaacaaagccaggtgaaaagcctagggtggttgttcttggtacgggttgggctgcgtgtcggttcctcaaagggatagacaccaaaatttatgatgttgtgtgcatatcaccaaggaatcacatggtctttactcctttgcttgcttcaacgtgtgttggaaccctggaattcagaactgttactgagcctgtatccagaatacaggatgcattagcaagggaccctaactcctacttctttctagcttcttgcactggcattgacacaggcaaacatgaaatctattgtgaggcagttaacaatggtggattgcctcaagagccttaccaattcaaagtcgcttatgacaagcttgtaattgcaacaggatctgagcctttaacttttggcatcaagggagtaaaggaaaatgctttttttcttcgtgaagtgaaccatgctcaagaaataaggaagagacttctccttaatctgatgctttctgaaaacccaggcatatcagaagaagaaaagaaatgccttctgcactgtgtagttattggaggtggccctacaggagtggaatttagtggtgaattgagtgatttcatcatgagagatgttcatgagcgctatactcatgtcaaagattacattcacgtaacactcattgaggtacctaggacctggctgaattcacttccatataggaaagcctattgtgcaaacgagatactgtcatcctttgatgttagcctacggcaatatgcaacaaagcacttaacaaagtccggggtccgtcttatgcgaggtgtagtgaaggaggtgcatcccaaaaagataattctgagtgatggaacagaagttccttatggcctcttggtttggtccacaggggttggtgcttctcagtttgtgaaaacactagatcttcctaaatctcaaggtggaagaattggtgtagatgattggctgcgtgttccctcggtggaagatgtctttgcccttggagattgtgctggttttcttgaacacactggaagacctgtgcttccagctctagctcaggttgctgaaaggcagggaaagtttcttgtggaattgttcaacgaaatagggaatcagaatggaggcaaggcttattctgcaaaaggcatgccatttggagagccttttgtgtataggcatcttgggagtatggcatcagtaggtggctacaaagcactggttgatctacgacagtcaaaggattcaaaggggttgtcacttgctggttttgttagctggatgatatggcgctctgcatatcttacacgtgtccttagctggaggaacaggttttacgtggcagtgaactgggccaccacattagtcttcggcagagacaacagcaggataggttga

SEQ ID NO: 71443 - DNA, 489 bp, Glycine max
  Peptide Sequence Number=SeqID_163128
atgttttctcttcatgaggttgatttggacatagaaagtggcatggcatgggttgaggctggtgcaacacttggtgaacttaattaccaaatagcaaacaaaagcaatgtacatgctttcccagcaggggtgtgttcttctttgggcactggtggccacttctctgggggtggatatgggaatttgatgagaaaatatggtctttctgtggatgacatcattgatgccaaattggtcaatgccaatgccttgctaccaacacctcaggagccaccttcaatatacttcaagagcaagtcagattttgtggaaacccccatcccaaaggaggctctaaagtccatttgggatttgatgattaaatataacaacatttggatgcaatggagcccttatggagggagaatggctgagatatctccacaagcaaccacttttcctcacagggcagggaacttgttcctcattcagtactctgttttggactga

SEQ ID NO: 71444 - DNA, 390 bp, Glycine max
  Peptide Sequence Number=SeqID_163129
atgcaagcaaagacgcataataaaaaattcgaagggaatatatatacaaggaaagtagagcttgttggagggatcgagcttgagacgacgtcgtgttgggagaagagatctcgcgacggaggaaacggaattggaggtgtgggaagtggaaccctcgagggggagattattagggttgtggtggtggtggtggtggttatggtgatgatgaagatggtgaaggttagcggaagacggcgtcgtattggtggcggcggaatggcggaacggaagcttgaagaagttccagaccttaggttcggagtgaggcttgggatcagctacggccatgctctcttgttcgggaaaaacagcgataatcgcgcgagagaaggaaaaggaaggacttag

SEQ ID NO: 71445 - DNA, 258 bp, Glycine max
  Peptide Sequence Number=SeqID_163130
atgctgcgagctcggtctggtctctatgctactcatggctcaatatttctactgctgacccaatatccgttcaagaacacttctgtcaacatgttttactcaaagcttcagctgcttcaaaccgaaaatggagggttctttggtgcgctgttacttgggtcacttagaactggaggaacaacattatcttctgcggtgtggtgtttaacagagataagttcctgcatgatatactgttccaaagttggtcctggctga

SEQ ID NO: 71446 - DNA, 204 bp, Glycine max
  Peptide Sequence Number=SeqID_163131
atggctcccgatgaaaatgcgaagactccatgtaccaacctaaactttggaatatttttttgtcgggatgatccacgttgtgaagaagaagaagaagaagaagaagaagaagaagaagaagaagaagaagaagaagaagaagaagaagaagaagaagaagaagaagaagaagaagaagaagaagaagaagaagggagcgtgtga

SEQ ID NO: 71447 - DNA, 162 bp, Glycine max
  Peptide Sequence Number=SeqID_163132
atgaatggatcagaagggggggatgggttccatttccgggccgggtggatgttcgataagatgaaagatgatgcaagagtagtgaaatggggtttaagagttacaaatatttcagggctgcctagccaatggacaagagatagcagtgaaaagattgtctga

SEQ ID NO: 71448 - DNA, 417 bp, Glycine max
  Peptide Sequence Number=SeqID_163133
atgttcaagggtgagctctatcttctagccacggaccaaggttacataaatcaacctgatctggtctgggaaaaactgaatgagatgtcctcaattaaacctcttgaaaacttaaaggtcaatggtgatacattgtttttgaccagtaatttgaaggaattcaaggtagaaaaccatgaaagtagcacttgggatgagaacaatgctctgaccagcactgctgtatacaacttcacgtttaaggactatcttgccagcatagatagtgcaacacatgcaagcttagatatcaattctgatctgcaattagcaatagccttgcaacaacaagagtttgagcagcagccaccacgccaggataatttacagcagaaatcatccattagtggtagctctagactggtcacgggtccccag

SEQ ID NO: 71449 - DNA, 821 bp, Glycine max
  Peptide Sequence Number=SeqID_163134
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccctaaagcttcagaaaactatagaagataatgccacggcggctgcctccaatacagctagggaagtggaaccggtgctacagcctgcaataaacttgggccgagacagaaacacgacagttttcggtcggagatatagtcctatagcctacccttatggtttgcctccggacttcaccccccataccgctccagacgatttgagccaagcccctaccttcgagaagcaactccctccttatgccgactatcctctgcaagaagatgatgaaggagaggcccatctaggccctctacttcccctcaaggatccggccccccatgaattgccccaaccaaacatagtcgccatgtcccgtctccacccgcacctgttaaagaattcgttcggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 71450 - DNA, 201 bp, Glycine max
  Peptide Sequence Number=SeqID_163135
atggtgatgatgatgacaaaggtgatgacaaaaagctcaaagatcaatcaaagaacaactcaagtgaatcaagaacaattcaagagttcaagaaagaagaattcaagactcaagaggaaagttaagagtcaagaatcaagattcaaggttcaagatctcaagactcaagactcaagattcaagaatcaagagaaggcttaa

SEQ ID NO: 71451 - DNA, 331 bp, Glycine max
  Peptide Sequence Number=SeqID_163136
atggctctgaagaaattctccacgaagaggtctagaagagatgccacaggagaagggtccagtgtcgcccccgagtttgatagtcatcgtttccagagtgccgagcaccagcagcacttcgaggccatcaaaggatggtcattccacaaggagaggcgtgatcagctcagggaggatgagtatatggactttcaggaggagatagctcgtagacattggacaccactggtgactcacatggccaagtttgaccctgagatagtcctagagttctatgctaatgcttggcccacggaggagggagtgcgagacatgcgttcatgggtgaggg

SEQ ID NO: 71452 - DNA, 219 bp, Glycine max
  Peptide Sequence Number=SeqID_163137
atgtgctatgccagtcatcctggtaaatcaaactctatatcaacttctaaggtatgtggtacctttgacatcaattcgagggtgaattcttcccaagaaggagggtatgatagaggactatccaaggaagaagagttttacttaatgggctcaacatggatggaccaatcacttgagcaaggagtaagagaattcaagaagagtttggcaagagactaa

SEQ ID NO: 71453 - DNA, 180 bp, Glycine max
  Peptide Sequence Number=SeqID_163138
atgaaagaaagagaacggaagatcttccgaccagataaattttcggcaaggtcgttctcgactagcgatatcccacccgacatgaacaaagaggaaaagaccgaaacacccagcgtcctctccaaaaacacaaccctcgagaaaatcctattgatccgtgatcgtacgtgtgatctctga

SEQ ID NO: 71454 - DNA, 119 bp, Glycine max
  Peptide Sequence Number=SeqID_163139
atgcggggctaccctatggttacttgcaccattcgtcaaccagggccaaacgagtctgttgatgcgcggagactgacatcgtcttctgcaccttttgtcgtcctgacccgtgaaatcag

SEQ ID NO: 71455 - DNA, 1187 bp, Glycine max
  Peptide Sequence Number=SeqID_163140
gaacttggagaatgtttcccaaagtgatgaagcgttggaggcaaggataatggataaaaaacacattaatagtttacggctggaatggtctggatgtaacaacaacagtaccaacttccaacttgaaattgatgtgctttgcaagttacagcctcactttaacattgaattgttgcacataaaaggctataaaggaaccagatttccagattggatgggaaattcttcctactgcaatatgacacatctagccttgagtgattgtgacaactgtagtatgcttccttcacttgggcaactaccttctctcaagttccttgaaatttcaagattgaataggctgaagactattgatgcaggtttttacaagaatgaagattgtcgttctgggacgccctttccctcccttgaatctctgtccattgataacatgccttgttgggaggtgtggagttccttcgattcagaagcttttcctgtgcttgaaaatctttacattcgtgactgccccaaactagagggaagtttgccgaatcaccttcctgctctggaaacacttgatattagtaattgtgagctgcttgtctcttctctcccaacggctcccgccattcaaagattggagataagtaaaagcaataaagtagcactgcatgcgtttcctctcttggtagaaattataatagtagaaggaagcccaatggtggagtccatgatggaggccatcactaacatccaaccaacttgtctccggtctttaacattaagggattcttcgtcagccgtgtcatttcctggtggtcgtttacctgaatcactgaagactctgcgtatcaaggatcttaaaaaactggaattcccgacgcaacacaaacatgagttactggaaagcctagaaggattgcctgcgcccaacttgattgctttcagcatttcgggctctgacaagttgaagtcgttgcctgatgagatgagtagtcttctcccaaagttagaagatctcggcatattcaactgcccagaaattgagtcctttccaaaacggggtatgccacctaacctgagaacagtttggattgagaattgtgagaaactactgagcggcctagcatggccatccatgggcatgcttactcatctcactgttgggggtcgatgtgatggcatcaagtccttccctaaggagg

SEQ ID NO: 71456 - DNA, 276 bp, Glycine max
  Peptide Sequence Number=SeqID_163141
atgactatgcaaaacatgcagtttcaacaagaggccagagcctccattcagagcttaaccaatcagatgggacaattggctacacagttaaatcaacaacagtccttgaattctgacagattaccttctcaatctgtccagaatcccaaaaatgtgagtgctattacattgagatcgggaaagcagtgtcaagaacctcaaccagccaatgaacctgcccaacctcactctactccagaaaatggaggtgactctaaagatgtaaagagtaagtaa

SEQ ID NO: 71457 - DNA, 267 bp, Glycine max
  Peptide Sequence Number=SeqID_163142
atgaagggcatgcgataccatgcccaagattgcaacaatgatgcacagctgcccatggttttagcatcagggtcagtggccctacacatttctttgtacagcgttgccagtcaagtagagccccaactataccgcctaactcggtcgagatcagccaagacagtgagctccattggagcttgtaggccttggatcttctttatcaatggagtcctttgcttcttgaggtttgattgcagcggaatggagaaggagcaagatgaatag

SEQ ID NO: 71458 - DNA, 903 bp, Glycine max
  Peptide Sequence Number=SeqID_163143
atggcagaatcgtcgaagaagcaaaagggaatgtcctccaccaccactactattggccatcgccgccacagaccatctaaagcacccacagcaccaattcatccttccttgatcatcttagaccctaagtacctagacatagatttctttaatgatgagacatttgactgttatcaagtgtttcgaaacactggattagttgattttatgtccttaaaattgccttattatcctgaactagttagagtcttttacagtaatttaaaaattcaggatggtattattcgttctgaggtgcatggtatttctatgatcattgatcaatctttgctcttttcattaactaaattacccaatcaaggtgcaccttttgaggtcaccattgttgatgactggaagtttgactattcaagtcatgatgctcgtcgtatgactttccttaccggtcgtcagatcgattgggctcacttggttaggtaccgaatgcataaggcatatcgggccaatgcacctcttccgtatcctcaattggtcaccctttttctctgtcattttcaaattcctcttgatgatgaaccttttgttcaagtcaagagatcttttgctataggtgctagtgcattaacttcatttgattaccgtaaggatcgtgatagacaatggctgaagaaggacgcgctacctccacaagacgagcatactccttctcctcctactcaacgagatgattcctcaacccttatgaatgaagttctttcagaattatggggcctccacacctatgttggtgaacgattcgattccttggatggtcgctttgatggtctggatacccgcatcacccagcttgaagaggatgtgggttatcttcatcggtgcttcgaccttccaccaccttcttag

SEQ ID NO: 71459 - DNA, 213 bp, Glycine max
  Peptide Sequence Number=SeqID_163144
atgtattcaaatgctggtggaatgattgattatgctgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 71460 - DNA, 486 bp, Glycine max
  Peptide Sequence Number=SeqID_163145
atgggctgctctagctccatggctggtgctgatggcatgataaatggctcaggaggaataggctcatcctctgcatctggcacaggctcttgggctgcggaggcctcaccccctccagaaggagaaggctggactcctggcaaagccacctatgcaaggaactcatctacactcatagctggctactggccagagctatgcaatctttgtatgatgatgatatggcctttgtgcagactttgtagcatggaaaataatgtctcagaggtgactgaagatggtcctataggaggaactggagctggtaagggagtgggagctgaggctggcaactgtggaagatgtggagtcaaagtggatggggcggaaggatttggtaaagtagatgaagaagaagaagaagtatctagtgctactgaagttgggggagcctcagatctcttacccctggccttcctcggccctctgaatgtcactgttggataa

SEQ ID NO: 71461 - DNA, 240 bp, Glycine max
  Peptide Sequence Number=SeqID_163146
atggggttgaaccaagatcatgcttttaagaaaagaaaagaacacgctttacggtgcccttaccgaacccgtgctagagctagagtaatgggtgaagtagaaaaggtgcaagagcagatgaaggccgacatggaggccatgaaagagcaaatggccacaataatggaggccatgatgagcatgaaaaagataatggaagccaatgcggttgcagttgccgctatcagcgctgttgctaag

SEQ ID NO: 71462 - DNA, 441 bp, Glycine max
  Peptide Sequence Number=SeqID_163147
atgggtgaagactcttggtcgttggtccgcaaccatctgcttaaagaacttggcaaattcttagatgactatatcaagctctttggtggcacaaatagatttgaggaatttaggatgtcactacttgttgatgagttaaccaaggtgactatgaataagtggatggatataattgacatgggatatgtcattgcatcaagaagtcaaacatcgacagatacttcagtgcatcgcataatttgtatcggtcacgtgtatggaaattattttgttcaggtttatttaaaagaccgttgtcctttaccgcctgtagcattgttatggtctaacaattatcatcctcaagcgaagcagtggccaactccatatattagtagaatgcaacattacaaaagtttcatgatgttcaaaagagactatgttgacataaatgatgactga

SEQ ID NO: 71463 - DNA, 291 bp, Glycine max
  Peptide Sequence Number=SeqID_163148
atgtggaagaggataaggagggtggaattggtgttgtggatgcgctggtggctccggaacgatgagctcttgaagccaaagcggaggcggatgaacccttatatttcaatcgatgaaatcaaaagaaaaatgaaaaagaagaagatttcaagttacgggagtcgatttgatgaagaaatgagtaagataggaagttttggaggtttgggaatggaggaacgtcgcaagggagaagaggctgcgcaggagtttctgaaaaacgtgatatttatagaccaggacgcattgtaa

SEQ ID NO: 71464 - DNA, 1072 bp, Glycine max
  Peptide Sequence Number=SeqID_163149
cgccacgcttcccgaagggagaaaggcggacaggtatccggtaagcgacagggtcggaacaggagagcgcacgagggagcttccagggggaaacgcctgcctatggaaaaacgccagcaacgcggcctttgtacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgcaggccttggtgaaggcgggtatttcggattccggaaaattctttcttggcaccgacagtgcgccacatcccaagtctgccaaggaagccagctgcggctgtgcaggcatgtatactgcacatgcggcgattgagttatatgccgaggcatttgaagaggctggtgcactggataaactggaaaactttgccagtgtttatgggtcagatttttacggtctgccgcgtaataccgacaaaatcacactgcgcaaggaatcctggctcgtgccagacagtattccgtttgcagatgatgtattggtgcctttgcgtgccggacaaacaattgcttggagattggttatgatgttaagtgcacacggatttgccgtgacgatagatgaaatgcgtggtgagcaggcaccctatgagcaagcgtttaaagcgctggacacggatggcaatggcaagctgtctaaaaaagaagtgtctaaagataaagactttaaacatgcgtttgccaaggctgacaaaaatcacaatggcagcctggatcaagacgaatttgccagttataagtccaaggtagatggtgcggaaaacaaacaggctgccgcggacagtgcgatcaccgccaaaatcaacggttttgtcgatacggctgaacagaaggcgcgtgccgagaaaattgctaaaagtgtagatggtgtgaaatctgtcaacaacgcgctggtggtgaagccttaa

SEQ ID NO: 71465 - DNA, 255 bp, Glycine max
  Peptide Sequence Number=SeqID_163150
atggcttctatgatggaagccatgctgggaatgaaacgactaatggagagtgcttacccctacggtttaccacccaactacacaccaccagccatgcatgaagacgcgggtcacgttactcccctcatcctcgaaggggagcctcctcggcatcctgacggggtccacaaggatcctcgagagcgcgctcagggagacgtcgactcctactctctgtttcccactgagggaccggcgcccaacgcactaccttaa

SEQ ID NO: 71466 - DNA, 232 bp, Glycine max
  Peptide Sequence Number=SeqID_163151
gattgtcatcatcaaaaagggggagattgtggaagtaatgtcttccaaggttattttgatgatgccaaagaatcaagagttacgcaaagtttcaagcaaagattcaagaatcaagtttcaagattctagattcaagaatcaagtttcaagtttcaagattcaagaatcaagatcaagattcaagactcaagattcaagaatcaagagaagactcaatcaagataagtactaa

SEQ ID NO: 71467 - DNA, 318 bp, Glycine max
  Peptide Sequence Number=SeqID_163152
atgaagctttgcttttacaaggctaagcgcagctgtgcgctaagcctattctgcagaaaaaaatattttatgtgtcttcaagctaagctccatcttgctacgcttagtgctcgaatggcttctaggaaaagaaaggcaccctctacacctacccaagccagatttgatagatccagattcacttcccaagaggcttgggagaggtacactgacattgtggtgcctcttaagcttttactagagaagaatgtggttgtttactatacaaagtttgatgagttcaaggaggaactcaagagacgccattgggatgagtag

SEQ ID NO: 71468 - DNA, 219 bp, Glycine max
  Peptide Sequence Number=SeqID_163153
atgatttacctaagttggttgcgacaaaattttcagcaacttctcattgatgttgatgatgttgccattgcacaacatgctagagctcatatcatgatgctcataagcggctatttgatgccagatacatcagcaatattagcatctcttttccgagctctagatcgggttgtgaagccagaccaaacaaaaattggtgaatgtttgttgttgctatag

SEQ ID NO: 71469 - DNA, 381 bp, Glycine max
  Peptide Sequence Number=SeqID_163154
atggggaacaatcaaagtgatttgattcccattgatttggagattaacgccacttgtagaaggcgtaatcaagagagaattataaattttttgcaggacttagagggagcagtaattccagaggaagaacctcaatcttctgaggcatcttctagttttcctattgcaaaacattctcatttagatcttagtgaagactacatcatggctgaagagccaagaagagttactctggaagattattcaagttctaatgtgccacaatttttcaccagcattggacaaccagaagttcaagcacaaaccattacttatccaccatcattgattcagttgattcagaataatttttttcatggattaccaaatgaagacccataa

SEQ ID NO: 71470 - DNA, 878 bp, Glycine max
  Peptide Sequence Number=SeqID_163155
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcctcagctgcaggtctgttggagtttgctagaggttcactccagactctgtttgcctgggtatcaccagtggaggctgcagaacagcaaatattgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71471 - DNA, 399 bp, Glycine max
  Peptide Sequence Number=SeqID_163156
atgccgcctaccaggcaccctctagacccagataagtctaacagggccctaggatttccagcgttgatcacgagcctctgccagtcattcagggttaccgtcacacctagtaaggtgattcgaccgccgatcacccgggccttcattgagaagtattgcacgcctaggcaggtgcagggtgatgcaccgcaggccgcagacgcaccgccaccacctcatcaggctgatccagctgggtcatttggcatggagtgggggcatgtgcagacccatgagtgtctctaccagctcagcctcagtctgcagagccagggtttcgctcattttctgtgccctactctagatcagtttagggctgaggtcgcatggcccagagattggcccgaggaccagacatag

SEQ ID NO: 71472 - DNA, 591 bp, Glycine max
  Peptide Sequence Number=SeqID_163157
atgacgacccagtgcacttgccgattagatttcacatccacaaaaacaggtagtaccaggatgcgaacaatgttatggatgagtttatgcaatttgaagatgaagatatgtcacaagtgggggcttaacaaatatcaaactaggcttcttgctgataacgtgcaagccttgatatgtgttcgatcagaatacttgtttactccctctttcaaattggtattacttgtttttatatgggagtggtcttaccggcaagcgcactgggtcgccaagagtggggatgtctcctccacctctaggaatctcacaatcactcaaaaactcactaatctccctaaaagacgaaaacttggccccttgctctactctacgctctctctgaaattcacactcttcaggcctctcagtagtgaacagttctcttggctccctctaattttgtgcaaatcaggcttaaacgggcttcctgatctcgacgtcgtgcttagcgccattctcgcgcttagctcgagaaatgaagatgaagatgtggagatgaagaaggatcaagatacttcaaagatgaaatcatttgttgttggagatgtttaa

SEQ ID NO: 71473 - DNA, 507 bp, Glycine max
  Peptide Sequence Number=SeqID_163158
atggctgaaccatccgccatgacatcctccattttccgctacgccattcgccatatttttatggcgaatttttggctttccgccatgaaccgtcgtccgccattaacaacattgttaggagatagggagaaagagcgtgagagggatagggataagaaggaccagagtaaggataaagagcgtgaaaaggagagagaggtggagaaagacagtgatagagtgcgagagaaggagagggagagaaggagagagaaagctctagagatggggacaaggataaggggaaagataaaattagagagaaggagagagaggcggatcgagataaagaaaagggcaagagatagagtgagcagaaagacttatgaggaagattatgaactggataatgttgatgataaagtagactaccatgacaagagagatgaggagattggcaagcaggcaaaggattcaaagcttgacaatgataatcaagatggtcaaacatcaacacatctgtcttaa

SEQ ID NO: 71474 - DNA, 339 bp, Glycine max
  Peptide Sequence Number=SeqID_163159
atggtaatttggtttggaccctcaaaaggagtgacatgttgcatattttgggagatattggtaacatggttatatgctctagaatctggataccagctgcttgatgaggtgctgggaagtatgggcaaaatggataaggtgagtaaggatagggtgaattgggattctgtttggggtaattggattggtaattggtttgggaatttggttgagagggcttggaggagtagcttgcatcatttctataccagcaatgatgatgtgaacctgactaggagcggatcgttcgatacaggctatgaagttttggatgacgccacttccagtgaaggaagataa

SEQ ID NO: 71475 - DNA, 177 bp, Glycine max
  Peptide Sequence Number=SeqID_163160
atggcaggagcgggtgacaatggtggtgtatatcatcaactggatggatctcaacgcttattactagatgtaatgactacacaaatgcaacgtttgttgaaccgtaacaatgaagagctctacatacgaatagccaaatcttccttgtttattcttaaacctctatcccctagagaa

SEQ ID NO: 71476 - DNA, 507 bp, Glycine max
  Peptide Sequence Number=SeqID_163161
atgttgcctcaatgtgtcatgttgcagtcactggctacagaggctggctcatttaggagtgttttctggagtggaaatcaaggatgcctcttccctgctctctgtttgaacattctagaccactgccctacgtttgaatttctctggcttcattttgttgtgaatatccagcaaacttctccttttgagggtccagacctgatcttcattggtaatggacaaggtctgaatatctcagcctctggtcattccaattttgtttaccctttcggtcctaatgtcaaactttttcttaaaaatatgcttcatgttcctcaaatcactaagaatctgattggtgattccaataaaatccttctacaaggaggtggtattggatttgatggcttgtatcagtttcccaatcttcagttttgctctgctgtgtcttctcctgcttgtataaacattgtttcttctgttggttgtaataataccgtgcctaactccatatatttggcaccttag

SEQ ID NO: 71477 - DNA, 467 bp, Glycine max
  Peptide Sequence Number=SeqID_163162
atgaagcaagaaaagcgtatgaagcaatatcacgaagaattgaagatgaagcaaataaagagcttagatacaccatcactgtctgtggagagaatgagggaagttcaggctcgtttgcagacatcctggatcaacataggcataaaggagcactcaaatcgggtgagccccaaggcctacacttcgaagagtccgtcagggcctctccctcctgattcagtttatctcgtcgctaagggtcttaacattaactcgttgcctttaaaggatcttagcattaactcgttgcccttaaagggtcttatagtcgatcctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 71478 - DNA, 1068 bp, Glycine max
  Peptide Sequence Number=SeqID_163163
atggaaggtggaacagtagttctaactattaaagatcagcccatacttgccaatggtgatgttaatgaagatgttgacatgcttgagaacattgaaattggagaacagaaacgacgagatgaagcttataaagctgcaaaaaaaaaaaaaactggcatatatgatgataagttcaatgatgacctctccacggagaagaaaatgcttccccagtatgatgatccagttgcagaagagggtttaactttggatgaaaagggacgattctcaggtgaagctgagaagaaaattgaagagctgcgaagaaggttaacgggtgtgtccacgaatacctttgaagatctaactgcatctggaaaggtatcatcagattactatactcatgaagaaatgctaaaatttaagaaacccaagaagaaaaaatctttgcggaagaaatataagctggacatcaatgcccttgaagttgaaactgtctcttcaggattgagtgtcagtgaccttggttctcggaaagatgtaaggagacaagccatcaaagatgagcaagaaagattggaggctgagatgagaagtaatgcttaccagtctgcttatgctaaagcagacgaagcctccaaattgctgcgtctggaacaaactctcaatgttaaaacagaggaagatgaaactccagtttttgtagatgatgatgaggatcttcgtaagtccttagagaaagcaagaagattagctcttaaaaaggagggagaaggggcatcttgtcctcaagctattgcattgcttgccacctcaaatcataataatgagactgatgatcaaaaccctacagctggagagtcacgagaaaacaaggtggtcttcacagagatggaagaatttgtctggagtctccacattgatgaagaagcacgtaaaccagaaagtgaagatgttttcatgcatgatgatgaagaggctaatgttcctgatgaagaaaagagtaatgaagctggtggatggactggagttcaagaaactaatgaagatgaacaacgcaatacagaaaacaaagaggaaattaaatag

SEQ ID NO: 71479 - DNA, 558 bp, Glycine max
  Peptide Sequence Number=SeqID_163164
atgattatgaggggccaagacatttatagtagccaagatgaggctactacttcaccttcctctagtgaaagtgaaaaaacaaaaggggaagaatctagtgaagaaatctacccccaagaagaaggacaaccattagtggttaaagagaagtgtaaggaggtaagtgtctcctctaagaggttagctaagaaggaaactcattttacaataaagacaaacattaaagaaactttccctcttagacaacctccacattttctcttttgtaaaaagacacttgttagcattgtcacacctcttgggcttgagtttattcctcaagtaaagaggttgttggatgagggtttggttcgcaagagtttaaatctttatgttttgttggtgcccaaaatagggattcccatggaccctaagagaataaaggtcattcctgagtggcccactccaccaagtgttgagggaaggagcccagagtatgaagaacctcaagatttgaggtcaaatcctttccaaggtggagggaatgatgcaatcctaccccgcaaggacattggatag

SEQ ID NO: 71480 - DNA, 69 bp, Glycine max
  Peptide Sequence Number=SeqID_163165
atgccgcccaataggcgcccaagtccaaagccaaaggtagcaagataccttggatatgcatgtatatag

SEQ ID NO: 71481 - DNA, 261 bp, Glycine max
  Peptide Sequence Number=SeqID_163166
atgaagacctctccgaaatcgcacacggtggttaatgcctcaacatatcagtgttacagttgtggattctggaattctgatatctatggattcctcgagccacagtccattcagaggtctgggcaatcgcagtttgagtctgaaagttacataaagacttggatgcagagttcaaaacgggatgtctatcttggagcctacctaaatggcgggcactggcagatggtggtcattgtgcccaaggaacacctagttgtctag

SEQ ID NO: 71482 - DNA, 279 bp, Glycine max
  Peptide Sequence Number=SeqID_163167
gggtgttccaattctgattttgatattgagagtggcaattggaaccaaagggggtgttccaaatctgattttgcttttgagagtggcaattggaaccaaagggggtgttccaattctgattttgcttttgagagtggcaattggaaccataggggggtgtcaaagtataatgagagtaaagacattcagagttcagaacacaaagaggatgaggaaatggctcagaaggaggatttaatgatctttcaaggtggagaggaccttacaataggtcaatag

SEQ ID NO: 71483 - DNA, 855 bp, Glycine max
  Peptide Sequence Number=SeqID_163168
atggcaaggggttggggtgtctatgcttcattgactcgtactgggatgaataattccattttgaagcatcatgttgacctgagatttaatttcctatttctggaaatgaggatacctgtaaggatgaacattgacaggggcgatgttgggaagaagggtttaaaattggtcaatgatggtgagtatggtggggtgggtagtgggtttaagccgagggatttgacgaggcgtgcctacacaaaattgtgtgtgctgcctccgtcaacaaggatcacgacctgtggttcgggtgggttttgggtaagtgaggaattatttggtatcccggggaaggtcgggtcaggtgcaacggtggcccctcgtgaacttctcatcgcaattaaaacacaatcctcactccctctggcttgtgatttcctcagggctcaagtgtttgacggaggttacggagaggggaattggggaagaaggttgagggccagggtgggcacattgccggagacttttgcggtgttccaggagtttcttctcctggagacgggccaagccggcggcatgcaccaacgtgagcggttggagagcttggacttcacgcctaacgtccaattcgaggctagagatgaagcaactcaagagagtcttgttggatccttatatggggactgtgcgaagcgagcttctatagcttgtagaaagtcagaccatgtgggaagcttggtgtatctccacgacggagtaggggtaggagtggaggaggaagaagaaaatggacgccatggagatgagaaggaggaggaaggtggatttgactatgcgaggattgagatggggaattcgaggattttttatttttaa

SEQ ID NO: 71484 - DNA, 228 bp, Glycine max
  Peptide Sequence Number=SeqID_163169
atggtgtgtgaaaacaaatatgcaaacgtgttggttcctcctacaagcataaccgaacagcaatacggttacaacataccaaaaaaccaagttaccgcactctgtgtccagatatacgataaattagccctatcctatcaagttctaaggatcaaaccatttcccaatgaggataatcctaactacacttgcgtttgcgtgatcaagacaaaaacatgcgagaattaa

SEQ ID NO: 71485 - DNA, 255 bp, Glycine max
  Peptide Sequence Number=SeqID_163170
atggactatttgtccctctactttatccatttttgtctaaaaattcaaaagcaaaactacctacttatggcaccctttggcatgtccaacatggctatcaaatggtcattcaagcttgtcaacgagtatgtcctgctaagcaaggcaccagcacgctcaatgagacacaagaatcctaaagagaatctgccttgcaagcacgcgctcagcgccttgtcgctcgctaagcgagtcattcgtcatcttccagactaa

SEQ ID NO: 71486 - DNA, 120 bp, Glycine max
  Peptide Sequence Number=SeqID_163171
atggaggtgagcatgtacaccatggatgatgcaatccctgccgatatttccgacgtcactgaagaggcagacccttcattggttcacgtgactacccctcaactccgtggattcatttga

SEQ ID NO: 71487 - DNA, 1146 bp, Glycine max
  Peptide Sequence Number=SeqID_163172
atgacttccttcaaccaaattgatgattacggtcaagagaaattgtggaagacacaaaagcaactagcaccacggaagaggaaaaaccagatcgctgctctcgttgagcattgcaatttgcagtgtttgcctagcactattcacagggttagtgcacaaccaacttggatggatgctagggctgtggggcatgatggtatgttatccaattgcaagatatgggacttgaatcccacccataatggaaatatgagtttctgctgcaaaatgagtggtgtgctggcgatgttggcattgcaatgttcactcaaaagggctagtgcacagcctgccagtgtgggtgctgtcgctgtggaacattgtgggatatcaggatcttatttgcaaagtatgagacttgggtcccacattggaagtctattcatggtgacaaatcagaattccacttccgctactccttttcatccgatttctcagaagttagataattctaacttcttgctgcagaggcaacaggtagaacctggcatcaaggctcgtacacttcagcgtttcgtggcaagtcctcagatctcgatgcgctttctcaaagaggcagattgtgaagtcgatgcgcttggatcgtgtggagatcctgttcttcccgtgaacacaatgatctcagtgattgaaagcaatgattctgactgcagcggtggctatagtcatggagacaataactttggccatgtggaggtcgtcgtggcggcggcattggcaatagtcccaaacgtgtctttcactctgatggaaccaatgtttcaaagcaattcatcgaacacctttgatcctaactctactacttggatacctgattctggtgcatccttccacctaactggagagtctcaaaacatccagcagcttggtccatttgagggggaaccaatgaagtcctacttcaaggttcactgggtcctgatgacctctacatatttccacatcttgcactcaaagactgccttagccacctgcttactttctaattccagtgttgattctgctgttacttctgtttctagttgttctaatacacaaatttctgattccattgtaaacccggtttctgatgttaaaacaacacctagtactaaggcttgtgtttaa

SEQ ID NO: 71488 - DNA, 1227 bp, Glycine max
  Peptide Sequence Number=SeqID_163173
atgtctgactcacacactgcagagtcttcgaggactctgttacctcctttccaattcatactcaaactttattccattctctctaacaatctgcttcctgctccccacctgcctcgtgtgcaggatcttacaatgcaatttcccaggatgattaccaatcacattcccttcattgttgacaaaagcctccaatcctcactaccctttcccttctttttgttccacatcttagtgatcactgggacagcgaagtctaggttttctgctaaagattacagtgatcatatggctcttaaacagtttagctttatcttgaaagaagcttgcttggtagatgcagaagcgagtgtcattaacaaattgagtcacaatcagtctcttgtgcgtgcagtcatatgttctggactctttcctggcatagcatcagtggtgcacagggagacatccatgtcattcaaaacaatggatgatggccaggttttattgtatgctaattcagtgaatgcacgttaccagaccattccttacccttggttggtttttggtgagaaagttaaggtcaatgctgttttcatccgtgattccactggtgtatctgattcaatacttatcctttttggtggtgctctaagtaatgggatacaggctgggcatctgaaaatgttagatgggtatgttgacttcttcatggatcataatttagctgacagctatgtgaagcttaaggaagagctcaataagcttatccagaagaagctggaagatcctagcattgacattcacaaggaagggaaatacttgatgcttgctgttcaggagctggtttcaggggatcaatgtgaaggaaggtttgtatttggccgcgaaagccggaagcctaaggcctccaatgatgaaaacaaatttacgaaagatggaacaaatcccaagagcttgctgcagacactgttgatgcgagcagggcactccccaccaaaatacaaaacgaaacatcttaagacaaatgagtttagggcactggtggagttcaagggaatgcaatttgttggcaaaccaaagagaaacaagcaacttgcagaaagggatgcagctatagaggcattggcttggttgactcacacctctgacaataatcagcatgaagatgataagtctcctcctgatataactgacaacatgctaaaactcctagggaagcgtagaaaatcaaagcaaggccatggttga

SEQ ID NO: 71489 - DNA, 780 bp, Glycine max
  Peptide Sequence Number=SeqID_163174
atgaaagcgaaattcctgggtgagaaaaacaatagcagatactcgtctcccaaaacagtgaacctgtcaggacccaatgacgtgaagaccacagatgactcctccctacaacaacaaccatttatgagcaactatattagaggagtgaaagcaaaggatatgccctgcagcttcaagccaactattgacatgaatcttacttttgaggagacacaggtttgtgcatatgtcttcaatcctaatgtggacccaagcgggaacgaaattttgtatggggtaggaaacaacttggggacacgacaaaactttcagtcgttgtgtcccaataagccaataagggaggagttggacgtaattgatggaactcaagtggaaactctcattaagcattatgggaaggattggatgccttcattttcaaacttaaagttgatatatatacccatcgttgaaaataaggatcattgggtcatgtcatgctcagtgttctccaaattgtgtttcaaacacaagatttgctttttggatttaatggaatggatagttgagatattatggaagccggaggaattcctaattatggatccagcattatgggtcctagagtggatacaaatggaggagtcatttgtgagtctgttgtatggagtgctacatgaaaaggcaatcagaatgaaggtgacaatgaccctgctactagggacacacaaccagtacaagggagacttgattagaaatgtagaacgcacttcacatgactatatccatggcaaacattga

SEQ ID NO: 71490 - DNA, 228 bp, Glycine max
  Peptide Sequence Number=SeqID_163175
gtgaaggagtttgatgagaaggttttgaaggagagaaccaagattgatccaggagaacaaagaactatgcgtcaagctaatgaccgcaacccttgcgctaagcgccatttccttcacgcgctaagcgagctgttgttcatgctaagcgccttgacccctgatatttggctggatggtcccgctaagcaagtgcttagtgctaagcccagaaacctctctggattttaa

SEQ ID NO: 71491 - DNA, 276 bp, Glycine max
  Peptide Sequence Number=SeqID_163176
ggtacatccactaggttgttcaaagagaacaagggagggtacattccttatggatctttgcttgtaaaggatttttacaaggttgaaaagaaatctcaaggaccacaggtcgcttggggactggatgcttttgtcaatcctaatgcaattctcctaaggaaggaacccatcgccagagccatggctaagagactccaagaagataaggctaggaatgttggagaaggccttatggttctcatgagccttatggtagattttgagtccatgggctaa

SEQ ID NO: 71492 - DNA, 570 bp, Glycine max
  Peptide Sequence Number=SeqID_163177
atggaagacatgaaagttggggctgtgaaatataaagccatggattatcagaaaaatatgagaggaaaaattgatgcaaaaactggaagaaaaagccttgaagaaaaattggaaagcccacttagcgcgcaagatatgcccggtgtgtattctcgctcaacgtgcaacacacgcttagtgcgaaaaaggcctacgaagaagcccaaaggcgtgcttagtgcgaaagttcgcgctaagcccgaagtcagcgtgaaagttaagctacctagtgcctatataaagaggaggaagcagaagaaaaagacacggagtctcacaacccacgcattgggtctatcccttagggaaaaccctctctttagtcatccatcatcttcttctatccaccttaaccccctaaatcttccagcaaagtatatctttggagttgtcttggtcaagaaggaccttaagcaccatgaaattggcaataacaatagagatgatcatagggtcatcccagttgacgggattaatgcctttgaaatctttgtcaatgaacattatgggagggaggctccttggtgttga

SEQ ID NO: 71493 - DNA, 216 bp, Glycine max
  Peptide Sequence Number=SeqID_163178
atgaaaaagaccagacaagtttctaccacaaaaagaaaaggcgaaaaaagaaaagaccccagaagctggaatcacgagaagaagtgtgtggaggaggtggggaatgtgaagaggaaagtgagggtggtgagaattgagagcgaaacggtggcggtgtttttttcagcttggtgggacgtagagaaaggtggcatgatgagaaaagcgtggtggtga

SEQ ID NO: 71494 - DNA, 222 bp, Glycine max
  Peptide Sequence Number=SeqID_163179
atggaagaaggagatacaactgaagtaattgtcttagtgcatttattacgatggtgccttagtggtacaaagtggaagttcagaaggcaatccaatagcaaagtaagcagggatattaagcatgtaggaagtgtgtacgtatcgggaaaagactggaagcacgaatacaagttgtggatggttggtccaggactccagggacttcgaaaacattttcattaa

SEQ ID NO: 71495 - DNA, 99 bp, Glycine max
  Peptide Sequence Number=SeqID_163180
atgacgatttttcaccatggagatgcagcagaagataaagaagaagaggtagcttccttgagaagcttccttgagaacttccttgagaagcttctttga

SEQ ID NO: 71496 - DNA, 364 bp, Glycine max
  Peptide Sequence Number=SeqID_163181
tcaggctaagtgcgccctgtgcgctaagcctgaatgttattcgattgaggctgagctaagcgcgccatgctgcactaagctccaactctcttcgatggcatctaagaagaggaaagctccttctacacctacccaggccaaatttgagagatccaggtccacatcccaagaggcttgggagagatacactaacattgtggtgcctagaaaactactaccgaagaggaatgtagtagtttattacacagagtttgacgagttcaaggaggaactcgagagaagacattgggatgagaagctgactgatttttctgacagtagcatatacatcgctattgtgaaggagttttacgccaacctctag

SEQ ID NO: 71497 - DNA, 144 bp, Glycine max
  Peptide Sequence Number=SeqID_163182
atggttttgcaacatcacccgcgagaaagtatccagacattgactcatattcctgcacatcagcaaagagaattgtttaattgtagagagggagcaaccatacctctagaaggtttagaagggtgcaagcgaaacacagagtaa

SEQ ID NO: 71498 - DNA, 456 bp, Glycine max
  Peptide Sequence Number=SeqID_163183
atgtggcgtatccaatcacctttcctctttctccattccaccgtcattgatcttcaagaagcaaatgattccattgatgaagaatatctaaggcctacaagctctacatggagctacatcatgtgttctggcacattgattactcctctagcaataattgacacttgttgggacatcatcaaattcggtcaacgacttgtggtgcttgtgcaatggaaagggttgcatctagacgatacatcatgggaagattggaaaacattgaaagatacttattaccttgagaacaaggtgttgttcaaagggttggtggatgataggccaaaggatacagacctggaagacacaaggagcaggaccataagaagaactaatcctgtatctgaaagattatgtttgaagcaagttgcaaattcagttaagggaataatgtgttggcctgctaggattggttag

SEQ ID NO: 71499 - DNA, 477 bp, Glycine max
  Peptide Sequence Number=SeqID_163184
gacaagagagggtacatctcttgtggatcagttcaagtggagggtacatccacttggttttttaaagagaacaagggagggtacatccctggtggatctttggcttgtaaaggattttataagaccgcagtggacgcttctgtaggtggaaaaatcaaattgaagacccctaacaaagccatggatctcattgaatatatggctgcaagtgacattgcaattttgagagatagagctaacattcctactaaaaagagtttattggagctaacctcccatgatgcattgttggcacaaaataagttcttgtctaagcaacttgaggcattgactgaaacactaagatgtaccatctgtgggggagctcatgaatctggacactgtatccctattgaagaaaaacccactcatgaagtcaattacatgggaaatcagcccagaaacaattttaatgcaggaggattttctggattctaa

SEQ ID NO: 71500 - DNA, 513 bp, Glycine max
  Peptide Sequence Number=SeqID_163185
atgaagcatttcactgacaccctcatcagtgcccaacatagtaagccagtatacactccgctagcgcccaatacgcaaaccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71501 - DNA, 776 bp, Glycine max
  Peptide Sequence Number=SeqID_163186
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggatgatgagaaagaggacacaaatgaaaggaagggaaaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71502 - DNA, 147 bp, Glycine max
  Peptide Sequence Number=SeqID_163187
atggagaattggcggacagcgctacgcaataactttgcggggctccagactcgaaggagaatggagaattggcgaacagcgctacgcaataacatcttggggctccagactcgtggtggaggatacatgaacagcgctaggcaatga

SEQ ID NO: 71503 - DNA, 348 bp, Glycine max
  Peptide Sequence Number=SeqID_163188
atgggacctctccaaatgcaagccttccacaaggcgtatggaaagattttacatttgaccatatcggagatattcacagaggccgttgtatcactcacccaatactatgaccagcctttgagatgcttcacgtttggagacttccaattagtaccaactgttgaagaatttgaggagattctaggatgtcctcttgggggaagaaaaccgtatcttttctccgggtttcttccctctttgagcaagattgcaattgtggaggcagaacaatctactggtttcctcgatggaaggaaggaaatgagggagttctcttctcatgtggggactacccaaacatcctgttga

SEQ ID NO: 71504 - DNA, 87 bp, Glycine max
  Peptide Sequence Number=SeqID_163189
atgacattcatggggctccgaataaaagtgggaggatggaggattgcactagagggaccgaacggtccaccgggtttttccacctaa

SEQ ID NO: 71505 - DNA, 573 bp, Glycine max
  Peptide Sequence Number=SeqID_163190
atgacaaaaagatattggaacataatcttggaagagatgatggaagcaggagttcattttggccacggtactagaaaatggaatcctaaaatgtcaccttatatatctgcaaagcgtaagggtattcatattacaaatcttattagaactgctcggtttttatcagaagcttgtgatttagtttttgatgcagcaaaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaatttgtgagggccgttctagctatatacgaaattcttga

SEQ ID NO: 71506 - DNA, 1488 bp, Glycine max
  Peptide Sequence Number=SeqID_163191
atggtaccggtgtcggtcatgttcggccgcgcgccgggtcgtgaaaaaggcgaagagaatccgccgctgcggatgcttaacggtattcagaaattcttcgccgtctcctggcttggccgcgatagcttcgtgcgtttctcgccgtcggtctctctgcgccgcatggcggatgagcacgggaccgataaaatcatcgcccagaagctggcccgcgtggcgcgtatgcacttcgcccgtcaacgtctggccgccgtcggcccgcgcctccctgcccgccaggatctcttcaacaagctgctggcgtcgaaagctatcgcccgcgcggtagaagatgaagcgcgcagcaagaagatatctcacgagaaggcccagcagaacgccattgcgctgatggaagagattgccgctaacttctcttacgaaatgatccgcctgactgaccgtattctgggctttacctggaaccgtctgtaccaggggattaacgtgcacaatgccgagcgcgtacgccagctggcgcatgacggccatgagattgtctatgtgccttgtcaccgtagtcacatggactacctgctgctctcctatgtgctctatcatcagggtctggtgccgccgcatatcgctgccggcataaacctcaacttctggccggccgggccgattttccgccgcctgggcgctttctttattcgtcgtacttttaagggcaacaagctctactccacggtattccgcgaatatcttggcgagctgttcagccgtggttattcggtggaatactttgtcgaaggcgggcgttcccgtaccggccgtctgctggatccgaaaaccggcaccctgtcgatgactatccaggcgatgctgcgcggcggtagccgccccatcacgctggtgccgatttatatcggctacgagcacgtaatggaagtgggtacctacgccaaagagctgcgcggcgcgacaaaagaaaaagagagcctgccgcagatgatgcgcggcctcagtaagctgcgtaatcttggccagggctacgttaacttcggtgaaccgctgccgctgatgacctatctcaatcagcacgtgccggaatggcgcgaagccatcgatcctatcgaagccgtccgcccttcctggctgacgccgacggtgaataatatcgccgccgacctgatggtgcgcatcaacaatgccggggcagctaacgccatgaacctgtgctgtacggcgcttctggcgtcacgtcagcgttctttgacccgtgagcagctaacccaacagttggattgctacctcgacctgctgcgtaacgtgccgtactccaccgattcgaccgcgccgacggcttccgccagcgagcttatcgaccacgcgctgcagatgaacaagttcgaagtcgagaaagacaccatcggcgatatcatcatcctgccgcgcgagcaggcggtgctgatgacttactatcgtaacaacatcgcccatatgctg

SEQ ID NO: 71507 - DNA, 867 bp, Glycine max
  Peptide Sequence Number=SeqID_163192
cggcccgctgaccggctgttcggagacgtcggaggtggcggtgatgtcaccgatggtttccagcgaggtgaccataaagatcagcatcagcggcagcagcaggttccagtcgaagcccaggccgtaatagagcggcgtggggatggtgattgccgccgtgggggccgccggtgcgtcggcgggcagcatgtccatcgcccaggccaacagatagccgaccgccatggcgatcaccagcgaagccacgcgcaggtaagggttgcgctggcggttcagcaggatgattaccgccagcaccgcgccggccagcagcaggtttttcggcgagccgaagctatgatcgttcatcgcggcgtagccgccgccgatcgaggtcaggccgacctgaatcagcgacaggccgatgatcatcactacgatgccggaaaccagcggggtgatgatgcggcgcgccagatgcagcacgcgcgacagcagaatttcggtgcaggaggcgaccatcagggtgccgaacagcgcggccatcatggtcggcacgtcggcgccgccgtttttcagcgccaggccgcccatgatcagcggcgaaacgaagttgaagctggtgccctgaatcgacaacagcccggaacccaccggcccccaggttttgatttgcagaatggaagccagaccggaggcgaacagcgacatgctgatgatgtgctgggtatcctgtgccggcagacccagcgcctggcagatcagcagggccggggtgatcaccgcgacgaacatcgccagcagatgctggccggcggcaaacagcgtttgcggcagcggcgggcgatcttccaggcgataaatcagttcactggcgcggggttctga

SEQ ID NO: 71508 - DNA, 342 bp, Glycine max
  Peptide Sequence Number=SeqID_163193
atgcagagttcaaaacgtgatgtctaccttgaagcctacctgaatgggctagacaactaccttaagggaataattaacagtgctttgaaagaacttgatgatactccacaacctaaatccaaggctggtgctaggtggattgttgttaagtgtaatagacaaaaaggaagcactgagtgtggctattacgtcatgcactggatgtccatgataatcttaggaactttcaggaataattgggaaacgtattttaacgatattagaccattggaagcagagagattgaaggcgcttcgcatccagtgggcacaattttatctcaaagttagaaatcaaacttag

SEQ ID NO: 71509 - DNA, 363 bp, Glycine max
  Peptide Sequence Number=SeqID_163194
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccaagtga

SEQ ID NO: 71510 - DNA, 246 bp, Glycine max
  Peptide Sequence Number=SeqID_163195
atgaaggttttccgtcgttcttcaccattgtttatccgttcttcgttcgttcttcgttcttcaaccggtctgatttcctcatcgcaaatgaggatacgtaggagcaaaagccccgcttttgtcgtccaccccaagagatcgttaatggttcaacgccttaacgtttctctcctttcaaaaaccaagagatcgttaatgatccaatgccttaacgtttctctcctttcaaaatcaagagatcgttaa

SEQ ID NO: 71511 - DNA, 185 bp, Glycine max
  Peptide Sequence Number=SeqID_163196
atggcctctaggaagaggaaatctaccgcctccagaccccaggagccctatgaaaccactagattcatatctgagggcgcctgggagagatatgcacagaacgttcactcccggaacatccttctggagaggaacgtcattttatatgtcacggagtatgacgagttctactgggagctcgagag

SEQ ID NO: 71512 - DNA, 243 bp, Glycine max
  Peptide Sequence Number=SeqID_163197
atggtagccataatccctgccagggttcctcaacctccatttttccgaggatacgactcgaacgcaacatgtgcatatcgtggaggagttcctggacattccattgagcactgtatgaccttgaagcataaggtgcaagccattggtttgtttgctcaagcgacctgtgctcctaagttttttgacttccaagaccgttcaatcagagattactcgtcctgcacgttggtgggggtgtcgtaa

SEQ ID NO: 71513 - DNA, 288 bp, Glycine max
  Peptide Sequence Number=SeqID_163198
aaaagaagaatcgagaggtgtcagaacttcaacaatggaagaaaatcacaagaagactctcaagttcttagatgttacaaatgcaaccaacttggtcacatcaaggctaattgtccttcaaatgaagaatgtcctgagaaaagtgataagaaaaggtatgatgaaagaaggaccaagaaggcctacattgcatgggatgacaatgattcatccgatggttcagaaaaggagataaatcttctaaccagggattatgagagtgatgaaaacagttctcaagaaggttaa

SEQ ID NO: 71514 - DNA, 766 bp, Glycine max
  Peptide Sequence Number=SeqID_163199
tgtttgggacagtactattcccgaatgtagacgggttggtggatctagtggcgatcgacgcctttcttgcttatcaccacagcaaggaaagcccgatcattgctgttttggcagatacatgtgatatattcgacttgagattctgtctcctacaaggtcatctcatgtgctccgaagagggtaaagaaaattgggaagaactcttggtaggcatgacgggagtgtccattagttggttcccacggtggaaagaaggagagccaggagtgttatgctcatgctatcctatgagaggtgagtcgtcggagaaaatcatcacgcctttcatcgagcgaggtttcaatgaagctaatgcgaagatacttcacaaaatctgtaaagcgtggaatagagtgggaagaaaagataaggagcttaggggaggtagcaatggcgtcatcagtgactatcacaagtggttgaagtctagaatgcaagggatagcctggctcccaaagctgagaagtctaagtaggaaagaggctgaaattcttgtggaaagtgaagaagtgcaagctttgaaagcagagctcgaaagaacaagattggtgaaagagaatcttaagacggtagtcactagggtcagaaaagagtgtgatgagctgaaagatatcaacatgaccacggttgaagcattagataacgagcttaagcgtagaagggccgagagggacaaatcaaggatggaaagcatggtgttagaggataagttaaaggcttgtcagag

SEQ ID NO: 71515 - DNA, 399 bp, Glycine max
  Peptide Sequence Number=SeqID_163200
atggagtttgcggatcacttactacctgcgggtcagccttgtctagtgcctgggcaggtatctgcggattacattgagtggtttttccgcatatctcaccctttcatgacaccgacccaggcagctgaccagcagagggatgcaccagctacagaccctgaggactacatacggcccagcccccaggttccagtggcatttgacccccctccatatgtggatgattacgagggatatgaggcgattgcacagaggttggagcgtgtgctcaaccttaggatagtcactgcaggcacagagttatatgacattatgcaggactgcctgacgatcgcgagagggggacccagtactgatgggacggtcagggctcgtcagagacgccgcacggaccattga

SEQ ID NO: 71516 - DNA, 164 bp, Glycine max
  Peptide Sequence Number=SeqID_163201
actttggtagagaagaccatatggaatccatcacacaacatcaagggtcagtctgtccagacggctatgatacgttgacacgagaaatgccttgccagaggtccatcaacatgcacgcggtctctactcgtcataatccttggaagctagggcgaaaccaatag

SEQ ID NO: 71517 - DNA, 111 bp, Glycine max
  Peptide Sequence Number=SeqID_163202
atgggaagcactatggatagcactgtctatgaccatttggaagcacagaaacagcatgaaaacaaagaggggaacgagcaacaatttgaaggttgtacattcaggaactaa

SEQ ID NO: 71518 - DNA, 348 bp, Glycine max
  Peptide Sequence Number=SeqID_163203
atggacttgaaggaaaattgtacttatgtcatgcataattttaaagtgcgaaaaaacaacgatcagtacaaagtttgtgatcaccaatttaaattggtgtttattggagttactgttgtaaggcagtgtgttctagatgacctcccttttagaaaatacaggtttgttggatttgccgatgttgtggctgggcaatttgaacctggcctattggttgatgaggttgtctttcgccatgtttcaggaaaaggtagaagggtagtctttaaactaaaggacttgaggcttgcagagttgggcattgaggcccggtcagtttttaaatcccttggtcaaggcagttcatag

SEQ ID NO: 71519 - DNA, 488 bp, Glycine max
  Peptide Sequence Number=SeqID_163204
atggcttctccacctgcctcgccccctcctcctcctccttctccttctcatcctcctccttctgacgcatcagcttcgccatctaccgtgaagcggacacgcaaagcctcactggtccatgttgattctattaccagcaaggtcgtcggtccctataggaagaaattaaaaacatatttggggattgtggcgcgtgataaggtggacgtcacgtacgagaactggaaggaggtccctactgctcagaaggacttgatttgggaggatattcagaatttgaaatcccagaggcttctgacagtaggatgtaaaagaagttacttcagactgtcggtgagagatggaggcagtttaaatcagaccttacgaggaaatgggcccttgcagccgatcaggacggtgtggacgacactgtctatgagaaatacaacaaaagcaaggaaaaatgggtccagttttgccagactcgcagagaccctttttgggag

SEQ ID NO: 71520 - DNA, 1044 bp, Glycine max
  Peptide Sequence Number=SeqID_163205
atgtcgctggagctggagcagctcaacatcgtctttgggccgaacggcaccgggaaatcgaatatctataaggcgatacatctgatgcacagcgccgcgcaggggcagttttcccaggcgctggcaaacgagggcggcatcctgaaggtgttctgggcaggcaaaacccgcagcgatcagctgcggcggatgaatctggcggtagaaacagagacctatgaatacgagctgcaggtcgggtttgtggagaagctgccctatccctcgcagtttcagctcgatccggtgatcaaagaagaatctctctggctgagtggccagcaccgacgcccctcgtcgcagctgatgaagcgcaggaatcaggcggtgtttctgaataacgtgcatcacgagaaagtgactcacagcggcacgctctatgagaatgaatcggtgttcggtcaactcggtgaaccgcatctttacccggaagtgtcgcagatgcgcgagtccctgcgtaactggcgcttttaccatgagttttccgtctcctccggctcggcgatgcgtgccccgcaggtcggtttccgctccccggtgctggccagcaacggcgccaacctggcggcggcgtttcagaccattgtcgagattggcgacgaactgctgctgatgcgcattctcgaccaggccttccccggctgcgtattttacagcgacaacaccggcggacggttccggatgatgatgcagcgcgaagggctgagcagaccgctggagcccgcagaattctctgacggtacgctccgcttcctgtgcctggcggtggcgctgttaagcccgcgcccaccggcgtttatcgcgttgaacgagccggaaaacagcctgcatcctcagatgctgcccgcgctggcgagcttaatcgccgaggccagccgctactcgcagatctggctcaccagccactcgccggagctggcgcatttgattgagaaacatcgatcgttttcgctgtatcagctgtcgatggtggagggagagacgagggtggagaggctggggtaa

SEQ ID NO: 71521 - DNA, 447 bp, Glycine max
  Peptide Sequence Number=SeqID_163206
atgaagcacttcactgacaccctcatcagtgccaacatatgtatcaatccttacaaatttttccaaattatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71522 - DNA, 423 bp, Glycine max
  Peptide Sequence Number=SeqID_163207
atggtgttaatgttgaagatgatgattcactcattgataattatgcaaatggctacaccacccaactcactccttcccccacctactgatttagcatcacattctccttctaccttgaagtggacaagaaaaacgacacgactgagatcattggctactagatcagttggggcagagaaatccctgaattggaaacaagtccctgttgcccagaaggatttgatatgggaagatattcaggcacttacaatcaacaaggacgatgtcgatgacattgtatgtgaaaagtacgacattagcaaggagaagtggacccaattttgtcagagccgtagagaccctttgtgggaggatgtgcgaaagaaggcacatgccattcagaaacaaaacattaccctcacattttgtctcgtggggttatga

SEQ ID NO: 71523 - DNA, 276 bp, Glycine max
  Peptide Sequence Number=SeqID_163208
atggagtttgagaaagacatgaatatgagtcagagtatgaataagaatgaggtggatttgcatctcatggagacaagtgagaaggcaactccgagttttgatatcttgaattggtggaagcattggggtagagttcttaatacttacaggagtttcttgactccaaagacagttgaggcttcaatttgtgcacaaaattggttccgctccactccattaacaactgatattgaagaccttgtgggagaacttgaaaagatagagctaggtacttga

SEQ ID NO: 71524 - DNA, 1137 bp, Glycine max
  Peptide Sequence Number=SeqID_163209
atgggggtgggtggaaaggtgggatcttttggagggaaaggatggtgggtgattgtattgttaaaattcgttggacccaaggagaagaagctatgtgcaagggagttgcggagggaagtgaagatcatgtatttagttgtgaagagagaaactgagaaaaggaagagaacaagcgaagtgagaagagaaaaaaatgagaaacaactaaaaagcttcgagaaatgggatgctcctgaggagaatggcagagaaggacgcagaggaagattggagttcttttcggagaaagaaaaccaagaaacacaacaaccacaccctggagaagggaacactccagagaagaaccctcactgtgttaccgtggtgttgccagagaaggatgcagggggcgtcaatttcttttgccgttgtggtgttgtcagaaaagaagcccgtcgaggccgcgcgacacagagtggagaagaccatgaagtggacatacgtcaggagaagacaaagcagaattttgaaatggcacaagagagcataagacagatgcgagaactcttaggagagctagtcatggttgagggtgagatagcgagacttaaatcccaaataagccaactccaagatggtttgaaacgtgaacaagaagtcaccatggaatcaaagcctaaaacgatggcatttgaaaccaaggcgttgcatttcataagcaaagctataaagggcgattataatctcaatgacttcagttataatgataaagcagggttttttaaaacttctgtcgaacagaaagaaattgcgggagcgcaatccagagatttacttggatctcccaaccagatcactttggatccacttctgtcagaagagaatgatctcaagtggcagcccaacaagctatctgagagcatcatgaactctatggatcccaagttcatctcaagtccatcctctataccattactaaggaagttaaggatcttgatgagcaatcttcaaactgttgacttgaaaagccttacaaaccaacagaaattagcattctggatcaatgtgtacaacgcttgtatcatgcatggatttatccaatatggagtgccatctaccccagaaaaactacttgcattgatgaacaaggtacattaa

SEQ ID NO: 71525 - DNA, 279 bp, Glycine max
  Peptide Sequence Number=SeqID_163210
atggctacaactgcaagatgccatggtcttatggctcatgttaaacagcttgagattgaagttccttcactggagaaggctttcttttctcaaactcatcattcctcattctatacaaatggagcgattgattggcatcctaatctacgttttgaacaaaatcttgtgacttgtgcagacttacctcgatttacaatggattcatatgaagaatgtcatggtcctcctagactgtacttgttggataagtatgagctgattcatgagacatatgattag

SEQ ID NO: 71526 - DNA, 1542 bp, Glycine max
  Peptide Sequence Number=SeqID_163211
atggaagaacacaggttgagcttgagaatgagcacgcttgtcttcactctttccattatcatcatcgtactctcttacccagcacaaccacttgcgttgaaccattctccgaaattcctaggaaaattcgcagcaacagcacgaacccattcaaattccgagccaccgccgcaattccactacgaaaaaagatacttccaacagcgcctcgaccacttcagcttctcggagctacccacgtttcctcaacgctaccttatcagcaccgaacactgggtgggcccacatcgcctgggcccaattttcttctactgcggcaacgaaggcgacatcgaatggttcgcccaaaacacaggcttcgtctgggaaatcgcccctcgctttggagccatggtggttttccccgaacatcgatattacggcgagtctgtgccttacgggagtgcagaggaagcgtataagaatgccactaccttatcgtatctaacagcagaacaagcacttgctgatttttccgttctcatcacttatctcaagcataattactccgccaaggattgccccgttgtcttgtttggaggatcatatggtggaatgttggctgcatggatgagactcaagtatcctcatattgctgttggggcactagcttcttccgctccgattcttcaatttgaagacattgtgccacctgaaactttctatgaccttgtttccaatgcttttaagcgtgaaagtttcacttgctttaactatataaaacagtcatggaatgagatagcatctacaggccaaacaaataacgggctggagcttctgaccaaaactttcaacttatgtcagaaattgaagaggactaaagatctgtatgactgggcagaggctgcgtatagttatttggcgatggtgaactacccatatcctgctgaattcatgatgactttgcctgaacaccccatcagggaggtttgtagaaggattgatgggggtcctgctgggactagtattctagagcgcatatatgaaggagtgaatgtctactacaattatactggagaagctaaatgttttgaactggatgatgatcctcatggcatgagcggttgggaatggcaggcttgcactgaaatggttatgccaatgtctagcagccaggagtccagcatgtttcccccatatgagtataattacacttctatccaagcggagtgcttaaagaaatttggagtgaagccaaggccaagatggattactacagaattcggcgggcatgatatccatgccaccttgaagaaatttggaagcaatataattttctcaaatggcctcttggatccatggagtggtggcggcgttttgcagaatatatctgaaagtgtggtttcacttgtcactgaagaaggtgcacaccacatagatttacgttcttcaacaaaaaatgatcctgattggttggtagagcagagggagactgagataaagctgatagaaggttggatcagtgactaccaccagaaaaatgaagctatgtttgatatgtaa

SEQ ID NO: 71527 - DNA, 276 bp, Glycine max
  Peptide Sequence Number=SeqID_163212
atggaagaaaagtctacatcatgcaatgtgtgtgacacatggtgctcattttcattgtatgtgcatattgaacaagtggcagcaacagcggtgtgggaattgatgactttattgataaaacctataagggaaagcgaaccatcttgtgaagacattgaattgcttttaaatgtgagagaggcccaatctcgtgggcgatctgattttcaaatttacttgagaaacataaagaacaaaaagtccatggtgaagcgtctcatgcatcagcatatctga

SEQ ID NO: 71528 - DNA, 447 bp, Glycine max
  Peptide Sequence Number=SeqID_163213
atgaatgtagtagccggagaaattaattggcatgtatgttgggattttggtttcttagccattagtgaatatggtcacaacaaccgagtggaggagcttcagcactcaactcttgaccttgctagtactacgcggcgtcaagcatcttttcttttctctccgaatcctctccttcacctactcctcataatcttgttaacctcaaagggtcaaagtccatttattttaacatttacgtatctatctgtcaacaaaatacagaaaggtaaagcgggacaagaaaagaaacaaaaaacgacaaacgtgtttcagaacaacagaaaattcggagagaaagagcttttcttctttgaaattgcaatgtcacaacgtgtaaacacagtgtcgaggctcgggaatgaggaagactttggaataaaacacagaagaaaaatccctaactattaa

SEQ ID NO: 71529 - DNA, 348 bp, Glycine max
  Peptide Sequence Number=SeqID_163214
atgatcttgattgaggtttgttgcattgctttgtctctcccggttggttattttgatcctttcagttattcatgcatttgcagtccgcaatgtcaaggttcttgcaagttggaagaatttattttcactgcctattactctattattgagtttgttattatgttggcatgcttgttttcccatcagagtggtatcagagctctttggttaaggggttatttttctacttgcttgaacgatgaaggcacatatgaagacgatatcattgagtggagcaaactatcacttttggaagggcaagatgaaggactttctatttgtgaagaatatgcatcttccagtctttga

SEQ ID NO: 71530 - DNA, 1473 bp, Glycine max
  Peptide Sequence Number=SeqID_163215
atgaggaaaaatgtggtggtggcagtgagcacaacaactcttgcgctggtagtagtaggggtattgatcagaaggtggaagcgatggaaagagcaacagttgtggaaaacaaagcaaattattcgaaaattcgctagggaatgtgccaccccagtaactaaactttggcaggttgctgatgattttgtctctaacatgaaagtctctcttggttcttccgatgaaaactccactctcaacatggtgatctccaatgttacatcactcccacttggagatgaggaaggatttttttatggggttaatttgcaaggaaagcatttgttgatgttgtgtgcacggctaggaggaaagagtatgcctatctctgcgttacaaagagaagagatttccatccctgatgctgtcttggctggtgcttctgaggaaataactgattacgtagctacagagatagctaagtttgtttcgttgcatcctgagattcaagatggtgcacccgccaaaaagaagaaattgggcttcaccttgtcatatccagtggacgaagttttgccttttgcggccacaacatttcaacggaaaagcgcaaacaacccagttcgcaaaggaatggtgaaagaccttaataaagcattgactaatcatggaatgaaaatgcatgtttcttcactggttgatgaaactatcggaggtttggccggtggaagatactataacagagagagcgtggctgcaattacccttggcatgaacacaaacgccgcttatgtagaatcggcagaagaagttgctaatgaccttacacaatctcccaattcaagcgagctggtaattagcatggagtggggaaagttcaattctcctcatcttcctttaacatcatttgatgcgagtgtagatgctgaaagctcaaatcctggtcgcgagattttcgaaaagcttatttcaggaatgtatttgggagaagttgtgagacaggtcttgttaaagttggcccgagaaacagccttatttggaagcaacgtgcctccaaagttaatgactccatacttactaaggtctccagatatggcagctatgcatcaagacatgtccgaggatcgtgaaatagtgagtgagaaactcagcgagatttttgatatcgatagttgtagcctaatggcaagagaaatggtggcagaggtgtgtgacatagtgacggagcgtggtgcacgcctagccggagccggaatcgtggggataatcaagaagcttgggagagttgagaacagaaagagtgtggtgactgtggaaggagggctttatgagcactatcgcatctttagaaactaccttcatagcagcatctgggaaatgctcggcaaggatctctcagacaatgtcatcgttgaacattcgcatggtggctctggaactggtgctttgttccttgctgctgctcaaacttatgcacaccgtgcggattcttga

SEQ ID NO: 71531 - DNA, 849 bp, Glycine max
  Peptide Sequence Number=SeqID_163216
atgccacaatctccctatatttcctatttttttccttcttcaggtggttttgatggtggagaggttgagaagattcctgggttcgatttcgtagactggttaaagaacacggtttcggagaatgatttcgttgtgatgaagatggatgtggagggtactgagtttgatttgattccaagattgtttgaaactagggctatctgtttggtggatgagatttttcttgagtgccattacaataggtggcagaggtgttgccctggacagaggagtcccaagtatgagaaaacttatgatcagtgcttgcagctcttcacttctctcagacaaagtggagttcttgttcatcaatggacccaaaccgccagaaccagtggcgagtttggtgtccttgagcaaatcgccagcaccaatggcgatacgtgcatgcagagacgaaaccgccagtccaaatggcgatacggtttgcgctttgggaaccgccagtcaaactggcgagttccatggcctgaggctgcagggctacgtccctgccatggcagtgtagtgcagatgcaggtgcaggcaaaaccgctattaccattggcggtttgccttgcacagggattgccaagaaaacgctattaccattggcggaagaagcttcgtgattgcactgctcttccttcctttgcttccattgctttgctattcttcttccttatttcctcttatttggttgttgttgccttcttcttatttggttgctgtcttttgtttttggggtgtgctttgtttcagtcttggtacgtgatttctctcctcttcatattacgtgagttctctgtgcttggtttagttggaatgtga

SEQ ID NO: 71532 - DNA, 585 bp, Glycine max
  Peptide Sequence Number=SeqID_163217
atgaccatgattacgccaagctcgaaattaaccctcactaaagggaacaaaagctggattaaacaacctacagaaacaaaacgaaagaggaaaaagcagcggaaagagaaagccattgatgacgatgttgtggaggacttagtacttagttcggacgaagatgtgcctccaagccacagcccttctgctaggaaaaatgacgacacagaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71533 - DNA, 893 bp, Glycine max
  Peptide Sequence Number=SeqID_163218
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctaagaaatccgcagcaaagtctaccgaaaagaagggaaaaactgttcaggtgctgaaggaagagaaactagatccactagctgagaaacttcgccagcaaagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 71534 - DNA, 348 bp, Glycine max
  Peptide Sequence Number=SeqID_163219
atgatttttgacccacggatgaagcttgaagcacttcggttttactattcaaagcttgatgcttctacttgtgatgaaaagattaataacataaaagagaagatgtacaagctctttgatgaatatgtgattgtaaagtcaagttcatctactgcatcaagttctcaacaacctactgttgaagaagatttcagtatagaagaaaatcaagagatggatgatccatataatgaatatatcaattatgtgagccaaaatgttaatgtcaatggcaagtctgaattagatctctatttggctgagacaccgcttgagccaaagttttttttcctaaattggatattttga

SEQ ID NO: 71535 - DNA, 873 bp, Glycine max
  Peptide Sequence Number=SeqID_163220
atgccagctaactttgcggacctcgtcttcaccggagaaagaatcgagtccggactgagaaaaggcaagtttgaatatgcctccaacgttgcccccaacaacaacagaagagccccagtggtgggcacgaggaaaaaggaaggagatacccacgcggtcaccaccgccccaacatggatgaaagcgccccaaaatgtccaatactcataccagcacaaccccccgaacctttcaatccgagccgggagttccctcccaactcaagtgaaaggacctcccgcaacaaaaagaacgcctgcccaacacacagctccagccatgccccggccagccaataatacaactcctggcgcgagctataataatgcacggcgcacccctccgagagatgatttctctcctattcccatggcatactccgagttgtggccttcattattggaaaattatttggtggtggccatacccgggaagccattcaaatataaggtgcaacatctattaaacgccggctggctatcattccaagagaagggtcccaacgttaaaaccaatccactgtccagtcatggaggggctagcgtaaacgccatcgaaaaggatgggccgtcaggggcaaagagattagaagatgtggctacatctagacggttcacctacgagtcgctgcaagcggcatgcatggtctctcgtggcggagacgaaagggacgaaagggacgaatgtttatttcatctcagggaatcgcacgacatggaaacctgtcccgcggtggaagaattgcttcagcggctcatggactgggggcagctcgaagtgtccaaaggagggagggaagaaccacagatttgcatgcagtcagaagaaaagaag

SEQ ID NO: 71536 - DNA, 336 bp, Glycine max
  Peptide Sequence Number=SeqID_163221
gtgctccagtggcttctgtttctatcagctgtccctccctgttcagctactgacggggtggtgcgtaaccggcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 71537 - DNA, 237 bp, Glycine max
  Peptide Sequence Number=SeqID_163222
aaaatccaagccgaggcgctttcgagacgtttccgtgggcgatttcgcgaaggttttccaccgttcttcatcgttcttcgttcgttcttcggtcttcaaccgacgcgtggggtgctaaacgttggtggcgactccgcgcgttttccttccttggaagatgcacccgttagtctagcatcgccctcccgccgaagggtagagtcaacagttggtgactccactggggacaattgttag

SEQ ID NO: 71538 - DNA, 652 bp, Glycine max
  Peptide Sequence Number=SeqID_163223
agggctacacgtcctcgccttcagagggctacacgccctcgccttcagaggactacacgtccttgccttcagagggttacacgccctcggccttcagaggactacacgtcctcaccttcagagggctacatgtcctcaacttcatagggctacacgcccttactttcagagggctagacgtcctccccttcagaggactacacgtcctcgccatcagagggctacacatcctcacctttataggactacacatcctcgccttcagaggtctacatgccctcgccttcagaggactgcacgtcctcaccttcagaggactatacatttagaggactacacatcctcgcttacagaggactacacgtcctcgcctttagagggctacacgccctcgccttcagaggacaacacgtcctccccttcagagggctacatagggctacacgtcctccccttcagaggactacacgtccttgccatcagagggctgcacgtcctcaccttcagagggctacacgccctcaccttcagagggctacatggactcaccttccgaggaatacacgtccttgccttcaaagggctacacaccctcacctttagaggactacacgtcctcgcctccagagggctacatgcggggatcctctag

SEQ ID NO: 71539 - DNA, 234 bp, Glycine max
  Peptide Sequence Number=SeqID_163224
atgtttgtcctccgtttcgaggccatcaaaggatggtcgttccaccgagagagacgcgtccagctcagggacgatgagtacaccaactttcaggaagacatagctcgccagggttggacatcgctggtcacccccatggctaagtttgagccagagatagtcctggaattttatgccaatgcttggcccacgaagaagagcgtgcgggacatgcggtcatgggtaaggggctag

SEQ ID NO: 71540 - DNA, 783 bp, Glycine max
  Peptide Sequence Number=SeqID_163225
attatggatagaaccagaggattggattggactttaggcaaggttataggaagaaccttagggagagaagttagtggtgatgcagatgaatcccctcggcggcgaagacccacaacatctgcacataggcaacgggaagttgcatcttttgttgaggatgttgagcatgtggatcatgtagttgacgaggtccataaacagcttgaaaaggcaactgctgaagatgtagatgctgatgcccaggattttccagacaggccccacgatacatcaattttgatggactatattcatcatgtggcagtcacagtttggaatagagaggaacgtcctgagttgaagttgtcatcccatggaaggaaggaagagaaatttggtagacctgtttcagatattgaaggtttagtggctgccacgggattaagtcctctaattgcatgttccttggacactagtaacaggggacttatatctgcttttgcagagagctttaaggctcttcatgtggacgaagtcgtggacctgttagttgacttgcttgaatttagtttagaagaagcaagagatgagacattgcaatgccatgaggcacatgttcggctatcctggctgcgagacatttatcgtagcaaatgtgacgcagcactatggactgtagcagctcaagcatatcttttgcatctgataggttgcacactctttgctaacaagagtgccacacacgtgcatatggtattcttggatgcatttggtgacctcagtcaaactggaagctatgcatag

SEQ ID NO: 71541 - DNA, 168 bp, Glycine max
  Peptide Sequence Number=SeqID_163226
atggcttcctatggtgtggtgtctccaatcatctttcttctccattccgctaccatgatcttcaagaagcaaaggactccattgatgaagaagatccaaggactacaagctccacatggaagctcgacaatggacacaaaagccataacatttgactcaaatgtttga

SEQ ID NO: 71542 - DNA, 399 bp, Glycine max
  Peptide Sequence Number=SeqID_163227
atgactggaacattccagaaatccctcaggatactcttagaaacaagcttaggacaaggtccagtatacttcaactgttatccaaacaaaacggtgagtctgatggatagaaacattcttgactctctgtttttaaatatccactttcatggccttgacatgaaagaaggatcaattctagcagctttgatttataggattcagtacaaggtcatgaatacttgttcgtctagaatcctgttaaaacctcaaagaggagagacaactttgtttatcactgatatgacaaaggctaacgtttctctcccaagaacaataaaattggatgaagtaactcttcccgaaaaatgggttatggataaggccacaccgtttgttccccgacccgctctaccatag

SEQ ID NO: 71543 - DNA, 184 bp, Glycine max
  Peptide Sequence Number=SeqID_163228
tcctttcactaagcgcaagcctcgcgctaagcgcatatttggtcatgcgctaagtcgagggtctctagcgcttagtgctcaacccttgcatctcaagctgacttggtccgctaagctggccaaggctaagctaaacccatttcaattcggtttgaattgggctaagcgatggccttcctgctaa

SEQ ID NO: 71544 - DNA, 768 bp, Glycine max
  Peptide Sequence Number=SeqID_163229
atgggttcgatgaggagcccatcgcccaactgctatgtataccggggcaggattttgcccggactgctgcagggaggcgagtgcgaatcatgcgcaccaaatatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatatatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaacaccgagcacatagccagggcttcgcttcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 71545 - DNA, 806 bp, Glycine max
  Peptide Sequence Number=SeqID_163230
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatggctgacacctgtaatcctagcactttgggaggctgaggtgggcggatcacgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71546 - DNA, 237 bp, Glycine max
  Peptide Sequence Number=SeqID_163231
atgaccatgattacgccaagctcgaaattaaccctcactaaagggaacaaaagctgtagagacagggtttcatcatgttggccaggctggtctctaactcctgacctcgtgatccgcccacctcagcctcccaaagtgctaggattacaggtgtcagccatcgaattcctgcagcccgggggatccactagttctagagcggccgccaccgcggtggagctccaattcgccctatag

SEQ ID NO: 71547 - DNA, 825 bp, Glycine max
  Peptide Sequence Number=SeqID_163232
atggcaaggattcctgacaagattaagtctattgatgggtcaagagagacgcttaagcttgctgtgagaatcaccgacctttggttcgttgggactcccaacaagtttgagcaagcggaaatggttattgttgattctgagggtgatcaaattcatgctgtttgtaaagcggaccacctaaagtcttggaaagctgatttgaaggagaattccacttatgttatgcataatttcaaagtggtcaagaatgatggtcaatttagagtgtgtgaacatgagtacaagttagcttttattggagtgactattgttagagaagttgatttgcatgaactaccttttaaggaatttagatttgttgaatttggaaatgtcgttgctgggaattttgtggttggcctgttggttgatattattggggtcgttgatcaggtgctttttcagcatgtttcatcaaaaaataccagggttgtttttagaatgaaggatttgagtggtgaagttttatcttgcacactttgggaaaattattgtatgcagttcttagcctatttgaatgaacgtggaaatgatgggccgatcgttattattttgacacatgccagaataaaagatgcgcagggaagttatctagcttcagtgagcaattcgttcaaggcctcaaaattattaattaatgaacctatattggaaatccaggaatttagagagaggcttttagatttaggtgttaaggtcagcccagttttgccacctggcgatcaaggaagttcacaactttcaaggggaagccaactatcatcaaaggatgcatttctttcgaaa

SEQ ID NO: 71548 - DNA, 239 bp, Glycine max
  Peptide Sequence Number=SeqID_163233
catttaatggacagaatgaggttgaaagtgtgcctaaacccctaggtggacacgaagtgtatgatcgggtgaaagacatcgatactatctttgagtatattaatatcgctaaactagttggggttcctgaaagtcgtcatgactgcaacattgaagaggtgatcccatacatagatgctcacaaaaaccatgtcaccgctactcatccaaaaatgaacaagatgacgttgttgcaatag

SEQ ID NO: 71549 - DNA, 342 bp, Glycine max
  Peptide Sequence Number=SeqID_163234
atggccctggaatggtggcctcagatgacgcatcctctacatgctatggtacctgggctgtgggaccttcatcttccctgtgaagagaaggttggcaccaggctaggctaccctatccagaaattgctcaatggaaggaatggatcctggaggcgccaccacctgagttgcagatgtggaaggaagatcagctggcctcaccctcgccctcctagcccctcggatagaaactaccagatcatcaggattccaacagttcttcctgatgtaggcctagttaatggttgggctcaagcgctcaaaagtaaggctatcagagacaacccctctggctcgacatag

SEQ ID NO: 71550 - DNA, 294 bp, Glycine max
  Peptide Sequence Number=SeqID_163235
atgacaagggctagagcaaggaaagccaaggaagctcttcaacaagtgttgtccatactatttgaatacaagcccaagtttcaaggagaaaagtccaagggcccaattggcaacctaggcatcagccttttgggagaccaaatggtggctgacttgttggctgttggggtgattcaagaacaccctggctgtatcaaaggactttcacaacctttgtgtgttgccctcgctggaaagagtgattctttccttcctttcatcttcacccttgttctttcaaaccacaaattctag

SEQ ID NO: 71551 - DNA, 513 bp, Glycine max
  Peptide Sequence Number=SeqID_163236
atgaagaccaatatggaggccttgaaagatcaaatgacttccatgatggaggccatgttaagcatgaaccgaatgatagaaagcaacatggccgcaatagccgccaccagcgccgccgctgaggtggattcgacccatccccctgccataaaccaagcaaaccaacccatcccgaacgtgttgggtcaaggaggagaggtgttgggaagcaccagcgatccacacgtagggcataataggaatgcttacccttatggcttaccccccaattatacgccacctaccatgcacatgcccaatgagaacgctaatcacgccgttcccgttacctttgagggtcagcaaccccagcctattaggggcgcccgtgaagaacctcaggagcatgctcaaggtgacttctacccatacctcactttcaccactgagggaccagcatttaatgctatatgccttgacccaataccgcgggagctcctcaaccccgccctctacaaccgctgcatttcttag

SEQ ID NO: 71552 - DNA, 477 bp, Glycine max
  Peptide Sequence Number=SeqID_163237
atggagatcagagtcgaaactgtaggcagaagacatggaagagatgaaaggatattatttgcagacctgtcgttttgttttgggactaacaagaaaggttggaggagagacggcgaggagcagcagttgaacgtagagataggtgcgatgaaggtgaaggtgtgttgcggtggtcggaggcagcaaacgaggtacgcagaaggtggttccattgtcgcggacgtgtttgagtgccgagaggatgttttgcggtgggctcgatccgtggctcatgaaaacagatttgtggtgataattttaaggtcggacacaaacatatgtagtagaggaaggactacgtttgtgttaattggctatgaaaggagtggcgagtataggtgtaggaaaaaagaatttatcagaagagacactaggactaggaaatgtgggtgtcccttcaagcttcgtcgcaagctagtgattggaggagaaggctag

SEQ ID NO: 71553 - DNA, 1521 bp, Glycine max
  Peptide Sequence Number=SeqID_163238
atgtcttctgcctacagtttcgactctgatctccatgatgaggagatggagatggagatggactttctgcgtgaacggtatcaggaggacaacagaaactatgatgtgtttttaagtttcagaggggaagacacgcgtgcttctttcacttcacatctctataccgctcttcacaacgcgggagtctttgttttcaaggatgatgagacactttcaaggggaaataaaatttcaccctcgctgcagttagcaattgaagagtctcgagtttctgttgttgttttctctagaaattatgcagagtcgcggtggtgtttgaaagagttggagaaaataatggagtgtcacagaacaacagggcaagtggtagtgccagtgttctatgatgtagatccctctgaagtacgtcatcaaacaggccactttggaaaagcatttcgaaaccttgagaacagacttttaaaagtggaagaggaagagctgcaacgatggtggaagacgcttgctgaggccgctggcatctcagggctttctgttgtccgaaattgcaaggagattggtgataagatatgtctccttgcgcagcattggagggaggcacttcgtgaggctgctggcatcttgggggattcagtctcagaattcggggaaacactgtgtgaggcactttgtgaggctgttggtttctcagatggtgcagacttatattacagaaccgcttgtggtgaattggagtacggcacttggcgaggctgcagagggaagtttgctaatgagataagcctcctcatgaagcattggagggaggcactttgtgagcataatggcatcccattggttttcctcttaaatttcagtgttgaagaggagattataagagattttaaggacttaatgatgtcttggaaggaagcacttcgtgaggctgctggcatctcgagggttgtagtcctaaattacagagctcctttttggaactctgctgtgcatagtcttcgaaaaatgccttcttgcaacaatctgaatgcgaataatccctcttctactctgaatccagtacaagatcctatgagccttttctatgtcaatccaaatgaaaatcccgcagcatcaatcgtttcttctccattgactggaggaacttgcgagaaagattctgattctaggaaagcatggctaactctgaactttcctctgatgctaggaggaattttcgagaaaaagattctcacaagcagatctgcaacctcctgcaaccggacactcattggagctcaatattcctcaaccaggatgagggcacgagttgaaaactcaacactcaagcatcgttcgctgcaggattctgatagacatggcacatacatgacatcgattgctgccaacaggcatgtttctcagtgtacacgttctaacatcatcaccactgtcaatgacatcgacgcggatcccttaacgtggtggtttcattcctcctcaccatcaatgctatcaaggttgcaaagcttcaaacacggctaa

SEQ ID NO: 71554 - DNA, 852 bp, Glycine max
  Peptide Sequence Number=SeqID_163239
cactttccctcaatcgcggagtccactattgatcaggactacgacgaggattccccgcgtgcctgtaggtggaatgcaacaaagaagaccgtgaagagcatacgtacaccggcgtatagggagcgcctggaccgactccggattctggatgtctattggatctcgtatggggagcaccgaccgatccgggacttccatttgatttcatgctattctggtctcctgcgctggggacctgttgttgtttattatcgaccaaaaagggtcgtgcgggagtttggatacacccaaaccattcctgctccgcctatcgattcatgggtgtcgtatgatgatatacacgataggtggatgcactacttggatcatatggttccaacaggtgaggtgtgcgttgtgtcaagtcagtgtgccagcgactacatggactggttcttctgcatttcccatcctttcatgacaccatgccacgcattagatcctctgccagatggtcatgccctgcagccccgagtcgtccctcaggccctacagatagatatccctcacgtgctagagccaagaacaccgtcgacatctgcgaggcctgctgtggaggagcctagacatgcagtggacgtttgccatggaattgctgagaggttggagcgtcatctgagcctaggggtggtcatgccaggctcattgacacatgaggtgatcgaagaatgcctcatgatggccaggagtgtcacacaggaccagctatgtcgagattctttaaacgcaaaaggaatatggatagaaatacatggtaaagagttagtaagagacttgtttcatgctaggtctttgaagagtcacaaagtatag

SEQ ID NO: 71555 - DNA, 318 bp, Glycine max
  Peptide Sequence Number=SeqID_163240
atggcggaaacatggttacggtgcttacctcgacggtggacgatgataacgctccctcgacggtggacggtgacgttgctcttcacggaaacctcctcaatgcacctcgcaacctcttcacaacaagctcctcttcacggaaacaatggtttgtggctgaagaagaagaacaaatggagcagaagaagaatgaaacggtctgaggtgaggaatggagacgccaatgagatgttcaacaatgttgagtggaataacagagctcaagttatttatgaagatgttcaattaggcggcatatataggaaaacctgggagtga

SEQ ID NO: 71556 - DNA, 147 bp, Glycine max
  Peptide Sequence Number=SeqID_163241
atggatggtaaagtcgacgatgaagatattcaagaagtgttacgtgagacaactttaacaccagatcttaatcgacaacaatgggttaaagctattaaatggttatctgacgatccaaagcagttggttattgtgaacaaagaatag

SEQ ID NO: 71557 - DNA, 699 bp, Glycine max
  Peptide Sequence Number=SeqID_163242
atgccaacgccatcacatcagctcggcggctcctcaccagaatcttactccctgcaccctgccactgtcattctgttcccacgaacaagaccacccggttgtgcacgtagcagcccccctcccataggtgatcagcctgggagcccaaaggtgttccctaccagaaaaatcaacatgcaacagggacaggcagatatcctcatagctaggttccctgaccctagctttggtgttaaaacaggttcctctcagtgttgggttgcaacggagaacaacgacgatttgtggtggataatggtggttgtgggtgatggagaaagtgcttgggacgttagaaatgactttggaagaaagaaagaagaaatggtgtttttcctaagctacacgaaagcaaaggctgaaaatgctcaagtgagaaatggtctcggacacggaaacatcgcgcacactccagaaatcttctcgaagatcccaaagggttcctctcagtgtgcagttgcaacggagaacaacgacggtttgtggtggctaatggtggttgtgggtgatggagaaagtgcttgggacattagaaatggctttggaagaaagaaagaagaagaaatgcttcctcaagaagcttcattaagaggcttcctcaagaagcttcctcgtggcttctttgagaagctttctcaagaggcttctttgagaagctag

SEQ ID NO: 71558 - DNA, 237 bp, Glycine max
  Peptide Sequence Number=SeqID_163243
atggagaaggttgtttatgagtggtttctccaacatcaagaacgtgtgaatatcacaggagaattaattttgcagaaggcaagagatacaatgaaactcgtgtatcctcatgatgattcaaattttagcttctctataggatggcttgggaaattcaagcaccgacatggcataaagtcatttcgtcgttttggcgagagtgggtctgttgatgtaccagacattggacaaaaattg

SEQ ID NO: 71559 - DNA, 240 bp, Glycine max
  Peptide Sequence Number=SeqID_163244
atgggacgaagatcgcacatggtagatggatcatcatactttggtattcaaactgcattggtattgttcaaagagggtgatgaagctcatacaaaccatgaaattgatactgaagaagagcaagcacaaatgcgtgtgaaaactcagccatgcgttctcgatgagacagcaaatgcaggtgctgatgcagtcggagtagaaatagcatatgcagaaataggtgcaacaatgcactgctag

SEQ ID NO: 71560 - DNA, 492 bp, Glycine max
  Peptide Sequence Number=SeqID_163245
atgggttggcaatggtttatcaaaagattacaaagctcagaaagaaattcatcggctcagaagcacaagttttgggcagtttgtcactttagtgaagaatggaagccttcagtttggtctctaatttttatttttttcccaaccttccttttctctgcgagcattttccgctttggccgaagaatttgtgaagggttgtgttcatgcaatggtttgatatggtatgcagcagaagatagatgtggagtggttgttaaaggagcaaatcggagtggaaatatagcaggaacatgcccattgaaggacaacgacattcttttgacagcaagagctttggatgattccaatgaagtaagaaacacaattgctgttgtgaatgagttgtccaaggaaatgagacaaattttgctttctcatcctgcgaatcctaaatgtgctctaggaggaaagaacatagcaagtgtagtccttttaggagactctggcatttga

SEQ ID NO: 71561 - DNA, 366 bp, Glycine max
  Peptide Sequence Number=SeqID_163246
atggcatgggtacatatgaagaatgtgcagttgctactgctttggcatttagaaggtctattccacatctacaacaagaccgttaatggagaaaatagtttcaaagttcctactgaagactctttgcatctggttgaagctttcaggcagtttagttcctttaaatatttgcatctaggattgtttgctattgtttatatcttgaattgtagtatggttgttactgaacttcctcaagatgatgctaagagagctcttgaggcattatgcataccagtcataactcatttacaagaaggaatgcatgaaggtccaaaaagcttgagtaaaagaccttctcgtcagttaacaattcatattgattaa

SEQ ID NO: 71562 - DNA, 282 bp, Glycine max
  Peptide Sequence Number=SeqID_163247
atgtgtacacaagcactacttacatcaggtgatgtggagcacgaggcaacagtttctgacaaccctttcacaactacagatctcgtagtcacggatattaagatattgtgtttaactattggatcttattcaaaatggcttgattatgcatctgaggcaatgtttgtattgccattagttttagatatcctaatgaatggcatgggtacatatgaagaatgtgcagttgctactgctttggcatttagaaggtctattccacatctacaacaagaccgttaa

SEQ ID NO: 71563 - DNA, 180 bp, Glycine max
  Peptide Sequence Number=SeqID_163248
atgaaaattctgatgaccaatactttaacaccctatcatagaggaggtacgatgaatgcatcagggcattcattgccatggtgcccaatgcatgcaattaagaaggcgatgcggaccttccgacttcccgtgacaaagataacgaaacaaatgcaatgcatgagtgatgacacggtgtga

SEQ ID NO: 71564 - DNA, 666 bp, Glycine max
  Peptide Sequence Number=SeqID_163249
atgttatgggcatccaaggttctacttgctcctcactcgatcaaaatgatacgaaaccttatgcttcaaagaagtgagcttgtgacagagttatttaagggaaaatgtctcagacatccaagtttctgcctgctctcgactttatcgaatgatacgacaccttatgctttaaagaagagttatttaagggaaaatgtctcagacatccaaggttctgcctgctctcaactctatcaaatgatacgacaccttatgcttcaaagaagtgacatgattggatcaggtagtccaggaaatgatgctttaataggggaggttgctaaggaagctcgggaccgtgctgctgacatgggtgtttacaatgaggagttagtgtacagcagaaaatgtgtgtcattagaatacaggccatcgattgttgatgaagacttagaatcaattccactgcccatcccatcacttccaatctcctctagagaatgcaggaggagtgatacgacaccttatgcttcaaagaagcgtaggagggttccagatgcgttgtggtgggcattgtgttgtgtagtgattcttctctttgtttatattttgagcaaagggaacaacattgagtccagatccgctttgtccaagatttgtcctgttaggtgtagctcaggattttga

SEQ ID NO: 71565 - DNA, 192 bp, Glycine max
  Peptide Sequence Number=SeqID_163250
atggagaggatcgatgcggtgaagggacaaagaaatcaagacagtggctgcagccatgaggagtggcaccggtggctgcatgcacgaggaatggtgatggttggaggagttggtggctcaaggggcgacgacaaaagggtgaaaaatgaagttagaacattgaggaaagaggaaagttctggagttgagtga

SEQ ID NO: 71566 - DNA, 675 bp, Glycine max
  Peptide Sequence Number=SeqID_163251
gctcataagaatcctagggccttctcttgcatctctagcccaatctacttggagttttctatccaatgcccttgcggggtaggattgcatcatgcagggttgctatggatggcgtggtcagggttcaacagtggagcaccatatgcagttaacattgcctcttccattgttgtgctcgacactaacatttgtgctgccactagtttccttttatggacttctcttgatatggtctttgctaagacccgtcattgtatccgaaatggtatcacatggctggcacgtgcttgttactttctcttactttggtgtgccctatcacttctttgctcgaaatttcgactcaattactcttactttggcgccctagctaggtacatagaccatcgtctccgacaaacaccatcgtctacgttgcgtcttgttcagtttgcagccaccgccgataaaggtaaggctgcatttaggccgttagttgctggtggtggtctacatcgtcttaaagctgcgtcctatataagtggggtttatgtgggcctcgttgatgaagctgacttgtggccagcgagtgaacgacctttggaaacaacctcctgccatccttcatcagtggtgtcatcctatgccagattatcactttcattgagcattgtttggtctaagttagtacactga

SEQ ID NO: 71567 - DNA, 367 bp, Glycine max
  Peptide Sequence Number=SeqID_163252
atggcattgactctacgtgtcaacatctctgagaggctgataggaatattgggtactggcttgaacttcgggcgcgctcgcggcgactgcgaggatcgattctattctccggcgaaggctcgccgagcgcttcacaccatggagaatgacaagcttcgtagggtccacagtgatgtcaccgcatctcgctccgtcagagacaaatcgggtcatcacgccctccgtttgtatctgcctaagttcacgtctttgtttgtgagttgtaacgaaagcattcaatgggaggaagcgtcgagaagaggactcagggcgtgtgaggctgagtttcagcctaatggaagcgcgatggaggcagttaagcgtgaaa

SEQ ID NO: 71568 - DNA, 705 bp, Glycine max
  Peptide Sequence Number=SeqID_163253
atggcccaggtgttcttcaagggtaggtttgtacatcaagatgttgtcaaagaagatcatgatgaatttgtgaaggaagggcttaaggtgctcgttcatggttgcttgaaacatgccataagaatctggtggaatctctggcataaatcaagctttgaaaaccaggaggcaatgcctagttcatccaatagctcatcgatcttcgacattgaaaaatgcacaggggaggaaaaagggttgtggctaatttggatgagaccagcgggtgtgaaaaaggtgagaataacattggatgaggtgattgatggtccgtatgaggtgagtaaatggggtagggtagatgtgtttgtgggtgtcgtgctgtcggagccagtggacgccgaggacaatattggcgccactaatgagaaggacatggagatcaacatgaaatgtttgtccctgaagaaccaagcacgtctgaatgaaattatgagtactccctccatcaatgagtattgtaaagcgggagtgatgaatgtggcatgccaggtggcctcttcatcttcaacaatgctcaagaagaagcgagctttgcatatgcgcttgacctgggctttaggtgaaggaatgggaggtggaagaagggctggaagtttgggggtaggttgtggtgtttgtggtagcagtggtggtggcggtgggttgttgaggattctagaatga

SEQ ID NO: 71569 - DNA, 294 bp, Glycine max
  Peptide Sequence Number=SeqID_163254
atggagaagattggtgttgtcgcttattgtctggctcttccgtcggattcccgcatccacaatgtatttcactgctccttactcaaacctcaccagggcccaatgtggaatgacctcactccagaagacaccatgtgggaaccatgggataaattgcgtgccactttccaccttgaggacaaggtgtctttgccagtggagggtgttgataggacactccaaccattgcaacccaagaggaacatgcgaagcccaattctaggcctgaccatgattggcaggaggtctctttaa

SEQ ID NO: 71570 - DNA, 324 bp, Glycine max
  Peptide Sequence Number=SeqID_163255
ttgaaagattccgcgtcggtggaagggttcctctcggtgtggggtccaacggagaacaacggtggtttgtggtggctacaggtggttgtgagtgatggagaaagtgcttgggacgttagaaatggctttggaagaaataaaggagaagaaatggcgtttttcctaagctacacgatagcagaagctgaaacgctcaaatatcttctcgaagatcccaacggtaagatcatggacaagtgtcttttgaagctgaagaccaaatttcgagaagatccaacggttaacaaaggctgggaagcatttttaacgaggcagctcatgtag

SEQ ID NO: 71571 - DNA, 390 bp, Glycine max
  Peptide Sequence Number=SeqID_163256
atggtggatgtgggtgatggaaaaagtgcttgggacattagaaatggctttggaagaaagaaagaagaagaaatgatgtttttcctaagctacacgaaagcaaaggctaaaaacgctcaagtgagaaatggtctcggacacggaaacttcgcgcacacgccaaacaccttctcgaagatccgaacgggtcaggagcccttgcatcatcaacgagattttttagacgacagtgacaccactctaaacggtgcagttgaggcgatgtacagtgaaatggcttctcgtcacagggttaggagcccttgcatccaaattatcaagactacaaccatcccagctaagctttgcaagaaggagagcaccaagcaatttcacaattcaaaaatctag

SEQ ID NO: 71572 - DNA, 459 bp, Glycine max
  Peptide Sequence Number=SeqID_163257
atggaattccaacacaccattttgcatgcttcttcgatctgttccccgcagagcctcgggttcccccaaaatgacgacgcattgaaccggatccatgccgacctcaccggaatcttgcccgagagccggttgttggacacatttaaatacctgaggctgctctacttgaaaccgggaatgcgtccggtgcgtgatctcctccgtcgtggcatcaatctggtgccggaggcacttctcctccgccagccacgcgttccgcaaatgaagaagaaggcaatggcagcgatgaacaagggtagggtttggagtagagggggtgtgaaacgcaaggtttgggaagatgctcagatggagtgtaacctaaaggagaggaggaagacagaaagtgaggtggtgaagaagaaagtcctgaagaaggagaagagtgaatgtgaacagtctttgaattatgaagactaa

SEQ ID NO: 71573 - DNA, 237 bp, Glycine max
  Peptide Sequence Number=SeqID_163258
atggtaattgttagggctaggggacctgatacttctactccctcttcttttgctcctcctgctccagctccaccaccagcagcaccctccggctccttcagcccaagagccgtagctagagccggaggtgatgctcgaggccactctagagactacccctactatcacaccacttgtggaggttacagatgttggacaagtggcctcagatatcttaagaagggggggttgaattaa

SEQ ID NO: 71574 - DNA, 280 bp, Glycine max
  Peptide Sequence Number=SeqID_163259
acagagtgtcacgtcatcacgcctagtcaatggccacgtaagcataggcctcaacatcagtgccatgtcatcatcttcttcctcttctccaacggaaaccaccaccacctcccatcatgccatccaaccaccaccactgcaccatgggaacaatgggtgcaccacgggaacaataggtggtccttcttactatgtttcatcattgccctacattgtggttggagaagaggaagaaggtgatgacgtggcactgatatggaagcctgtgcttgcatggtaa

SEQ ID NO: 71575 - DNA, 225 bp, Glycine max
  Peptide Sequence Number=SeqID_163260
atggtaatcgattacacctttgaaaaaccattttcaaaaatatttgggctactggtaatcgattactaccttctggatgaggatggcgctggagaaacagactatgcagctggcatggtcgcggcgcagagcacttgggatccctggcccactacaacacaggatacacctcagccagcccagaatgctccttcctcacctcatgatgagcccacaccggcatag

SEQ ID NO: 71576 - DNA, 213 bp, Glycine max
  Peptide Sequence Number=SeqID_163261
atgttgaagttaaaccatgcctcaacaataaaaacgaagccaagggattccatagaatccaatcatgtacaagatgatgtgtcttaccaagttgaggaaatgtcacatgtcaatgaagtcattgaagttgaaagtgcttttggattgcaagatttaagaggtgtcgttgaagaagtaaaccctgcttatttgttgacaaataaagaagaataa

SEQ ID NO: 71577 - DNA, 267 bp, Glycine max
  Peptide Sequence Number=SeqID_163262
atggatgattttagtgaggatgaagatcaacagttctttgatcacatcaatcaccaaagcgatgacgagggtgttggcagaccaacgacacctctgtcacctccgttgcaatatcaccaacctaggtgtccagtcaacttaaactttgaccacctatcacactatattgatcgacaccatttcgttcagcaacaacataatgtacaaccaccaaccagttcactcgaggttggcatgacctttgatgaaaaaacacaatgcatttga

SEQ ID NO: 71578 - DNA, 258 bp, Glycine max
  Peptide Sequence Number=SeqID_163263
atgacaggatgcaaccctcgtttgaccacttcgaggtacttggcacccatcgttagggcaattcgtaaaagttctgttaacattccgaaagggcaaaaaagggatgattacgtaaatccggaaaggggtgcaaatagcaaccaggcccacttgggccttccaggaagttctccaaaaggcggtgccttctggaggaagcaacctagctcgcatgggcgagctgggtgtcaagcttatccttccttttcctataaatag

SEQ ID NO: 71579 - DNA, 683 bp, Glycine max
  Peptide Sequence Number=SeqID_163264
atgaaagataagagggatgaggaagaaaaactagaaaaccaaatgaaaaagaaggatagtaaggccttctcttcaaaggccaaggggaaggaaaaagagaaaaatgactcctccaagaagattgttaagaaggaaaatcattttgcaacaaaatgtgatatcaaaagagcactccttcttaaacaatctttttaccttctcctatcaagggaaacatcccttagcaccgccatacctattgagcttgaggttattcctcaagtaaaggagttgttggataagggtttggttcgtgagagcttaaatacttgtgctttgttggtgcccaaaataagtattatgaggcgccaaatccctatgataggtggtatgatgaatgtgttgagtggtgcaaccctcttttgtaaaatcactcatgcatccaacatcttcatgattcatatacatagggactcattaggtagatttgttcttatttttagtttcaatacaaacttaggggctcttgtgggacaccttaggtttgtcgtacttttggtaggaataatcaacatggaaatacagaaaagtgatcaaggggttcccatgaaccctaagagaataaaggtcattcctgagtggcccactccaccaagtataaggaaaatttggggcttccattacttaacaaacttttacaaaag

SEQ ID NO: 71580 - DNA, 471 bp, Glycine max
  Peptide Sequence Number=SeqID_163265
atggttacctcgaaaaaaaccgcgaaggtcagattgggcttcgttctctaccgaaaccgcgagacaagtttagaagatttcactccgattgaagggttcctcttggtgtgggctttcaacggagaactacggtggttcatggtgtctactggtggttgtgggtgggttttggaagaaagaaggagaaaggaatggttgttttccaaggctacacaaaaaataagacttgaaacactcaagtgtttctgctctcgggaaaagaatcgtttcttaggcaccatcagacatatcacagatcgcaacggtcagatcgtggacatctgtccaatgaaccttcaaaccaaatttcgtgaagatccaacggttaacgaatgcaagagggcgtttttaccgagatggcttcaggcagcttccttgagaagcttttctcgagaggcttcgttgagaagcttccttgagaggcttctttga

SEQ ID NO: 71581 - DNA, 456 bp, Glycine max
  Peptide Sequence Number=SeqID_163266
atggaaatgcttgccgaagaagatgattataattatcggattcagcaagtggatatgattgataaagacattgaagcgctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71582 - DNA, 486 bp, Glycine max
  Peptide Sequence Number=SeqID_163267
atgaccatgattacgccaagctcgaaattaaccctcactaaagggaacaaaagctgggttacctgttatgaatgggtcgataataacgttgtactttccttctatatcacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71583 - DNA, 600 bp, Glycine max
  Peptide Sequence Number=SeqID_163268
atggagtctcacaatttccctgaaaaacagttttgcgatatgggaagcatcatccaccttgtggcatggtataaagtgtgccatcttgctaaaccgattcaccaccacaaagatagagtctacacctctttgggttctaggaagcccaaggacaaagtccatactaatgtctacccaaggtgcagaggggatggcaaagaagacccaactctggatgcaagttcagatgatgaggagtctcagcctaatgacactatcaactttgatggtgaagagcatgtggatctcaagaaagctcatcaagttcacttagttgaatttgtcctggaaaccacttcgcctggtagtgtacaagatgcctttgtttgtgaggatgtcaaagcactactagacgaaaaggtgtctagtggatacaaaactcttaaggattttcaagacttggaagagaggcttaagggacatgtgatggaagcttgcttgtggggcttctatggaagctggatcttaaagcttcaatggggtcctttaatggtgattttccaccatggagatgcagcggaagacaaaggagaagagatgagagaaggcaccatccactag

SEQ ID NO: 71584 - DNA, 295 bp, Glycine max
  Peptide Sequence Number=SeqID_163269
agacaaatcatggtcagtctgcgcccttttgtcatccagaggcggcgagcccgatgacatgcggagacaaattatggtcattctgcataccttttcgtcattcggagacaatcgtgttcgatggcacgagacaaattatggtcattctgcacccttttttcatccagaggcggtgagcccgatgacatgcgaagacaaattatggggcggcgagcccgatgacgtgcggagataccttatggtcatccgcgcctttcgtcaatcgaaaggaacaaattcggcagtatcaggatga

SEQ ID NO: 71585 - DNA, 258 bp, Glycine max
  Peptide Sequence Number=SeqID_163270
atggagtgcaacatctatggtgtaaaaataaaatctgatggtcctacaaatataggagctagaagtggtatctatgtaggtgtaggaggaataactagagctgaggaaggtactggagttgtggaagaagaaggagctggtgtctcaggtggtgctgaaatgagctgtgatcaagacagggaatccaagtctggatgtgtcatgctattcaatcagagagatctggtgggagatgaggtttgtggcgtccctaaataa

SEQ ID NO: 71586 - DNA, 247 bp, Glycine max
  Peptide Sequence Number=SeqID_163271
atgaatgttggagccctcatttctggtcagatttctcttgtggcccagtcgaactccttgaggcttggatttctagcccttatcactgctttgtgcatggcccgaggagttacttcagattctgtgacttatgagtccctcagcccagccattaacttggcttacatgaagaagaactattggaacctggatgaccccatggtcaactttccagggacccgcaagagtagggctagaggatctgagg

SEQ ID NO: 71587 - DNA, 330 bp, Glycine max
  Peptide Sequence Number=SeqID_163272
atggtaggagtttggagcatttcctggatgagtcttgaggtgtccgaccttcttagtgctagccagcttagagatcaggtctgctttggtattgcttcccctggggatgtagtacattttgaaacattcgaaattgtcaatgaaagtcttcacgatgtgatagtacttgggcagcactatttccttggtctagtatatgttggcaacctgcccttggacaaactgagtttggagcgtctcctagatgatagtcttgaggtgtccgaccttcttggtgctggccagcttggagagcaagtctgctctggtattgctttccctggggattaa

SEQ ID NO: 71588 - DNA, 213 bp, Glycine max
  Peptide Sequence Number=SeqID_163273
gcaaatggtcactttgggatagttgcagctcgcccaggtgagttgaaacttaaccctgcagcagtcagcttgcctaggcgagctggtttcttcaccatgaagctatttggtggcccaagcgagcaagaggctagcctaggcgagctagggtccaggaaaaccaaggaaaagacccttttgccccctttttttggtattgttttgcattcttga

SEQ ID NO: 71589 - DNA, 396 bp, Glycine max
  Peptide Sequence Number=SeqID_163274
atgttatccagcgcatgctgctgccctttcgtcaggcggccctggcgacggacgaagctacgaatacggcgcagcgggcgaccgttttcatcgaattccggagaaatgacgtcgtttttcataaaagttaagtctgcttgtgaatgtgttcggaaaacgggcattatccaaagttacccggcggatgcaagggtttacagccactcgcccttgtgctgcaatctgccaccctgtaatcgcgattccggagccgtagctttgacttttctcgccgcgcaattttcagcccaggtcctggactggtacgacaaatacggccgtaaaaccctgccctggcaaatcgccaagacgccctacaaagtatggctctccgaagtgatgttgcaacaaacccag

SEQ ID NO: 71590 - DNA, 516 bp, Glycine max
  Peptide Sequence Number=SeqID_163275
atggagctaatcgatattgcatgggattgcagttttttcagctggaaggtagaaaccaccgcgcgctttgccacatggctgcaggcgcaggatgacgcgatgattgaggatgtgttggccagcctggcggttctcagggagttcgggcccacgttagggcgacctgatgttgataccctcgtcgggtcgcgtttttccaatatgaaagaactccgtgttcagagtaatggccgggcgattcgtgcgttttttgccttcgatccggcgcgcatcagaaataaggcggcggaaaaaatcctcgagattcacctgcgccagctgcgggaagaactggcgctttcacaggtacagctggctgaaaagatgggggtttcgcaacctgctattgcagccatcgaggcgcgcggtgatgaactgaaactctccagcctgaaaaagtacgttgaggcgttaggcggaaaattgagcgtaaccgttgaactgccagccggtgacgggcggattttccagctttaa

SEQ ID NO: 71591 - DNA, 912 bp, Glycine max
  Peptide Sequence Number=SeqID_163276
atgagcaaagttaccatgagcgcgattgccgccgctgccggggtggggatcgccaccgtggatcgggtgctcaatcgccgtgcgccggtgcgggcgcagaccgaacagaaagtacgggcagcggcgcaacggctgggttaccgcagcagccacgccccgttcagtgcacagagcgacggcgtgacgctgcgcatggggtttatcctgctgtcgacttcgtactctttttatcaaacgctaaccgatgcgctgcgccagcagacgcagccatttcatccggccggcagcgagccgctgtttgtctggcacgagattgatgaggtggcagcggtggtggattcgctctaccggctggctgagcaggtggaggctatcggcgtggtggcgctggatcatccgctgatccgccacgcgatagcgcacgtttcgcaaagccgggcgcagcgcgggctggatcgccagccatctgctgcatcagccgggtccggcgggcgtgctgctgggggatcaccgctttatctgtcaggagagctgcgagagtggttttcgctcgtatctgcgcgagcaggacagtgcgcgccgcgtgctggaaccgctcaaaacccacgaatcgattgccggtggttatcaggcgactcgccagctgctggagcaacatgccgatctggcgctgatctacgcgccgcgctgcgtgagcagccgcagcgtaaggtggcgctgatttgtcacggcccggtcaatgacggcgacctggcgctgatagatggcaccatcacggtgatgctgcgccatcagatcgctgacatggcacgacagctggcacaaaccgtactgcaacgtcacgctgagcgcagcgaccatttttctcaggtcaccctgccgtttgagatcgtcatgcgggaaaatgtctga

SEQ ID NO: 71592 - DNA, 885 bp, Glycine max
  misc_feature (508)..(508): n is a, c, g, or t
  Peptide Sequence Number=SeqID_163277
atgaaaatcgcttttgatgtggatgttatccgcgatctcggcatcacgcgtatggtgcatcaggtcgcggagtggggttataaatacattgaacagtcgccgcatccgcagatcaatccgttctataaacacccaaaagccagccgggagatcatgcgcgagtacaaaaatgcgctcaacgctaccggactggaaatctcctcgtttattaccgtctatcgctggtcgggaccggatgagctgcggcgccaggcggcggtgaaaaactggaagcgcatgattgagattgccgtggagatgggcgtgcaggtgatcaataccgagctgtccggtaacccgaacgagcccgaaatctgcgaagagatgttctatcgctcaatggacgagctgctaccgattttcgagcgagaggggattcgcgtggaaattcaggcacatccgtgggatttctgcgaagagagcaatgaaacggccgatatcgttaagtcgttccgcagtgacaacgtcnaatacatctacagcgcaccgcataccttctactatgacaagggcaaaggcgacgtgaagagtatgctgcattacgctggtgacgatctgtcgcacatgctgattgccgataccatgaaccacaccaaacactgtcgctacatcgttaacccgccgggcgtcgatgccactatccaccagcacgtggccgttggcgaaggtgaggtgaatttcgacgcgctgttcgaagcgctgcgcgagatggatttcgctaaccgccactataaagtgggcggcgagtcgattatctccgccgcgctgtttggctatccggagaagatgaagtatcaggcggtggaaacccgcgagctgattgagcgcgagctgctgaatctgtaa

SEQ ID NO: 71593 - DNA, 417 bp, Glycine max
  Peptide Sequence Number=SeqID_163278
atgggtaaagaaattgtccgaagagaatcaccaacagagccttggaaacgtagtaggttatggttccatgatgatataaatcaagttttacaagaaaataaggggactagtaagattgaaatcatatgtatgaatttttcctcatttggagaagaagtagaatgggatggagatgccttcaagaagatgaaaaatctcaaaacacttattatcaagagtgattgtttttccaaaggtcccaaacatcttcctaatactttaagagtattggaatggtggagatgtccttcacaggattggccacataattttaacccaaagcaacttgctatatgcaagttgcccgataatagctttacatcactcgggttggccccattgtttgaaaaggcaagtgtattgagttcatttcattga

SEQ ID NO: 71594 - DNA, 213 bp, Glycine max
  Peptide Sequence Number=SeqID_163279
atggaacataatggtgtttgggaccttgtagaattaccaaagggttgtaagagagttggttctaacgatcttggtcttcttcatgagactaagaaatttatctctagaaactttgaagtgaaagatatgggtgagcaatatttttgtaagaacgacaagtactctaagggtgctaagcatatggaattgaagtactttgttgtgaatgaataa

SEQ ID NO: 71595 - DNA, 333 bp, Glycine max
  Peptide Sequence Number=SeqID_163280
atggatcgagttacatcgctgtttcgtctactgccaaacacatttaggattgttgatgtccttgttacttccagtttcaccttgacaaagataaaagaacatgctttacggtgcccttaccgaacacgtgctagagctagagtaaagggtaaagtagaggaggtgcaagagcagatgaaaaccgacatggaggccatgaaagagcaaatggccacaatgatggaggccatgatgagcatgaagaagataatggaagccaatgtggttgcagttgtcgctaccagcgctgttgctaaggtgaacccgatgccccatctggccttaaccaaatga

SEQ ID NO: 71596 - DNA, 1407 bp, Glycine max
  Peptide Sequence Number=SeqID_163281
atggccggcattcgtcagttcatggttaaccgcgactttatggaagtggaaacaccgatgatgcaggtgattccgggcggcgcctccgcgcgtccgttcatcacccatcataatgcgctcgacatcgacatgtacctgcgtatcgcgccggagctgtacctcaagcgtctggtggttggcggtttcgatcgcgtgtttgagatcaaccgtaacttccgtaacgaagggatctcgccgcgccacaatccagagttcaccatgatggaactctatatggcgtatgcggattacaaagatctgatcgaactgaccgagagcctgttccgcaccctggcgcaggacgtgctgggcacgacggaagtgccttacggtgagcacaccttcgatttcggcaagccgtttgagaagctcaccatgcgtgaagcgatcaagaaatacccagtggcgattgccaatgagctgcacatcaaagtggagaagagctggggtctgggccgcgtggtgaccgagatcttcgaagagaccgccgaagcgcacctgattcagccaaccttcatcaccgagtatccggcagaggtgtcaccgctggcgcgtcgtaatgacgagaacccggaaatcaccgaccgctttgagttcttcatcggcggccgtgaaatcggtaacggcttctccgagctgaacgatgcggaagatcaggctgagcgtttcctgcagcaggttaacgcgaaggacgccggtgatgacgaagcgatgttctacgacgaagactacgtcaccgcgctggagcacggtctgccacctactgcgggtctgggcattggtatcgaccgcctggtcatgctgttcaccaacagccacaccattcgtgatgtaatcctgttcccggctctgcgcccgaccggggacttgcctgtaccccggtgggagagggccgctgtggttttctccctctccccgtggcagaaggccgctctggttttctccctctccccgtgggagagggccggggtgagggcaccagaaatcaccatgagtgcaaaagcggctacgttagagggtcggattcgtcagcactgggatcaactctccagccacgagcagcgacttgccgatgtactgctcgccgcaccgggccagttagccatgaacaccgccactgaactggcacacagcgcgggcgtgtccaaagccaccaccacacgcttctttcgccatctcggctacgaaagttatgaagccgcacgtcggcaggcgcgtgaaatgcagagcagtggttcaccgctctatctgcaaccggtacccagcgcgtcgccgctggccagcatcatgcagcagcatctggagaaagagatcgccaacctggttaacagctatcgcacgctggacagtgaacagttgcagcaggcg

SEQ ID NO: 71597 - DNA, 699 bp, Glycine max
  Peptide Sequence Number=SeqID_163282
atggtcgcacattgccgataccccaatggattgcccggtaatgcggcgtcaacacaacagggggacagagttatgcgatggatcatcgcgctggcgatcggcggcttaagcggctgctcggtcgggcactatgaatacagctcagaagcggccaggcgcgtcgatatgaccgtcaccggcatccccaccgtgctcggcatgggtgcgctgggcaccactatccccctgacgcgcgaatacagcctgacggcggcgcacgtggccaaatattcgctgtatcgggtgaaggcctggcatccggagtgcgatatcgccgtggtttatcatgcgaataaagaagccaacctgcccccgcagttccgcaacagccatatcggcgacaacgttaatctgtatgggtatagctttatctccgcgctgccggtggcatcaagcggcaaaaacctgatcaatacgacgctgagcaatgactggaataaggccagttgcgtggtggtggcggccaatgccggcgtggtgaaaggcatgtccggcggcgcggtgtataacgccagcgacgacacgctggccggggtgattgtcggctatagcagtcggattgatgataataagagcggcaaaacgctgtttaaagatgtggcactgtatgtgccttatgcgcggttccaggcgtggctggatggggtggtgaagtcttag

SEQ ID NO: 71598 - DNA, 567 bp, Glycine max
  Peptide Sequence Number=SeqID_163283
atggcaaaaatcaactggcggcatatcgaaatctttcacgcggtgatgaccagcggcaatctgacccaggccgccacgctgctgcacacctcgcagccaacggtgagccgcgaactggcgcggctggagcagcagctgggcttacagctgtttgagcgagtgcgcggccgcctgcagcccaccgtgcaggggctgcggctgtacgaagagccgtttttacagcgctatccgcaggtgagcctgaatattattccgcaggagtcgccgctgctggaggagtggctgtcggcgcagcgctacgatctcggtctgaccgaaacccagcatgcacccgccgggactgaacgcctggcactgctgacctgtgatgaagtgtgcgtgctgccgccgcagcatccgctgtgtcagcgggcggtgctgacgccgcaggatttccacggtgaaaactatgtcagcctgtcgcgcagcgatagctatccaggtggagcggcggctggtgctggagacgcacagcgccgcgtcggtgtgcgcgatggtgcgcgccggggtgggtatttcgattgttaa

SEQ ID NO: 71599 - DNA, 1605 bp, Glycine max
  Peptide Sequence Number=SeqID_163284
atgggcctgctgctggcgcgcgtcggcgatctgcagctgatcaatcatccgatgctggagcacgaggccgaccagcgctcgctgcgtaccgtgacgctgccgaccaaccgcggcacgctgctcgaccgcgacggccaggcgctggcgctcagcgtgccatcgcgcgatatcatcgccgatccgctgcgcgtgctggaggccaatcccgatttcaccagcgccaaatggagctatctggcggcggcgctgaatctgcgaccggacgagctgcgcacacagatcaccgccaatccgaaaaagcgcttcctctatctcgggcgcaaaatcgagctgggcattgccaaagatattgctgagctgcatctgaaaggcatcagttcggtgtatgacgacagccgtttttatccgatgagtgaggccgcggcgccgctgattggcatcgtcggggcggacaataacggacttaacgggctggagaagggctttgaccgggtactgcagggcgagccgggtaaagaggtgtatcgccaggacggggacggcaacattattgcgatgatcgattacgagccgccgaagcagccgccgacggtgcagctcagcatcgataagtttgaccagtttacgctgtacagcaagctgcgcgacggcgtgctgctcaacaaggccgattcgggcgcggcggtgctggtgaagatcgacaccggcgagatcctcgctatggcgtcttatccgtcgttcaaccccaacaattatgacaacgccacgccagcgcaaatgcgcaataccgccatcaacgacagctacgagcccggttcgacggtgaagccgctggtggtgatggaggggctgcagcgtcatctggtgcgccccgattcggtgatcgacaccacgccctacagcgtcaacggccacctgatccgcgatgtcggccactggccgcgtctgactatgaccggcattttgcagaaatccagcgacatcggcgtgtcgcacatcgcgctggcaatgccggcggaagcgctggtgaacacctatcaggcgtttggtctcggcaagccgaccggactggggctgaccggtgagagcgtgggttacttcccgctgcatcgccagcgctgggccgacatcgagcgcgccacttttcgttcgattgcgcgtgaatacgccacgctcggttcgtatggcgtctatcgcccgctgtcgatcaccaaagtgacgccaccggtgctgggcaggcaggtggcggatccgcagatcgtgcaaaccgtggtgcacatgctggagagtgacgtgctgccgggcggtaccggggtgaaagcagcggttccgggctaccggctggcgaccaaaaccggtaccgcggagaagatgggcagcagcggcaaatatgacggcggctatgtcaactacaccgccggcatcgcgccggccagccatccggaagtggcgctggtggtgatgattaaccatcctactgccggcgatcactttggcggctcggtggccgcgccggtattcggcaacatcatggggccggtgctgaaacacatgaacgtggcacccgacgcgatttacagtaaaccggcatcagataaatcttaa

SEQ ID NO: 71600 - DNA, 363 bp, Glycine max
  Peptide Sequence Number=SeqID_163285
atgactcttttagctgaggaaaaggataaaattattgaggcacacgaagaagctcctccttcggttccacaatttgaacgtcaacaatttgacatgttgggtagaagtgtggagacccaaggatatgttacggttgacttatttgggtctccttctcctgcgggaaccctttcatttgcacatggttgtcagatatcaatgcctaacgccccaatgggccctccatggagtgtgtcgggaaacattcctaacattactgatttattaggggtagattcaggtaatgaattttctgctaaggctgatgaaaggaggggcgataggagaaggaatccagatcgccaagctcggagatgggagtga

SEQ ID NO: 71601 - DNA, 744 bp, Glycine max
  Peptide Sequence Number=SeqID_163286
atgcatccgctcaaggtgcagaccgatgtgtcgattgtggacaacgtgccggtgcacgtggcgctgcggccggaaaaagtcatgctgtgcgacgaggtgccggccgacggctgcaactttgccgtcggcgaagtggtgcacatcgcctatctcggcgatctgtcgatttaccacgtacggctgcgcagcggccagatgatcagcgcccagctgcagaatgcgcatcgctaccggaaaggcgcgcccacctggggcgatgaagtgcgcctgtgctgggatgccgacagctcgagccggagtagcgggcacaccgctgcagcgctggggcacgcgcatgaaaatgcagcacggtcgcaagctggtgatcgcgctgccttatctgtggctaatcctgctgtttatgctgccgttcctcatcgtgctgaagatcagtttcgccgatattgcgcgcgccattccgccgtacaccgatctggtgacctgggcggacgaccagctcaacctggtgctcaatctgggcaactacctgacgctgaccgacgacccgctgtacgccgaagcttatctcacctcgctgaaggtggcggcgatctcaacggtgatctgtctgctgatcggttatccgctggcgtgggcggtggcgcacagcaagccctccatgcgcaccatcctgctgctgctggtgatcctgccgtcgtggacctcgttcctggtagcgcgtctatgcgtggatggggctgctga

SEQ ID NO: 71602 - DNA, 839 bp, Glycine max
  Peptide Sequence Number=SeqID_163287
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcggtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71603 - DNA, 126 bp, Glycine max
  Peptide Sequence Number=SeqID_163288
atgacactagagaactactctagtacaacaactccacaattcttcataagcattgcaaggccggaggggaagcaaaaaggtagctacactcctttaaagaatgttcagcaacattccaaaccctga

SEQ ID NO: 71604 - DNA, 720 bp, Glycine max
  Peptide Sequence Number=SeqID_163289
atgaggtttgttgtgtttaaaattaaaatcttctgggtgttaatgtacaatgtggagttgtataaaaacatatgttttattggcttttcatctatgcagataattgttttggaagataaaaaagagtacattagttatgtctcaaaggaagaggctaaaactcaagatagaagacctgctgatcttttgcataaaccaaagagggtggagagtgtcaatgctgatgccaaatcctttggtgatcactgggaaagttcaaattgctctatgcattctaaagttgaaccactagaacatatgaagaaaagagatagaggccatcaaagtgtgtcattggagaataagacaggagattcaattgtggtcaagataagtgagaaaaataataatgttgataccggcgactgcatgattcttcatgaccatgaaggagaagagcattgttgtggcaaaggaacaaatgcgaggagtatttcttttttgccaagaagccaagagaagaaaggagattcggctaaagttgtgataaaacaagacatgaagggaggagagcataaatatgggtttaacaacaataaatgtgagaaggcagagaaggtaagggtggtggatgatgaaactggcgacaaacatgagttgtatgaagtcctaaggatgccatctagatgtgtaaaaactgatgcctcaagttttttactgagggcaggaggggtattataa

SEQ ID NO: 71605 - DNA, 93 bp, Glycine max
  Peptide Sequence Number=SeqID_163290
atggatgggatcgtgcccccaagacacccagtggactcggagaagtccaatagggccttggggtttccagctctgattacgggcctctattag

SEQ ID NO: 71606 - DNA, 711 bp, Glycine max
  Peptide Sequence Number=SeqID_163291
atgtcgatatttgtatgtaacccaaaattacattttaatgatgtatacaggatcaaggcttctccaccggcctcgcctcctccttctcctcctcctcctcctcctcctcctatttccgatgcatcagcttcaccgtctgctgtgaagcggacacgcaaagcctcacgtctacgatccttgtctgctagaccagctggtgttgagagaccagtggtccacattgatcctgctaccggcaaggctgacggtccccataagaagaaattaagaacttatttggggattgtggcgcgtgataaggcggaatttgaaatcccagaggattctgatagtagaacgaaaaggaagttacttcaaactgtgggcgagagatggaggcagtttaaatcagacctcacgaggaaatgggcccttgcacccgataccgatagtgtggagacactgtctgatgtgcgcaaaaaggcacaggccatccagaaacaaaacactgccccccacgttttgtctcgtgggggttatgaatatttggagcagaagctcctagctgagaagacgaagaagaagctcaaggaagctgcacagttcggaagcgttgatggcgtcatcgaccctccatccccggtcagacgccacgtgaagtggaagatgacccgcacgaagaaaacaggggagatgacgactgaggctgcagaggaaatcgctaagaagatc

SEQ ID NO: 71607 - DNA, 1692 bp, Glycine max
  Peptide Sequence Number=SeqID_163292
atggccgtgtctctgacacagggggcgataacggagatttgcagaggcaattgctccgaaaacttgcaaccggtgctgcaggtgatcgagttgaagcaggtgcagtcgcagcaaaacagcaccgtcgagaggtactgcgtggttctttccgacgggtccttttaccagcaagggatgctcgccacgcagaagaatgacttggttcattcgggaaagttgcagaaaggttccgttcttagactcactcagttcctctgcaatgttgtccagaaccacaagattattatcatcattgacctagatgttatactggactattgtgagctgattggacaacctgtctcaacaccaaaacacacacctaaagaaccaggagtcaactttgggaattcacaatctttaaatagcagttcacatgcaggtggcatgaatgctagaccaaatgtatctgggtcatctatctattatccaaaagcgaatcctcctgctcgtaatgaccctcctgcttatcctaaagcaaagactctgacgcagggggcgataatggagatatgcagtggcaatgaccccaagaatttgcagccggtgctgcaggttatcgagtttaagctggtccagtcgcagcaaaacagcaccattgaaaggtaccgtgtggttctctctgacggttccttttaccagcaagggatgctcgccacgcagaagaatgagttgatctattctggaaggttgcagcaaggcgccattattagactcacacagttcatctgcaatgttgttcaaaaccgcaagattattatcatagttgacctagatgttatatgtgaaaaatgtgagctgattggagaacctgtcgcagctccaaaaggtgcacctgcagaatctgccactggtcaatctggattcacctttggaaatttgcaatatttggataggagttcacattcaggtggtatgactactatacaaaatttggctggtcaatctctggacttgaagccagtgctgcaagttctggagttggagttggtgaactcccaacaacatagcgcctccgtgaatttccatttggttctctccgatggttaccatttccagcaagcgatgctcacgacgcagaagaatcaattggttcgttctggaaagttgcaaaaaggttccattgttagactcactcagttcgtctgcaacgttgtccagagttgcaagattattatggttcttgatctagatgttgtgctggagaaatgtgagctgttaggacaacctgttgcagcacctgcagaatttgccactggtcaaccttctggattcacctttgggaattcacaatctttgaatagctgttcacacgcaggtggtgtcagtgggctggcaaatgattttagtgccatgaaccttgccaccgggcaagttacgcctccagcttataatccaataaatagcagtagtgattttgattttgggatgccaacaaaccaagtgggtcaacggtatgaaagccaatataacaattttgtttcagcaggtgctcctggttcatatatgtcatgcaccaattgtggaggctctggccatagctctcttctttgcccaaatattagaaatctacctttgggatcaggtggtggtgcttctgtcgaatgctgtaaatgccatcaatctgatcactggggggagagattgccctga

SEQ ID NO: 71608 - DNA, 684 bp, Glycine max
  Peptide Sequence Number=SeqID_163293
atggatcctccggattctcagtcccaggaacaggaagcgcccaagaagaacggcgtcgtttttgtcattctgcgatggatcctcgcgattctttttcctttcctcctctttctctcgattccctttctgcttggcttactggttctcatgttcgccgatttctccatccccaaccccatttctctcccctcacagtgcaaaatcgtctccactggtgttgatattaggtcatctaagatatgtgaacttggattgttagattataaagcaaaggatgtgttccatcattttgaaagaagcaaatttcgctgccgttatgattactattgggcttcagtattcaaggtggaatataaagatcacttttctggtcagacacaagttgcatttgctgaggctcccaatgaggcccttcctctttattgcaggcctaattttggtgctgcatggttgacacaatataaatttaaggtcaacgagacttatgattgttggtacacatctggcatttccaaagttcgtttacatcaagatagtctttttggttgtgatgcccatgagcagtctactcttgagaagagtagacaatattctaccatttctttgtggccactcaaatgtgtgaccaagtttactgatttgaagatggcaaataaacttgggcataggttggtggggatttag

SEQ ID NO: 71609 - DNA, 480 bp, Glycine max
  Peptide Sequence Number=SeqID_163294
atgaagagcctgatatccttagtggggtcttgggcatccaacagcagcatctggctcatgatagcatcggccacaaagtcatcgatgctgctcccgaggaacacaatcctctctctcagcaacagccccatcacgtcgccctccgcgcctctcgccgccgtcgagggagtctggggcgaggagagctcgaaggtgaggctcgtagggttccgagactgggacccaaagtttgggtttttggaggggattggcgaggccggcgtgaagacgcaccttggtggggttttggagaagcgtgaatggggtttggggatgaagaagaaggaggaggaaatgggtggcttagggtttgaggaaagggttcgaatggaagaagggttcaaacttccaatctcaagccttcaagttaaaacaaatttgtttttttccttcttctattggttaagttcagatgactcaagagtttgtccaaactcatga

SEQ ID NO: 71610 - DNA, 3840 bp, Glycine max
  Peptide Sequence Number=SeqID_163295
atggctatgccattgcctgttttatgtgtggaagatggtgtggcaattttacgtttctctgaaatctttggcattcatgaacctctcagaaagggagaaaagagagagcatcgacattctattcctagagatatatacaagtctttcgatttaactgatgattttgtagaagaggatgaagaggaatttctgaagggcttctcccagagtctctctctttctaaacaggtttgtgtagttcataatgatgtatcagaaagcaatgatgttgacttggagtttccaaaatttggatttcttcatgcggatgcctcagtggacaggaaagatgatcaacaatcaaaggactcgtgtcatagtgctgaaccgatgaaaggggattttgtagaagatcatttctggaaagatcatcctttcatgttggccaacttttatcctcttgatcagcaagactgggaagataaaatcctttggggcaattctcctgttccaagttataataatgttgaaagctgtgaaatttctggacccgagttgggagcttctggtggcagtgaaatagaaattgaaagtgggatccataatattcagatggagcctcagaaggtactggaggataaaaatcataatgtcttaatgcgcagctctcctgtcaaattggagccctttggctcaagggattcttctggagctaagaccaatttaatatccagaagtctctttcacccccaacttctaaggttagaatccagatctgaagtggatagttctagtcttgcagatggaagagatgcagagatatctgagcataatcaaagtggtcaagtgaagcgctttaccaaggttatatcacaaaacagagacatgatggagggctcctggttagacaagataatatgggaggagcttgatcagccttcagtgaaaccgaagcttatctttgatcttcaggatgatcaaatgcactttgaagttttagataccaaggatggtacacatctttgccttcatgctggggctatgattttaactcattctttaaaattaagcagcggggattcttctgagttaccaggacatggaagtcaatatggatggcgatatgttgctaatgacaaacactattcaaaccgtaaaacttctcagcaactgaaatcaaattccaaaaaacgctcagctcatggtgtcaaagtttttcactcacaacctgcactgaagctgcagacaatgaaattgaaattgagcaataaagatattgcaaattttcaccggccaaaagcactatggtatccccatgacaatgaggtggctgtcaaagaacaagggaaattgccaacacaaggacccatgaaaattattataaagagtttgggtggcaaggggagtaaactgcatgtcgatgttgaagaaactctctcttctgttaaagcaaaagcttccaaaaagctagggagggagcttgaagatcacaagtcacttgctgcacaaaatgttcaaccaaactccttgttacatcttgttcgtacaaagatacatttgtggccaaaagcacaaagggttcctggtgagaacaagtccttgcgtcctcctggggcattcaagaaaaagtctgatctgtctgtaaaagatggacatgtttttctgatggagtattgtgaagaaaggcctttacttttgagcaatgttggaatgggtgcaagactttgtacatactatcaaaaatgctcaccagatgaccaatctggctccttattacgcaacacagatagtagattggggcacattatttccctggatcctgctgataaatttcctttccttggagatttaaagcctggttgcagtcagtcatcactagagacaaatatgtatagagcacccatatttccccataaagttccattaactgactacctgctggttcgttcatcaaagggaaagctatcattaaggcgcattgataaaattaatgttgtcggacagcaggagcctctcatggaggtattatcacctggaagtaaaaatcttcagacttacatgatgaacaggctattggtacacatgtgccgtgaattccaagcagcagagaagcgacatttgcctccgtatattggtgttgatgaatttctctcacagtttccttaccaatcagaagcatcattccgtaagaaaatcaaggaatatgccaatttacagaggggaacaaatggacagtcaattttggttaaaaagcgaaattttcgcatttggtcagaggatgaattgagaaaaatggttacaccagagcttgtttgtgcttacgaaagcatgcaagctagcctctaccgtctaaaacatttaggaattactgaaacacacccgactaatatttcatctgcaatgagtcgtcttcctgatgaagcaatagcattggctgctgcatcacacatcgagagggaactgcagattactccttggaacttgagttgcaattttgttgcctgtacaagccagggtaaggaaaatattgaacgaatggaaattactggtgttggtgatccttctggtcgtggcatgggttttagctatgctcgggcacctccaaaggcaccagtgtctagtgcaatggtgaaaaagaaagcagctgctaaccgtggaggttctactgttaccggtacagatgctgatctacgtagattaagcatggatgctgcacgagaggtgtgtggatggaatagcattgcatatttacttcctaggattcctgcttttaatctcaagtatggtcttatccaggttcttcttaagttcaatgttcctgaggaagtcattgcaaaacaaactaggtggcatcgcattgctatgatacggaaactttcaagtgaacaagctacatctggggttaaggttgatccaacaactatcagcaaatatgctcgtggccagcgaatgtcctttcttcagttacagcagcagaccagagagaaatgccaggagatttgggatcgacaagttcaaagtctgtcagctgtaaatggtgatgaaaatgagagtgattcagaagggaatagtgatttggattcttttgctggagatctggaaaatttacttgatgctgaggagtgtgaagagggagaagagggtaccaatgacttaaaacgtgataagggagatggcgttaagggtcttaaaatgagaagacgcccaactttagctcaggcagaggaggaaatagaagatgaagcagctgaggctgctgaattatgcaggctgcttatggatgattatgaagctgacagaaagaaaaagaagaaagctaaagttatggtgggagaagcaagattggtaccgaagatgcaatcaaaattttcctttgacaatgctgaacaagttaagcaaataactaatactttacaattagatggaactaatcacttgaaagaggatgcaatcacagatcttagggaggaggaaaacgttcctgctaaaaaaagcaaatcactgaaggtcaataaagccaagaagaatgatattatgcctattagtatacccaataaaaaaatcaaattgaatatgggagaaggaattaaggaatggtgtaaggaattatggaagataaaaatccctagtaagattgcggtttttgcttggtggctgttaagggacaaattaccaacaaagaagaatctgctcaggagacaaatgcagattcaggatatgtgttgccctttttgcagaggtgctgaggaggaggcctacacaacattttctccagcatataggtatacagacagaaggattaagaggcaagagatggaggtattggtggttggcgataacatgggctatttggaagcttag

SEQ ID NO: 71611 - DNA, 399 bp, Glycine max
  Peptide Sequence Number=SeqID_163296
atggtcaacgtcaagggagacgccgcgaaagaaggagtggtctatgacgtggcggaggatgcttggaaggagatgccggaggggatgctgtacggctggagaggacccgttgcggccatggaagaggaagtcatgtacgttgtggacgaagccaaaggtgttctcagaagatacgtggaggaacaggacgcgtgggaagacattctcgagaataagagactcaaaggagccgaacaaatcgtcgctcagagaggaaaactgtgcgtcgtttcgccttcttccgggatctccgtcgtcgatgtcgccgctgtgccgccgcggattgtgccgattttgctgccggaagagttcgagccggtggccgttcacatcttaccccggatgccagccgaccagtga

SEQ ID NO: 71612 - DNA, 1257 bp, Glycine max
  Peptide Sequence Number=SeqID_163297
atgcaggttgtggacaatgtgaacaccattattgctcctactttggttggcgagaatgctattgacaacttaatggttcaacaacttgatggaactgttaatgaatggggttggtgcaagcaaaagccgggtggggattcccatgatttgtcagtgttgggttacaagtgtgaagtgaagttccacatcgggtctccttatgtggtggctcatggtccacaggtgtacccctcaaatctccccaacaattggtatcagagccgatggttcaagttggtgatcggctcagacgacggggtggccaaaatggctagcgggcagggcaagtactgcaggtggccatggctatacttgtggatgataaagacttccgctcgaggggagactaccatgtggaagagactcacacttgagggggagacgtgttgggttacaagtgtgaggtctccttatgtggtggcttatggtccacaggtgtacccctcgaatctccccaacagtcggctaagggatgtgccggcctctgattttgtggcaaaagctgtggatttagcagccagagaattaatagcaattgcatcaccaggacaaggtttaatctgcgttgctttttgtctcttgctgggatatagcaagggtattaatcttgaactacttgctttgcctgatgacgacgttcctaaattaccccttcatatcggttgtggattgggacttagaggtgagacaatctcggagaatggacaccattggattgggcttgatatttcagcatcaatgcttaatccaggaagattggtagatttactggagagagctagagtttcattgcagatgataagatatttggccttagatgaggcagatagaatgctggatataggtttcgagccacaaataaggaagattgtagaacaagtggacatgcccccagcaggtgccagacagactatgttgttcagtgctacatttccaagagatacaggtactgatttaattgtccaaagagttgagtatgttcaagaatctgacaagacaagtcacctcatggatcttcttcatgcacagaaggcaaacggtgtacaaggaaagcaattaaatgcaatgaaatacacatttccaagggcttattcgagttattttggcctcaatcaactgatgtatgctgatccatacatccagtggtcttgggaaaatgttccaaatcaattgaaatggggattatgctatgaatccaatgatgatttctttagatga

SEQ ID NO: 71613 - DNA, 264 bp, Glycine max
  Peptide Sequence Number=SeqID_163298
atggagagcttcaagtacaacgattgtgacatgaatcgaaagggaatcgagcacttacaaattgaatgtccattcgaggtagaaaaacgtgaacgggttcggagctggactctactcgggtcggtgcctaaagaatactcgaagaaagtggcaatcaaattggtgaaatgtggtagcattaacaaatcaaaagatggaaaagaggggagaatggaagtttcgagagtggtgaggagaaaagaggaaagcaccagtctgagatga

SEQ ID NO: 71614 - DNA, 651 bp, Glycine max
  Peptide Sequence Number=SeqID_163299
atggtgggattctacgacctctccgacaccgacaacgacaacgactccgccatcctcgctggcccaagacgcagtcgttttggagcaagtctccgccatcaacttctccggcttcaccgacgaatcccttctcccctcccacctcgaaaccgtttccgcaacctcaaattcttccctccctccaaaaccaaagctctcactttttcttccacaaacaaccaaagtcccaatcttgatccatccaaacacaacccaaatgaaaaacccgagcaagggtctgtttcaagtcccaatttttcaccatccaaacataacccaaatgaaaagcccgaccatgggtctgtttctgtttctgtttcttcgcccccttttggttctgcctctgcgtcttccccttcctctgatgaaagttccatgtcttccattttcaaaccgacgcaaaaggaacaaggttccaaacggaactctgtctctgagatcttcgaattccccttcgcctccacggaggaaggattgtttgtggaacaacaaaaaatgccgaagaaggcgatgaaggaagaagagaaggttagccgcgaggctgaaaagattgttcagtgggccaagcaagaatctgcaaggttcaaccttggggatcagctcagtgattga

SEQ ID NO: 71615 - DNA, 336 bp, Glycine max
  Peptide Sequence Number=SeqID_163300
atggagccagagtacacaggaggatcagcatgttgcttttgcttctcctcctccaccaagaagagtgttgcaaggaatggtaaaagaagcactggagtgttgagttcagaacacgttgttgagtggggaaagaatgatgaaatactctcagacatgagcaccttttcggtgaaagaacaagaaagtaggctgaagaaagcgttggaagaggaagagagggtaagcaaggaagcagagaggcttgtcaaatgggtgaaacaggaatcagctagaattgatgtttctacaatcaaatcaattctcagtgacgatgaaaatgaagcaaatgttaagtaa

SEQ ID NO: 71616 - DNA, 1455 bp, Glycine max
  Peptide Sequence Number=SeqID_163301
atggccttcgacaacaaatccaagaagtctagttccccttctaattctactttcttcatcacccttgttttccttgtcctctgtaccataccagtatttttactcctccaaacaaccaccaccctctccaaaacctggtcaggcgatcttcgtttagctgaattcgcatggaacaaactcccatttcttgaacacaacccttcacccgtacctctcaaaatcgctgtcttctctagaaaatggcctattggaaccactcctggtggcatggagcgccatgcattcacccttcacaccgctctagctcaacgtggccacaaggttcatatcttcacctctccaccacaagaagaaagtgcttcagacacaacaatcaatcaccaagcagatgctaatgctaatgcaccctcttcaccttacatccattgtcacgaaggggagccgggtaagtggcgctacaacaaagcatgggaacagtttctggaacaaaaccagaaagaaccattcgatgtagttcactcagagagtgtagcacttcctcactggcttgctcgcgaacttcccaaccttgcagtttcttggcatggcatagctcttgaaagcttgcaatctagtatcttccaagacttggctcgtacgcaacatgacgaggctagttccccagactttgacaaaggcttacaaggggttctccctaagattctaaatgagataagattcttcaggaaatatgcacaccatgttgctatcagtgatagttgtggtgagatgctaagagacgtgtaccaaattcccaagagaagagtgcatgtgattctcaacggggtagatgaggatggcttcagagaagatctagaattgggaaaggaatttagaaccaaaattggcattccaagcaatgctagtttagtgcttggtgtagctggaagattggtgaaggacaaaggtcaccctctccttcatgaagcatactctatgctaataaccaagtaccccaatgtgtatttgattgtagctgggtcaggaccatgggagaatcggtatagggacttagggaggcaagttcttgttcttggatcaatgagtccttccatgctacgagcattctacaatgccattgacatctttgtcaatcctacacttaggccacaagggcttgatcttactctgatggaagccatgatgagtgggaagcctcttttggcatcgaggtttccgagcatcaaaggtagtgttgtggtggacgatgaatttggcttcatgttctctcccaacgtggaatcactcttggaggctctccaagctgtggtgaaggaaggcaaggaaaggcttgcaaggaggggaaaggcatgccgtgaatatgcaatttctatgtttactgcaacaaagatggccttggcgtatgagagactattcctatgcataaaagaagataaattttgtaactatccttga

SEQ ID NO: 71617 - DNA, 1839 bp, Glycine max
  Peptide Sequence Number=SeqID_163302
atggaagaattcaagcaagttcatgcccatattctaaaattgggtctcttctatgattctttctgtggcagcaatcttgttgccacgtgtgctttatccagatggggcagcatggagtatgcttgctcaatcttcaggcagattgaggaacctggtagctttgagtataataccatgattagaggaaatgtcaatagcatgaatcttgaagaagctttgttgctttatgttgagatgcttgaaagaggaattgaacctgacaacttcacctacccttttgtgctcaaggcatgttctctattaggtgctctcaaggaaggagtgcaaattcatgctcatgtttttaaggcaggtcttgagggtgatgtctttgtgcaaaatggcttgatcaacatgtatggcaagtgtggggcaatagagcatgctagtgttgtgtttgagcaaatggatgaaaagagtgtggcttcatggagttccatcattggtgctcatgctagtgtggagatgtggcatgagtgcttgatgcttcttggggatatgagcggtgaggggcgccatagggctgaagagagcattctagttagcgcgctttctgcttgcactcatttggggtctcctaattttggaaggtgcatacatgggatcttgttgaggaacattagtgaactcaatgttgctgtgaagacttcattaattgatatgtatgtcaagagtgggagccttgagaaagggctttgtgtattccaaaacatggctcagaagaatagatattcttacactgtaatcatcacggggcttgccattcacgggcgtggtagggaagctctaagcgttttctctgacatgctggaggaaggtttggcaccagatgatgttgtctatgtgggtgtgttaagtgcttgcagtcatgctggtcttgtcaatgagggtcttcaatgtttcaaccgcctgcaatttgagcataagattaaaccaacaattcagcactatggttgcatggtcgatcttatggggagagctgggatgctaaagggggcctatgacctcataaaaagcatgccaattaagcctaatgatgtggtttggaggagccttcttagtgcttgtaaggtacaccataacttggaaataggggagattgcagctgagaatattttcaagttgaatcaacacaatcccggggactatttggtgctagcaaatatgtatgcaagggctaaaaaatgggctgatgtggccagaatcagaacagaaatggcagaaaaacacttggtgcaaacacctgggttcagtttggttgaagcaaataggaatgtctacaagtttgtttcacaggacaagtctcaaccacaatgtgaaaccatttatgatatgattcaacaaatggaatggcagttgaaatttgaaggttatacgccagacatgtcacaggtgttgcttgatgtggatgaagatgaaaagaggcagagactgaaacatcatagtcagaagttggcaattgcttttgcactaatacagacatcagagggatctcgcataagaatatcaagaaatattaggatgtgtaatgactggtctcttactcatgaagccagagaagctttcctttcagcattagtgtctgaagggcgtgcagaatggatggataaaggacataggaaatgtcttattctctggcatcggattcaagattgggctgatattttaatacagtttgcaaaagataatgggctggaagatggtgttgtcacaatagaagaaatacgatcaggcactgaatctcaaggaacaggtaatctgttaatgcttataggttgtatttggttggctataatgtga

SEQ ID NO: 71618 - DNA, 1611 bp, Glycine max
  Peptide Sequence Number=SeqID_163303
atgacatataacggccttgagagttgcatgctgaataaccagtcttatgaagatgagagcagaacaagtagaggagatgaatgcataactgattcatttgatgacgacgactccagttgttcctccagcaaagatgcttttggatcattctcttcaaaatgtttgacaatgaaaagggatgataaaggacttgaagaatgggaactctcagaaagtcctcaacatttttgtgtcaaagagaagccttatgctatccaacattcagatattgaagccatgaaagaaaatttttcaaagcttttactaggtgaagatgttacaggaggaactaagggcctcagtacagctttggcactgtctaatgccatcacaaatctatcagtgtccgtttttggtgagctgtggaaattggaaccactatctgaagaaaggaagagaaaatggcagagagaaatggactggttattgtctcctaccaactatatggtcgagctagttcctgctaagcaaagcagttccaatggtgggatttttgagataatgaccccaaaagctcgtgcagacatccacatgaatcttccagcactccagaagttggactctatgcttattgaggcactagattcaatgataaatacggagttttggtatgcagagggaggaaaccgggcagaagggagggacacagatgcacagcatagcaaaagatggtggcttccatcaccccaagtaccaaaaagtggtctttctgatactgaaagaaagaggctacttcatcacggtaggttggtacgccaagtattcaaggctgccaaagctatcaatgaaagtgtgttgcttgaaatgcctgtgccagctattattaaggatgcacttgcaaagtctggaaagacaaaccttggacatgaattgcacaaggttttgacagctaaatcaagctctggagaagacatgcttaaatatctcaacttgaaatctaaaaatcttgtccttgagactgttaatagactggaagctgctatattctcatggaaagagagaatttcggaacaagttagtggcaaatcccctgttcgatcctcctggtcgccttttgttaaggatcctatgtcagaggttgataaactggagttattattggaccgtgcagaaacactactacagctgattaaaatcagatatccaaaccttcctcaaacatttctggatgctaccaaagttcaatatggcaaggatattggacattccattttggaagcatattccagagttcttggaaatttagccttcagcatactgtctagaataggagatatattgcaggaggattctttaagcaatcctaattcacctgtggcgataaaatgctctcctgggattaatctctctcaaacttgggaggtcagttcacatatcaagcagtccttacttgataagatcaacaaggcagatcggcaatattgtaactctagctgctatagtacttctgatttagaacttccatctattgatataaaatccagctctgtaatagctacaccaaacaggagtactgtctggtgcattagtagagaggcttgtaaaagtgtgtctcctctaaattctccatag

SEQ ID NO: 71619 - DNA, 1059 bp, Glycine max
  Peptide Sequence Number=SeqID_163304
atggcacggatttctgagataactaacataatacttttggtgacaaggtctttttctctacttagattggcatgcttgtttggtatcagaatcgcattaactgtcatatatacttggacggagttgatcaggacttcaattagcttccatgtaaacataatattaagaatgatcacatggacatttgggcttatctccctgcctgcaagagttgtgaatgcctttcaaagggagaggcagctggaacaaaaactacatgaaatgcacatagagttggagaatctagtgtgggataagaaggaacttcaagaacattttcaaatggctgtcaaagagcgcaaaatgatggagatactactggcagagcttgaagaggagcatgatatggccattgcaaatattgaaaagttagagggaaagttgcgggatcagacaaatgaaaatcttcggctgaaagaaattcaaggaaagggatactggagctccaaagaccacaacaacactgacagagtccaaaccatagatgacagcaactacaacatttctcatcctatactctcactgaactccaactacaacggcagtggaatcacccttcaagatcttctaatgcgcaaagatatttggcaagatgagagcaaaaccagaagtgagttgcttaaactcttgaaagctgtaccaaagtccgggcaagttaagtccgaaatgagggaagcactagaccatcatcgagacatagctctttcacaatcacttttcagtgcccttatgtcacttgtggttggagtcactgcgtgggaagctgaggacccttgcatgcctcttgtggtggctctcttcgccgtagtaggcatgtccttgaagagtgtggtgcagtttttctccaccattagaaataagcctgcatctgatgctgttgctcttttaagcttcaattggtttgttcttggcactctaacctaccctaccttaccaagggttgctcgcatgctgtctccactagcgcaacgccttatggaccaaaccatgatccggtttggtctcctttccttagcttga

SEQ ID NO: 71620 - DNA, 312 bp, Glycine max
  Peptide Sequence Number=SeqID_163305
atggaggacagaagtataggaagaaagggtagctttaggttggggttgggaatggatgggaaaaaggatcacagtgtggttgagcttggtagcatcgacacacaaagacttcttctaagcaatggagagagagaaaaaaaattgcaacccctcaccaactctctctctccaaggcaaatgaaatctctcactgctctctgtgacactatcttaccttctgtcgccgaccactttgtggactcctctgatgaatctgtcaccaagttttaccagatttcagcttccatgactggaacacctgaacgtgtatga

SEQ ID NO: 71621 - DNA, 1323 bp, Glycine max
  Peptide Sequence Number=SeqID_163306
atgagttcaaaggtggtttttacagtgggggacccagccagcgatcactctctcattctccgacacccggaagctccaaacgacgccgtgtgttgctgttgcagcattctttcagtctcttcttcttcttcttctcatacattcaaaggtggagcagttgaagaagctggtggggagggagcaatggggtccaataatcatggcaactcgaaggagtttctagaactcataaagtccatcggcgagtcccgatccaaggccgaggaggactgcatcgtcctccgcgagatcgaaaccctaaaacgccgcatcaacgacgctgacactccgaaacgcaagatcaaggagtacatcatccgcctcctctatgtcgagatgctcggccacgacgcctccttcggatacatccacgccgtcaagatgactcaccacgactccctcctcctgaagcgcaccggctacctcgccctcacgctcttcctcagcgacgaccacgacctcatcatcctcatcgtcaacacaatccagaaagacctcgcctccgataactacctcgtcgtttgcgccgctcttaacgccgtctgcaggctcatcaacgaggagaccatccccgccgtgcttcctcgtgtcgtcgagcttcttcaccactccaaggacgccgttaggaagaaggccgttatggcgctgcaccgcttctacctcaaatctccgtcctccgtttcgcatttgctttctaatttccgtaagcggttgttcgataacgatcctggtgtaatgggcgcttctctttgcccgctttctaatatcgtttccgatgatgttaactcttttaaggaccttgtcgttagctttgttaatattctcaagcaagtcgcagaacataggttgcccaagacttatgattatcaccaaatgcctgcacccttcattcagattaagttgctgaaaatacttgcgttactgggaagtggcgacaagcaagctagtggacacatgtacactgtgcttggtgatataatcaggaggagtgattcgatgaccaacatagggaatgctgttctctatcagtgcatatgctgtgttgcttctatatatcccaatcctaagttattagaggctgctgcggatgtaatcgcaaaatttttgaagagtgacagtcataatctcaagtacatgggcattgatgcccttggtcggttgataaagttaagtccacatattgcagaacagcaccaacttgccgtcattgactgcttggaggtgagggatgttgctcataaaaatcaatctgttgtgaatttcgataatgttgagatcatttag

SEQ ID NO: 71622 - DNA, 384 bp, Glycine max
  Peptide Sequence Number=SeqID_163307
atggtgtatcgtgaaacaattgaagccggtgaaaaacctacaagtgaaatattgtcgcaaattctgggatgcctgcaactcccttatgatacatctgtgaaaaatagacttgttgagaacctaggagtaagcatggaaacttcaagaagctcaaacctctgttcattaatggatggatttggtgaatatgatcctcgtgctttttcaatacttgaggaatctgcttcacacggagttgttccatctgtatcccttaaagtgagtcctgttgttattgatgctaaggaattgaatgcttctactgctgaggtgttggaaaagccacctaaattgtggtcacccctatatagaggaggtgtgttgaaagtcccacatagcggctag

SEQ ID NO: 71623 - DNA, 375 bp, Glycine max
  Peptide Sequence Number=SeqID_163308
atgtattcaatgttggttctcttcttatctccaaagacggtttcagagctaccaatcagctcggctcagctcaagcctcaatgtttacagattgcttattgtcacttagatattagttggtacatggcatcattttctgcagccaaagctacttgcaagggacttcaagtcccaaaaggctatcttgctgtctatgttggagataagatgaagcggtttgtgattccagtatcatacttgaaccaaccttcatttcaagaattactaagtcaagcagaagaagagtttggatttgatcatccaactggtggtctcacaattccatgcagggaggatgagtttctaaacctcacttctcgcttgaatgagctgtga

SEQ ID NO: 71624 - DNA, 375 bp, Glycine max
  Peptide Sequence Number=SeqID_163309
atgaagaaaggaatataccgatgcaacaatgacaagaaaggaatataccgatgcaacaaaccaacaatgtctcagtctccaattaaatttaacaaacaaaaaacaaaaaccatgggttttcgtttgcttggtgttagaagagctagacaagcattgtcaattaagggtgcagaggtcccaaaaggatatctagccgtgtatgttggagaagaaaagaagcggttcgtaattcagatagaatgcttgaaccaaccttcatttcaggacttgctaagcaaagcagaagaagaatatgggtaccatcatccaatgggtggccttaccattccttgcagagaagatgtcttcttacatatcatgtcgcttctggcttga

SEQ ID NO: 71625 - DNA, 525 bp, Glycine max
  Peptide Sequence Number=SeqID_163310
atgggtttccatttacctgctattcgaagggcatcattcgcagcttcaaaatctgtacaagtcccaaagggatatcttgcagtttatgttggagagaaacagaagcggtttgtgatccccatatcatacttgaaccaaccttcattccaagagttgttgagtcaagctgaggaagagtttggatacgatcatcccatgggaggcctcacaattccttgcagtgaaaatgagcaagagaaaacaatgggtttccgcatacctgctattgtcacgcaagcatcgttttctacaacccaagcagcctccaagagggttgaagtacaaaaaggatatcttgcggtctatgttggagataagatgaggcggttcatgattccagtatcatacttgaacaaaccttcatttcaagaattacttagtcaagcagaagaagaatttggatatgatcatccaacaggtggtctcacaattccatgcaaggaagatgagttcctaagcaccatcgctaacttgaatgagctgtaa

SEQ ID NO: 71626 - DNA, 585 bp, Glycine max
  Peptide Sequence Number=SeqID_163311
atgggtttccgcataccaggtattattagacagacatcattttctgctgccaaagcaactcgcacgggagttgaagtcccaaaaggctatcttgcagtatatgttggagataagatgaaacggtttgtgattccagtatcatacttgaaccaaccttcatttcaacaattactaagtcaagctgaacaagagtttggatttcatcattcaatgggtggtctcacaattccatgcaaggaggatgagtttctaaacctcacttctcgcttgaatgagcgggctgagataggagtcatgggaacaattgagagacaagggcatatggcaatgtcttcgaggactctcccacaaatcaacgcagcctccaagggggttgaagtaccaaaaggctatcttgcagtctatgttggagataagatgaagcgatttgtgattctagtaccatacttgaaccaaccttcatttcaagaattattaagtcaagcagaagaagaatttggatatgatcatccaactggtggtctcacaattccatgtcaggaggatgagttcctaaatgtcacctctcgcttgaatgagttgtaa

SEQ ID NO: 71627 - DNA, 732 bp, Glycine max
  Peptide Sequence Number=SeqID_163312
atgggtttccgcatagcaggtattgttagacgggcttcattttctacaacccaagcagccaccaagggagttgaagtaccaaaaggctatcttgcagtctatgttggagataagatgaagcgatttgtgattccagtaccatacttgaaccaaccttcatttcaagaattattaagtcaagcagaagaagaatttggatatgatcatccaactggtggtctcacaattccatgtcaggaggatgagttcctaaacgtcacctcttgcttgaatgagtttgatgatggatcagagagagttaagaaacgacgtcgtaaaagccatgaactgtgcagcaccaaaagctcatgttcgataaagcaccgtcaagaacagcctgaatttagtggtcctacccctaaatcacagcgaaccaaaatgggcaaatccgaagacaacgataagaagaacttaggtaagaaactcaaagatgtggaaataagcattccaatagtgtatgggaacatagcaatttggcttggcaaaaaggctagcgagtatcagtcgcataaatggacagtaaatgttcgtggagcaaccaatgaggatcttgggacgataataaagcatgctgtttttcagctgcattctagtttcaataatcccacacgtgtggtggagtcgccgccttttgaattgtcagagtcaggatggggggaatttgaagttgccatcacactttatttccagtga

SEQ ID NO: 71628 - DNA, 384 bp, Glycine max
  Peptide Sequence Number=SeqID_163313
atggtttcttcgtatcctgttatctatatatattcatggctacaagcatttaggaccaacagaaatcattcacatcgtgaagcattcaaaattcgaaaacctccacttccaagttaccttctcaagtattgggaaggcatcatctgctgcaaaccaagcatctcaactgctgtcgacttgccaaagggctatcttgccgtctatgctggggagaaaatgaagcagtttctgatccctgtatcatacttgaacaaaccttctttccaagagttgttgagtcaagctgaggaagagtttggatacgatcatcccacaggtggtcttacaatacctttcagtgaagatgttttctggcatataacttatagattgagtgggttgtaa

SEQ ID NO: 71629 - DNA, 489 bp, Glycine max
  Peptide Sequence Number=SeqID_163314
atgggtttccgtttaccttctattcgacagacattatacaacgctaaccaagaggcttcaaaatcagtagaagttccaaagggctatcttgttgtgtatgttggagagaaacacaaacggtttgtgatccctgtatcattcttgaaccaaccttcattccaagacttattgtgtcaggctgaggaagaatttggatatgatcaccccatgggtggcctcacaattccttgcagtgaagatgccttccaacatacaacttactgctttaagggacacataacagctcatgtgcttcacagtctgggcagtgataatagtattgtgctacggccaagagaaacatcaatttattttggacggattagaaagattttaaagttttacactcacacacaaaattgtaattcatggccccaatcatacacaagatgctgtccctgcccctgtgaactgcctaggaaggtaacaatggacttagccccgccttaa

SEQ ID NO: 71630 - DNA, 117 bp, Glycine max
  Peptide Sequence Number=SeqID_163315
atggatgaggagctagggggtatttatggagagagggtggtgtcgggcacaaggcaaattaaaggacagaccacgggtgttttgggtatatatgatgatatgatcgttcaattttaa

SEQ ID NO: 71631 - DNA, 447 bp, Glycine max
  Peptide Sequence Number=SeqID_163316
atggaaataaataaaaagttgatgagaacagagaaaccagcttcttttgataatgtcgtcggcgtcgacgggaagcagcagcagcagcaaaatccggcgcattgtgcgcgtgcggcaaatgcttctccggtggcggaggaaggtggcggtggacgttccggcgggacacgtggcagtgtgcgtggggcccagcaggaggaggttcatcgtgcgcgcgacgcacctgaaccacccgattttcaagatgcttcttgtgaaggccgaagaggaatacggtttctgcaaccacggtcctctcgctattccctgcgacgagtctctcttcgaacaccttcttcgggtggtggcccgacccgtacccctacccggtttctcctcgctcgaggattttcagacacgctgccacgtggactttgtaggaggagaatcgtggccgttgcttcgtga

SEQ ID NO: 71632 - DNA, 1123 bp, Glycine max
  Peptide Sequence Number=SeqID_163317
gtctgtgtatgagtctcggagacaatttggggagattttggctactgagagtcctgtggactgtgatgttgtgattgctgtgcctgattctggtgttgtggctgcgcttggttatgccgccaaagctggggttccgtttcagcagggtttgattaggtcacactatgttgggaggactttcagtgagccctctcagaaaattagggactttggtgtgaagctgaagctatcgcccgttcgtgccgtgcttgaaggtaaacgtgttgtggttgtggatgattccattgtgagaggaaccacgtcgtccaagattgttaggctgctgaaggaggccggtgctaaggaggttcacatgaggattgcgagtcctcccattattggttcttgttactatggtgtggatactcctagctccgaggagttgatttccaataggatgagtgtggaggagataagagactttatcgggtcggattcactggcctttttgccttttgatagcttgaagaggttgttggggggtgaaagtccgaatttttgttatgcttgtttctctgggaattaccctgtggagcccagagagcttaaggtgaagagggttggggactttgttgatgatggcttgaatgggagcttggagtctattgatggtggttggcataaggcatctctcagtggacaaaaatcagatgcagttcttcagtcttcctcatcaacccggccaaatgagcttgagttcatagcagagccaagcttacttaacgaagaactcgatccctttagtgaggacgaagacaaagttctttacaatcaaccttgggaggaagatgatgaggaagaagcccgacctgtttcactaatcacaattgtaccaccccgtttgcaaaattttgaagaatcttattttcaagaattggaatacaagcatagcttggatcacaaagaagtcaaacgtccggttgttgaagacatctacgacaactggaaaatatcgtaccacgatctaccgagatttttgcaagcaatgcaacaatatcttctttgtatgttgatgaagaaggaaacactgctaatgccaccacaaggaggtcaactgatagaggattttgtcattttccattga

SEQ ID NO: 71633 - DNA, 822 bp, Glycine max
  Peptide Sequence Number=SeqID_163318
atggctcactacatttcttcaagcaacaacgaccattcatgtgcccgttctttttccatatttggctcatattactttctcattccaagtaagttgaaattgcttttcaaaggtttcaaattggttcgggtgttagagcttggttgtggaggaaagatccctttcacttctatacttacccttggaaatctacaaaccatagacttaggtcattggcgtcggaatttcccaatttctttccctgctggaatatggaaactcgatcatttaaggcatctgtatgggcaagcacctatcatgctacgaggccactgttcaggttcaaatgagggcgatttcctagactctgtcttgggggcacaattcaattgtggctccgatcaagggcgtagtggtgaaggagccgaaagtcagaatcttcaatgggcgcaggggaaagtaggggaggatcgtgttcgtgttgtggtgtttgaggaacacgattgggtttttgtggggacctatgatggtttcagtggacctgatgtacttgattaccttctctccaatctccacaccgcggtgcataaggagcttaaagggttgttatgggatgatgggtctgcaccggaaaattcaatgataaaggaggacagctcctccgtcgtgccaagctttcaagccaccgcgaaagactttgtagtcgctgcgtttgtgaacgacaagcgagcgtttagatctaggttttttcaaggagaacactatcggttggtaatggaggagtacggtggtcacggtggaggtgaacggcaacagcgaaagatggagagtaacatccaatga

SEQ ID NO: 71634 - DNA, 1224 bp, Glycine max
  Peptide Sequence Number=SeqID_163319
atgatcagcattatgaaccttactagttccatggccattatcagtgtccttatttcagccttagtttgtgaagctaggcttctccgtgttacacctggatttgttgaaactaagggaacagaacttgtgctaaatgactctccctttctgttcaatggttttaactcttactggatgatgaacgtagctgctgatccaaaccaaagatataaagtttccaatgtatttcgagaagcttcagctataggtcttacagtgtgtcgtacatgggcatttagtgatggtggcaatcaatctctacaaatatcgcctggtctctacaatgaggctatgtttcaggcattggattttgtggtggcagaagcgagaaagtacagagtgcgtttgattctgagcttggtgaacaattacaatgattttggaggaagacctcggtacgtgcagtgggctaatagcagtggtgttcccgtcgccaacgatgatgacttttacacaaatcctgttgtaaaaggttactacaaaaaccatgtcaaaagggtgctgacaaggatcaacacaatcactaaaacagcttatagagatgaacccaccatcatggcttgggaactaattaacgaaccacgctgccaagttgattactctggcaagaccataaatgcatgggttcaggagatggctccctatgtgaaatctattgacccaatgcacttattggaggttggaatggaagggttctatggagactccatcccggataggaaactagacaaccctggtttccaagttggtacagactttgttagcaaccatctcattaaagaaattgactttgcaacaatccatgcttaccctgataattggctaacaggacaaaacgataccatgcaaatggcattcatgcaaaggtggatgacaagtcactgggaagactcaagaacaatcttgaagaagccattggtgtttacagaattcgggaaatctaagaaagatcaagggtatagcatcagcgcaagagattcgttcatgaatgttgtgtattcaagcatctatagtttcgcacaaaatggaggaacatttgctgggggtttggtttggcaacttttggacgaaggaatggacccatatgatgatggatatgagattgttttgtctcaaaacccttctacaagtagtgttatcagtcaacaatcttctaaaatgattgcacttgagcatatgcattga

SEQ ID NO: 71635 - DNA, 1665 bp, Glycine max
  Peptide Sequence Number=SeqID_163320
atggcgcttaaaaccctatccactttcttctcacctctttctcttcccaacaccaaattcctcacctccaagccttgcctcattctcttcgaattcccgcgctctcagaaatcgcgcttgcccgtcgccgatgctgaaggcaccggcgctgccgctccttcgcccggcgagaagttcctcgaacgccaacagtccttcgaagatgctaagctcattctcaaagagaacaacaagaataagaagaaaaagaagaaagataatgctataaaagcttctagagccgtcgcttcttgctacggctgcggcgctccgttacacacttccgatgccgatgcccctggctacgtcgatcccgaaacctatgaattgaagaagaaacaccaccagcttcgaaccgttctgtgtaggcggtgccggcttttgtctcatggcaagatgataactgccgttggaggacacggtggataccctggcggtaaattattcgtttctgctgaagagcttcgagaaaaattgtctcacctgcgtcacgagaaagctctaattgttaaattggttgacattgttgacttcaatggcagttttttgtctcgtgtgcgagatcttgctggttctaatccaatagtattggtggtgactaaggttgatctccttccaagagatactgatcttaactgtgttggggattgggttgtagaggctactatgagaaagaagctaaatgttctcagtgtccatctgaccagttccaaatcattggttggaataactggggtgatatcagaaatccagaaagagaagaagggaagagatgtttacattctgggttcagctaatgttgggaaatctgctttcatcaatgctttactaaaaacaatggctataaatgatccagtggctgcatctgcacaaagatacaaaccaatacaatctgcagttcccggaactaccttagggccaattcaaattaatgctttcctaggaggagggaaattgtatgacactcctggagttcatctcttccataggcaaactgcagttgttcattctgaagatctacccatccttgctcctcaaagccgactgaggggcctggctttcccaagttctatagtatcttcagacaatgtagaggaaggagcttccactatagtgaatggcttgaatgaattttcaatattttggggaggtcttgttagaattgatgtcttgaaggttctcccagaaacttgtttgacattttatggacccaagagaataccaattcatatggtacccactgagcaagcagttgaattttatcagacagaacttggatttctgctgaccccaccaagtgggggagaaaatgctgagaactggaaaggacttgaatcagaacgtaaattgcaaataaaattcgaagttgtggacagaccagcttgtgatatagctatatcaggtctaggatggtttactgttgagccagttagcaggtcacacaaaatctcgcaaccaaaacctgtagagactgctggggaattgatattggctgtgcatgtccccaaggctgttgagatttttgtgaggccaccaataccagtaagcaaggctggagcagagtggtaccagtatgtagaattaacagagaaacaagaggaaatgagaccaaaatggtacttttaa

SEQ ID NO: 71636 - DNA, 702 bp, Glycine max
  Peptide Sequence Number=SeqID_163321
atgaattcgtgttccaccaatagcatggttccgcataagcaaaacggcactgagttttttctcgggaaaaaaatcttccgagaaatccgagaaagatatattagaattattttacttacgagcaacaacaacctgcaacaaggtgaagagaagagggaaatgggggaatattcatgcgcgttgtgcaagaagagggcgatgatgctgtgcgactcggaccaggctaagctatgctgggagtgcgacgagaaagttcacagcgcgaatttcttggtggctaagcattcgcgtgtgcttctctgtcgtttatgccattccccgactccgtggaaggcctccggcaccaaactcatgctcacggtgtcgttttgtcagcgttgcgtcgcgcatcgacacgtgagcttaaccgtgcatccatatccatcatatggatatcaatctagtaataataatgatgatgttgacctcgatgttgatgatggtatcgatgattcggatgaaagggaaagtcatcaagtcatgtctagttctgccacctcaccattcaagcgactaagaaataactctttttctgtcgattccaatgatgagacagtgagttcttcatctgagatgtttagtgctacatggcccgatgatgatgaatcaacaacttctctctccgtattgaagaggcaccgagatgatcaaccaaattattga

SEQ ID NO: 71637 - DNA, 225 bp, Glycine max
  Peptide Sequence Number=SeqID_163322
atgaaacgagaagggaacatagtggatgctgcatccaatgttgagaagaaggcattacctgagggttggtgtgtgaaggtggtgaagatacagtttatgggttttagtagcagtgtctctttagccaacttgaaaattgcaattgcacgagcatacaaacaagcaccacacctttggaaagagagacgtggttcttttgacgctagaaaatcacaaaagatataa

SEQ ID NO: 71638 - DNA, 450 bp, Glycine max
  Peptide Sequence Number=SeqID_163323
atgtttgtcttcatctgtacaactcaccaacttggtggtgtcgcttcctctgccccaatcgatggctgctgcggcggtggcgtagctggtgatcccgttctcagagtcggagaggctgaattgcattgggagcgggagcgacgagacgatgtacaaggtagtccaccacacttgcaaaaaagcaagagctgcatccttctcctctcgacgagccacccatcgcttccccttccgattctgaggaagaagagccacaacaacaacaaccatcctcccagaagcatgaagaagtttcctctggagaagaagaagaagaagaagaagaagaagttgtttccttcgaagaagaggaagaagatgaagatctcccaccaccaccaatttccaaaaaccctccaccccctcccacaaacccatagccccaacactcttcctttgaatccgaaatga

SEQ ID NO: 71639 - DNA, 711 bp, Glycine max
  Peptide Sequence Number=SeqID_163324
atgtttagggacgtgtcaagctgcaacacgtacaactacggcgaggctgtgtattgggacgcgcgctacatccaagaggatggttcctgcgattggtaccagcgttattctgctctcaggccttttgttcgcaatttcatccctctttcttccaggattctcatggttggttgcggcaattctgttatgtcagaggatatggtcaaagatggttacgaggacatcgtcaatattgatatttcttcaattgcaattgacatgatgagtagaaaatatgagcacatcccacagctaaaatacttgcagatgaatgtcagagatatgagcttgtttccagatgaatcttttgatggtgttattgataaaggaactcttgattcattgatgtgtggtactgatgctccaattagtgctgctcagatgcttgctgaaattacatatggggatccaacagtaaggatgcctcatataagcagaccggtgttcaattggaaaattacgctgtataatatcccaagaccaggatttcaaaagcccgagagtagtacaccatcaagaaaatcatacttggagcccatcgctcttactgaaaagggcttactttcagcagatttcgttctggaagatccagattctcactatatatatgtttgtaaaaagataaatgacacagagatagacaataatacctgcataccaattaacagctga

SEQ ID NO: 71640 - DNA, 855 bp, Glycine max
  Peptide Sequence Number=SeqID_163325
atggcaaatgctttgagagttggtagtgttatctcactctgctcccttcggaacacgagaccccatcttccccttctctccaacgccacgcgcttccgttccaagttcccatttttcaccctctcatcgtcgccaaatccatctgggtatccaccatttcgcacactctcttcttcttctgcttccacagatgaggcagtgaccaccgaagccatcactagcaataatgcaagtggtgaagctgagaacagtattaaggatgcggcggggttgcttgacatgagggttgggtgcattctgagagcatggaaacatgatgaagctgattctctctatgtggaagaggttgatattggtgaacctgaacccagaatcatatgcagtggccttgtcaaatacatccctctagaacaccttcagttcagaaggaatactaattactgtgggacgaataccagacatgacacaaatgcaaacactttgacatggctaaagtctaagatattagaacatgaggacaacacacaagatgagttatatgtctttaaaaagaaaaggcagacaaacttacatgactgcttgaatagttgcttttgtgtgtgcccgtgcgcatggcaacagtgcagaaagggcaaaaaggttattgtcctttccaacctgaagccaagaaatatgcgtggtgtcaagtcctgcggaatgctgatggctgcttctgatgcaaaacatgaaaatgttgaacttttgttccctcccgaggaagcaattcctggtgaaagaatctggtttggaacggaagatgaaaaggataatcaacctgatgctgccactccgaatcaggcaattgctcttccttaa

SEQ ID NO: 71641 - DNA, 1605 bp, Glycine max
  Peptide Sequence Number=SeqID_163326
atggcttctcagtgtcaattggattcattgttgcagaaatgcacctctctgattcgcatgaagcagcttcaagcccatctcataaccaccgataaattccaattccacctttcccgcaccaagttcctcgagctctgcgccatctccctcgccggcgacctctccttcgccgcccaaattttatggcgaatcgaaacgccctccaccaacgactggaacgccggctgcgcgcgcgcattggctttctccgaagccacccagatacattctcagcttctgcgttttgggttcgaagctgatatcttgttgctgaccactttgctggacgtgtacgccaaaaccggtgatcttgacgctgcacagaaggtgtttgataatatgtgcaaccgagacattgcttcgtggaatgccatgatttctgggttggctcaaggaagccaccccaatgaggctatagctttgttcaacagaatgaaggatgagggatggaggcctaatgaagtaactgttctaggtgcactctccgcttgttcgcaattgggtgctttgaaacacggccagattattcatgcctatgatgtggacaagaagctagacaccaatgtgattgtttgcaatgcggttattgatatgtattcaaaatgcgggttagttgataaagcttatttggtgtttgttagcgtgagctgcaacaagagtcttatcacgtggaatactatgatcatggcgtttgcaatgaatggtgatgggtgtaaggcacttgagtttttagatcagatggctttagatggagtgaatccggatgcggtgttgtatcttgctgcattgtgtgcgtgcaaccatgctggcttggtggaagaaggggttagtttgtttgatatgatgaaggggtgtggggtgaaacctaatgataagcattatcggagtgtgagtttgcttggggcttgtaagactcatgggaatgtggaaatggctgagatggcatcaaggaagctggtggagatgggatctcacagttctggggattttgtcttgttatcgaatgtttatgcagcacaactgagatggcatgatgtggggagagtgagggaggccatgaaaattagggatgtgaggaaggtgccgggatttagttacacagagattgatggtaagatacacaagtttgtgaatggtgatcagagtcatccgaattccaaagggatttatgcaaaattggatgagatcaagttcagggcaaaaacctatggatatgctgcagagactaatcttgtgttgcatgatataggagaggaggacaaggacaatgtgcttaattatcacagtgagaagttggccgtagcatatggtttaattagtacaagtgatgagacaccaattcaacgcgatttcacagatttaaagagggtgtttgttcttgcagagattattggagctggtgaactagcaactgtagtatacttgttccaaatcacactgcttggtatagaggtagatttgtctttgtccaaagtcaaacacgaactggatggcctaggcatcatgacatttttactcgatccgcataagctcatgacaacacaacaacactcttctcattactga

SEQ ID NO: 71642 - DNA, 903 bp, Glycine max
  Peptide Sequence Number=SeqID_163327
atggaatctccctctcgctccttcgtcattatcgtcggtgctggtgtatccggtgaataccaccatcgctacaattcttcctctctctccgcatcttcatttttccatatcaataactatgagttttcctttctgaaaggtatctctgcggcaaagctgttggccgagaatggcgtaaaggatcttgtaatcctggaggcttcaaactgtattggcggtaggattcggaaggaaaacttcggcggtgtgtccgtcgaactcggagctggttggattgtcggagttggcggcaaagagtccaatccaatttgggaactcgtcgctgaatatggccttcgaacatgcttctctgactacacgaatgtgccatacaacatatatgatcgcaggcgagactctatttctttttccatttttttgcttctgttgctctgccgattcctctgttccataattcctgttatcgttcattccagtggaaagatattttcgagtggaatcgctgcggactcgtacaaaaaagctgtggactcggcaattcgaaacttaacgaaccaggaagaagccgatcgcgaaggcaatagctccaaaacaactgaaccaccttcgtcgccattagagctagcaattgatttcatcctccatgattttgaaatggcagaggcagtaccgatatctacctttacagcgtttggcgaaagggaatttttggttgcggatgaaagaggttttgattatttggtatataaaatggctgaagattttttgttgacatctgagggtaaaatactggacactcgtctcaaactcaaccatggtaataatgggttggtccgttacattgccttaaactgttacattatctttatacgcctactccggggcttcttctctgcactctaa

SEQ ID NO: 71643 - DNA, 3618 bp, Glycine max
  Peptide Sequence Number=SeqID_163328
atgaagagattgaggtcgagcgaggatctctactcctacggcggagataagagtaataatagttgcaaggattcgaacaatcttaaccgttcgttttcgtcggcgcagcggagcttctactacaagcaggagaatgcgcgcaagggtttggtctcgtcgtcttcgtcgtcgtcatcacggtacgagagggatcgaacggtggaggaggatcgggagggttcgcggctggttcggaagcgatcggagcacgatttcgagggtttcgatcggaggaaggggttcgatcggtacagggagagtgaccggagtttgattcaccggtcggagagtttctgcggcggtggagggttgcggagggatcagtttccgaaggggtttcggtcggagagggagcgatcgcggagggaggggagcgtgtcgtcgtggcggcgagggttgaaggattttgatgatagagagagggtggtgcgttctcccaagggtttgagggatgtgaagtctccgtcgtggtcgaaggattctgtttctgagagcgagcaatcgaagaagaggtcttcttcttctccgagaccattcagagatggtaactccgtcaagtctaagtccaagtctcccacttggtccaaggattcggagagcgagctgtccaagagtgttgaggtgaagaaggttgaggaggagttgttgcagcaggttcagagtgggagtgggagtgggagtggtagtgagatggaagaaggggagcttgagcctgaaccccaagcggaaacggttcctcctgtgactgaaggcctgccctctgttgctatggagactgatgagaagcaagttcagaagaatgaatgccaccctaatgatggtgacactgatgctgctgtggaggaggaagggaaacctaacgaggaggatggatgttgtgaggtaaaggatggagagaagaagaaagaagctgatgagatggcagatgttcgggattatcagactgagaaaatgcttgtgactgagactgaagttgagtctgtgggtaatggtgatgatgataaaaaggaggaggctttggatgctggtgctgagtatgaggaggaaacaaagaagggtgcgtgtgtggaggaggagaaggagaagaaggtggcgttgaatgaagaggaggataagaaggacaagggcaaggacaaggacaaggacaagggcaagggtgtagatctaggaaccagcacggatgttctcaaacctgagttaaatgatgtagtatcgacaggaaatgaggttccaaaggaagtggatagagaaatgatgatggagaatgtgatcaatattgcaaaggataaaggcaaaggtgtctctgttgcacttgtacctcctactgatgttgttcatgctttagatgatggcttgtggttggatagagagtcgagagacctcctgacgtgttctgttgatgttatagaaggtccaagcacaaggggattcgagttgttttccagatctcctgttaggaaagtggagaaagtagaccactcagttctcaacaagcacaaggatgacatggagcagcttgatcttactcttagcttgccgaatgttctgttacctattggtgctcatgagactggtgctcatgagacaacatcgcaaatccctggatcccccagtcaagcacggagtgtgcagtctttaagtaatacattttgtactaactcagatggttttactgcatcgatgtccttttcaggttcccaatcattctatcataatccaagctgttctctgacaaaaaattcagtggactatgaacaatctgttggcagtcgccccttatttgggggaatagatcaagtttcccagggatgttggcaaggtcagtctcagagcgatcccaaacagaaagaagttccttttggtcaaagaacctcggcgaatggaaatggctcccttttccagtctcaggcatcatggggtgttttagacagtcaagctgtgaagggtcaacattccagggttctagaaggaagttcaaaaatgggcagtggacttgacaggcaattgagttttcataagcagttttcaggccagtcaagacgccatgatgatgttagatctccgtcacagagtgttgggtctcatgatattggatcaaattatagctttgagaaaaagagagaggtaagagacaggggtagtggtagtctgtatcgaactaccggccagaaggaacaagagcaacttctgatgggtggagttgattttgttgagacaatcattgcaagaattgtttctgaacctgttcaagcaatgtctagaaagtttcatgaaatgaccggacagtccatagtatgtctgaaggagggtattcgtgaaatcatgcttaatgcagataagcatgggcagatacttgcttttcaaaaagttctgcagaacaggtctgatataatcttggatgtcctattgaagtgccaccgagtgcaactggaaattttggttgctttaaaaactggtttgactcattttcttcacctggagagcagcatttcatcttctgagttggctcaaatttttctgaacttaaggtgtaagaatctttcatgtcgaagtcagttgcctgtggacgaatgtgattgcaaggtttgtgcaaagaagaatggtttttgcagggagtgtatgtgccttgtgtgttcaaagtttgataatgcctcaaatacatgtagttgggttggatgtgatgtttgccttcactggtgccatactgactgtggattacgggaatcttatattagaaatgggcatgggacaaaagggatgaccgagatgcagtttcactgtattgcttgtgatcatccttctgagatgtttggctttgtcaaggaggtgtttcaaaattttgcaaaagaatggtcagttgaaacactttgcaaagagcttgaatatgtaaaaagaattttttctgccagcaaggatatgagagggagacggttgcatgagattgcagagcaaatgctgccaaggttggcaaataagtctaatctccctgaggttttgaggcacatcatgtcttttctttcggatggtgattcttccaaattacccatgacaacaaacttttctgggaaggaacaaattaaagaaaacaatggagtagctgggcccagcccggaagcagcttggatgaaatctatttattcagaaaagccacctctgttagaaaggcctgcaaatatccttcctaccttcgaccagaatgataaaagaactcttgtgcaagaatttcagatgagtagtatccagaaggacttctgttttgatgaattggagagtatagtaaaaattaaacaggcagaggctaaaatgtttcaatcacgtgctgatgatgctagaagagaagctgaagggttgaagctcattgcccttgccaagaatgagaaaattgaggaagaatataccaatagaattgccaagttgcgattgactgagactgatgaaattcgtaaacaaaaatttgaagaagcccaagcattagagagggcacatctggagtatttgaacatgaaaatgagaatggagacagacattaaagatctgttatccaaaatggaagctaccaaaacgagccttgccatgtga

SEQ ID NO: 71644 - DNA, 231 bp, Glycine max
  Peptide Sequence Number=SeqID_163329
atggggttggatgatgaatgctttgccagttctatgaaaggaagagagggtggagcaaactcgatattgacaaaggggatgaatgactggcaacagtgcccggaactgggaccaataggggatgttctttcaggaccagacttctcaacatcactatctgtgttaattatccaacaacacaaacttaggggagaattagatgggcttgatgaggacttctctatcatgtag

SEQ ID NO: 71645 - DNA, 657 bp, Glycine max
  Peptide Sequence Number=SeqID_163330
atggcagcctgcactgtctactcaacacaatctctgagcacaaattgctccatctcaaccccatcaaagacacagctgagtttcttccaccaaaagcaggtagttttctggaggaacagcaacaggggcagcagcagcagcagaagaagctatgtgataacatgtgcagcaggtgactcccagacagtggtgattggtcttgctgcagactcagggtgtgggaagagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggagaagggtgtcactgcccttgaccctagagccaatgattttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgaaacatttgtcattaacaattagtctaattgatttgttaattgtattgcctagtgaatcttcagaagtgggaggtgggggtgttacggttgtttga

SEQ ID NO: 71646 - DNA, 672 bp, Glycine max
  Peptide Sequence Number=SeqID_163331
atggaagaagtaaaggtgtcaccagaaaataagcacaaaggaaggttccaacgaatatgtgtattctgtggtagcagggttggatataagtcttcatttagtgatgcagctcttgagcttggtaaattgttggttgaaaggaagattgatttggtttatggaggaggaagattaggactaatgggtttgatctctcaaactgtgctaaagggaggtcgccatgttcttggtgtgattcctaaagctctgctgcctcttgagatatctggggaaacttttggagaagtgaaaacagttgcaaatatgcatgaaaggaaatcagtaatggctaaacatgctgatgcgttcatagcccttcctggaggctatggaaccatggaagagttgctggaggtgatagcatggtcccaactaggaatacatgataaaccagtgggtttgttgaatgtagatgggtatttccacagcttgctgtccttatttgacaagggagtggaagagggttttatagacaactctgcaaggcatattgtagtcatagcagacacagcagaagaactcataaagagaatggaggaatatgtccccaaccatcacaaggttgcaacaagacaaagttgggcaagggaccaattattatttgagcctactgaaactggggagatcctatga

SEQ ID NO: 71647 - DNA, 2802 bp, Glycine max
  Peptide Sequence Number=SeqID_163332
atggctttggcttctaagagtaagaggtgctcgcttatttggttgattctctttctttgtttattgttgagttcatcaaccaaaacaatagcaaggaaccttgctggttatgcagcagatgaaaaaggtccatgtaggagactccttggcattggcagagaactgcatccaccatgggttcccgttgcatgcaggacccgtagcaagcggaaaattgaatctgtgtctggagcttctttgaagcgtgaaagggtatctgaacgaggttttgattgtttgggagggcatgcaggtgaccctattgaaatcagtgacagtgaggctgaagagggcattaggcattctgagaagaagaggtttctggttcaaaaggaaagcaagcgtgaggagggtaaaggctgtcctgtatttgttgataaagttgaaaactttggcaatgatgactattcttgtgtacctgaaaaccggataagtttgccggatgagaaggagcattgcgtggataaaagtgaggattgtgcgaccactggtgaagattttcaggttgattatggtgagagtgattgctactcgagcagtgaggacagtgattcttcttatgatgatgatgatgatgctgatgaggatgagagagggggatacagcaagaccacgacctctagtaaatctgagatttataagcaggaagcaatgaatgctgcacataaagcaaagagagtagaaagtgtcaatgctgatgcgcaagtctttggggagcactggaaaagttcaggttgctctatgaagagaagagatagaggtcatcaaagtgtgtcattgccgaaaaagacagaatattcaactgtgatcaagaagaatcttgatgaccatgaaggaaaagagcatcatcgcgtcaaaggaacaggcaggaggagtgtttctcttttgccaaaaagccaagagaagataggagattcagctaaagctgcaagggtggtggatgatgaaactggtgacagagatgagctgcatgaagttctaaggatgccatctagaacaaaaaaccgatgttttaaattatttaatgaattcttttggggcaagaatgattctgttaaagatgattcaaattggttggaagaaaaggatgatgatgttggtcagggtcagactcagccattagcttctagggaaacagattctttgaattggaactttatgaagaaagaacctagtagtgttgataatattgggacaaaccaagcaagagaaaatgaagaaaatccagcttcgcagtgcaagcacgacactatttttaatgaggagattgggatatactgcagatgggtgtcatctggtggagggaacacctcacagtttgatggggatctaatgaatctggtgatgactcagaagcagttcggaaccactgaccttgccaaattgaagagggttgacccatgtagtcaaggtgggtgcattgtttctcatgctcctggaacaggaaagacaacgctgaccatggtgtttcttcagacatatttgcaattgtttccaaaatgtctacctattatcattgctcctgccaacatattgcttacatgggaagatgagttacggaagtcgaacattggaattccattccataacttgaacaattctgaattatcgagagaagagaaactcattaatgaagttgactggtctggcaatcaaaagcagaataaggatgccatacgtatggtgaagttgttttcatggtacaaagagaagagcattctattaatcagctacaatttgtatgagaagttagctggggccacatctgaaggtgatgggaaaaaagagaagaaaaatagcaagatgaaaaaaaaaaggagaaacgtgcaaggccaagggagtacattgaaagtggaatgggaaaggttctgtgtgactatcctggaaaggaaagatgtgagctgggattgggaacctgattcatctggagatacagctgatgagaaaataaaccagctaaaattgctgatgaatccctttgttcatgttcacaaaggtaacattcttcagaagaaccttcctgggttgagagattgtgtgctggttttaaagccagacattttgcagcaagaaactctagagagcattgaatgttctcagattgcactgaactttgaacacaagttggcctgggtctctgtccatccatccctattcctcaactgctctctgtcaaaaaaagaagaatctgttgttcacaaggataagttggaaaagcttagattgaacccttatggaggggaccaacttgagtcagccatcaactggtctgtagggacggaagtgctgtatatgtatggcaagcttgaccaaaagcaaaaacagtccctcattcaatgtttcaatgattcaaatagccaagcaaaggtgttgcttgcttctgtaaaagcatcttctgatggcattaacttaattggagcttcaagggtcatgcttcttgatgttgttaggaatccctcagtggaaaggcaagctatttgtcgagcatatagacttggacaaaagagggttgttttcacatatcatcttcttgcacagggcacccccgaatgcacaaagtattgtaaacaagcagaaaagaaccggttatctgaacttgttttctcaaatagaaatgctgaaagtgataagctcaagagtagtggagtaaggtttgaggatagagttcttgatctcatggttcagcataaaaaactcaaggatatgtttggtgaatgtctggttcaaccaagggagagatatttggagactttgggcccctga

SEQ ID NO: 71648 - DNA, 966 bp, Glycine max
  Peptide Sequence Number=SeqID_163333
atggatccagatcagggcacttcaaaagcccggaagcccaagttcaaacccaggaatctcaaagcagtccgagctcccaaaaccgaagcggatgataagcgaaacgaagatagcgaagtgcctcgagctctctcgcgtcgacgacatcaggatgtcatgcctcatgacacgaaaatcctgcaaaacgcgagcctaaagtcgaaagaaaatattttggaattgaagacagttgctacgcatgctagcgtggaagttgcatttagtcttggaagttcatcatcacattccctcaggacatatggcacaagcaaatctatagatagtggcacaagcagtggttcaccatctaaatattttgccaatgaacaaattcgttcaattgctactgaggatcaaaatgatgcttctaatgcatctgccaggaaaatcaaaagagagtacaaggaaccatgggattatgaaaactcttactatccgactactcttcctttgaggaagccaaattctggagatccagaaattcttgatgagaaagaatttggtgaagctgctactagtgtggagtatgatgagaatactgttaattctgctgcagaactcgagatcttggagagtgaggaacaaaggatgtttttctttcagattcctactcctctgcctatggacaagcagagtaataaggggaaggagaaaattggtacatcaacagtatcgggagaggccacaaagtcaaagaatgccttggaagagttgccgaggggatatatgggcaaaatgctggtgtacaagagtggagcaatcaaactaaaattaggagaaactctgctcgacgtgtctccaggttcaaattgtcgatgtgttcaagatgttatggctgtgaacactgcacagaaacagtgttgcaatcttggcgagattagcaaaagggttgttgtggttcccgatcttgattcaattgaactgtaa

SEQ ID NO: 71649 - DNA, 195 bp, Glycine max
  Peptide Sequence Number=SeqID_163334
atgtcttaccgtaacgaaacgcagaagcacgatgtaattggatttcgtggtttagagaaacgaagatatgagttgggtgaattgctatattctatttcactgaaactgagagtcgatattttaactccacaagccctaacaccgctgcggaagatgaaggccaagattcattctgtatttgcactgaaatggtaa

SEQ ID NO: 71650 - DNA, 564 bp, Glycine max
  Peptide Sequence Number=SeqID_163335
atggcaggtggatactatgacgctggcgacaatgtgaaattcagttttcctatggcattcacaatgagcatgctaggttggagtgtcttagaatttggagatctgatgggttcagagttgcaaaatgcatgggaagcaatccggtggggaagtgtttatttccttaaagccacaaaatatcgtaatgtagttgtggcgcaagttggcaatcccaatgccgatcacgattgttgggagagaccagaagacatggagtcatggacactcttcgaacctccatggttgtataaagccactaataggtccaattatcgggattttgtgaaagcaaacatccaatccatgggcaatcctgatgaatttggatggggactcgctccaagcatgcttgtttcgcaggagaccaatattccaaaacttactggggctgtggttggaggacctgcggaagatgattcttttcgggattcgcgctataatgttggtcaatcagagccaacaacattcatcaatgctccttttgttggtgttttggcttacttcaacaagcccactattacttag

SEQ ID NO: 71651 - DNA, 390 bp, Glycine max
  Peptide Sequence Number=SeqID_163336
atggctgacagcgtattctcttttagattattgaatgaaaatccagtccaaagattaggtgcaacaggagctacagaagttaaacgccacgctttcttcaaggatattaattgggatacccttgcaagacagaaggctatgttcattccaacggctgaagctctcgatacaagttattttatgagccggtacatttggaatcccgaggatgaacattgtcttggaggtagtgattttgatgagattactgaaacatgcagcagtggttcaggcagcgatttattagaagaagatggtgatgaatgtggtagtttagcagagttcagtggtccacctcttgaagtgcagtactcatttagtaatttctcatttaagagttggtccacttag

SEQ ID NO: 71652 - DNA, 1293 bp, Glycine max
  Peptide Sequence Number=SeqID_163337
atggtgggaaagaggtggggtgaagaaatcagaaaagggcaaaaagctcacatggcaagcacagaagcgaaaaatcatcctcaacgactcatagaacaaccacctttcttccactcctgctactctttcccttccttcgtcctccaagactcactctctctcgacctcgacctcttgccacttcccagccacttcgacgctttcgcagatctggtgcacgcgccgtcgttcgcttaccggcgcgtggagaggcatctcgagaatgagttgcgtttgcagagcctctctgaccgtgtggcggagctggagtcgcggttcgaccgtgtgctcggcggagatcggaagtacacgtggacagcggagatcaagggagcggagaagaacgggttcgataggaagtacaagtgggttgcggaggtcgctgaggaggaagataagaagaagaagaagaataagaagaagcaggtgaaggtgctgaaggataagagcgcgaggtggactcttcagctggagaatgaggatgctgaggaagaagaggagaagaagaagaagttgctgaagggcgttgcgaggaacgtgaaatggacggctgagatcacgggaaaaggggagaacagtgggagctcgaggaagtacacttttcaggtgcagagtggggatgctgagaagaaggagaaaaagaacaagggaaatgggaatggattgcgtattgtggagattcaggagccaattggtcatagagatgtggttttgagacaggccagtgatttggttgttgaggcatttgccaagaggtttggagctgttcaaaatgagaggggcaaaaagaaggacctgtctcctcaagatgctgccttgttgatccagatcagctttagagcttacttgatccgtaggtcaaaggctctccgtgcccttagagaactggccattgcaaagtctaaattaaaggaaatcagagcccagttcaataacttttcctaccgacgtcatgtagctcgtgatgcggaggaacgccagcggttttctgagaaaatcattgtcttgctcctcactgttgatgccattgagggatctgatattatggtaagatctgcgaagaggtcaatggtggatgagctggaagcaatgcttgatgtggtagatccccagcctggtggaagatcagcatcgctctacttcaaaagaaggacatttgatatgcctgatggagtcatcaggaaggaaatagaagaaggggttgcacaggttgtgcaaatgcttgaagaagcagagaatagtagtgaagcatga

SEQ ID NO: 71653 - DNA, 1083 bp, Glycine max
  Peptide Sequence Number=SeqID_163338
atgtggacacgcccctccaacaaccatgaaaatacactactaccacccagacctgattgtgatcataagcgaaaactgattgaaggcagacctggtgatgtaatggaggaagtcgtgaagacccatcaagctatcaagtcactggataaggcagtttcgacattggaaatggaactgacagcaggtcgaacaagccaaactggagggcggcaacagtcttcaaaccacagtgcacagaaggcttttgtggtgattggtattaacacagcctttagcagcaaaaggagaagagactccatacgccaaacatggttaccaaaaggaaatcagcttaaggaattagagaaagagaagggcattattgtaaggttcgtgatcggccacagtaccacaccaggaggcattcttgataaagcaattgatgcagaggaggcagaacacaaggacttcctcaggttagaccacgttgagggctaccatgagctatccaccaagactcgcctctacttttccactatcatttctacgtgggatgctgatttctatgtcaaggtcgacgatgatatccatttaaatttaggtatgctagtgagtacacttgccaagtaccgatcaagacccagggtttatattggttgcatgaaatctggtcctgttctatatcaaaataatctcattttaactagtgtgagtggcagaggagcaaagtatcatgaggctgagcactggaagtttggagaggaaggaaacaagtattttaggcatgccactggccaaatatatgccatctccaaggatcttgctacttatatatccatcaattggcccatattacacagatacgcaaatgaagacgtatctttaggttcatggttattgggcctagaagttgaacatgtcgatgaacgctctatgtgttgcgggacccctccagattgtgattggaaggcaaggacaggaaatgtgtgcgtggcatcttttgattggtcgtgcagtggtatctgtaagtcggtggagagaatgagagatatacacaaaacttgtggggagggtgacggagctgtttggaacgttgacctctaa

SEQ ID NO: 71654 - DNA, 1373 bp, Glycine max
  Peptide Sequence Number=SeqID_163339
gagattaagaacataaattcgtccaaaaactttgatggtatccctggtgccctcaaagattggttgctagacttattagcatgttctgacccaacattcccaacaaaagattcacttcttccttatgctgagctttcaagaacttatgggaagatgtgcaatgagactggccaattactaaatgtgatcaagtcttctggtatgtttaatgagttgctgacagctacccaaattgagttggatcgcttgagtgtggatgatgccattggttttgcatcaaaaattccaactttgtgtaatgatagttctgcaaatgaatccttgggaaagaacatcatggatgatatcgaatccttgaaacagagactcttgactacttctggatatttaaaatgtgttcagtcaccctcaatgatttttgacatgcttatttctggttcctgtgttgatttgcagagtaatttgcatgttacagtcacatctgcagttgcagctgcagttgtctggatgtctgaatttcctacacgacttaccccaatcattttgcctttgatggcttcaatcaaacgagagcaggaggaaatactgcaaatgaagtcagctgaggcccttgccgagctaatgtatcactgtgttgcacgaagaccttgccccaatgataaattaattaagaatatatgtagtttaacttgcatggatccctctgagacccctcaagccaaatccctttgttccatggagagtattgatgaccaaggttttctgtcttgtagaactcctgtgagcaaacagaagttaaaggtccatgtgctggctggtgaggatcggtcaaaggtggagggatttttaagtagacggggatctgagctagcattgaggcatctatgtgagaagtttggtgtgtcattatttgataagcttcctaagctgtgggattgccttactgaagtgcttaagcccagctcctctgaatctctacttgtcactaatgaaaagtcagctactctgtctattgagtctgttagcgatcctcaggccttgattaacaatatccaggtggtgcgttctgttgctcccatcttaaatgaggagttgaagccaaaactgttgacacttctcccatgcatttttaaatgtattcagcattctcatgttgcagttagattagctgcttcacgctgcatcacttccatggcacagtcaatgactgtgaaagttatgggagctgtggttgaaaatgctatccctatgttggaagatgcatcatcagtttatgctcgacaaggagcaggcatgttgatcagttttcttgttcaggggctgggtgtagagttggtcccttatgctcctctattggtggttccgcttctaag

SEQ ID NO: 71655 - DNA, 720 bp, Glycine max
  Peptide Sequence Number=SeqID_163340
atggcggcaacggcaacaaccgtgcctgtgcggtggcaaccaccaaacaccaggtttaggattcaacctcagcctcagatgaagagactgatgacagtgaaagcatttggcaatggtaagggaggcagagatatggatagggtttggagggaggcgtggcgaagtgcgaacgatggatttgagcgctttgtctttgaagcgaagaagactgcggagcgcatcgaccggcgatattctctttcgcggcgtctctcggccgtggcgagggcggccgccgaccgagcccgcgagattgatcgtgaatttgagattggacaacgttaccgcgctttcagcatggatttccaaagaaactggcccaagtacaggaagcagctcaacaactttctggatagtccggtcggaaagagctttgctacactattcttcatctggttcgcactgtctggttggctttttcggattttgataatcgcaacatgggtacttccatttgctggacctcttctcattgggactttggccaacaccatagttattaagggaacttgtccggcttgcaagatgcaatttggtggttacaagaatcaaataattcgatgtacaggctgtggcaacattgtctggcaacccaaaggtaaaggtaatggaggtgggagaaccaactccaaatctaagtcagaccccgacattattgatgtcgacttcgaggagaggtga

SEQ ID NO: 71656 - DNA, 498 bp, Glycine max
  Peptide Sequence Number=SeqID_163341
atgatgacattttgtaaattacagtattgggctgttgaaagtatctggcacacacataaaggtaccgagctcgaattcgtaatcatgaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaa

SEQ ID NO: 71657 - DNA, 297 bp, Glycine max
  Peptide Sequence Number=SeqID_163342
atgaggtggagaaagagggtgtctagttggcgttatggggacgtaggtgtggatggtgtgagagaaaccggtgtggcggagaacatcgaaggtggagaaagaagaggaaggtgtgaaaggggtgttggagtgggcgagtgcggtggaggcaaatgggtgccaaagggtggtcaaggtgggcttgtgtttgtgaatgactttgaaggaaagtttgaaagcgcgaagctgcatgagcatggaaataagaacaacatgcggtggtggtcgtggcggctacttcaccctgcaaccttctaa

SEQ ID NO: 71658 - DNA, 201 bp, Glycine max
  Peptide Sequence Number=SeqID_163343
atgtggcaagaatatgaaggagatcagtggggtcctgatccaaggagaaagaggactgtaaagggtcgtcccgtttcaactcgcattcctactgagatggacgaagacgaaaatgaacgagcaagtagaaaaaaatgtggactttgtcggcaacatggtcatagcagaaataattgtcctaattataatgttcttatataa

SEQ ID NO: 71659 - DNA, 432 bp, Glycine max
  Peptide Sequence Number=SeqID_163344
atggatgtgcggactaattctctcgtcaggccatcagggacaattgacaaagataaggaaaagctacggattgccaacaatggtgtcgttcagagtgaagaacaaaccttacctattggaggtgatggttgggaaaagtcaaaaatgaagaagaagcgttcctgtatcaaactagatgtttctcccagtacaacattgactaaacctgttaacaccttccaagaaactaaacagggaatgcaacaaagacttgctaccgattcgcgattctttcagtttgtaatggaactgttggagttggaaaatcagatggtatctctcaacaaactgggttgggcatacgagcttctacccctagaaacaaccaagataataattcccttgtcaatgataggaggggtcgtcctgttagttcagacaaggaaagggtga

SEQ ID NO: 71660 - DNA, 1923 bp, Glycine max
  Peptide Sequence Number=SeqID_163345
atgaagcataaagatggaaaaccgattaatcagccaaataagaaccggactgtgactttggcagtcacgttaattgctctctgtggtttttctttctatctgggaggaatcttttgctctggaaaggatagtgttgtggtcaataacatccagatggcccttgattctcctaaggaatcctcaggttctctgcaagttaagccaatcagtttccctgaatgcagcttggactatcaagactacactccatgcacagatccaaggagatggagaaagtacggcatgtaccggcttactttgttagaacgccattgtccttcagtttttgaaaggaaagaatgcttggttcctcccccagatggttacaagcctccaatcagatggccaaagagtagagatgaatgttggtacaggaatgtgccgtatgactggatcaacaaccagaagtctgaccagcattggttgagaaaggaaggggagaaattcctgtttccaggtgggggtactatgttccccgacggcgtcggtgaatatgttgatttgatgcaagatctgatcccagaaatgaaagatgggactgtgagaactgccattgatactggttgtggggttgctagctggggtggtgacttgttggatcgtgggattctaacaatttctcttgccccaagagataaccatgaagctcaagttcaatttgctctagagcgtggtattccagctgttcttggtgtcatttctacacagagacttcctttcccatcaaactcctttgatatggctcattgctccagatgccttatcccatggacagaatttggtggtatttatctcatggaaatacaccgtattcttcgtcctggaggattttggattttgtccggtccacctgttaactacgagcgcagatggcgtggatggaacacaaccattgaagaccaaagatcagattatgagaagttgcaggaactacttacttcaatgtgcttcaaattgtacaataaaaaggatgacattgcagtatggcagaaggctaaagataaccattgctatgagaagctggctagagagagctatccagcaaagtgtgatgacagcattgaaccagattcaggatggtacactccactccgtgcttgttttgtggttccagatccaaaatacaagaaatcaggtctcacatacatgcctaagtggcctgagcggttgcttgctgcccctgaaaggatcacaactgttcatggttctagtactagtactttcagtcatgacaatggcaagtggaaaaagcgcattcagcactacaagaagttgctgcctgaacttggcactgacaaggttagaaatgtcatggacatgaatacagtatatggagcttttgctgcagccttgatcaatgatcccttgtgggtcatgaatgtggtctcatcttatgctcccaacacacttcctgtggtttttgatcgcggtcttattggaatcctccatgactggtgtgaagctttttcaacatatcctcgaacctatgacctccttcatcttgatggactcttctctgctgaaagccacagatgtgaaatgaagcatgtgctgttggaaatggaccgaattttaagacctgctgggcatgctatcattcgagagtccgtttattttgtggatgccattgctactattggcaagggtatgagatgggtatgtcgcaaagaaaacaccgagtatggagttgacaaagagaagattctgatatgccagaaaaagctatggcactcatccaacaatggcgacctcgtactaagcggaccttttgggcttaacaagtatggtcgtgatcacgcccttagcgcaggattcgcgctaagcgcacctttgaccttcttcgtgagccttcttcgcgctaagcttgaactgaccgctaagtaa

SEQ ID NO: 71661 - DNA, 930 bp, Glycine max
  Peptide Sequence Number=SeqID_163346
atgggagaactgggaaaaacaactcttgccaagctggtttttgacaacaaggaggtttatgcatgcttcaattgtcacttgataacaaaactcagaaatggcttgcgcaataagacgtatgttgtcgtgtttgatgatctatggagtagaagattttggaatgacattgaattttctctgattgatgataaaaatggaagtaggatattaatcacaacacgggacacagaggttgcacagtttagtatgaaaaattctttaattcagcttcgtgtgcataagctagaacctttaagtgaagaaaagtctttggaattgttatgtaagaatgcatttgggtatggttttgatggatgttgtccaaaagaatatgaagatgtaggtcttgaaatcgttggaaagtgtcaatgtttacctctagtgaaggaaagagttttatccgaaaacttcatcagcggaatccttgcaaactacatgccactgaaggaagcttgtcctgcaaggaaagttaaccaacgatccattgaaatcgctaaaagatatgccaaatttgttgtgttcctctctttggaattacatgcttatgaaggtggaactttacattttcaaatgggagggttcccagaactaaaggaactagtgctcaaacgattgtataacttgaaatcaatcgttattgataaagtagggctacaatctttgaaaaagcttcggttagagaaaatctacaacctcaagagtaccccgtggcattcaacacttgggaagcacaggctgctggatgttgtagcgaggagcaattcatttgagaagagtgttgttgttgctctttctggtggtgggattgttattctagatgaggtgtttgagatgcggccattgattcagatggaacgtagtgcatcaaagcttcaggttcccatcaaataa

SEQ ID NO: 71662 - DNA, 306 bp, Glycine max
  Peptide Sequence Number=SeqID_163347
atggggggggggggagttgttggtgcacgacaaggtgacctcaacacttgctacctagttttcctaagtgagagtgttgtgtggacacgcttaggctatttcccgatgaatggtaccacgtggcatttgagaattaaggctaggtgcatgcatcatactgagcatgatcgattggaattatggaaggttgatgactacttgttgagtagtagtgatattatagcgacgaggcaggtcgttacagttgctgccttggctaaggcaaagaaacaatctttggatgcatttaggacaaaagctcgttag

SEQ ID NO: 71663 - DNA, 186 bp, Glycine max
  Peptide Sequence Number=SeqID_163348
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtggtggcagtattga

SEQ ID NO: 71664 - DNA, 327 bp, Glycine max
  Peptide Sequence Number=SeqID_163349
atgagaatcatgaaactggccaaatacaggctaaaggcccaagtggagaaggacgaaggcccaagtggagaaggacaaagcccccgagtggagaaggatgaaggcccaaagtttatctccgggttccttgttgaaccaattatcagacttatcaaggtaatccttgtggcgtctaccctgacttatcttccttcattggaagtggcgtctacccagacttatcttccttcaccgggaagtggcgtcatccaaaccttcgtagcctgtatcaaacgatccactcctactcaggttcacatcatctggtatcagagcttcggctcttga

SEQ ID NO: 71665 - DNA, 288 bp, Glycine max
  Peptide Sequence Number=SeqID_163350
atggtgccaatagatagaccagatatcacatccatcacctttgatcactttcgacattgctatgttccttggggattaacatctcacctgcaactggagtggttcaaagacatcaatttttatctgggcatggaagtgccgcatgacgctcaagaattcatagtgaccccaatgaggtttgatgtcattgaggatcggggagatcacaccaatatgatgccaaaggaggaggaagagtatcgtgagcttctacgagacttagagccttcatctaaggaagaagattga

SEQ ID NO: 71666 - DNA, 309 bp, Glycine max
  Peptide Sequence Number=SeqID_163351
atgaggtccttcaatggtgattttccaccatggagatgcagcggaaggcaaaggagaagaggagaggggaggcaccatccactaggaaataagccatggaagaaggagcttcaccaccaagaatgtgccttggataagaagcttgaagaggatgctttaatggaggaaaagaaagagagaagggggcagcatgaaattgaaggaataaaagagggagagaagttgaactttgaagtagcttcctcgagaagctttcttgagaaaacttccttgagaagcttctttgagaaaacttcctggggaagctag

SEQ ID NO: 71667 - DNA, 228 bp, Glycine max
  Peptide Sequence Number=SeqID_163352
atgaagcttgagttaagcaagcctaaagagggtcgagaaatacccaacacttttgtagaagcaagcttcatgatgatgaaccaagtaattttgatgatgccaaaagcccaaatgattgattcaagattgattcaagacttcaagatcaagcatcaagaatccaatccaagattcaagattcaagagaagaaatcaagaagcaacaagtcaagacttcatataggataa

SEQ ID NO: 71668 - DNA, 574 bp, Glycine max
  Peptide Sequence Number=SeqID_163353
tcttcattcttcatctagtgttaatggtgagggttctactcctaaggaccccttgtataagatattagatgagtcaagatcccttaagttgtggaaagaaaggactagcaacattaaatgcttcaaatgtcttgggagaggtcacattgcctctcaatgccccacaaagaaaatcatgatcataaggggtcaagacatttatagtagtcaagaggagactacttcttgcctttcttctagtggaagtgaagatgaggtaaggggtgaaaagtctagtgaggaagtttacccccatgaagaaggtgacctcttaacgtctgatttcctcatcacaattgaggaatacgtaggagcaagcccatcacttaagaactccacagttaagcctgtttggcttggagcaattttgtcattgatcttggaagcaagaagagttgattgtcaaggtctcgaaaaggctacctatggaagagtcatcaagaagtcaacaattagtggtgttacaaatggcatcaaagcaaacctttctcctagtacagtgtggtttgaggatgaaccaagcagaagctggtag

SEQ ID NO: 71669 - DNA, 378 bp, Glycine max
  Peptide Sequence Number=SeqID_163354
agtggacccaaccttgacccatgggctcaaaaatctaccctaaggttcattagaaccctaaggccttctttatcagctctagcccaatcctcttggagcctcttgctcatggctctggcgtccaatgataattctttgtggcatttgcgtatgggccgcaagagtgaaaaaggattggaaattctaagcaaggctagatgcatgctatccaattcagggttgaatggaagtttctgggatgcggaaatcaacacaacatactatcttgggaattgctccccatccattgacatagatttcaagaaccttattgaggctatgaagataaaggattcaaaatctgaagattcgggcaaggctaaggatgacattaagtag

SEQ ID NO: 71670 - DNA, 297 bp, Glycine max
  Peptide Sequence Number=SeqID_163355
atgggcacttggggcaatggcagctcgcccaggcgagctggagcttgcccaggcgagccgatgcttactcctgaagtaactggctcgctcaggagagctgcttggaattctcataagcttgaaatctcagttcctccaattcatggagttggagcttcctatgttcaccagctgcatttgagtcaaagttcagaaactttaatgcccaataagctttatgttccaactcaacagttgggcattacaaaaatgagatcctccgtcacttattggttccctgggcgtgccaaaccttga

SEQ ID NO: 71671 - DNA, 390 bp, Glycine max
  Peptide Sequence Number=SeqID_163356
tggatggtgcctcccctctcctcttctcctttgccttccactgcatctccatggtggaaaatcaccattgaaggacctcattgaagctcaaagatccggcctccatagaagctccacaagcaagcttccatcacttgccaatcgtctaacaaatcctcaagtgtctttgagctcccccttccgtggtgcggctggtttggtcaaggtgcattgttatgatggttcatttgtagttcgtggttatcgccatggtgggtgttgcggtgcaacggcgaagaagattgtcaatctgtatgtgatgcgatcctcccaaggtggggatccaacaccagagccatggctaggaaactccagaatgattaggccagggatgcaggagaatgtcctagg

SEQ ID NO: 71672 - DNA, 90 bp, Glycine max
  Peptide Sequence Number=SeqID_163357
atggtcattctacgccctttctcattcggggacagttccgctggcaaggagattcattggccgaatggtgtttcgctcgaacgaaattag

SEQ ID NO: 71673 - DNA, 210 bp, Glycine max
  Peptide Sequence Number=SeqID_163358
atggctccatgtaaggcttgtaggccttggatcttcttcatcaatggaatcttttgcttcttgaagatcaatggtagcggaatggagaaggaggaaagcttctcaaggaagcttctcaaagaaacttctcagggaagtttctcaaagaagcttctcaaggaagtttctcaagaaagattctcaaagaagcttctcaaggaagctacctag

SEQ ID NO: 71674 - DNA, 183 bp, Glycine max
  Peptide Sequence Number=SeqID_163359
atgtgggatcggcacaggcttaaaggagcactcaaaccgggtgtatttacccccaaggcctacactccgaagagtccgtcagggtctctccctcctgatttagacactgctcatgaagtatacaatacccatggcctcatactcctgtttcaaacacgtttaacacattgcgctacaatttaa

SEQ ID NO: 71675 - DNA, 423 bp, Glycine max
  Peptide Sequence Number=SeqID_163360
atggtcattgtacccttcatgtacatagacaacatacatcatcacaatgacatcatcaacatcatctcatctcaatgtcattatcaacatcaacataaacatcatctcatctcaatatcattatcaacatcaacatcatcccatctcaacattatcatcaacattaatatcatctcatcacaatatcattatcaacatcaacatggtctcatctcaacattatcatcaacactaatatcatataatctaaacatcatcatcaacatcacaaatttcaaaaacaaggtgtcagaccctaatttcgttcagggactatcgatggatattttgattctcgctagccgaattgagctgttcgacaccgattaccgtgctagaggaaagatcattcgatgttttggtcaggagtgcaaaagatactaa

SEQ ID NO: 71676 - DNA, 131 bp, Glycine max
  Peptide Sequence Number=SeqID_163361
ggcgacgcgaggctcgcgggtgcatcttccatgggaggaaaatgcgcggagtcaccaccaacgtttattcgaggaaaacgtcggaaaaaccggaaaggtgtggtcgacaagggtgtttcccttgctcctac

SEQ ID NO: 71677 - DNA, 117 bp, Glycine max
  Peptide Sequence Number=SeqID_163362
atgggaggaaaatgcgcgaagtcgccaccaacgtttattcgaggaaaacgtcggaaaaaccagaaagggaaggtattggcaccctacgcgtccgtcacaagggacaacaacctttaa

SEQ ID NO: 71678 - DNA, 738 bp, Glycine max
  Peptide Sequence Number=SeqID_163363
atggccagcaatcccgccagagctcagaagaaagccaagtcccagaaaaggaagcaaggaaagtgctctcaagctgctctcaatagattggatacttggttcacggacaaaagcaagaaggttgacttcaagatgatttatgttgtgaagaatgtgagaattccaaagtgtctgaacttggaatggtgctctcagcagggattcaactttccaaacttgctagaagcacaagttctatcaaagttcatgcaaatgaagggaaccttttacccagaattggtaaaagttttctatacatgtcctaaagttgatatggaaagcaacttgtactctattgtcaatggtgtagagatggttattgatgccgaagtttggaaagcagtagtaggaatagacatgggtcaaacatatagaggtatgctccttaacccaacaaggattttaagaaacatactagatgttggtggtctaacagaggaggacagaatgttgattatatatgggctgaaatcaagtattcaaatgaattgggtactgttgattgaagatattatgttgaaaagccgacgactaatggattatgaatttccatatgttgtagactttaccaaaggctctaatgagataactgaaaggcatctcaagaagcttggcatgacatatgttgatcatgaatggatcatggtcagagaccaaccagcagcaacaaacaacaatcagatggaagaagaagcttag

SEQ ID NO: 71679 - DNA, 357 bp, Glycine max
  Peptide Sequence Number=SeqID_163364
atggcagcgcagttgatccatgatcgagttgtgatggagtgcctagaggtacatccggaggaacccgcacgcacacttcagcagcctgtggagtggatactacctacacctactccatatcgactagtggagctagttcaagtgatagaggtgtcatcctctaaagaggatcctgaagaggacttagaggagttacctcctgaacctattgtggatgctcttgacttcctagaggatgatgaggacccactccttgatgttgattctccagaggatatcatgtcagcatttgaggcagactctacagaggagagcggccctggagggacaacgaatagtgaagactcttcatcatag

SEQ ID NO: 71680 - DNA, 90 bp, Glycine max
  Peptide Sequence Number=SeqID_163365
atggatgttaaacattttgaggtggttaaacgaaggtcgcatgccaacaaacaatggtccccggaagaaattaagataaaagggaagtaa

SEQ ID NO: 71681 - DNA, 909 bp, Glycine max
  Peptide Sequence Number=SeqID_163366
atggcctggcaatactcacccttggtagacgtgtcgggccctcacatattagttgcacgtgtcagcaccaaaggaagttgtgttgaagctactgcaaatgctataactgaagagccttttgctgttgatgtgacaactatgggcttgtacatagttggtgaggagtgtacacagctagtggccttgggtaagctgtttgatagtggcgccacgatacaccatgtcccttacacaaatgatgtggtgagggtcagtgttgtaacaatttacaacgctgacgtgcgggtcccatttctgacattagagattcaatatgtgagggaggcagttaacacattcattggatggccaatgcatcttgtgaaacctatatctgatgattcacacaataatgtggtgaaagcggttggatgcgttgagaggtgcaatacaagtgctgtaaaggattcattaggagaattgatgaagatcttgtatgatgtttaccagaagctagttcaactaccgtgggatgggacaaattatgggcttccaaatgtggaagcatcctttttcatcacacattgcaatgaagaaaataacagtactttcaaaggtatgtctgatcaagctgcacctcgatggattgaagcaaagagtcatgttcaaaccggaggctatgagtatggatattatgtgatgcattggatgtggtgcatagttactggcggtttgaaggatgaatggaacatgggcatttcatggtctacaaacgacaagattcaacaagccaattactttggctccctcacccaagcctcagccatccgagttaaccctgacgacattgtgtttgggggatgggatatcaacaacatgaacctggctgatgccatggccagggcaaaggtgtttgacatcaatttgtag

SEQ ID NO: 71682 - DNA, 585 bp, Glycine max
  Peptide Sequence Number=SeqID_163367
atggcttcttcttcttcttattctttttctctgcttcgttccattcccatttcctttccgcacacccaatgcgctctcaaatcccagcgcctctcgcttcgtgcttcggccactccgagccagaaggctcggttcgtcgctcgccgcaaggagtccctttcggttcggcaactgcaacgccccctaattgagtacatgcggttaccggcgagtcagtattcggtgttggacgcggagaggattgagcgggtaaacgaaaacacgtttaggtgttatgtttataggttcaagttcttcaaccttgaggtttgtcctgtgttgttggtgaaagtggaagagcaacctgatggatgttgcatcaagctcttgtcttgcaagatttctttgtctggcttttggggacagctcgagggctcggcaatggttgctgcacagaatgacaagtttgatgagaattgtgggaaaatgcggcagatgctgcttcaattgcagttgcaaaggggttgtggagaccttaaaattgcaatattgcaagcttcacttgttattgtggagcacaatttaaaactgataaatgatgtctga

SEQ ID NO: 71683 - DNA, 297 bp, Glycine max
  Peptide Sequence Number=SeqID_163368
atgggccatactaaaaacaccaacactggtataaatgaaggggctgatgtaacaagaggcagtggtttgaaggaagtgacagaatgggaagaacaagataagggacaacatgaaccatgtgctctaccagatagcaaatataatgaaacctgtaatcagataaaagaagtaacatcatattgggtcatggctcaggatttgggagtaacatgtggggaaagagaggaatcattgatcactacgatgattaatctggaggaaagggataagatcgaggctgataagatggggaaatag

SEQ ID NO: 71684 - DNA, 336 bp, Glycine max
  Peptide Sequence Number=SeqID_163369
atgaccacagcaattgctatagaggatgtaaggagagaagtgaagatattgagggctttaacaggacataagaatctggtgcaattctatgaagcctatgaagatgatgacaatgtttatatagttatggagttgtgcaaaggaggggaattgctagataggattctttccaggggtggaaagtactcagaagaggatgccagagtagttatgatccaaatattgagtgtggtagctttttgtcatctgcagggtgttgttcaccgtgatctcaagccagagctgagaaacttaggcattgaggttttcttgtttttgggattaattacatcatag

SEQ ID NO: 71685 - DNA, 261 bp, Glycine max
  Peptide Sequence Number=SeqID_163370
atgactgaagacattgtcaccatgaagttatttggtggcccaggcgagccaggggtttctacagatatcttcctctttggtaacaacatcgtggcggtagggactaccaacgacaatcaaaagaggaaaactctagatgaggcttcactgttattaagcgagtcagagacccaacatgaccacagatcgacctccacttcctatgtctcacacaaacccgggtatagggcctataacctcaatgtgtgtgcaaaggtgtag

SEQ ID NO: 71686 - DNA, 435 bp, Glycine max
  Peptide Sequence Number=SeqID_163371
ggtgcatccacttggttttttaaagagaacaagggagggtacatcccttgtggatctttggcttgtaaaggattttacaaggttgaaagaaatctcaagaaccgtaggttgcttggggactggatgccacttgatccaacaccagcttgcttgggcgagctgagctcgcctgggcgagcaaggttacttcaaaatgaagtaacagctctcctaggcgagctaccttcatcccaaatgccttgttttgccataaataggcgtgaagggaggatgaggaaggggttcctaggtccagaggagtggaagtcgatctatggtcatgctgggtctccgactcgcttgatgacaatgaagcctcatctagagttttcctcttctagtgatgcattgtcgttgatagtccctatcgccacaatgtattacctaagaggatga

SEQ ID NO: 71687 - DNA, 342 bp, Glycine max
  Peptide Sequence Number=SeqID_163372
atgtcagaatttacaagcgattatcctcctcaaattttagccaacctgcatcaattagactttgcaccttatgcttcagggtcatacaaggctcaagggaatgccccggaactcctccatgataatcacatgttacattcgagtcgtatcctcgaaaaaatggaggttgaggaaccttggctagggttatggctaccattgcattatcgagtagatatgggagcaaggtggtgtttggtattcgatgtgcgaccggcgggccttgtggctgatttatgggtggcctttgtggttgattgggtattcttggctgataaggtggtgggtaatgagaagggttga

SEQ ID NO: 71688 - DNA, 83 bp, Glycine max
  Peptide Sequence Number=SeqID_163373
gggaagatttggcgataggagaattgggtgagcaacacagtacaatagacagtgcttgtaaaggatgctccaagcacgactga

SEQ ID NO: 71689 - DNA, 417 bp, Glycine max
  Peptide Sequence Number=SeqID_163374
atgtatatcactctagatgatgtgtcttatttgttgcatttgcctatgacaagcaagctcattaatgatgtcctttccacctttgacagagtcatgatgaagattctgttgatgactcgccttggcattccaactgaggaagagactatagaggcaacaatcgcaggtgccagggtgaagttgacgtggctggcagagttgcatcagtggaacgtcgcgttagggtcatgcatgtgggctgccacgacttatcttttgcccttggtcgatagtatgatacttgctgacaagtcctcaactcacattcatgtcgcttacctcctctacctcaataacttggatgcttgccatgattacgcatggggagtgactacactgtcatacctatacaaccttctctcctctacgagccaatag

SEQ ID NO: 71690 - DNA, 826 bp, Glycine max
  Peptide Sequence Number=SeqID_163375
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctaagcccctatgcttagtgtattttttgaactgtatgatgccgctaagcacagcctctgaggagcttagccggccctatgtgtcgctaagcgggagtgtgtttttctgtgaaggccagctaagcggaccatgtctcgctaagtcgccaatggcttctaggaagcgcaaaagtattggttcaagacccacaacacaatatgatacaaggaggttttcctccttagatgcttggaacaggtacacggataatgttttggggagaaacatcttacctgagaggaatgtagagctctatcacactgagcttgatgattttaaaactgaattggagaggcgtaatttccatacacgcctcaccaatttggttgatgggagcatagacttggctttggtgaaagagttttatgcaaacttatacagctctgagggaccttcaccaaagcaatccagagtcagaggtcatttagtgaagattgatgttgatagtctcaacacattcctggagacacctatggtattggcagagggtgagactttacccacatactccagatactgcatgttgcccacagattacaaagagattgaggctgccttatgcataccaggccgagggttcatcttgaacgctgagggccatcctgggaagattctcaggaaggatttgactactctagctcag

SEQ ID NO: 71691 - DNA, 510 bp, Glycine max
  Peptide Sequence Number=SeqID_163376
atgaaggccgatatagaggccatgaaggaacaaatgacaatgatgatggaagcaatgatgagcatgaggaagatgatgaaggataacactactacagttgttgctgcgagtactgctactaggataggactcaacgttctcacctttatttttcataggactcaatgtcctctatctttatgctttcatatgactcaacatcctcgccttcatgttttcataggactcaacgtcctcgcctttatctttcataagactcaacatcctcacctttatctttccataggactcaacatcgtcgcctttattttccataggactcaacgtcctcgcctttatgtttccataggactcaacgtcctcacctttatttttcataggactcaacgtcctctgtctttatgctttcataggactcaacgtcctcgcttttatgttttcataggactcaatgtcctatgtctttatgttttcataggactcaatgtcctccgcctttatcttccatag

SEQ ID NO: 71692 - DNA, 159 bp, Glycine max
  Peptide Sequence Number=SeqID_163377
atgatgcaaaggaaaatgaaaggtcagattagagctttgttctctaccgaagcgcgagccaagttggaagattccgcttcggttgaagggttcctctcggtgtggggtttcaatggagaacaatggcagtttgtgatggctactggtggctgtgggtga

SEQ ID NO: 71693 - DNA, 648 bp, Glycine max
  Peptide Sequence Number=SeqID_163378
atgcctgccggaaatgttccacaggtgaagcggtttttgatatttgacgcgcagaagtcttcttcagtagctacaaatgtgcgtttacgaaaaaatcagaagcaagaactgaattcaagttttactgcaaaaggagcattgcggaatagtaaaataaatggagatgatgatgagagcgaaggaaggcgaaccttgtcgagcaagaagttagggaagaggttggtgttggtgcgtgatgatgcacatgtagcagaagctgtggccgcacgcggtgaggaacgcgtccttgatgatctgcatgcaaatcgggcagaggaagtccttgtccggctccgacgtggaggccgggaacgtgccgccggaggccgcggcggaggtgtcggcggcgacggcggcgcctttggacgcttccggtttgacgacggcggggacgagaggccccgcggagagctcttccatgagcgagggactgagggaggttaccttttttttttttattgcggaggtgtggttgtgaatgtgaattcggttttgggattttggagtgagagagagagaaggggcagagcgtgtgggtatggtggctcttcttctttgagatttgaggtagggagaacgagagtgggccccacgactgaagtgatgtga

SEQ ID NO: 71694 - DNA, 213 bp, Glycine max
  Peptide Sequence Number=SeqID_163379
atgatgaaagaagaaagaaaaagattcttccttagccccaaaatgttgaatgcgatcaacttagggcacatgagattcaattgtcctgtgtttaaaagaagaatggaaaaatccgacaagaggaatttcaaagagaagaaagaaaagaaaggatacatcacttgggaagataatgtcataaattcttcaagtgattcagagaataaatcataa

SEQ ID NO: 71695 - DNA, 453 bp, Glycine max
  Peptide Sequence Number=SeqID_163380
atgccaaatcataaaagcactgagtcaacactgaaaaaccttgaggtccaggtgggacaactggctaagcagatagctgacaagtcatccaatagttttgtggcaaatacagaacaaaatcccaaggaggaatgcaaagcggtgatgacaaggagtaagaggtttgtggaagctgaggatgaagaaagtgtggtgtacaatgagaaagtggctgaaaagaaaaggaatcgggaaaaagagaaacaaataatggtccagaaaaaagaaatggaggaccaagaaaaagaaaaagaagttgaaaaagaaatagaaaatgaaaaagaagaaaaaataataagaatgcaaagaagagttaaagtgaaaaagatgtggatgaaggtgttgaagtaccatatcctgtggtaccttctaagaaggaaaaagtgttggatcaagtggcctcaaaatagttaa

SEQ ID NO: 71696 - DNA, 185 bp, Glycine max
  Peptide Sequence Number=SeqID_163381
atggtgaaagttggaacctcgtacgtgccgatcaacgtctcatattcgccaaaagttggcccagggcttcccggtatcaacagggacaccaggatttatttattttgcgaagtgatcttccgtcacagggaaggtcttatgcataggttgtatcgacaaagaggagaagttataacgatggatgg

SEQ ID NO: 71697 - DNA, 504 bp, Glycine max
  Peptide Sequence Number=SeqID_163382
atgggggagacacatgaaattccccaccacaatctagccgacttcgagccttgcctcggatatgccactgaagggcaagcaattggtgtggttaaaaaccctcatgctatggcagaaatgggaaagaggaaaggctcagggccattgaaggagtacccaatatcatcacccctcccaaagttcaaggtgctggactttgacaagtacaagggggactacttgccccaagaaccatccaaagattatcagtacaattttgatatggttcccgataggatgcaactacagaacatttgcaaaaagggggacggatctttcaaagaacacccccaaaaggtggagggatctggcggcccaggtggtacccccaatgatggaaagggagacgatgatcgtgatggtagacacattatcaatactctactatgtaaagatggtgggctacgcaccctcaaagctttgcggatttggtcttcaccgacgaaaggatcaaagtgggtttaa

SEQ ID NO: 71698 - DNA, 576 bp, Glycine max
  Peptide Sequence Number=SeqID_163383
atgacatccttcagccagatgcagtcccaacttcaatcacagatgcaattacagggacttgcactgcctccagagcctaaggttggtccctcagctactcgtgttagcacaaagtggagttatgttgatccctcaccgaccgatccagagacgggtgacttagacaaatgcgggctgtacatcgaagaaaatccttcccatctagtttccctaggaagagtttatgagggatccacagctgttcacaacatcccttttttgcatcgccaagtgagagttagtgttgaggaggttaaagatgcaaaggctcccgttcctgtacccactgacaaggcagttgtgtctccagcaaagcctccagatagggcacatcctgaggtcgatgatcccctatatctgatgacattgaccatcccacatcttttcttgaggcctctccaagttatgtgggatgctaccgtgttcggggtgtttaatcaagacttcccattgtacatcaagcatgcagatctctccgaaattacacacgatggtcaatgtctcagcatatctattttacagttatggattatgtaa

SEQ ID NO: 71699 - DNA, 450 bp, Glycine max
  Peptide Sequence Number=SeqID_163384
atgaatttgttgcctagcgctgttcatgtgtcctccctcatcgagtttggagccccgcgaattcattgcctagctatgttcgccaattctccattctccacttttatttggagacctatgaattcattgcctagcgctgttcatgtgtcctccgccatcgagtctggagccccgcgaattgattgcctagcgctgttcgccaattttccatcctccaatcttattcggagacccatgaattcattgcctagcgctgttcatgtgtcctccgttatcaagcgcggagcctctggggactgggaaatatgtttttctgttatttgctggatcggtttctttgccaaacataaaaaaaaaaggataaggaatagagacaagagccgtcatcacggaaagggtaggacagacgaaatcaatgtcttatctttgctttcttcttatctccaatga

SEQ ID NO: 71700 - DNA, 456 bp, Glycine max
  Peptide Sequence Number=SeqID_163385
atgtgggcttttcatacaggccgacaaattgattgggcacacttagtccgatatcacatgcataaggcattgcgattaaatgctccatttccatatcctcacttagtcactctcttccttcaacactttaacatccctcttgattctaaaccttatgttccaatcaagagatccttcttaattggtgccactgtgattgcatcttttggttaccgtaaagagcatgatggctcttgggtgaaaaaaggtgcacaacccattgaagaagaaggacacttaccagttagagaagattcctctcttcttcaaaagattttggacaagtttgatgctttggagttacaagtggacatgcgattcaatgagatggattcaaggatcaccaaggtcgaaggagatgtctcttacatccgcacaagctttgatctaccaccaccaccgccaccatcatcttag

SEQ ID NO: 71701 - DNA, 159 bp, Glycine max
  Peptide Sequence Number=SeqID_163386
atgaactcactaagcgagcatgctgcgctaagtgagttcatcagtactcattgtcctttaatgagcttagtgcatatccttgcggcagatgttcagcttagtgggcgctgtccagctaagcaaattctgcagaagctgaatttctgcaacttccgctaa

SEQ ID NO: 71702 - DNA, 519 bp, Glycine max
  Peptide Sequence Number=SeqID_163387
atgtctttttcgcaggaaatagctccaaagaaactctccacgaagaggtctagaagagacgccacagaggaaggatccagtgctgcctcagagtttgatagtcatcgtttccggagtgctgagcaccagcagcgcttcgaggccatcaggggatggtcattccacagggagaggcgtgtccagctcagggaggatgagtatacggacttccaggaggagatagctcgcagacgttggacaccgctggtgactcctatggccaagttcgatcctgagatagtcctagagttctatgctaatgcctggcccacggaggagggagttcgggacatgcgctcgtgggtaaggggtcagtggattcccttcgatgcagatgcccttagccagttcctgggcgacccgctaattttggaggaaggccagcagtgtgagtttagccagaggaggagcagggctgacgatttcgatgaggaagccatcgcccagctattgtgcataccgggacaggattttgcctag

SEQ ID NO: 71703 - DNA, 114 bp, Glycine max
  Peptide Sequence Number=SeqID_163388
atggaggctttggaggaagactatggagatggaaatgggaaaaatgaatcaaggcaatttattgaggggttaatggatcttgcattgaatagagaatcaatagactggagacag

SEQ ID NO: 71704 - DNA, 114 bp, Glycine max
  Peptide Sequence Number=SeqID_163389
atggatgaatccgagtatcgaacacagggaactaagcctaaattactaaacctcgatccctcgttagaccgaatcaatccaagcttcatcctcagatccctcttgttggactag

SEQ ID NO: 71705 - DNA, 49 bp, Glycine max
  Peptide Sequence Number=SeqID_163390
ggtgaatgctgtgaagattttcccagatgcccaaaatggactcggatga

SEQ ID NO: 71706 - DNA, 522 bp, Glycine max
  Peptide Sequence Number=SeqID_163391
atgaaagggatcttcctccaccaccaccgctgccatggaacctccggagacccactagcaccaattcctccctctctttcatcttgccggtcatccaccttattttcctctgatgatcagcgtcagaggtactactctcaattttgtaatagagttattgtagaccctaagtaccttgaccttgaattttttgatggagaaacatttgattgttaccaagtgttgcaaaactctgctttggtcgatttcatgtctcttaaactgccatattttcctaaattagttaaagttttctataataatttgaaaattcaggatggtgttctttatcctgagctcaccatttgggctcagcatgcatccatcgctaagcgcagcttcagcgtgatagaagaatctgacagagcatcaatatcaaggccgtgcgctacatgcaagatcagtgcgctaagcacagtggttgtcttcagccaggctcagcgcatgactgacgctaagctcaaatccacttactcgtgctaa

SEQ ID NO: 71707 - DNA, 159 bp, Glycine max
  Peptide Sequence Number=SeqID_163392
atggcgttcatggtctatcagctgttcctcctgttcagtactgacggggtgggctgcgtcccattcgccatttgcgcaactgtctgggaacctgatcggtgcgggcctttcgctattacgccagctggcgaaagggggatgtgctgcaagtgcgattaa

SEQ ID NO: 71708 - DNA, 122 bp, Glycine max
  Peptide Sequence Number=SeqID_163393
atgccagaaatcatgcttaaagtgtccatgcattgcaaaggttgtgccttgcacgatttctggcagcgcaaattcctccttggccaaagtagcctgactatcgcacctgatagacatgggag

SEQ ID NO: 71709 - DNA, 648 bp, Glycine max
  Peptide Sequence Number=SeqID_163394
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccacacgtggtgtggaactccgtgcctccgtttctgcccttaaaaaacttggagatggtccccatgctcacagcttgctacttaatgcccatcagcaacgatatcagtataacatgggtaccgagctcgaattcgtaatcatggtcatagctgtttcctgtgtgaaattgttatccgctcacaattccacacaacatacgagccggaagcataaagtgtaa

SEQ ID NO: 71710 - DNA, 267 bp, Glycine max
  Peptide Sequence Number=SeqID_163395
atgaaaagtgataaagcctcacaagatatacactctatctctcaagcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 71711 - DNA, 330 bp, Glycine max
  Peptide Sequence Number=SeqID_163396
atgtgggtagaactaactcaactgcattggctcatggctactccacctgcctcgcctcctccttcatctcctcctccacctcctcctgtagtagcatcaacgtcttcgtctaccttgaagcggacacgcaaagccacacagctacaatccttggccactagaccacctggggcaaagagactagtggtccacgtcgatcctacgacctggaaggtcgacggtctccacaagaagaaattaagaacatatttggggattgtccctcgtgataaggtggaatttgatatccctgaagcttctggcggtaggacaaagaagaaagcactttag

SEQ ID NO: 71712 - DNA, 144 bp, Glycine max
  Peptide Sequence Number=SeqID_163397
ggtcttccaacagaaggcggtgccttctggtggaagcaacccagctcgcccaaatagggggaggagggcagaacaaaaatgttcaaccctcctggttttccaccattcttcatcgttcttcgttcgttcttcggtcttcaactg

SEQ ID NO: 71713 - DNA, 213 bp, Glycine max
  Peptide Sequence Number=SeqID_163398
atggtgaaagttggaacctcttacgtgccgatcaacgtctcatttcgccaaaagttggcccagggcttcccgcggagttgtatactggcttactatgttggcactgatgagggtgtcagtgaagtgcttcatgtggcaggagaaaaaaggtgcaccggtgcgtcagcagaatatgtgatacaggtgctaatattccgcttcctcgctcactga

SEQ ID NO: 71714 - DNA, 423 bp, Glycine max
  Peptide Sequence Number=SeqID_163399
atggtgtttccattcgattcattcgatgttgattccattagcttccgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71715 - DNA, 696 bp, Glycine max
  Peptide Sequence Number=SeqID_163400
atggcctggtttgccaatcagcgcgagcgtcagtcgctctttttctctaccacctttgaggtgatggggcacttaaccaaatccaaaggacgtgtgacagaagccgatattcagattgccagcgtctttatggatcgcatgaacctgcatggtgactcccgtctggcagcgcaaaatgcgtttcgcatcggcaaatcggacaactatccgctgcgtgaaaaaatgcgtcagttccgcagcatctgcttcggtcgctttgatttaattcggatgtttctggaaatccagatccaggcggccttcgccgacggttccctgcaccccaatgaacgcgacgtgctgtacgtcattgcggaagagctgggtatctcccgtatgcagttcgaccagttcctgcgcatgatgcagggcggggcacagtttggcggcggttatcaccagcagtcgtctggcggcacctggcagcaggcgcagcgtggcccgacgctggaagatgcctgcaacgtactaggcgtgaagcccacggatgatgtcaccaccattaaacgtgcctatcgcaagctgatgagtgaacatcacccggacaaactggtcgcgaaaggtttaccgccggaaatgatggagatggcgaagcaaaaagcgcaggaaatccagaaggcctacgagctcattaaagagaagaaaggtttcaaataa

SEQ ID NO: 71716 - DNA, 177 bp, Glycine max
  Peptide Sequence Number=SeqID_163401
atggatgaggttgacggaatgtctgccggtgaccgtggtggctcagatcaagcttatcgataccgtcgacctcgagggggggcccgctgcattaatgaatcggccaacgcgcggggagaggcggtttgcgtattgggcgctagcggagtgtatactggcttactatgttggcactga

SEQ ID NO: 71717 - DNA, 421 bp, Glycine max
  Peptide Sequence Number=SeqID_163402
atggataaatttcgtgtacaggggcctacgcgcctccagggcgaagtcacaatttctggcgcaaaaaacgccgcgctgccaatcctctttgctgcgctgctcgcggaagagccggtagaaattcagaacgtcccgaaactgaaagatatcgacacgaccatgaagttgctcacccagttgggcactaaagttgagcgtaacggttctgtctggatcgacgccagcaatgtgaataacttctctgcgccttacgatctggtgaaaaccatgcgtgcttccatctgggcgcttggcccgctggtggcgcgttttggccaggggcaggtttcacttccgggcggttgtgccatcggggcgcgtccggttgacctgcatatctttggcctggaaaaactgggcgcagagatcaaactggaagaag

SEQ ID NO: 71718 - DNA, 249 bp, Glycine max
  Peptide Sequence Number=SeqID_163403
atggaggatgagtcctctgaggccactatcccagagccatttattgtagaggtggaggcaggcgacacacagacgacacaggtagctgctgccactcctgaggccatttcagagcccccagcaccagcaatggatccatcttcacagtatgcagcagacccttccactcctgtgttagagatacctgagggccagaccacactagccttgactctggacacttctcctccagctattttgaattcctga

SEQ ID NO: 71719 - DNA, 501 bp, Glycine max
  Peptide Sequence Number=SeqID_163404
atgcttatcattcatgcatcctccgccatcgagtctggagccccaacagttgattgcttagcgctgttcgtttatcctccaccctcaaatcttatccggagccatgaattgtttgtcattcatgcatcctccaccatcgagtctggagccccacgaattgattgcctagcgctgttcatctattctccaccctcaaatcttatcaggagccccatgaaattgcttatcattcatgcatcctccaccatcgagtctggagtccccacgaatggattgcctagcgctgttcgtctatcctgcaccctcaaatcttatccggagccccagaaattcttatcattcatgcatcctccaccatcgagtctggagccccaggaattgattagcctagcgctgttcgtctatcctgcaccctcaaatcttatccggagccccatgaattgcttgtcattcatgcatcctccgccattgagtctggagccccatgaattgattgcctag

SEQ ID NO: 71720 - DNA, 297 bp, Glycine max
  Peptide Sequence Number=SeqID_163405
atggcttctaggaaacgtaaaagtattagttcaagacccacaacgcagtatgacacaaggagattctcttccttaaatgcttggaccagatacacagataatgtcctggggagaaacattttaccaaagaggaaagtagagatatatcactcaaagatagatgagtttaaggctgaactagagaggcgtaatttccataaacacctcaccaatttagtcgatgggagcatagacctggctttggtgaaagagttctatgcaaatttatacagttctgaggaccgtccaccaaagtag

SEQ ID NO: 71721 - DNA, 862 bp, Glycine max
  Peptide Sequence Number=SeqID_163406
atgtgggttttgaagctacaatccaaatttgaaggagatccaatggttaatggatttgggatcacggttagttccacaaaggaagattgcaaagaaatctctaatgatgatgaagatgtagagaatctgaccttgatggtgaagaaatttggaaaattcctcaagaggtccaaagacagaaaattctctaaacctttaaagaaggtggaaagcaacaacaccttcacatgcttcaaatgcgaaaagcaaggccgcatcaaatcaaatgcatcaacatccttcaatgcttctagcgaagaagttgcaaatgtgtgcttaatggctgattcaaaggatgactcctcaactattgaagaaattgaggtaaattctgaatttgaagaagttttggaagcctttaacgaaatgcacgaggaagtgcaaaggcttgttgtttcaaacaataagttgagaagcaatctaaaatggcatatcactaaattggcttcaacacaaagtgagcttgataaattgaagcatgaaaatgaaaaacttgatcactatgaagaacatatgaagttgcaaaatgagctttcctatcttaaagatctttttaggaaaatgaataaaggaaagagtgatcatagtcacttacttagtatgcaaaagcatactaccgataagattggtttggggtataacatgcaaactagcttatccaagaaaactaagtttgcatcctccaaaaaggtgaacccagacaaagtctccaaaaagaaaaacatattgcatcctaatcctaatgcaaagacttgtcattattgcatgaaaacagggcacacatcctataaatgctatgttaggagatttgatgttcctaaag

SEQ ID NO: 71722 - DNA, 288 bp, Glycine max
  Peptide Sequence Number=SeqID_163407
atggttgtcatcataaaaaagggggagaatgtgaataatgcaggttttgatgatgctaaaaagaattcacttgataattattgtcatcatcaaaaaaggggaagaataataatcaaacaaggttgctttcaagattacttcaacaaacattcaaaggtgaagcattgcttcaagattaatacaaggttgcttcaacaaacaagcattacttcaagatcaagcttttgcctcaaaacaaagtgtttccaagagatcaaggctctggtaatcaattaccaggcagtgtaa

SEQ ID NO: 71723 - DNA, 354 bp, Glycine max
  Peptide Sequence Number=SeqID_163408
atgaccaactcttttgagaatttagaaaggactgataaaacgaggtgtgagtttttgggatttcaaagcttgaccaaccccagtccaaggggtgactctcaagaatacatgatcatcaacctcgaattccaggtcttttctcttcttgtcctgataactcttctacctactttgagaaatcctcatcctatcttggataaacttgaccttcttagtgctgaactctatcaacaacagaaaacactccaaactcccatttgtctaatacacatgctcctaaaaggtcctccagcgcctgaatggtctgttcagtttggtcatcagtctgaggatggtaggctgaacttagcctaa

SEQ ID NO: 71724 - DNA, 200 bp, Glycine max
  Peptide Sequence Number=SeqID_163409
atggtgagcaacccttcaagagctcagaagaaagaaaaaacttccaagaggaagcaaggcgaatgctctcaggctgctctcaacaggttggacacatggtttactgatgaaagcaagaagaatgactacaagatgatctatgttgccataaacatgaggatccccaagtatttggacttggaatggttctctcaaaaaag

SEQ ID NO: 71725 - DNA, 771 bp, Glycine max
  Peptide Sequence Number=SeqID_163410
atgttgtatattgtgggtcctgtgttgcacactttgacatttgagtatgttgagggcccttcagtcaaagatgtatttcttgagtttgggtcacgtgatgttgacaaagagtgtatggacaacattgcatcccaaattggtcatgcaattggaaagctacatgattgtggtcttgttcatggtgatttaacaacatcaaacattctcaaagagtggtaccaatcagttggtgagttcattcacgtcttcttaggtcctgcgatgtccaattatccttcattcatattatgcagcatgagaaatattatcaatctgtgttacagaagtcaagtggattttgtgtatttgtgtgttcttgaaagagctattctgtcaatgcattcttcatgtgggaatgtgctgacaatgaagaggttttctgccaagcttgggattagttttttggccaaaactttaccaatggaatacataaaggccttttctatcttgttttctactgtttacaatccggattttatagtttgcgcactaaagttgatctgggcaaaaactttaggggataaagtttatcccttctcaccgatgtcaaatttgaagccttatgattatggattagatacttgctgcataccgcaagtcatcaaagcagtgctcatccacattgaacaaactagcacaagcattccagctagtgagcctggtgaaaaatcttgtgcgcatgcgagaaattttttccatggcggcgtatacaccgagaggcaaaccaagtag

SEQ ID NO: 71726 - DNA, 252 bp, Glycine max
  Peptide Sequence Number=SeqID_163411
atgtctgacatagaatatgttttcctccagctttctggctatattccttgtccacgtcatcgactgccaaggtttgaccctcaaactggactactgactgggacaaatgatgggacacttgttaacttctttctaagaaatttaggccgaaagtccgaaaaggcactttgtatttatcttcttgctttccaggctatagcgtgctgtttatgtttcttgctacggtatttccttgctggttggtacaaatga

SEQ ID NO: 71727 - DNA, 339 bp, Glycine max
  Peptide Sequence Number=SeqID_163412
atgaggcttcactgttatcaagcgagtcggagacctagcataaccacaaatcgacctccactctttatggctcggataaacccagtggagtcaccatctgtcgcaacctaccctttgacgggaggccaagctgaaaagcataactacgtcttccaaaaatggaaaatgagcggagtcgccaccaacatttattcaaggaaaatgttagaaaaaccaaaaagaggtctgcgaattttgaaaataagggttcgagagttttttttgcatagtggaggtattagcaccccacacgaccatcacaagggacggcagcctttcatcgagtgtgcaaaaatgtga

SEQ ID NO: 71728 - DNA, 171 bp, Glycine max
  Peptide Sequence Number=SeqID_163413
atgggacaccttaggtttatcgtacttttttgtaggaataatcaacatgaaaatacagaaaaagatatagagggaaggagcccagagtatgaagaacctcaggatttgaggtcaaatcctttccaaggtggaggggatgatgcaatcctaccccccaagggtattggatag

SEQ ID NO: 71729 - DNA, 527 bp, Glycine max
  Peptide Sequence Number=SeqID_163414
atgggatatgtgcatgaagaacactgtgtgacgtatgattttatgtattatttgattgtgaggatcgaaggaaaggaaaccttctgttgtggggtcaagcatgaccaagaacaacaaagtgacgtcgagaggcatgattgtgtaaggcaactatggaaggatttgtatagttgcaaagcaccatcttgtactatgccttcaaaacccacatcgattcatgggacaatcctgatggggagtgttgttgaggagttattcctcaaagcaatggatgaccacagagtgatgacacgttcatactattgttatgctaggcatgttgagattgtcaagttgtcatctaattcttacattcaagttttagatgttggatcaaaggattccaaggagaccttacctatcgtggaatcacctaggactaagctgaaggctagttacacttttccaccggggactagatgtcctctagtattggagactagtgtggaagaggcgacgttgtctattacaaagcttagggctttaga

SEQ ID NO: 71730 - DNA, 543 bp, Glycine max
  Peptide Sequence Number=SeqID_163415
atgatgcaccctctgcaatttcattcctcaatctccactagcagcgcacctacaccaccaacggctgtggcactttttgaaggtagcacactggttaatcaaccatcaaacaatggagtgcaaactccgaatgttacatctggaaactcagagaggcaagatgaatcaaacaatgatggatgctccaatgttgaaaaagctcaaaagaaaaggaaacatggagaagtagcaccactgccaccaccatccacgaatcccacacccactaatcctattgctggagagtcagttgttgatcaatggcaagtgaggcaacttccaataggccttgtcaaccaccaaaagttccaacacaaccacaagagacacaaggagttcaaggatccccaacacaagaagctcaacaaactcaagcaacacaaggaaaggctagacaacaaactcaaccataacaaggacaggaagctccatcaaaagatcaaaagtccaaaagaaaaccaagtaggacaccttctagtgcttggaactattataaacaagtaa

SEQ ID NO: 71731 - DNA, 192 bp, Glycine max
  Peptide Sequence Number=SeqID_163416
atgaggggtggaggttgcacagtagcctctttacctcagttggtcatgacaaaagacaacaatagatacctcaaagccctacactgggcaatgagaggcactgtgcataagcctcaagcaaacctaagggtggatcagaagttcttacccggtaggttgagaacccaaaaaggcaacctaggcaaaaattag

SEQ ID NO: 71732 - DNA, 228 bp, Glycine max
  Peptide Sequence Number=SeqID_163417
atgaccggtttccttcggtttttccgacgttttccacaaataaacgttggtggcgactccgcccattttcctcctttggaagatgcacccgtgagcctcgcctcactcgcccgccaaagggatttgatgatgtcaaaaagaatttgcttgataatgattgccatcatcaaaaaggggaagaatgtgaatcatgcaggttctgatgatgctgaaaagaaattcacttga

SEQ ID NO: 71733 - DNA, 168 bp, Glycine max
  Peptide Sequence Number=SeqID_163418
atggcagctcaccaaggtgagctggttacttcacccctaagctatttgggggtccaggtgagccagaggctagcctgggcgagccagggtccagaaaagctaaaaatgacccttttgccttcccctttggaagcaaggattgagaaaaggaaggagacagagaagtaa

SEQ ID NO: 71734 - DNA, 267 bp, Glycine max
  Peptide Sequence Number=SeqID_163419
atggagggtgagaacgcgagcaaggtgattgaattggtgaacgagatagccagcatctttgagtacaggcctctgatgaagaagcagtactgcaacttggtgtggaggctgaagcttctgatcccgatgttagaggagattagggacatgaacaaagatgcgcttgccaaggacacttccaacgccgtcctcgccttcaaggaagctctccaatccgctaggaaactccttagattcggaagcgaaggctgcaagttttacatgtaa

SEQ ID NO: 71735 - DNA, 474 bp, Glycine max
  Peptide Sequence Number=SeqID_163420
atggaggcactgatgtttcatcatgctcacttggtattggaagtaactcccaaaatgttggaagtctcaggttggagttcaaaatatggtggatggagaagattaaatgaagaaccgagaccttctaaagaatgtacgtggtggagggatttgaagaaattgtgtcaacatccacagcaggggcaacttttgaataattcaataatatggcaagttgggtgtggcgaccaagctaaattttgggaggattcaaggacaggaggtgggaatcaactaatggagaagtaccctaggctatacaccatatcggaacagcaaaaccaattaattcagaacatgggaactcacaaagatactagctgggaatgggattttaagtggcggagaccattctttgacaatgagattcagatggcagtttcatttatccaagaagtggagggactcagaatcagacctacaattggtgactag

SEQ ID NO: 71736 - DNA, 519 bp, Glycine max
  Peptide Sequence Number=SeqID_163421
atgaatactgtgttgcaaactgaaactgaattgaagctgggttgtggggataaattcagattttgggaggacagatgggtacgaggaggggaagcattaatgaggaaatatcccaggctgtatcaagtctcctgccaacagcaaagactcattcagcatgcgaggagacaaactgaaacagtttgggaatggaatcttgagtggagaagacccctattcgacaatgaagtagatgcagcctttgatttatggatgacatatcacagatacaaatccaaaatcagatcactgattgctggatatggaaaccaaaaactacaggataaagtaaggaggaggaagcctctcacctattttttgattgaccaaagacacggcccttatggtgggaatccctctcctggattcaaaccatgggagctttttctattaatccaagacaacatttcatgcagcaaacaattggcacaaatggtggaaagcagtattctagatggaagtgctggtgggtggccctaa

SEQ ID NO: 71737 - DNA, 534 bp, Glycine max
  Peptide Sequence Number=SeqID_163422
atgtccgaggtctttaatccagacttcccgctctacataaagcacgaagacttctccgaaattgcacacggtggtcaatgtctcagcatatcagtgttacagttgtggattctgcatctgactgaaaccagtatgcgagcggggaattctgatttgtatgcattcctcgagccacaatccattcagaggtttgggcaatcgcaatttgagattgaaagttacataaagagttggatgcagagttcaaaacgcgatgtctaccttggagcctacctgaatggtggacactggcagatggtggtcatcttgcccaaggaacacctagttgtctggttttgttcattgcataacaggccagacaacaaccttaaggggataattaacagtgctttaaaaggtcttgatgaagctccacagcctaaatcaaaggctcctgctaggtggattgtcgtcaagtattttagcgatcctagaccattggaggcagagagattaaaggcgcttcagatccagtgggcaggatattatctctaa

SEQ ID NO: 71738 - DNA, 357 bp, Glycine max
  Peptide Sequence Number=SeqID_163423
atggatgccgatgaaggtcgccggcgccgagaggataccatggtggagatcgaaaagaaccgtagggaagagagtttgcagaagaagagatgcgagggtctccaatcccaacagattccttcgtcacttcactctattgtaatttatttaacacagttactcttgtctcagtctgcgcagaatccgaatgttttaatttgcacacccaactttactattggctcaagtaggagttgcaattttgtgttgaaggatcagactataagtgcaaatttgtgcaagatcaagcacacgcaggttttgagccgttgtggggtggagtgtgaaggactcgagaccttgtgcattaaggattag

SEQ ID NO: 71739 - DNA, 876 bp, Glycine max
  Peptide Sequence Number=SeqID_163424
atgtttggtgtaaaatctcagatttttagaaagggtgttcacttccgcgagcagcgccgtgacgcaaatctcgaagccggagcggacctcgtggttcaccgaggacagcaccgaccgcagcggcgacgccggtacacttcgtgtgttggaagatccggttgcaggggtccgccgccttgcacgcggcgtgctccgcaccctcatacagtggattcgttcctccgccgcgatcggaaccggagaggagcgcggcagaggcgacgacgacagagatggaaatggcggagagatggaatccacgatatgagcagtaacatgtacatgatttcatttggtatagtggaaattattttctcacaaattccgggcttcgatcaattgtggtggctctccattgtagttgctgtcatgtccttcacatactccactattgggctaggccttggtattggaaaagttattggtatgaattcatgctattcacatgtccatcatgatgatatttgttcatcttcaatcactgaaaatagaggagtcaggggaagcctaaccgagataacaattggtaccgtgacacaaactaaaaaagtttggagaaccatgcaagctcttggtgacatagcctttgcctattcatactccctcatccttgtagaaattcaggttatgcatgttcttggttttgatccacatgcctttgctcattttagagatgaaaggaaaagacggcataatcaggccaaaacatcactaacaactaacaaaacactactggcaccaacaaaatcatgccagactagactactacatccaggaagaggttgtagatatgcagacctcttggccaatcatgagcaaaatttgcaaggtagttga

SEQ ID NO: 71740 - DNA, 922 bp, Glycine max
  Peptide Sequence Number=SeqID_163425
ggtggttgagataccaaggaagcacttggaagataaagcaaaggctttggtagatcaaggagagtggacttcattcgctgatgttctagcactcttggtgtttgggattgtcctctttccaaatgtggataggctagtggatctagcagtgatcgatgcttttctttcttatcaccacagcaaggaaagtctgaaagggaaggcaaattgggaagaactcttggcagctatggtaggggcatccgttaattggtttcctcgttggaaggaaggaggggccggagttttgtcctcatgtgaagggttcccaagcgtccccttgatgggaacaaggggttgtattaattataatcccgtacttgccataagacaactaggctatcctatgagagggatttcaagtgaggaaaaggctgaagttcctgaagagagcgaagaagtgcaagccttgaaacagaacttgaaagaacacgagtggtcaaggaaaagttcaagacgacagccatcagggggctttatggggcagcaacagcgaactcaagcttcaaagggccgaaaaggacgagtcgagggtggaaagtatgatattagaggacaagttgaaggcttgtcaaagtacaaagagaagctaaatctagctgctagccatgagcgaagactagaggacgagcatgcaaaagtattggctctacaagcagaaagggaagcaagagagaaagtgatagattcattacacggagaagctatgatgtggatggataggttcactttcactctgaatgggagtcaagtgcttccaagactgttagccaaagccaaaacaatggcggacatgtactcacctgccgaggaagttcatgggcttttcgattattgtcagcatatgatcaagttgatgtctcacataattaggaaccgctga

SEQ ID NO: 71741 - DNA, 732 bp, Glycine max
  Peptide Sequence Number=SeqID_163426
atggaatttccttcaggaaacaaaggatttgaagaggccatgaatcttgaagtgtgcacaaaggaaattaaaagagtagggaagaagaagtcaaacacacaagagttttatactggttcagcaacaacccatgcctacatccagtccccaagcgacctgcggtccttgagatttcttttcaaccttgtaaattcctttacaatcaaagatccacaagggatgtaccctcccttgttctctttgaacaacctagtggatgtaccctccactagaactgatccacaagagatgtaccctctcttgttctcagtcacaataacccaagtagatgtaccctctacttgtaccacaaaggatgcaccctctaatgtgttaagacaaagttctcaggcggttagtcctttgaaattttgtgaaaggggaaacaaaagaattcttaggcgggagaagggagacataaaagaatttaggcggttagtccctggcgaattcttttcgacaaagggagaagggaatgaaaaagatgaatatcacaattttgttttcaagttttatactggttcggccacaacccgtgcctacgtccagtactcaagcaacccacttgagatttccactatctttgtaaaatccattataaagtctgaaccacacagggacaacccatcccttgtgttcaggaatcctttacaacaagagactcacagtctcttaaccaatctcattgaataa

SEQ ID NO: 71742 - DNA, 219 bp, Glycine max
  Peptide Sequence Number=SeqID_163427
atggagggtagtgcatcaacatctgttgttcaagatcatgttgaggagcatagaaatccatatatggatatggttatagatgttacttatgatgtattaaatccagaagcaaaagaaatggaagaggatccaaatccgtcaacttctaagttctataacttattgagtgatgttgatgaatctctgtggagggttgcaagaagcatacaaaattgttag

SEQ ID NO: 71743 - DNA, 718 bp, Glycine max
  Peptide Sequence Number=SeqID_163428
ccaatcgttcggggttctcgtcacccctagtaaggtgatccgaccgctgatcactcgggcctttgtcgagaagtactgcacgcctaggcaggcgcagggtgatgcgcatcaggccacagacgctccaccaccacctcatcaggccgatcccgctggatcactaggcatggagcgttatctacaacacttggttcgccagcaagcggccaaccaccgggggcaggtgcagatacatgagtgtctctaccggttcagcctcagtcaacaggggcagggtttcgcttcttttgcatgccctaccctagagcagtttggggttgaggtcgcatggcccggagactggcccgaggtccaggcaggggaggagcctgcaggatcctctggtgaggcagaggaggctcatatggatgaagaaatgacggacttgctcggtttcttaggaggaagcggagccactttcatttgtcaattattctcaatgacaacggataagggttccttctctttctgccgttctgtctctcaccgccaacccaaaaatattgttgccccacccctgcttctgtcttcgccacaaccttcctacgtgatcagaattgtcgcttcacttaatgacaacaaccatctcattgttgtcgccaatagtagtgtgttgatgaaggcgaagaagaagattcacaatgctcgattgtggatgaggtttgaccagtcaggctga

SEQ ID NO: 71744 - DNA, 474 bp, Glycine max
  Peptide Sequence Number=SeqID_163429
atggcagaaccatcgaagaagcgaaagggggttgcgacttcatccgcagtcactggaacacgaagccacggaacatccaaggtgcatacatatcaaattcctccctccatatcatctcctacgttgttttcctcggaagaacaacgtatccggtacaattctcttttctcttctcgttccattatcgaccctaagttcgttgacttagctttctttgatgatgaagtctttgattgctttcaagcatttcaaaattctggtttaattcagtttatctccatgaaacttcctttttaccctgaattggttaaagtcttttattctaacttggaaattcaaaaagattccttgatttctgaagtttatggaattaagatggtcatagaccaatcccttttctttgatctcactcaattatcaagtgatggtgtaccatttgagggtatactttatgtaacatcccatttttcgtaa

SEQ ID NO: 71745 - DNA, 318 bp, Glycine max
  Peptide Sequence Number=SeqID_163430
atgcagatggcagacaaaggtagaggtggtggtcgtagaacatttaatcgtggtagaagatgtggttttggtttgggagctccaattaccaccaaccctttcaccttctccattcacatttcaaccttagagtcgatgattcatgtcattgtgctgactccaaacacacttcctacaactcaagaccaaccaaatccgacctttgtaagggagtcaattcccactaccccagttggagatgcttcaccttcagcaccagatgattctcttacacctgagtacccacctgatccaaattgtgaacatattattgattag

SEQ ID NO: 71746 - DNA, 471 bp, Glycine max
  Peptide Sequence Number=SeqID_163431
atgaacaaaatcagaaatggtcaagataaaggaaagtggataatagccaatgttcgagcagccttggacgaacattggggttctatagatttcctaaacaagagctccattgccaaaggtccaaattacaagaggaatgtgtacatgctaggtactttgagcaaaaggtttagttgctcaaaatcagctccatctacttctattgctcctgtggaagaccaaatagaggaaatgcgtgagacaattaataaattgaatgttgagcttttggaaaaggcaaataaggagaagacacttgaggaaaagatgttgcagctgatggagaatcatgaccaccaaagtcaggatatgcgacaaccgatgcaagaacaaagtgagcaaattcatcaacaaaatgagctaatgcagtgtatactacaacacttgcatattcagtctatcattccagctcctactccatcgactacatag

SEQ ID NO: 71747 - DNA, 468 bp, Glycine max
  Peptide Sequence Number=SeqID_163432
atgcaaagcttgcaagaactggctcaacaaagaccaattatgagtatcgaccaattcattgagaaggtggcctggcctggagcccgaccttcttttgtaggggataatgaaagttttacggcccaggcacctcaaaagcatgagctagagccagaaaatgatcacttatctgaagccatcatccctggagctattgattttttgaaaagaagattagagacgagatccaataaggctgctcatcctgagccagtgccagcatcagctgatgcaccatttttaggagtggatccatcttcacctcagcatacagtagactcttccactcttgtcttagagatacctgagggccagaccataccagtcctgactttggacacttctcctccagctactccagtattgcatctgacaaatgaggaggatgttcagacacaggacaaccaggaccagtcacaggaattttga

SEQ ID NO: 71748 - DNA, 287 bp, Glycine max
  Peptide Sequence Number=SeqID_163433
ggccctacaatgctcaatggaatgtctcggggcttctccatgacaagcacacgttgcgttcgagtcgtattctcagagaaacgaaggttgatgaaccttggctagggttatggcttccattgaattatcaagtagatatgggagcaagtcagcataggacaccagaattgggttttgtggttgatttagggatggcctttgtggataactgggtggtgggtaaggagaaggtttgttattggctgagtaatgacattgttgggttggtgggaaacttggctgtatag

SEQ ID NO: 71749 - DNA, 136 bp, Glycine max
  Peptide Sequence Number=SeqID_163434
atgccgactagggatcgggcaatctcaaacatgatgtgttgctcggcaccttacgagaaatcaaagtctttgggttctggggggagtatggtcgcaaggctgaaacttaaaggaattgacggaagggcaccaccag

SEQ ID NO: 71750 - DNA, 345 bp, Glycine max
  Peptide Sequence Number=SeqID_163435
atgtggatctttaacggcaacgtaactgaacttggagacactggtgggagccccgggaagagttatcttttctccttaacagtctataaccctgaaatcagtttgtctggagctagggttcaatggctggtagagcacaactcctctgttgtgtccgggttgggtgtgtcgggccttggttggaagccttgggaccagactaggactgtctattgggcaacctttggatggacttggtcaggacctggtgctctgaatgtcaaagtgaagaaattcaaccaagcgcgggtaaacggcgggagtaactatgactctcttaaggtagccaaatgcctcgtcatctaa

SEQ ID NO: 71751 - DNA, 411 bp, Glycine max
  Peptide Sequence Number=SeqID_163436
atggctccgagaaagttttccgcaaagagatctaggaaggacgccgtggttgaagggactagtgccactcccgagttcaacagccatcgtttcaggagcgctgggcaccagcagcgtttcgaggccatcaaagaatggtcattccaccgagagagacgcgtccaactcagggatgatgactacacagatttccaggaagagatagctcgccggcgttggacgtcgctggtcactcccatggcaaagtttgacccagatgtagtcctagagttttatgcccaatgcttggcccacggaggagggcgtgcgggacatgcggtcatggacgccctcagtcagttcctgggagactcgctagtgtcagaggaaggccaggagtgcgagtatagtcagagaaggaatctgggctga

SEQ ID NO: 71752 - DNA, 372 bp, Glycine max
  Peptide Sequence Number=SeqID_163437
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggtagctcagagaacctttcgaaaaaccgccctgcaaggcgg

SEQ ID NO: 71753 - DNA, 570 bp, Glycine max
  Peptide Sequence Number=SeqID_163438
atgagtgaaatagaggagatgcaagagcagacgaaggtcaacatagatgccatgaaagagcaaatgaccataatgatggaagccatgatgagtatgagaaaaatgatggaggtcaacacggttacagttgttgctgcaagtactgctataaaggtggacccgactcacccacccggctccaatcaagtaaatcgtccaaccttggatatggtaggtcaaggaagcggagaattgggaagtacgggtggcccccattttgtgcaggtccatagcaagcattccttcccaccatatggcttgcctcccaattatacaccacccaatgttgcacacgctcccgatgagaatgtcgataactccgctcccatacccattgagagccaacaaccccaatctagtcatgcacaggtccctcaacccatgggggagacacatgaagtacctcgagaccacactctagttgacttcgagcctcaccttggggggccctcagtatcgaccgcaaccacaacccttacattttggggttggaaaagtgcctcataccatggtagaaagggagaaatttga

SEQ ID NO: 71754 - DNA, 243 bp, Glycine max
  Peptide Sequence Number=SeqID_163439
gaattctatgccaacctctatgaccccaaggataaatcacctaagcaggtgagggtgagaggtcatctgattaaatttgatgaggatacgcttaatactttcttgaagacccctattattgtggaagagggggaatcgctctgtgcttattccagatttgcactcttgaggcctgatcctcaggagttggttgctaagctctgtatcccagcaaagggattcgagcttaatgttgatgggtag

SEQ ID NO: 71755 - DNA, 301 bp, Glycine max
  Peptide Sequence Number=SeqID_163440
gctcgcttgcctctggttgacaaaaggtgcgggaccatatggttcccctgcatgtcattggactcgccgtctctggatgaaaaaggtgcagatgacaacgttagtctctgcgtaccaacgggctcgcttgcctccggttgacaaaaggtgtgggaccatatggttcccgcacatgtcatcggactcgccgtctctggatgacaaaggtacagatgacaacgcgttgagtcttacagatagcaaaaagaatgtttatatggataaccactggggtatttctgcctgccccctaacctcacgg

SEQ ID NO: 71756 - DNA, 261 bp, Glycine max
  Peptide Sequence Number=SeqID_163441
atgaagcgagaatacatgatgttgtctatgatgatattggtccttagacagccaggaagcactgacaccatgattgatcctccatttcccatcagacgacacgtgaagtggaagataacccgcaccaagaaaactggccaaatgacgtctgaggcagcaaaggaaattgctgacaagattgattccttggaggagcaagcctcacagggttcctttgtcacccatggacgtcgggatgtactaactgctgccattgggtga

SEQ ID NO: 71757 - DNA, 357 bp, Glycine max
  Peptide Sequence Number=SeqID_163442
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattaggtcggaaccatcaccaaacactgtagcatttgttaaccaaggagactga

SEQ ID NO: 71758 - DNA, 201 bp, Glycine max
  Peptide Sequence Number=SeqID_163443
atgagagaagcaaggaggtcaacctttttcaaatatacaacatgggttctggcaatgcaaatgtggttggactctcatgtcgatctgaatgaatcatcctttccacggagatgtaactccagttacttcggaaatggtaagatctttggcgcaagaacgcaagaggaggggttgatccgtatcatcttgacttggttctga

SEQ ID NO: 71759 - DNA, 267 bp, Glycine max
  Peptide Sequence Number=SeqID_163444
atgtccccagtggagtcgccaactgtcgcaacgtgcccttttgcgggcgagcgaacgcgaggctcacgggtgtgctttccaaaggaggaaagatgcacggagtcgccaccaacgtttatttgtggaaaacgtcggaaaaatcgaaggaaaccggtcgaaatggaaattctaagttcgggagttgtatttatgtttgaggaaggtcgacaaaagcggggctcttgctcctacgtaccctctatcgaagaggaaatcagacctacgtag

SEQ ID NO: 71760 - DNA, 1042 bp, Glycine max
  Peptide Sequence Number=SeqID_163445
ggtggacccttgggtacttgtacctatcacctttagagggctacacgccctcgccatcagaggactgcatgtcctcaccttcgtagggctacacgccctcacctttagaggaccacacgtcctcaccttcagagggctacacgccctcgccatcagaggactgcatgtcctcaccttcgtagggctacacgccctcacctttagaggaccacacgtcctcaccttcagagggctacacaccctcgccatcagaggaccacacgtcctcaccttcgtagggctacacgccctcacctttagaggactacatgtcctcacctttagagggctacacgccctcggctctgaggactatacagggctacgcgccctcgccttcgtagggctacacgccctcaccttccgaggactacatgtcctcaccttcagagggctacgtgccctcgccttcgtagggctacacgccctcaccttccgaggactacatgtcctcaccttcagagggctacgcgccctcgccttcgtagggctacacgccctcaccttccgaggactacatgagctcaccttcagaggactacacgtcctcgccttcagaggacaacatgtcctcgccctcaccttccgaggactacatgtcctcacctttagaggactacacgtccatgcctttagaggactacacgtccttaccttcagtgggctacacgccctcaccttcaaagggttgcacgccctcaccattagagggctacgcgttctcactctcaattctgggccaccctctaatattggagggcgaccaactgtgcaagcacaaccagagtgggaggctatcacgcagctactatgcataccggggcaagatttcacccgtgccgctgcaaagagacgaggatcgcgcccgcaagacacccagtggacccagagacgtccaacaaggccctggggtttccagctttggttacaggcctctgcaaatcctacagggcgcctggatcgtgcccgcaaaacactctgtggacccgaagaaggccaatag

SEQ ID NO: 71761 - DNA, 252 bp, Glycine max
  Peptide Sequence Number=SeqID_163446
atgtcagtgaaaaacctcgtcaagcgcctaggagtacatgacaagacaaaccacacactaggagaccagttagggtcacgctattttgtgagaatgctccaaccatatgggatcaacataggcttaaaggagaactcaaactgggtatatttacccccaaggcctacactccgaagagtcggtcagggcctctccctcctgattcaggtccaacccagaaaacacacaactcctcaattgttctcaaaatag

SEQ ID NO: 71762 - DNA, 231 bp, Glycine max
  Peptide Sequence Number=SeqID_163447
atggactcaaaaatctaccctaaggttcatgagaaccctagggccttctttagtagctctagcccaagcctcttggagtcttctatccaatacccttggggggtaggattgcatcatcccctccaccttggaaaggatttgacctcaaatcccgagagtatggtaaggtctgaaaacccctttcatggacatcttcccatgagggaacatggctcctcaccaactcaatga

SEQ ID NO: 71763 - DNA, 276 bp, Glycine max
  Peptide Sequence Number=SeqID_163448
atgatccccactccaaacgagaatatcccagttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaagggtgtttccctttgctcctacgtattcctcaattgggatgagaaaatcagacctacgtag

SEQ ID NO: 71764 - DNA, 177 bp, Glycine max
  Peptide Sequence Number=SeqID_163449
atggcaagagctggtgacaatggtggtgtatatcatcaactggacggatctcaacgcttatttctggatgccatgagtacacaaatgcaacgtttgttgaactgtaacaaagaagagctctacagacgaatagccaaatcttccttgtttactcttaaacctctatcccttagagaa

SEQ ID NO: 71765 - DNA, 317 bp, Glycine max
  Peptide Sequence Number=SeqID_163450
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtaggcagttcgctccagctggact

SEQ ID NO: 71766 - DNA, 342 bp, Glycine max
  Peptide Sequence Number=SeqID_163451
atggcgaagatcacgttgaaggtcgtggttccaccagatactattttaaacaccgttagcgccaaggaccagatttacggtgaagttagtttgtcatttgttgtcaggtggaaggacgtacttgaccgcttacgacgtttcatcaacgaggatggaaattttcataccgttgtctacaatcaagatttggacaaactagtcattgtagcagggtggacaacactaagagatttttatcacgtgaccgcatatcatcaagtgtcgttaactcattatggtaagaatgtattctttctcactatattcaagagcagtagcatgcccaaatcattcccaagatga

SEQ ID NO: 71767 - DNA, 391 bp, Glycine max
  Peptide Sequence Number=SeqID_163452
atggaggccaagaaagagcaaatggccacaatgatggaggccatgatgagcatgaagaagataatggaagccaatgcggttgcagttgccgctaccagcgttgttgctaaggaaatgatttggggagtacaggcggccccttatgatgtgcaaattcaaaacgagcacgccttcctgccatatggcttgcctcccaactatacaccacccaatgtggcgtacactcccgatgaggatgtcaataactccgctcccatactcattgagagccaacaacctcatcatgcacatgtctctcaacccatgggggagacacatgaaatttcccaccacaatctagccgacttcgagccttgcctcggatatgccactgaagggcatgtagttggtg

SEQ ID NO: 71768 - DNA, 294 bp, Glycine max
  Peptide Sequence Number=SeqID_163453
atgccttctttgacttccggcatgtcacgaaacttcacgaattgcctaacgatgggtgccaagtacctcgaagttgtcaaacgagggtcgcatcccaacaacggatggtccctggacgaaattaggacgcagaatgaccataatttgtctctgcgtgttgttggacatgatcaagcctgggcggcaagacacagaatgaccataatttgtctttacgtgccaccggacacgatcgcctctggatggcgaaaaggtgtgcggaatgaccataatttgtctccgcccacctcttaa

SEQ ID NO: 71769 - DNA, 1137 bp, Glycine max
  Peptide Sequence Number=SeqID_163454
atggcaagtggtgtttattgccttcaaatctttaaatttatacttgcggatcaacttgatccgcaagttatgcagatcaatcatgcggatcaagaagacggaggaagacataggagaagacggacgaagacgtgggagaaagaagcagcagcaccagcagctcacgggagaaggaagaagacgcggatgaaggtggaagaagaagaagaaaagcctggcgggagagaagaagaaaagaagcgctgggtgcacgagatttttaaaaaaataaaagggcaattttgtcttttcgctttaagtgctgggtgcaccagcatagcaactcccttaattctattgtctttgtcctactatgaagggttcgattgcagttcctttgttgtctcgtcagtagtggaagttgtgaagaacgttgaaggtgaaggaggaacagcgagcgagcgagcaatgtacaaaacgaggttgcaggaattgtgtcagagaaggtcatggaccttacctacctacgacaacagcagagaaggccccgatcacaaccctcgcttcacttccaccgttaatgttaacggcgtctccttccacaccccttctcccacccgcagcgccaaacaggcccaaaacgacgccgccatgctcgccttcctccatttctccccgccctcaccgtcaacgtcatgtcccacttttcctcaacactctctctccatttcggctctttcttcttttcctcagccttctcttttcgcctcatcttctggttcacctgatcccagctctgttgttgatgatatacttctcacaaatggagtgttgcaacctaaattagaagaagtgtgccaaacatctcaaatcagtggccctgtaatagctggtcctcctcatgctatgcgtttcaagtgcaaagtcactgttgatggacaaacctatgaaagtgacaagttctattctacgttgaaggatgctgaacatgcagcagctgaagctgctttaatatcattatcaccaggcagagttcaagaggctagtcttagtcacttgtatattggacatgtgtcagacaagtgttggggaggtgtaggtgtcagaaatgtgtccgacacttcaaacaggagagatgtccatggccatgcttcatag

SEQ ID NO: 71770 - DNA, 129 bp, Glycine max
  Peptide Sequence Number=SeqID_163455
atgttgagtggtgataacccgactaagggtcttattcctggttatgtgtgggacttaacgttcatgtttgtggttttgaaagggtggagtactgtcaccccttacaccaacatttgtaagttcaaatga

SEQ ID NO: 71771 - DNA, 216 bp, Glycine max
  Peptide Sequence Number=SeqID_163456
gtggctcgtggcagtcaccggtggtcagtggtggtggaggagaaggttggggatgtccggggagggtttaagggaagagatggaggtaaaaatgagaaggatccgtctatggacaaggaggaccctgtcacgaagccaaaatttatggaggaggattccttgcaggcttcatctgaggagtcttgctacgaggcctttctccatcgactttattga

SEQ ID NO: 71772 - DNA, 204 bp, Glycine max
  Peptide Sequence Number=SeqID_163457
atgttggtggcgactccgcgcgccttcctcccttggaagatgcaccagatccacgatgtcggatacaatgtccaggacatcctgcccgaaaatactggagttgctgcacaatgcacaaggcaagataaaagaattgaagctgcaggatccacgatgtcggatacgatgtccaggacatcttgcccgaaaatactggacacataa

SEQ ID NO: 71773 - DNA, 381 bp, Glycine max
  Peptide Sequence Number=SeqID_163458
atggctccccttttcttctgccctatttcccttatttataggagagaagaaggaggtggttgccgcctagctcgcccaggcgagctgggttgcttccaccagaaggcaccgccttcttttggaacactcaggaaggcccaaaaactttacggattatgcaacgatgcttgtttttcctttcgaaatgttgcgaaacttcacgaattatgcaacgatgcttgtttttccttccgaaatgttgcgaaactttatggattacgcaatgatgcttgtttcgagggtttcgaagggagcaaacaaggttcaaggaccgaccgcaagtactcctggacgaaattagggtatgacagttgcccctctttacttatcttttattggtga

SEQ ID NO: 71774 - DNA, 546 bp, Glycine max
  Peptide Sequence Number=SeqID_163459
atgaccggtcagttcttaaaaacattgttctttgtttgggaaagcgaaacaagtaacaagagaccaaagaggccaagaacgaagcttgacgttgtcttgaagtcattactatttcatacccacattccattttcttcagaacactctcgctttcgccttcttccttcccactcagcaaatgagattagtcgccatcctgaagttctgtgggcacaacgttctgataaggtttacctcactgttgctctacctgatgccaaggatgtttttgtgaagtgtgagcctcagggtttgtttgctttctctgcttctggggttcaagataaagcctacagctttagcttggaactttatggatccattgaacctgagggttgtaaaactaaatctggcttaagaaacatactatgctcaattcagaaaggagaaaagggttggtggaagaggctattgaagtctgaagagaaacctgctccatacttgaaggttgattggaacaaatggtgtgatgaggatgatgaagagtcaacctgtaaacttctgtaa

SEQ ID NO: 71775 - DNA, 246 bp, Glycine max
  Peptide Sequence Number=SeqID_163460
atggcagcgtctgctccaaccccgcggaagtgctcgttaaagaggggaattgaaggtagggtttgggtttatgatggggaccttgagggagaggttagaggagaaatcaaaggtccagtcaaggaagtaagggaaggaagggttgtgggattggaagagagggttgttgtcgcaattagagtggtgacaaagggagggagcagtggtggtggtggccatgttgggcaactggttgtcatcgggtaa

SEQ ID NO: 71776 - DNA, 378 bp, Glycine max
  Peptide Sequence Number=SeqID_163461
atgttaatgtgtaatcatcaattttcaagtgttggtctgattgagttattatgcaccattggtagaacaccagatggtatattaaacatacttgaagccactatgacccctactcgtcaaaatgagtttgttggttacttgctcacaggaataaatcccaaaaagtttgacattccttccggatgtaccatggatgaaccgaaggatttgatcaagcaaattgcgcctcatgggattcccccttatggcatatggatcaacttgatccgtaacaagcttgcggatcatctatgtcaactacggatcaaatatagcttctgcagatcaacaaaaccctatgcggatcacgtcatagcatacacggatcaagctgaatga

SEQ ID NO: 71777 - DNA, 249 bp, Glycine max
  Peptide Sequence Number=SeqID_163462
atggcacagtccttctttctccatttttgtgcatcctctccttcgttttctgtctttggtgcgcagtgtttctccgtttcttcgtttccttgcgatcagttaggtaaggtgaaggtgaaggtaccggtgttcagtgttgtggtggttgtcggtgacatacaaggtacgcatttgcgtcatggtgcgttctggtgtatggtagatcgggcagatcaagttgatccgaaactgatattatctggattgtga

SEQ ID NO: 71778 - DNA, 309 bp, Glycine max
  Peptide Sequence Number=SeqID_163463
atgttggcggttaaaaagccaggaattgcttcatcataccatttatcaggagttgcatctttttgtttggaaaatcaaccaaaacaaacaatcacacaacataaattagatccaaaaacccaaatccagaaacacctcaaacagagaagcaaccagatagataatccatgcaaattagaccccaacgggtatagagccaatcaaagaaataccgagctcgaattcgtaatcactggtcatagcgtttccggggggggggaaattgttatccgctcacaattccacacaacatacgagccggaagcataa

SEQ ID NO: 71779 - DNA, 1259 bp, Glycine max
  Peptide Sequence Number=SeqID_163464
aagagctacacgtcctcgccttcagaggactactcgtcctcaccttcagaggctacacgtcctccacttcagagacctacacgcccttgccttcaaaggactgcacttcctcccctttagaggattacaagtgctcaccatcaaatggctgcacgcactcgcctttagaggactacacgtcctccccttcagagagctacacggcctcgcattcagaggaatacacatcctcactttcagaggactacacaggactaaacgtcctcgccttcagagcactacacctcctccccttcagagagctacaggctgtcgccttcagaggactgcacgtctttgcctttagaggactacacgtcctcaccttcagaggactacacgtcctccccttcagaggactacacgccctcccctttagaggactacacgtgctcatcttcagagggttggacgccctcgccttcagaggactacacgacctccccttcagaggactacacgtcctcaccttcagaggactacacgtcctcccctttggaggaatacacgtgctcaccttcagagggttggacgccctcgccttcagaggactacacgacctcccctttagaggactacacgtgctcaccttcagagggctacacatccttgccttcagaggactacatgtcctccaattaaaaggactacaggtcgtcgccttcagaggactgcacgtcctcacctttagagggctacacgtcctggccctcagaggacaacacatcctacccttcagaggactacacgtgctcaccatccgagggctacactccctcgccttcagacgactacatgccctccaattaaaaggattacaggtcgtcgctttcagaagactacacgtcctccccttcagagggctacacgtccccgccctcagaggactacacatcctacccttcagaggactagatgtgctcaccatcagagggatacactccctcgctttcagacaacttcatgccctccccttcagccgacaacacgtcctccccttaagagagctattagccctcgccatcaatggactacacgtccttgccttcattggactacacgtcctctcgttcagagagctacatgccctctccttcagaggaatactcgtcctcaccatcagaggacaacacgtcctcgccataagaggactacacatcgtcaccttcagaggactacacgtcctccccttcagaggactgcacgtactccctttctga

SEQ ID NO: 71780 - DNA, 580 bp, Glycine max
  Peptide Sequence Number=SeqID_163465
atgtgcatgattagtttgaggttgccggctttcaatgagtatgggagcggagttattgacatcctcactgggagtgtatgccacattgggtggtgtatagttgggaggcaagccatatggtgggaaggcatgatcgccatatgggggggtcaggtccacctcaacaatggtgctgttaagaaggtgatatgggccttccgacttcccgtgacaaaagacgagaccaacatacaacgcatgtgtgatgacatgatgcagatgcgcaaaagcgcaacagtgggatgtatcatccccttcgaaaaacatattgcggcagtagggactaccaacaacaatatgttatcaaagagaaaaactctagatgagggttcacagttatcaggcaagtcggagacccaacatgaccacagattcacctccactccttatgttcccatggacccggtggagtcgtcaactgtcgcaacctacccttcggcgggagggcgatgcggggctcatgggtgcttcttccaagggaggaaggcgcgcggagtcgccaccaatgtttattcgaggaaaacgtcagaaaaaccggaac

SEQ ID NO: 71781 - DNA, 246 bp, Glycine max
  Peptide Sequence Number=SeqID_163466
atggttaatttgggggcattcctcaacccctgggcccacctaggcccattagaaagcttcaaggagaagcaaccagctcgcttgggcgagcaagttgcttcaagaagaagcaaccagctcacctgggcgagttgtgttgcaactttgcctccctattttgctataaataggtgtggggggctaaagggaaggggttcaacatccttaagagtttcaactgatcttttaagccgtaatctcacttaa

SEQ ID NO: 71782 - DNA, 366 bp, Glycine max
  Peptide Sequence Number=SeqID_163467
atggctgggagaaataagcgagaacgactccttatcgaggccttgaacaacttggcgcaagttatggccaatcagggaggcgatggaggagcaactatgtaccatggtttagatctctttcagaggaacaacccacctaccttcaaaggggcttcaatgaggtcttttaatggtggttttccaccatggagatgcagcggaagacaaaggagaagaggtgagaggaggcgccatccactaaggaataagccatggaagaaggagcttcaccaccaagatgagccttggataagaagcttggagaggatgcttcaatggaggaaaagaaagatggagagaaagagaaaggggggagcacgaaattga

SEQ ID NO: 71783 - DNA, 3945 bp, Glycine max
  Peptide Sequence Number=SeqID_163468
atgaataccagagcacgcaccactcttcactcaatgaaacctcctttaaatgatactcctatgaaagggaagatggaaactggaggagggaagagagcaatgggtggtgggcacaagaacgggcgtcggtccaatcgagaaaggaaaatggctttgatccaagatgtagataagttgaagaggaagctcagacatgaggagaatgttcatagagcattagaaagagcattcacaaggcccttgggatctctaccccgtcttcctccttatcttcctccatatacattggagcttttggctgaagtagcagtgttggaagaggaggtggtaagacttgaagagcaggttgtgaattttagacaaggtttatatcaggaagcggtgtacatttcctcaaagagaaatgcagagaatttgaatgaccctattgaccaaaacaccataaggagttccaagcatcagagatcaaaatccatgtctcaaagtgagttcaattcaactatgatgggtaagcctcagccttctcttgccagaagtgcttccagcagaaagctaatgttctcctctgacactggcaacgaccacaccgggaaactagtccacgggaagcaactgcacagaaaacaagattcattctcatctatcccagaagatgggaggggaaaagagaatcgatcgtttggtaactttgtgaaggataagcaatcaccagagaagaaaacaaccaaagttgttactgcaataaagaaatctccactcaagcaagaatcgcctgagaagtgcatggatcacttgaagttacagctggattggagattagcagatcatgaaagggctcaaagttcttcaagttcttcagatgataaggtgtcagaaattgatagcacacccaatagagtttctgaggatattgtcaagtgcttgtgttgcatatttgtgagaattggtacatccaaggacaaatttggggaatcaaaaacagcttcacgttctgtatcagctttcaaccaatgcagcaaggaaaaggatcaatcctgtgatccttatggtatctgttcagaatccaaaacaagagaagtcggtccatataaaagttcatgtgaagttatagctaccactgttgatatgaaccgaacaacaaatgcagtgtttctgatccacagattaaagttcctacttgggaaactagcctctcttaacttaaagggtcttactcatcaggaaaaacttgcattctggataaacacttacaattcctgcatgatgaatgcatatttagagcatggcatacctgagagtccagaaatggttgtagcattaatgcagaaggcaacgattgtagtgggaggccagttgctcaatgcaatcacaatagagcattttatcttgagactgccttatcacctcaagtttacctgtccaaaagctgcaaaaaatgacgaggttaaagcaccaggcatatttggtctggaatggtctgagcccttagtaacatttgcactttcctgtggaagctggtcttcacctgcaagagagagagagagagaaagtggacgagtgagagagacagatagaaggcgagcgagtgagacacagcgagggagagtgagagagacagagagagagagagagaaccagagagagcgagagacctggacagcaaaaggacagcaaagaggacgacctggtttaagggataatcatggagggagagtagatgacaaagtcaacgcccgcagccggagtcgagacaatctacaggaaggaaagtggattccagtgaaaagtagaagaaaggcaccttcgaagaactttcccgttgtccgaaggaatatagaggagctgaaagcctctcacaagaccactgcgagagtaacgcaagcatcttcgtggagggagaagttggatgtaacctcattctacttttcccgattccctgaggaggtccgtgaaaaagacctgtggaagatttttcaggaatggggaaaagtgtgggaggttttcataccacagaagaggaacaaacaaggccatagatatggttttgtgcatttcaaaggggtagaggatggggataggttggagagaattcttggcaacaacatatacatacaggggattaagatgtttgttaacaagcctaaataccagaggggaggtaacagggtacataagtcaatggcaggtctttatcatacaacagattcaacaccgaaggagttcgacacgcctgaactgaagagcaatcaggtgcctatgggcacgaaactgagatcatatgtggaggtggtcaaaaatcgtaacaaggaaggggaggacaggcaaggacccacgtctgcaaatgggtcaacaacggtgaacacagggcccgtaaaaatccagacgaccaaagaaaaaaccaaatggctggacaaggcttgggtgggccatttaaaaaataagggtattgtcgatagggtggaggaggagctacagggaatgctcggggtggaggtgaagactgcgtattggggcgacgatatggttattctctatgacctggaagaagaaacggttaacgggctcaatctcaaagaacaaaagcatggagggtctcctttcttctctgtgcagagatggaagccggagatgttgccttcatacaggctaacatggctttgtatttggggggtgcccttgactgtttgggacgcagagaatctagcaagtattgtatcgatctgcagggaactcatcgagctcgatacggcgacggaggataggacgcatttagacatggcgcgggtcttagttcggacgaatgaaaaaccgcccatagatcgttcggtgctggttatggtggacgaaatccaatactccttatatgtgcgagaggagtttgaggctggctggggaagaggacagcgggttgaggacgaggtccggttttcgccgtcacctttttctacggccatagtagattccgatactgagccacatattcatgggccaaatagattttctcccggaagcttctccgtcagctccgtcggtgggtcgtccactaggacgcggctgtgcatggtggaacgtcgccggagacggaggaactcaggcttctctcccagtcgccatcagtgtgagaccccgccaggtgctgacgtgtcaccttcaggccgtcacgtgcctctggcagcgtctgggcgctcgacacctgcctgcgtgggacaacaggacagcaacggccccctaatcccggactttcgtggggaagggaggatagactctaggatgctctgtcatagccagcagcagttgccttttctggaagtgaacgttgatgggaaaagccaagagaatttattagaagtcaataccccttgggtacaaaggaatgaaccctcagtcactagccccaaagcctttttaggggtcaaacacgggtcaaaccccacatgcccttttgaaaagctttccccaagtttgagggagggagccgtggaccataatttgggcctcatcaatatcagcccaagttccaaaggtaaccagaccccttcaaccttcaaggtgtatgttagaagaaaggggtctgctacagtaaaccatgtggcccatgaaaattgttatacgggaagttataaggctgcccctgcttcgtggactaaggaccttgggagtaatctttttaaaaatggggaggaggtgattcttcagtcctcagaatttgttgggaggacctctaagcaagatagctcctcacaaacccttgcctccaataacagcttcattaacagtgactctgagtctgaagaggatttccatagggagatagctagagagttgggtgtggcctgtgatgatagaaacacctgtaaggagaagaggaaacatggtgttattaatagcagcatttcccttaaatcagcagcagtagtgatgggaatggagcaacctgaaccatga

SEQ ID NO: 71784 - DNA, 729 bp, Glycine max
  Peptide Sequence Number=SeqID_163469
atgaaacgattgagaccaagagtggaaatcgctggctcaacttgctgtcgccagacggccggagcttcgccggtcggaacagcacctgtgccggtgttaaccggagtagcaccaggatttgcggaagccatgaaaaaggatcaaaaagcaggactgaaatctcttacaagagcagtatttatactgctgagattcagttataactgtcaactgactaagcattttatggaaggccatgcaaaaatttctcctatatcacgcttgcctcttatcactgttctagataacaagcatcatctgaaggactttccagtttgtgagattcctggaaatgtggagtaccgtgcaaaatacttgatacacagtaaaaagcagtgtttgtttcttgtagtgtatgaatttagtggtgctacaaatgaagttgtgctttactgggaaaatagtgatgcacaggtagcaaacagtaaaagcagcacagtaaaaggtcgagatgcagcatttattggccccaatgaaaatcagtttgctatacttgatgatgacaaaacaggattgggtgtgtatactctaccaggaggggcctctcaagaagctaaggacaacgataaagtttttgaagaaaatccaactgctactgcagagactagtgttggttcaattcgtggcccgatgccatttatgtttgaaactgaagttgatcgcatcttttctactccattaggtgattaa

SEQ ID NO: 71785 - DNA, 1254 bp, Glycine max
  Peptide Sequence Number=SeqID_163470
atggagtggacgacgctgcagcacctggatcttcgccatgtggggcgcggcgtgaggcctctgcagcctcacgctgcttccttccatcctcaccaagctctcgtcgccgtcgcaatcggaacctacatcgttgaatttgatgcattaacaggtagcaagatttctgctcttgacattggagcacctgcagtgcgaatgtcttacagtcccactagtgggcatactgtgattgcaatcctccaggattgtacaattcggtcttgtgattttgacttagagcaaacatgtgtattgcattcaccagagaagaagacagagcaaatttcttctgatacagaagttcatatggctttgaccccactacaacctgttgtgttttttgggtttcataaacgaatgagtgtgacagttgttggaactgttgaaggcggtagagcacccacgaaaatcaagacagacttgaagaagcctattgttaaccttgcttgtcatcctcgcctccctgtactgtatgttgcttatgcagaaggtttgattcgagcatataatattcatacctatgctgttcattacacgctacaacttgacaatactataaagcttcttggtgctggtgcatttgcatttcatccaactctggaatggatttttgttggggatcgacaaggtacactgcttgtatgggatgtatcaactgagagacctattatggttggaataaaacaagttggctcacaaccgataacatcagttgcttggctccccatgttgcgtttacttgtaactctatctaaggatggaaatcttcatgtttgggaaacgcgcgttacggtgaatcctaatggacctcccacacaggctaatttttttgagcctgcagcaattgaatcaattgatatccctcgcatcctttctcaacagggtggagaagcagtttatccattgccgcgaatcaaagctttagagtttcatccaaaatctaatttagcagcactagtgtttgcagttacgtgctaccttactttgtttataccttgcttaatgcgacaattgccgacaattcaaaaaataaggccagatacagtagagaagggagaaagcagctttttgcagttttacaaagtgcacgaggatcttcagaggtgctatgcagcatctgttttaaaggaaaaactttctgccttgggttcatctggagtgttggcggaccatcagcttcaagctcaactacaagagcatcatcttaaagggtga

SEQ ID NO: 71786 - DNA, 618 bp, Glycine max
  Peptide Sequence Number=SeqID_163471
atgatcactctgcaacacactgaaattaaggcatcttttgagacagatgcacatatggttggacatgtttttaaagttaccttatacaagaaactacttggcatggtatcaaggtatgctttaaaccagattactgctgagtttgagcaaaagctaagtttttcataccaaggtttatctgagcccgaagtcaccataattgaagagatggaagccatatccaagcggtttgaagagcttggtgtatgtggcaaagtgactctaaaaagtaaactttggaaaattgtctaccttgatctaaactctatgtgtgctccttctgaaaaggaacatgcctatgttgaaaacattgtcaatgtcaaaactgatgataattggggatatcgtgcaattgctgccttattaggtatgagtgaagattcaaggtctttggttcgtaaccatttgctgaaagaacttgcaaaatggtttgataagtatatgaacctacttggtgacatagacagatttgagaagttaaagcaatcgctacttgttgatggattattcatggttaccatggataagtggatgaatataactgacatgagttatgtgattgcatcaaggtatttctaa

SEQ ID NO: 71787 - DNA, 168 bp, Glycine max
  Peptide Sequence Number=SeqID_163472
atgcaagaacaaatagaggaagcaaaagaacatcacctagatgaagatgctctgataccacatgatgtagctccttgtggagcttggaagccttggatcttcttcatcaatgaagtcctttgcttcttgaagatcaattgcagtggaatggagaaagaggaaagatga

SEQ ID NO: 71788 - DNA, 255 bp, Glycine max
  Peptide Sequence Number=SeqID_163473
atggcttcctatggtggtgaacgtctccaatcatattttttccttctccattccgctgtcattgatcttcaagaagcaaaggactccattgatgaagaagatccaaggcctaaagctctacatggagctacatcatcgggagaagaggatatattggttagctacctatcagctattccctatgttgaggtggtagaggaatctcttgaaacatccttccacgctgtcgcaacctacacttccgctggagggtga

SEQ ID NO: 71789 - DNA, 359 bp, Glycine max
  Peptide Sequence Number=SeqID_163474
cccattggcccaaaatttaccctaagactcatgagaactctagggtcttctcctacatctcgggcccaatcttcttggagtctcctagccatggctctagtgatgggtcccctccttgggagcattgcataatcccctccctcttgaagaggattggtcctcaaatctatagaccagtcatcatcggaatcaactacaccatgtggcatggtatgaaatgtgccatcttgctaaacctatccaccaccacaaagataaagtctacacccctttgggttctaggaagcccaaggacaaagtccatacttatatctacccagggtgtagatggaatgggtaatggtgtgtatagcccatga

SEQ ID NO: 71790 - DNA, 394 bp, Glycine max
  Peptide Sequence Number=SeqID_163475
cccagagattatagggaagttctttggcatgaagcatgaccctagcagcctcttgcaaagtcctgtttttcctttcaactatgccattttgttgtggtgtaatggctgcagagaactcatgaatgatgccttcagatgtgcagtattcagtaaacttgctgttttcaaactctctgccatggtcactcctgattctcttgatgacacagtctttttctctttgaagcctaggatcttagactcaactccatgggagcttgtaggcctaggatcttcttcatcaatggattcctttgcttcttggaagataaatggcagcggaatggggaaggaagagagagaggagacgccacttcaaggagaagatgagtctagaagaagctcaccaccatag

SEQ ID NO: 71791 - DNA, 258 bp, Glycine max
  Peptide Sequence Number=SeqID_163476
atgacttctacaagtggagatgctactccaccatctccaaaaaccataaggctcatggcggagatgattaaacttggttttgatgatgccaaaaagaatttacttgataattgttgtcatcataaaaaaaagggggagaatatgaattataagcaaacaagattgcttcaagaaacattcaaggttaagcaagtagagattgcttcaagattaattcaaggtcaagcaaacaagatcaagaaaaagataaggccttag

SEQ ID NO: 71792 - DNA, 360 bp, Glycine max
  Peptide Sequence Number=SeqID_163477
atgattcgcgagggagttagttctcatgttgggactatcatcttgaaacgtaagccaccccgtatcaatcaagcattgtgctttatgcttaaaggccacacattgttcaatggagtgcctcgagacaccaccatgataggcacatgtaacgttgggatgttaccatcagggaaatggaggttgatagatttttccttggcttactactgtcatttggttatcgaggatactgatatatggggttataaggggcttgtggaaagtttagccatgtgggaactaatgcaatcctcccaaggaggggacccatcaccagagccatggctaggagactccaagaagattgggctagagatgtag

SEQ ID NO: 71793 - DNA, 415 bp, Glycine max
  Peptide Sequence Number=SeqID_163478
ggaaacctcccttagcactgccatacctcttgagcttgaggttattcctcaagtaaaggaattgttggatgagggtttggtgcccaaaataggtattgtgaggcaccaaatccctatgataagtggtatgatgaatgtgttgagaggttcaaccctcttttgtaaaatcacccatgcatccatcatcttcatgattcacatacatagggactcattaggtagtgatcaaggggttcccacggaccctaagagaataaaggtcattcctgagtggcccactccaccaaatataaaggaaatttggggcttccatgacttaacaaacttctacaaaaggtgtcgagggaagaagcccaaagtttcaagaacatctgaatttgaggtcaaatccttttcaaaggggggggggagatga

SEQ ID NO: 71794 - DNA, 622 bp, Glycine max
  Peptide Sequence Number=SeqID_163479
atgttggctcttttgggaaaatatgctagattaatgtgcatatcgtttatgctaaaagtgtattatgattggttgacggagcatgagttgaaggtgaaagagtatgtttccaagtacaagtgcatgggattgggaaggaaatggttttcaacgttaaacagctgcaatgcaagctctagcgagaagccttgcctgcctcatcaggatcttgaaggatgcttgagtgttgcgatcaagggaattcaagattctcatctaaaaacgaagatcaagttgtgggagtcttgtttctggttctttcgctgcttcactgtgatcaagaacactcaagaaatcatgtcaaacacaatcaggattgagaaattcaatggaaagaatagcttcaatctgtggcgcatcaagatgcgtgctctgttgaaggaacaacgtgtttgggctcctattgctcctgcatctgtgaagaaaccagtggcttctgattcaaaagaaatggcatctgcttcaaagactgaagaactcacggaacaagaagaaaaggctcactcactaatcctgctttctttgtctgatgaagttttatatgaagttgctaatgaagaaatacaagtggcttatggctcaa

SEQ ID NO: 71795 - DNA, 372 bp, Glycine max
  Peptide Sequence Number=SeqID_163480
atgccacccaccaggcaccctctagactcggataagtctaacagggccctggggtttccagcattgatcacgggcctctgccagtcattcgaggatcccgtcacacctagtaaggcggccaaccatcgggggcaggtgcagatacatgagtgcctctaccagctcagcctcagtcagcagggccagagtttcgttccttttgtgtgccctactccagatcagtttagggctgaggtcgcatggcccggagattggcctgaggcccaggcaggggaggcgcctgtaggatccccgggcgatgcagaggaggcccgcatggatgaggagatgatggatttgctcggtttcttgggagggagcggagccacatga

SEQ ID NO: 71796 - DNA, 464 bp, Glycine max
  Peptide Sequence Number=SeqID_163481
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaagggaatccgactgtttaa

SEQ ID NO: 71797 - DNA, 141 bp, Glycine max
  Peptide Sequence Number=SeqID_163482
atgaccctttcatcatggcagaacaagctaaacaggccgatggttactccacccagctctcctcctcctcctcctcctactgaagcagcatcacagtcgccgtctaccttgaagcacataagaaaagccacacggctatga

SEQ ID NO: 71798 - DNA, 916 bp, Glycine max
  Peptide Sequence Number=SeqID_163483
gagagaaattgagtggaggaattggcataaggagctcactaacttctcagagggaagcattgatgttgctattgttaaagaattttatgctaacctctatgaccctgaagacaaatcgcctaagcaggtgagggtgcaagggcacctaattaaatttgatgttgatgccctcaacaccttcttgaagacaccagtggtcatagaggaaggggagagcttgtctgcctactcctggttagctaatctgaggcctgttcctcaagagcttgcaactcgtctatgtatccctgggaaaggatttgagctgaatgcagatgagttgcctctgaagatcttgaggaagaatctgactactctggcccagacctggagtgttctatctttctctaacttagccctgacatcccacacttctgacattactctagataggtctaagttgatatacgggctcatcatgaagatggatatgaacttagggtccctcatctcaggtcagatctctcttatagcacaacatgacacctcgaggctaggttttccagccttgattactgctttatgcaaggctcgaggaggaacccagaaatccagggctaggagatccgaggccccaccatcttttgctcctgcccctactcatgcttctacctcagctccctctgcatctgccccctctacttctacagctccagttcctccaagcctgcatcagggccagctcctgattatgcagggtttacaagatgtggtccaccagcagtcagttatgagcattgaagaatttcttcagaaggtggcctggccaggagtccagccttctcctttgggagggggtgaggcctccgcagcccagcagcctcaacctgcacaggacgatgcttttgttgacacatcagagccctcttcaccatag

SEQ ID NO: 71799 - DNA, 411 bp, Glycine max
  Peptide Sequence Number=SeqID_163484
aattccagctgataggtatacgtttccacgggcatgttgagaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 71800 - DNA, 845 bp, Glycine max
  Peptide Sequence Number=SeqID_163485
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcgacattaaatcctgttcatcgtccaagtaatgagattgcaccgactctctgtgcttgggtgatggtcgagtgtcgtgtgctggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71801 - DNA, 510 bp, Glycine max
  Peptide Sequence Number=SeqID_163486
atgaagcacttcactgacaccctcatcagtgccaacataggaacaaaagctggtaccgggccccccctcgaggtcgacggtatcgataagcttgatgcagttttcaagacatacatccacaaagatacgggttcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71802 - DNA, 414 bp, Glycine max
  Peptide Sequence Number=SeqID_163487
atgattcccaaggtggtcatatctcacttgatggtttctagaggtatcatccccttcgacaaacatattgcggcagtagggactaccaacaacaatatgttatcaaagaaaaaaactctagatgagggttcactgttatcaagcaagtcggagacccagcatgaccatagattcacctccactccttatgttcctatggacccggttctagtggagtcgccaactgtcgcaacctacccttcggcgggagggcgacgtgagggttcacgggtgcgtcttccaagaaaggaaaatgcgcggagtcgccaccaacgtttattcaaggaaaacgtcagaaaaaccggaaaggcgtggtctacgaactttaagtgtgaaaggttcgagagttgtatttacgcacggggaaggtgttag

SEQ ID NO: 71803 - DNA, 426 bp, Glycine max
  Peptide Sequence Number=SeqID_163488
atggttaccttgaaagaaaatgaaaggccaagttggaagattccgctccaatcgacgggttcctcttgttgtggagtttcaacagagaacaacaatggtttgtggtggctaatggtggatgtgggtgatggagaaagttcttgggactttagaaatggctttggaagaaagaaagaagaagaaatgacgtttttcctaagctacacaaaagcaaaggctgaacttcaagcacactctagacagcatctcaaagatcccaacgatcagatcatggacaagagtgttgtgaagctgcagaccaaatttcgagaagatgtaacggttaaagaaggctgggcaacatttataccaaggcagcttcatgtagcttcctcaagaagcttccccgtggcttctttaagaagctttcccaagaggcttctttga

SEQ ID NO: 71804 - DNA, 687 bp, Glycine max
  Peptide Sequence Number=SeqID_163489
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatcagggcggcctgctgaccgaaaagatcgtcaagacgccgcactgcgtgctgctgctggacgaaatcgaaaaggcgcacccggatatcttcaacatcctgttgcaggtgatggaccgcggcgtgctgaccgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 71805 - DNA, 129 bp, Glycine max
  Peptide Sequence Number=SeqID_163490
atggtggcagagtatgcagcgaggtttgagaacctcgtaaggtattttcctcattatcaaggggaagctggggagaggtccaaatgtatgaaatttgtcagtggcctccaaccagaagtaaagatgatg

SEQ ID NO: 71806 - DNA, 255 bp, Glycine max
  Peptide Sequence Number=SeqID_163491
atggattggtggctgaaggagaaaagctttcagaatatggtggttcacaactggagtaactatcatcctagtggttggggtggttttgttctcaagcagaaattaaagttcatcaaaaatcacataaggcagtggagtttacaaaatggtgctactaaaatccagaatttaaagaaggacctgaatgctttggaggctggagtaaatggttcaaacatatctcaagctgaaatggagcttaagaaatctttgtag

SEQ ID NO: 71807 - DNA, 342 bp, Glycine max
  Peptide Sequence Number=SeqID_163492
atggcaaaggcattggcagatcaaggggaatgggcctcgtttattgacgttttcgcactgttgatatttggtgtcatcctctttccaaatatagagggattagtggacctagcagcaattgatgccttccttgcttatcaccatagcaaggaaagcccggtctttgctattttggtcgatgtctatgacatgttcgaccgaagatgcgaaaagagcggcacaagaattatttgttgtacaccggctctttatgtgtggcttgtctcacaccttttttgccaagaaagtaggcccacctatccactgcaaggtcaccgcttatgcaccgagaaaggaaagtga

SEQ ID NO: 71808 - DNA, 269 bp, Glycine max
  Peptide Sequence Number=SeqID_163493
atggtgcagatgacgacgttagtctctatgtgctaccggactttgagtctaacggatagtgaaagagtgtttatacggataaccacttggaaatcgtttgaacggataaccgcttggttatatccgcatgtcatcggactcgccgtctctggattacaaaaggtgcggaagacgacgttagtctctgcgcgtcaacgggctcgcttccccctggttgacgaaagggtgtctccgcgtgccaacggactcacaagtcataatagcaaaag

SEQ ID NO: 71809 - DNA, 648 bp, Glycine max
  Peptide Sequence Number=SeqID_163494
atggcgagggcgtgcagccctttgatggcgatgacatgtaggcctctaaaggttaggacgtgcatccctctgaaactgaggacgtgtagtcctctgaaggtgagggcgtgcagccctctgaaggtgaggacgtgtaatcatctggaggtgagggtgtggagccctctgattgataggacgtgtagtcctctgatggcgaggatgtgtagtcctattaaggtgagggggtgcagccctttgatggcgacgacgtgtaggcctctaaaggttcggacgtgtatccctctgaaggcgaggacgtgtagtcatctaaaggtaagggcgtgcagccctctgaaggtgaggacgtgtaatcctctagaggtgaaggcgtgcagccatctgatggctaggacgtgcagtcttctgatggcggggatgtgtagtcctattaaggtgagggcatgcccttttatggcgaggacgtcgagtcctctgatggcgagggcatgcagccctgtgatggtgaggacgtgcagccctgtgatgccaaggacgtgtagtcctccaaagcactctaaaggtgaggtcgtgcagatctttgatggcgaggacgtgcagtcctctgatggtgagggcatgcagccctctgaaggccaggacatgtag

SEQ ID NO: 71810 - DNA, 438 bp, Glycine max
  Peptide Sequence Number=SeqID_163495
atgggaatttacggtgcagtaaatattctcatctcagtcaattgtttctcttttggaaatatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71811 - DNA, 210 bp, Glycine max
  Peptide Sequence Number=SeqID_163496
atggtgaaagttggaaccttttacgtgccgatcaacgtctcattttcgccaaaagtggcccagggcttcccgtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 71812 - DNA, 812 bp, Glycine max
  Peptide Sequence Number=SeqID_163497
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataggtgggcaaggcccaattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71813 - DNA, 806 bp, Glycine max
  Peptide Sequence Number=SeqID_163498
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcctatatgttaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71814 - DNA, 195 bp, Glycine max
  Peptide Sequence Number=SeqID_163499
atggttacctcgaaggaaaatgaaagggtgttacattatgccttagctaaccttgaagggttgttcctagtacccaatgtcatcacccctcccaagttcaaggtgccagactttgacaagtacaaggggactacttgccccaagaaccatctaaaagatatattgtcggaagacgggggcatacgcaaaagatga

SEQ ID NO: 71815 - DNA, 297 bp, Glycine max
  Peptide Sequence Number=SeqID_163500
atgggggtcgtccgtacttgccaactctttgcctctcacatccgaggttggatgacttatttgattgaggccagatgggtgagtcaggtccacctcagcaatgcagccgtattgacctccattatctccttcatgctcataatggcctccatcattgtggccattttctctttcatggccttcatgtcagccttgatctgttcttatacctcctctacttcacccattactctagctctagcacagggaaagaatgcaatgaacaatgccaccaatgaaaagcatggatgtatgtga

SEQ ID NO: 71816 - DNA, 348 bp, Glycine max
  Peptide Sequence Number=SeqID_163501
atggccctggggtttccggcattgatcacgggcctctaccagtcattcggggttcgcgtcaatcctagtaaggcgatccgaccgtcgatcatcctggccttcattaagaagtattgcacgcctaggcaggagcagggtgatacacctcaggccgcagacgcaccgccactacctcatcaggctgatcccgttgggtcattaggcatggagcggtatctacagcacttggtgcagatacatgagtgtctctaccagctcaacctcagtcagcagggacagggtttcgctccttttgcgtgccctactccagatcagtttagggctgaggtcgcatggcccggagattag

SEQ ID NO: 71817 - DNA, 258 bp, Glycine max
  Peptide Sequence Number=SeqID_163502
atgttttccaagaaggaggaaatgatgagaattctgaaattggccaaatacaggctaaaggcccaagtggagaaggataaagcccccgagtggagaaggatgaaggcccaagtggagaaggatgaaggcccagagacttatcaaggtaattcttctagcgtctaccctgacttatcttccttcactggaagtggcgtcgtccaaaaactctacagcctgtatcaagcgatccgccccgtaaggttcacatcactttaa

SEQ ID NO: 71818 - DNA, 258 bp, Glycine max
  Peptide Sequence Number=SeqID_163503
atggtccatgacatcttggtcaaagtgaaactggaagtaacagggacatcaacagtcctaaatgtgtttggcagtcaacaaagtagcgatgtaactcgactcatcttttgccccaatttttgcaagacagttacttccatacttcaacttgacttaacgaaccttttcttaaaagcatggtcttggttcaaccccataatccaaggaaaagaaattttgactggcaatacttcgacaacatttcacagagatgaatga

SEQ ID NO: 71819 - DNA, 420 bp, Glycine max
  Peptide Sequence Number=SeqID_163504
atgagggatggcaagaggtcttcgtacgccattgggatcagggtgaattctggagttggcctcgggggaaagttccttatcgcgttggaaccggcgccaaagtgggcgttgccggccgagcgagtcagggttagagttggagcttggggggcctccctctggatgggcataggcgctctaggttgtacgggtgctgaacatgcggtggagggatctggcagcacaagtggcccctcccatggtcgaaagggaaatgattacgatgatggtagacaccttgccgagggaagttcgattatgtctcctccacaagtaccaacgctaggaggatcagagcaaccggggcaaaaaggaaagaaggagatttgtacgggtgctgaattggaagagtccccagcgcgagctgagaagctcgagtga

SEQ ID NO: 71820 - DNA, 165 bp, Glycine max
  Peptide Sequence Number=SeqID_163505
atggttgttcaaagaatcgtcttagaagggtactcttctaagatggttttagctaacaaccgtcttagaagacggttcttagctaagaatcgtcttagaaagtttcatggaaagttgccattccaaaaacaaggtaccagtacttgccaagtagctctttcttag

SEQ ID NO: 71821 - DNA, 342 bp, Glycine max
  Peptide Sequence Number=SeqID_163506
atggtgattgttgcagtggttggttcgttatcagaggtacaccagatgaacaaagatcaatggatgtatgacagtataatgtctgaagaagtcgataaggatgatcaaaatgaacaagaatgtggtgtgaatgaacaacatgttgattgttcggatgcgttcaatacttctcagataataatgttcattattgtgtttggtacccgagatgatgttttgcagtgggctcgatcagttgctcatgaaaatggatttgtggcggtgattatgagatctgacacaaacactgatagtagagaaaagatttcatttgtgttaagtggttgtgaaaggagtggttag

SEQ ID NO: 71822 - DNA, 1062 bp, Glycine max
  Peptide Sequence Number=SeqID_163507
atggagccctacaacaacgtcttctccaccctctcccttttggaacacaccgacttggctgttctcttggacaacgaagccatctatgacaataacggaggagaggaagcctctgtttcactctcaaatggaaacgttatcaaagtagccatatcagagctgttaccggccaatcctgatattttagagggtgttgaagatcttatacaactcagttatttgaatgagccctcagttctgcataatcttcagtctatatattctcatgatatgatttacagtaaatcagggccaactttaattgcactcaatccttttaaagatgttcaaatttatggagatgattatatttcagcttataggcagaaacttatggataggcctcatgtttatgctatggcagatgcagcatataatgagatgatgagagatgaagcgaatcagtccattatcataagtggtgagagtggatctgggaaaacagagacagcaaaaattgttatgcaatacttagctgctcttggtggtggctgttctggaatagaaaatgaagttctcttgacaaactttatactagaagcttttgggaatgcaaaaacatctaagaatgacaactctagcagatttgtgactgtaacaaatgctgctttggtaatgggttgcagttcccatgagctaatggaagcattatctacccataaaatccaagctggcaaggataccattaccaagacattgaccttgtggcaggcaattgatgcaagacatgcattagcaaaatttatctatgcaagcttgtttgattggcttatagaacaagttaataagtcacttgaagtgggtaaacgccgcactgggagatccataagtatccttgatatttatgggtttgagtcattccagaataacaactttgaacaattttgtataaactatgccaatgagaggcttcaacaaaatttcaattggcatctgtttaaacttgagcaggaggtgtcataccctaatttcgtccggggacctttgcttgatgacatgcgacctttgtttggtccttgtaag

SEQ ID NO: 71823 - DNA, 886 bp, Glycine max
  Peptide Sequence Number=SeqID_163508
atgctgagaatcaactacgaatggacaagagatgttcaactgagaaaagttgtcaccctaacaaggcgttatgagattttctccatgaaagaaggagaatctatggatgatacgtttggaagacttcaagtgcttctaaatggacttgaagctctgggacacatcttcctcaaagctcaaataaatctgaagattctagatgactttcttaagatgtggaattcgactcatggtgcttgggctgttatgctcataagtagaaaaaattgttccctaactatcagctatagcttttggcctagtgggaagattgtttgccaggttatggcatcaattgtcctatggtggaggtccaagtgggtcaagtcacagtcgactcgtgtcgtttatgctgttatgctcttaagtagaaagagttgtgccctaactatcagttatagcttttggcctagtggcttagaaaaactggcatcatcctccaagtcacagtctaatccagacaaatgtgacttttatggtaagtctggacattctaagttcagatccattcataagaagaagtatatgtctaagggtacaaattctactagacccaaaatgatttgggtaccaaaatctcatattgttcctatttcaaatatccttggtaggaaaaggctagggtttaagctggccatgtatgctactagaattttgttcaaggatttctcttatctgatgaagagtgcatttgaaataagcataataggagaactcaagttctttctagggcttcaggtcaagcaagatagcaaaggtgctaaaccaatgaaaacacctatgcatgcttccaaacacttgaacaaagccgaattaggtgagctagtagatcaaacgatctacaaag

SEQ ID NO: 71824 - DNA, 639 bp, Glycine max
  Peptide Sequence Number=SeqID_163509
atgaggaagaagcccctcagtgtcgaaggccaacaacatcggcacaatgtggatgatgttgctgacgagtttcatcaggagtctcacaatccaattacggatcatgtaggtgctgatacagagggtttttcaggtaggccccaagatacatcagtgttgacgaattatgcttatcgtgtggcaaccagagtttcagcaggagagaaacatactaagttgaagttgacctctcatgggaggaaggtagagaaatttggaaggcatgcacctgagattgaaggcatagtggctactacaggaataagttctcttattacatgttcgttggatacaagtggcaagacacttttatctgcttttgtggagaggtggcacaaggaaactagtagttttcatctactaataggagagctgactataaccctcgatgatgtggcatccttattacatctgccgattacaggtaccttccatacctttgatgctattgatgtagaggaagttgttgacttgttagttgagttgcttgaagtcagtacacaagaagcaaaagatgagactgagcaatgcagaagggcatatgtttgcctagcctggttgcgagacatttatcgtagcaaatgtgacacaagacagtag

SEQ ID NO: 71825 - DNA, 540 bp, Glycine max
  Peptide Sequence Number=SeqID_163510
atgattgcaccatggtctgtcagattttttttcatctcttttcccttcttcttaggttctttgcagcaagggcagaaccttgtgcttctaaaacaagggttggcttgttcaacatggaagagacagaaaaaccctagattggaaactgcaatatcttctattaattcctacatagacctcttcctccaagatgccattaagaaaggcattggtgacatcaagttgctgaattggccagtgataggtgacagccaaggagagaagaagttgcagaattataggcttgatagtaccaagaaaatgagtggggtgaagactgagatttgcttcctactttttgttgatgatgaagtgcgacttgaagatgattgggttcccatggatgaacaattaaatccggcagaacttgaggaggttattagatcaaaggaagcacattctagagcagttgtacttgagagtattggggatattcctgatgctgagattaagcctccagacaatgtattgtttgtctgtaaattgaacccagttactgag

SEQ ID NO: 71826 - DNA, 816 bp, Glycine max
  Peptide Sequence Number=SeqID_163511
atggtggtcccattcatagtggatgggtctttgcatgacgttgaaagggatatcgtagatgaggaagtggtgcccttgactatgaattttcaagaggaggaggaagagagtgaaggggagaataacattggtgaatacaaatgggtggacaaaggtgttgttgctctagtgactaatggtgcgagattgagagaattgagcagaaggaaggaaaaagtcattaccactaatgcaaaggaagggaataaaaagaggaaacatgatgactttgttgattgtgaggtgaattcaaagtctgagttgcacctggttcaaacacaattttccttccttgttatgaatggtgataatttttctggtgttggtgatttggctaagatggagaagaagaagatggtagcaactcaagtgaaaaagttgaatggtgaggtgtcaaggttgaaagaggaggttaaaaagtataaggaagaagttggttgtttttcaaataaactatctgtttataagaagcatgttgctagagttgaagaattggagcaatatttggttgagatacaggttaagttggagtcaaatattaaagctttcgagaagtatttagtgaaacaacttcatctcaaggggaaggaaaaaagcttacttgaagaagtagagaggtggaggtcagagtgcaacccaaaagatgttactgccattgatgatcatgcaaagggatttaataaggccttggcacatgttgttgccctttgtcctgatattgacctttcagatattacagtgaaattaaatttctatgctaaggatttctacacttga

SEQ ID NO: 71827 - DNA, 228 bp, Glycine max
  Peptide Sequence Number=SeqID_163512
atggttggagtattctcgcaaaacggagtgaccttgaatggtctccctatgatttcacccggtcaaagtgacctaacttaccagtatgtggtgaagaggtttttcactgacatgatggttaggtggatggctatggagaatctcatactagaggacattgggacaccatgctctgataagatgtggcatcgaggcttagggttttgtattgtttttatcatatgctag

SEQ ID NO: 71828 - DNA, 180 bp, Glycine max
  Peptide Sequence Number=SeqID_163513
atgggtatgagatggggcaatgatggacctaggcaaaataggatggaggggcagaacagaattgagggagtaaaactcaatgtacttcctttcaaaggtaggagtgacccagacgcctaccttgactgggagatgaagattgagcatgtattctcctacaatgattatattgaagagtag

SEQ ID NO: 71829 - DNA, 420 bp, Glycine max
  Peptide Sequence Number=SeqID_163514
atggactcaaaaatctaccctaaggttcatgagaaccctaaggccttctttatcagctctagcccaatcctcttggagcctcttgctcatggctctggtaactggtcctttcctagggaggattgcatcatctcacccaggctagcatctggctcgcttgggccatcaaataacttcatggttaagaaattagctcgcctgggcgagctgcaaccgccccaaagtggccttttgcctataaataggcatcctaggggtgttttaagggggtccaagtttcaaaagtggaaagtatcgagagaagagagaaataagaggaagaaagaagaagaaacgaagccgaggcgctatcgaatcgcgactgtggtcattccctacatcgttttcttgtcccgtgttctttgtgcaaccatcagttag

SEQ ID NO: 71830 - DNA, 228 bp, Glycine max
  Peptide Sequence Number=SeqID_163515
atggaggccatgaaaaaacaaatgaccaccaagatggaggccataataagtatgagaaaaatgatggaggtcaacgcgactgcagtcgctgccacaagtaccaccactgaggtggacccgactcacccatctggcctcaatcaagtaaatcgtccagtctcagatatggtaggtcaggcaggcaaaacattgggaagtacgggtggcccccattttgtgcaggtttag

SEQ ID NO: 71831 - DNA, 150 bp, Glycine max
  Peptide Sequence Number=SeqID_163516
atgggtggtgcactcaggaaacttcatccagaacattctagaaggggtcgaggtgcttccgtaacgctttcgagacgttttcgtgagcaaatccgtgaagattttccaccgttcttcaccgttctttgtccgttcttcggtcttcaaccg

SEQ ID NO: 71832 - DNA, 390 bp, Glycine max
  Peptide Sequence Number=SeqID_163517
atgatgatgatcccctttccaattcaaaagtttaacgagtgctacaaacaagcacgtaaacataggagaagtggaagttttgagaagaatgttttggctgatgctcatatgatttacagacaggattcaggtaaaaaatttgaggttgagcaagcttggttgttgttgaaagatcaaccaaaattcgatgcaaaatttatgtcaaagtattcaaaaagaacaaaggtttctatttctggaaattactcgtcatcttctaacccagagacacccattgaagtcaaagaatatgatacgtcatcgccaattctcacccaattggacaaaaagcagcaaaaaggaagagcaaaggaaatgaatcttcgaacactctcgatttatctaacatag

SEQ ID NO: 71833 - DNA, 927 bp, Glycine max
  Peptide Sequence Number=SeqID_163518
atggatgaagtggctgataggcaccatattatggggtgcttaagtctcacagcgagtaatatgggatgcttggtgaagtgcttaaagctggttgccaatgtcttggaaagagctacctgtgaagaggctgacctgaaaggaagacttaagcattgtagagtgcagccaccgggatgtaaactctcaaggcttcaagtcacaccactctcacaagagcgtggtaaccctactctacaaaaagttgcttggttctcctccttgtcacagctagcttttaagggagggtttcccaaggtgcctcaatcagtggtggataagttagtgaaaatacagcgcagattcctatggggaggtggttctgaccaaaagaaaattgcatggattaggtgggagacataccaaggtgaactttgggctagagtaatggagtccaaatatggtggatggaggggtttggaggaaggaggcagggcagccaatgagtcagtaggagctggggataggatcaaattctgggaggataggtggataagtcaggagatatcactagcagaaaaatatcctagactttacctcatctcatcacagcagcaccagcctatccgacaaatgggttctcacaaggataacggatgggagcccatacagcagcagggagatgatgaatgggagtggataggtcacccatcggcaactggaagtaaggaggactgttttgcggagatatggaaattaagaatccctagaaaaactgcagtatttgcgtggagactatttaaagatagactgccaacaaagaaaaatttgcacaggagacaagtgcagattatggatttgttatgtcctttttgtggtggatggcataagggtcaagagatggcaatgttggtgggtggctgtggcatggtccatttggcagatgcgtaa

SEQ ID NO: 71834 - DNA, 1662 bp, Glycine max
  Peptide Sequence Number=SeqID_163519
atggaagttggaggagtttggatgaaccaagaaggaatattagagagtctatctggtggggggttggttcaaaattgggacaaaggtgaagttttgggaagatggggtttcgttgctggagaaatattcgccaatggggagatagacatagctgcaaaatttatggagggcgtggcagtgcaagttcaacaagatagttggagttgggaggcggatccaagcgggagttacacagtggggagcaccttcaaactgctcagtagacatgtgacagatgaaaataaggatggagtgtttattgatctatggaagctaaaagtcccaagtaaagcatcacactttgcttgcaggttgatttgggataaattgccaacaaaggcccttgttgccagaaacgatggtgtttggagcaaagaccacgtttctgctttacggaagatttgtcctatggttagcaatgagattacgtctgaagcatctgctgcggaggttgagggatatggtgcttcaaaactgactgttgactcggctgtgaaatacttgcagcttgctaataagctcttctcgcaagctgagctttttcatttctgtgcaagcattctggaacttgtaatcccagtttacaaaagcaggagggcttatggacagttggctaaatgtcacacattacttactaatatctatgaatcaattcttgaacaggaatctagtccaattcctttcacaaatgcaacgtactacagggttggattttatggtgttagatttgggaaacttgataaaaaggagtatgtatatcgtgagcctcgtgatgtacgtctaggtgacataatggaaaaacttagtcacacatacgagtctagaatggatggtaatcacactttgcatattattccagattctagacaagtgaaggcagaggagttgcagcctggtgtctgttaccttcagattactgccgttgatccagtaatggaagatgaggatttaggaagtaggagagaaagaattttctctctctctactggaagcgtccgagcccgcgtatttgaccgattcttgtttgacaccccatttaccaaaaatggcaagactcaaggtggattggaagatcaatggaagagacgcactgttcttcggactgagggttcttttcctgcattagtaaataggttattggtaatcaaatccgagtcccttgagttctctcctgtagaaaatgcaatcggaatgattgaaacacgaaccgctgccttaagaaatgagcttgaagagcctcgaagttcagagggggatcaacttccaagactccagagtctacaaagaatcctacaaggcagtgttgcagtacaagtctgcccgtctgactggaaaactggtgaatcggttcagtgtcctttcaataaagtgaatagtggagtcttgagtgtctgcactgccttcttgtccggggagcctgcgaccaggttacgatcacaggaactgcagcaacttatagctgcccttcttgagttcatggctgtttgtaaacgtgccatccgtgtacatttcagattgattggtgaggaagatcaggatttccacacacaacttgtaaatggtttccagtcactgacagcagagttatcacattacattcctgccattctctcagagctatga

SEQ ID NO: 71835 - DNA, 672 bp, Glycine max
  Peptide Sequence Number=SeqID_163520
atggatcaaccaatcacactagaacaagtttccataggtgattgtgatcaatggcatctccagaattgtagaaatgtgcacttgactgagagagagaagcaaaaactgcaggtgtggtctaaaatcatgccttacaaagagtccttcacatggaccatcgtatcattatttgatagcagtattggtgcagcttcagtagggcctgcttccccaagcagccctcttgctccaagtatatctggttcaagttctcatgaaggtgtttttgatactagtgcaaaaatctctttagatggaaagctgagttactccaatggaaattctgtggtagtagaggtttcaaacttaaataaagtcaaagaaagctatactgaggaatcacttcaggatcctaaacgtaagatgcacaaacctatcaaaggtgttttgaggctggaaattgaaaagcaccagatttccctagctgatttggaaaatgtgtcagaaagtggtagtataaccaatgattctgttgaccctggggatcgaattgtggattcactgtctggaaagtatcctagtaatggttgtgatgatcctcagggtagcaacctcagggtagtatctccagttttgggaaatggagcaaatcaacatggaaattcagattttaatgccgatgatcaaaagtag

SEQ ID NO: 71836 - DNA, 141 bp, Glycine max
  Peptide Sequence Number=SeqID_163521
atgatgaaggcaatgacttttgagaacaggttcaacctattgacaccaaagaaggtagttgaagttgtggctactggagttgcaccttctcaggtggaggaaggggaagagggggaaaaggatgaggattgttggaagtag

SEQ ID NO: 71837 - DNA, 186 bp, Glycine max
  Peptide Sequence Number=SeqID_163522
atggctgcttggcaagaggctttgtcaacacatcagcaagttgaggataggcaggaacatgacacattaaacaagattgtgactcaaagcaacagtgctgagattatcacagtagacagctggggtggtaattttaatagagttctcttagtaaggattgaatccatagaagttctgatgcggtaa

SEQ ID NO: 71838 - DNA, 336 bp, Glycine max
  Peptide Sequence Number=SeqID_163523
atgttgagggggactccgcgtgccttcctcccttggaagatgcccccctcacccaggctagcatctggctcgtctgggccatcaaataacttcatggttaagaaattagcttgcatgggcgagctgcaaccgccccaaagtggccttttgcctataaataggtatcctaggggtgttttaagggggtccaaggttcagaagtggagagaatggagagaagagagaaataagaggaagaaaggagaagaaaaaaagtcgaggtgctatcgaatcgtgaccgtggtcattccctacatctttttcttgtcatgtgttcttcgtgcaatcgttagttag

SEQ ID NO: 71839 - DNA, 309 bp, Glycine max
  Peptide Sequence Number=SeqID_163524
atgtcaggactcatacgcgattctcctcaaattccagccagcccgcatcaattagactttgcacctaacgcttcagggtcatacaatgctcaatggaatgccccggggctcctccatgataagcacacattgcgttcgagtcgtatcctcagaaaaatggagtggtgtttagcattggttgtgtggaaagtgggttttgtggttgatttagggatggtctttgtggataactgggtggtaggtaaggagaagggttgttattggctaagtaatgacattgttgggttggtgggaaacttggccatatag

SEQ ID NO: 71840 - DNA, 297 bp, Glycine max
  Peptide Sequence Number=SeqID_163525
atgacacaaatcaacaagcttttcaataagggattgtctgatatctctagcatcacaatgaagaaaattcttgagacctataatggctttgagggtgttggatctgtggttgatgttggcggtgggactggagctattattaatatggtggcctctaagtatcccaccacaaagtgtgttaattttgacttaccccacgtcatcaaagaagctccagcttatacagtccggaggccaattaagggtgcaggaagcaacgaccttgaacccatcgttttaaaaattggaaaaggttga

SEQ ID NO: 71841 - DNA, 600 bp, Glycine max
  Peptide Sequence Number=SeqID_163526
atgcgccctttatcatttaggaacaacaaggtgggtggtaaatgtgcaaagacagattttgtgccctttatcattcaagaacagcaacctgagttggtaaacgcgcagagacatattctgcaccctttatcattcaggaacaacaagttgggtggtaaatgcgcggagacaaattatgctcattccttgcaccttttcgccatccagaggcgatcgtgtccgatggcacgcagagacaaattatggtcattctgtgtctcaccgcccaggctcaatcgtgtccaacaaaacgcagagacgaattatggtcattctgcgtcttgtattaaccaagaggaacatacatcaagacgatttatgtcttgttcttatgttgttgctcctcgtaagcatgctcaccatgagtatagcaactgcatacatcacgtgtatatgttggaaagtgtctccaacatatacagaggattatttggggaattgcataatgaagtgtattggtcaccatatcacgagccaaggatcagccctgacccagagaagaaaagaaattctaaaggtcatcctatctcctcttgtatactcactaaaatggatatataa

SEQ ID NO: 71842 - DNA, 472 bp, Glycine max
  Peptide Sequence Number=SeqID_163527
cttcgtctggccgtttctgcgcgagccgtttatctgcgcggtgctggcgctgtcgctgtgtaccgccgcttacaccgctgagatcctgcgcggtgcgctgctggcggtgccggcaggtcaggtcgaagccgggctggcctgcggcatgtcacgctggctgctgctgcgccgcatcatcgcgccgatcatgctgcgctatgcgctgccggcgtactccaccgaggcgattctgctggtgaagtccaccgcgctcgccagcctggtcacggtgtgggatgtcaccggcgtggcgcagcagatcatccagcgtacctatcgcactatggaagtgtttgtctgcgctgcggcgatctacctaattctcaactttattatcgtccagctgtacgcgctgttagagcgccgtctgaccccggtgcaccgcgctgaaaaaaagccgctgcccgccgttaaaccgcttgccggagagtaa

SEQ ID NO: 71843 - DNA, 1098 bp, Glycine max
  Peptide Sequence Number=SeqID_163528
gtagtcctgatagtgacgcgcttcggatcgcagcagcgagacgtaaaagcgattcagctcgtcgtccaggtgcggcgccagtttggcgaagcgttcacaggatcgcgcttcgatgtaggcgccgcagatcagtttgtcgatcagcgtcgccggatcgtgggtgcggatctcgcggatcatacccttggcgtagcggctggcggtgatcttgcgatacgggatcccgcgcgcctgcatgatctccagcacctgcgagaagtgatgcaactcttccttgatcaacagcaccatgcgatccgccagatcctggccgtaggccgagccgtttttcggcaggatcttgcgggtgaactggccctggcggaacagcgtgtccggcgcgccctgcgcttcgtgcagaaacgcctcgtagggccgcagcagcgccaacagcgcgtcgccgctctctttgtccgccacgtagcggcggatcagccacatgccggtctgcgcggccttcagctcgcacaccaggtggcgtcaggagtttcacagtgcaggaagcttaaaatcggggctaacagggattggtatgtcatcggcttaattgccctattgcagccaacaacgctgcagcttgaaagacgacggggatatcaggggccggcgagaaccggcccacaggtattgattggagagggattagtggcgtttgccgtcgtcgtcttcgtcgatgtagtcgccgtcttcgtcatcctcaccgtcttcaccgttcggatcttcgaagtaggtgccccagccatcgtagttgacgccgcagcgttccgccagcgccaccaactgctcgacctgagcgtcgatcagttcggcgttcaggccgacttcgctgatcacgtcgcagcacatcaccatcgaaccgtcttccacttccagctcttcggcgtcggtcacttcgtagcccagcttgaaggcttcaacggcggcctgctccagaacctcaaatttctcggcggacagatggtgctcgatggtgtagagcgcgtccggatcgctgccgtcttccagcagttcttcgatgatcaggcgggtctcttcacgttgttcttccagcaattcgcg

SEQ ID NO: 71844 - DNA, 492 bp, Glycine max
  Peptide Sequence Number=SeqID_163529
atgggaaaacacgaaaagactttgtgttccttaataaatgagaagccactcttggagaaactacttattgaaacagctgatgtgagtgaagtaattgacttgtacattacgtcacctatgtctacacttaggaagcttgtcctatttgggaagttaacaaggttgccaaattggatttcacagttcccaaatcttgtgcaactgcatctgtacaactccaggttgactaatgatgtattgaaatcactaaacaagatgccaaggttgttgttcctcgatttaagtagcaatgcttatgaagtaccctctggaattcaacacttggagaagcttaaagatctctatatcgaggacatgccaactgaatttgagcagcgcattgctcctgatggaggagaagaccactggatcatccaagatgtgccccatgtacgtatttggagtgaggatgctgaagaacctttgcatatattcggcagaagtcatcactaa

SEQ ID NO: 71845 - DNA, 246 bp, Glycine max
  Peptide Sequence Number=SeqID_163530
atggattggatattgagtgcaggttgttcctggtttgatggagttttggaggatgatggagatgatggtacagagggtgaaacaggggatgaggtttcttttggtgaggtagccatggagaagcagagctttgggcgtggtgttgaggaaaaaagcccagcgtttcaagaacctcgggatttgaggtcaaatccttttcaagggggagggaatgatgcaatcctaccccgcaagggcattggatag

SEQ ID NO: 71846 - DNA, 231 bp, Glycine max
  Peptide Sequence Number=SeqID_163531
atgccttttgggctaactaatgcaccaagcacctccatgaggctaatgaatcatgtcctaagggagttcatgggtaggccttggatcttcttcatcaatggattcatttgcttcttgaggtctgattgcagcggaatggagaaggagaaatatgaatggagacgccacttcaacccactaatccaagatcaagtccaagattctccactaagtgtgcttaggtgtcatgag

SEQ ID NO: 71847 - DNA, 384 bp, Glycine max
  Peptide Sequence Number=SeqID_163532
aggactacacgtctcaccttcagaggactacacgtcctcaccttcagaggactgcacgtcctcgccatcagagggctgcacgccctcaccttcagaggactacacgtcctcgccatcagaggactacacgccctcgccttaagaaggctgcacgccctcgccttcagaggactacacgtcctcgccgtcagaggactatacgtcctcacctttagaggactacacgtcctcaccttcagagggcttcacgccctcgccttcagaggactacacgtcctccacattagaggactacacgtcctcgccttcggagggctgcacactccctcgcctttaaagggctacgcatcctcgcttccagagggctccacatctgcaccttaa

SEQ ID NO: 71848 - DNA, 537 bp, Glycine max
  Peptide Sequence Number=SeqID_163533
atgacttggttgattggtactcttgttaatcctttatctgagtcaagtccttatgatcaatatgaagaaagaggaactcctaatcttgaaagtgtgtttgaagaattcatggcatataatgctagctctaaagaaaatcaaaatgtaatgaacagtcaagaaattgatgtggccaagagctactcaatagaaaagtctcaaaggacacctgtgttagaactctacactcaaggtgaagcagaaagagaaattttggttggtaagctggcagaagaagtgactcaatgtgtggccagaatagaagaagaccttgtagagattgaagctcaagaggaaatcccttccaaagagcatggattaagaggaaaagatgaaatgaaaggtgaggaaaaagcacaacaatgggaagagtacttacaacaagatattcaacaagaaattaaaatttttgcaattgtctatccgctaagtgcaaaccttgcgctaagcgctcagtcttcacacgctaaaccgagcttgctcgcgctaagcacatag

SEQ ID NO: 71849 - DNA, 218 bp, Glycine max
  Peptide Sequence Number=SeqID_163534
atgggatcgaatcaagcaccttcttttaagaaaaggttttataacgtcaaaatcaaaagcctagaagttgccaatttgcaagagttagggcaatggatggatcaactccaacatcaagctttccataagacatatggaaagatctgggatttggcaatgatagaagtgtctgttgaagccattgcatccctcgttcaatattatgaccaatcgctaag

SEQ ID NO: 71850 - DNA, 183 bp, Glycine max
  Peptide Sequence Number=SeqID_163535
atgccaaaagatagggggacttgtcttgatttcagggattgtcatcatcaaaaagggggagattgtagacaaaggatcaagctgaatgttttgatgatgccaaaggttcacatgcgtctcaaagctttattcaagacaaagaaattaaagatattcaagatggatgatcaagacagtctctag

SEQ ID NO: 71851 - DNA, 336 bp, Glycine max
  Peptide Sequence Number=SeqID_163536
gtaccacagcaagtagaggatgcctcatctgaggccactataccagagccattcattgtaaaggaggagactagtgagacacgggttagacaggaagctactgctactcttgagaggtcacgagaggtcacatcaaatccacccacatcagtggtggacttatcctcacctcagcatgcaacagacccctctactcctatactcgagataccagaggacccaaccacaccagtcctgactctgaacacttcttctccagctactctagtacttcatctaacagatgaggaggatgttaagacacaggacactcaggaccagtcacaggaattctaa

SEQ ID NO: 71852 - DNA, 380 bp, Glycine max
  Peptide Sequence Number=SeqID_163537
agtttgacaagttcaaggaggaactcgagaggagacattgggatgagaagctgactgatttttttgacagtatcatagacattgctattggaaaggagttttatgcgaacctctatgaccctgaggataaaccacctaagcaggtgaaggtgaggggtcatttagtgaagtttgatgaggataccttgaacacattcttgaagacccctgtagtgctggaagagggggagaacttgtgtacttattccagatttgcactcctgaggcctgatcctcaggagttggctgctaagctttgtatcccaaggaggggatttgagcttaatgctgatgggcagcctttgaagattttgaggaagaacatgaccactctagcttag

SEQ ID NO: 71853 - DNA, 417 bp, Glycine max
  Peptide Sequence Number=SeqID_163538
aacacgctttacggtgcccttaccgaacctgtgctagagctagagtaatgggtaaagtcgaggaggcgcaagagcagatgaaggccgacatggaggccatgaaagagcaaatggccacaatgatggaggccatgatgagcatgaagaagataatggaagccaatgcggttacaattgccgctaccagcgctattgctaaggagaacccgatgccctcatctggccttaaccaaatgaatcatccaacctcagatatggtaggcaaagatttgggaacccctcctgctatggctgaaaagggaaagttggatcatatagaggaaaggctcaaggacattgaaggaggcgaagattatgcctttgctaacctaaaagagttgttcctagtacccgaacatggttattcccaagttcaag

SEQ ID NO: 71854 - DNA, 737 bp, Glycine max
  Peptide Sequence Number=SeqID_163539
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaaatagtactgaaaaggaatgcgacgtgtgggcgcatccaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71855 - DNA, 318 bp, Glycine max
  Peptide Sequence Number=SeqID_163540
ggtggacccttgggtactagtgccctcaccttcagaggactacacgttctcacctttagaaggttgcacgtccttgcctttagaaggctgcacaccctctcctttagtgggctggacgccctcacgttcaaaggtttccttttatcagttcttgggccaccccctgatattggagggcgaccaactgtgcgagcacatccagagagggaggttatcatgcagctactatgcataccggggcaagatttcacccgtaccgctgcaaagagacgagtgcggatcatgcacaccaacatgaccactcttacacagatatag

SEQ ID NO: 71856 - DNA, 1110 bp, Glycine max
  Peptide Sequence Number=SeqID_163541
atggcgtctgcgttacgttaccgctactccacgcgcggcttttatagcctgcaggaggcgctggagagctatggcggcaacagcgccgtctatagcgatcacaagaagagccgcgccgagctgacgatgagccaaagcctgtgggagcggggaggaacgctgtcgctcagcctgtttaacgaagactactgggataacaatcgccgttcgcagtctgtcagcctcagctacaacaacagctgggaagcggtcagttacgggctgaattacacgttcaaccagaacggttatgacagtaacggcaatcgcagcagtattcgtgaccatatcgtggctttcaacgtcagcgtaccgctcagcaaatggctgccgggcagctacgccacctacagtatgaacgccagtcgcaatggtgccaccagcaacaaccttgggttgagcggtacggcgttgccgggaaacaacctgaactacagcatcagccagggctataccggcagggatgtgggggcgaacggcaatattcaggcggattataaaggctctctcgccgagttgaacctggggtacggctacgatcgccatcgccggcaggtgaactacggcgtgcagggcggcgttctggtgcaccaaaacggcatcacgctttcccaaccgctgggcgatacggtggcgttggtgcaagcgcctggtgcttcaggggtgaatgtcctgaaccagaccggagtcagcaccgactggcgcggctatgcggttgtgccttacctgacgccttaccggcgcaacatcgtcggattggacggtgaatctttcgcagaggacgtcgacatgacgctgagtagccaaacggtgatcccaactcgcggcgccgtggtgcgcgcccgctttaatccggacgtcggtgcccgtgtgttgctgaccttgctgacgcgcagcggcgctccggtgccgtcggcgccaccgtcagcactctcaacagcccctctgacaatgcagccatcgtcggggaaggcggccaggtttatctggctggcctgggggatagcgggaggttgcgggttaagtggggcaaggacgcggctcagcaatgtcaggccaactatcaattgg

SEQ ID NO: 71857 - DNA, 486 bp, Glycine max
  Peptide Sequence Number=SeqID_163542
atgaggggttgcattaattataaccttgtgttggccataagacagttagggtatcctatgaaaggtggttatcacaaatggctgaaatatagagtgcaatggattgcttggctcaaaaagctagaggatctgaatggaaaagaggcagaggtgtccgaggaaagtgaagaggtgcgagtcttgaaggctgagttggaaaagacaaaagtggcgaaggagaagctgaaggtggtagtcactagagtcaaaaaagaatgtgataggatgaaggatatcaacatgtccacggctaaagcgctagagcaggaaatgaagaaagccaaaaaggaagagttgagtagaaaaaggttccaaggggctttgttacgcagtagtaatgagctcaagcttagaaaggctgagagtgaaaaatcaatgatgaagaatgtaatgttaaaggatgagctaaggaattgtcgggagtcaaaggaaagcttgaaagagtag

SEQ ID NO: 71858 - DNA, 555 bp, Glycine max
  Peptide Sequence Number=SeqID_163543
atgacggtgtaccatttgagggtacacttgatgatgagtagaagtttgatttttttatttctgatgcccgccggatggtttgcaccaaccaagcggatacaaccggaaggcttcttgccggcccatcttgtgagatatcacatacataaggcattgcgatcaaatgctctactcccatatccccatctgatcaccttgtttttacaacattttaatatccctcttgactctgagccctttgtcaaagtcaagagatccttctctatcggtgcgaatgtagtctcctctttcagataccacaaagagagggatgggtcttgggtgaagaaagacgctccagtacaggctgtagaagaccgctctccatcaccacctcctcagagaaatgattcttcatctcttatgcacaacatacttgacaggttggatggacttcacactttcgtcggagagcgctttgactcattggatagccgtattgatgccatggatgcacgatttgcagggattgacacatgtatcaccaaacttaaggaagatgttagttatgtttga

SEQ ID NO: 71859 - DNA, 618 bp, Glycine max
  Peptide Sequence Number=SeqID_163544
atgacccgcaccaagaaaacaggggagatgatgactgaggccacaaaggaaatcactgagaagatccactatggacgtgtccatgctgctggagtcggtgtcaccatcaagcaatacttcggatcggctccacggacgtcccacagctcttccttgctacctcctgaagaattgcagcagctgacccagcaaatcagggaccagctagaggagtcgatcacaaaaaaaccaaatgcaatctcagtttcagtcctagatgtaatctcaggacttgcactgcctccggagcatctggttggtccctcaggtcctcgagtaagcacaaaggagagttgtgttgatcccttaggaaatgatcctgagacgggtgactcagataggtgcaacttgtacattgaagcaaatcctgcccgcccggttgccttggggagagtttatgagggattaactgttgttcataacactcttttgttgccaggccatgtaaaggtgggtgtggaggaggttaaagatccagatgctccagttcctatacccagtgaggaggtttccttagtggggcaggcaattcacaccttccttggttggccgacacatctggtcaagtttttatcatag

SEQ ID NO: 71860 - DNA, 426 bp, Glycine max
  Peptide Sequence Number=SeqID_163545
atggaaacgcatagatttataagcaagtttgattcagcaaaagccagaagcaatagaaagcatattagacaacaaaagcttcatcccatactgaagatcattataaccaaccaaagacgccaccacatagtgtccatgcaactgtcaatcaggcttcagacgatgctgaagatcatttcatcctttttctgctttgaggttaatgtctccggttcatcagacaatgagagttctggatcaacacaagaatatcagactctttcttcagttggatatgcaaactgtgaatcatcacatcatgattctacaatggacacaggagaatattttgatcttggtgaccagcttatgcaatgtagacattgtaatgcaaaaatgtggtataatgaaagcatattaaaacgttcaaatacctcaagcccatga

SEQ ID NO: 71861 - DNA, 1433 bp, Glycine max
  Peptide Sequence Number=SeqID_163546
atgaggcgccagcagctacacttcgcggcagttgtcgcggcgattgtcgtcaccgcttgggttgcgcacatgcgcggcggggttggccaatcggaggccaagggttggcagttcgaggccgttccgattgacggcgccgtcggaccggagagcttctccttcgatcctcgcggcgaaggcccttacaccggcgtttctgacggtagaatcatcaaatggcaccaaacgcagaatcgttggctcaacttttccgctattgcttcttcttcacactgggatgaagagtgtggaggaccatgtgatgagcattccaagaaagagcacgtgtgtgggcgtccactaggcttgtgctttagtacactatcgaatgatctttacattgctgattcttacaagggcttagttgttgttggtccccatggtggcactactagaagactcgtatcaacaatagaaggtgaacccttggcttttactaacggtttggatgttgaccaacgaactggagcagtgtacttcaccagtagtagttcaaaatatccgaggaggaattacatgtcgttgatcctaagcagagataagacggggatgctaatgaaatatgagccacaaagtgaacaagttagcgttctcctaaagaatctctcctatgcaaatggagtagcattaagcaaagatggtgaatatatcctaataattgagaccacaacttgtagagtattaaggtattggctagaaacaccaaaaactggaaccttggaagtctttgctgatctaccaggtttcccagacaacatcaaacggagtccaagaggaggattttgggtgggaatttactcaagaagagaaaaaattatccaatggattctatcatatccttggattggaaaagttttgcttaggcttcctttggacatcccaaaagcttattcatatttggctaagctaaaaaggagtaatggaatggcaattagactaagtgagcagggtgatatattagaaattgttaacgaaaaaaatgggagcatagggaggtctattagtgaagtggaggaaagagatgggatattatgggtgggatccatagatgcaccttttgttggacttagcggtggcatccgagtcagcgatggaagccgctgcaaaaagacagagatgaaggtcgcacgatggtttgggtcgtgtggtgatctgggtggtagtggtgtttgggtcttggctgcacaaagttctagtggtgcatcgggtgaaagttgtttgggtgatggattggtgcaaggagggaaaagaaaggagaaaggagagggaggaggcgacaaagaattcgtacatggaggaggggcgagcggagaactcatcgaggaagggggaggaggtgaggaagccaatgatggtgtcaacggtgtatttcacacccgtttggacatcgacgt

SEQ ID NO: 71862 - DNA, 1410 bp, Glycine max
  Peptide Sequence Number=SeqID_163547
atgtcatcttcacgatccagagtgctgcgtctagtgccattgccatggggttatgtggcttcagggaagagggtgatgaaggaaacccatccaagaacagaagaggggattctggaagtgggaaccgcggttgtgagcacaactactgcaaccaggtgtgagtgcttggggtttaacaagtcagaaaatttcagtaccaagagagagttgtgtgctgaggggttcaagctgaattgcttggttgaaaatagagagatggatgtggagtcatcatcatcatcatctttggtggatgatgcttccttgagcttaagtgaagaggatttaggggagcctagtatttcaacattggtgatgaatttcgagagtaagttcgatccttttggagcaattagtacccctctttaccaaacggctacttttaagcagccttctgcaatagaaaacggcccctatgactataccagaagtggaaatcctacacgagatgctttagaaagtttactagcaaagcttgataaagcagatagagccctgtgcttcaccagtggaatggctgctttgagtgctgttgttcgtcttgttggaactggcgaggaaattgtcgccggagatgatgtatatggtggctcagataggttgctgtctcaagtggttccaaggactggaattgtggtgaagcgggcaaatacatgtgatctaaatgaggttgcagcagccattggacccaagactaagcttgtgtggcttgagagtccaaccaatcctcggctacaaatttctgatattcaaaaaatatcagagatagctcattcacatggtgctcttgtgttagtggacaatagtataatgtcacctgtgttgtctcggccattggaacttggagcagatattgtcatgcactctgctacaaaatttattgctggacatagtgacattatggctggtgtgcttgctgtgaagggtgaaaagggagggaaaccagaaaggccattggaggaattgattaaaagggatctcatggataatgcacagaagattgctgagttccttgcctcccatcctcgagtgaagaaagtgaattatgctggcttgcctggtcatcctggtcgtgatttacactattctcaggcaaagggtgcaggatctgtgcttagcttcttgactggttcattggaactttcaaagcatattgttgaaactaccaaatacttcagtataaccgtcagctttgggagtgtgaagtcccttattagcatgccatgctttatgtcacatgcaagcatacctgctgcagttcgtgaggccagaggtttaactgaagatcttgtacgtatatctgtgggaattgaggatgtgaatgatctcattgctgatcttgacaatgcacttagaacagggcctctttaa

SEQ ID NO: 71863 - DNA, 423 bp, Glycine max
  Peptide Sequence Number=SeqID_163548
atgcctaatacacctgctgctgtaggcgaggcagcatcagaagaagatggaaatattatagccaaattgttagggtcaattggcaaaatatggaaagctgaggaaaagtattttgatgctataactggcctgagtggcagtggtcctgcttatgtttatttagcaatagaggctttggctgatggaggagtagcagctggtttaccacgtgatctttcattaagtctagcttctcaaactgtattaggagcagcatcaatggtcatccagactgggaaacacccaggacagctcaaagatgacgttacttctccgggtgggacaacaattacgggcattcatgagttagaaaatggcgggttccgtgggacactgatgaatgctgttgttgctgctactaagcgcagcagagagctttcctga

SEQ ID NO: 71864 - DNA, 5085 bp, Glycine max
  Peptide Sequence Number=SeqID_163549
tcacttgttgcacaggttgcaaacttggaggacatattatcagagagaggagcctgtggggttggattcattgccaatttggagaataagggatcacatgagattgtcaaggatgctttaaatgctttaagttgtatggaacatcgtggtggctgtggagcagataatgactctggcgatggttcagggctgatgactggagttccatgggaactatttgacaattgggccaacacgcaagggattgcttcctttgataagtcgcacactggtgttggaatggttttcttacccaaagatgcacaatttctcaatgaggcgaagaaaggtcttgaggttcttggttggaggcctgttcctgtaaatacttctgtagtaggttactatgcaaaggagaccatgcccaatatacagcaggtatttgttaagattgtgaaagaagaaaacgttgatgacattgaacgagaactgtacagcacaaatactagtcccagatggcctcttgcacaaccgatgaggcttcttggtcataatggagagatcaacaccatacagggtaacttgaattggatgcaatcacgagaaccgtcattgaagtcacctgtatggcgaggtcgtgaaaatgaaattcgtccatttggaaatccaaaggcatcagactcagcaaatcttgacagtgctgcagaattattgataagaagtggtcgaagtcctgaggaagctatgatgattcttgttccagaggcttataaaaatcatccaactctgtcaatcaaatatcctgaggtggttgatttctatgactattacaagggtcagatggaagcttgggatggaccagccttgcttttgttcagtgactttaagaatttaagaagtagcactctagtcaggaaagggtggttcttagaaactgacagtgatgggaaaactgttggtgcatgccttgatcgtaatggacttcgacctgctaggtattggcgaacatcagacaatatggtctatgttgcctctgaggtgggtgttgtgccagtggatgagtcaaaggttgtcttgaaaggccgtttaggtccaggcatgatgataacggttgatttacctggcggtcaggtctatgagaatacagaggttaaaaaacgagtagccttatcaagcccatatgggaactggatcaaggaaaatttgcggtctttgaagcctgggaacttcctttcagcctctgtgttggacaatgaggcattgatgtgggactacacttccactcttgaggctgcaattaaggcagccctgaagaggccgcatccaagacgggctagggtcttggtgatggatctaagagttgagaatagatttgggaggaaaagtcaagataggatttcaaggaccaattggtgtcaaataaagggtgaaaaacagtggagcctttatcaaagttatggagaaatagcatggggaggcaataggaagtgcaaatggtatctgggacaagatggacaaagggatttaggaagatggctaaagaaactcttggtgaatcaaaaggttgatgacctgtgggtaaagaatcttggtggtgaaagataccaaaaaggctttgagcaagagcttttgatgggttataccaatcctttggcaccaaaggtgccaagagagatattgtcgaaggcccgaaagaagaaagcagtttgtattgcatatattcaagcaatcaacgatatgtttgagagggtcacaactggaatgggagtacaagataggatcacaacagggcccatcgtacagaacaatgaagaaatagagggagatttaaaacttaggattcaagagggatggatcatgggtggaacggaggagtgctttggggcatttgggtactctagtgaagatgtccagatggtgatcgagagtatggctgctcaaggaaaggagcccacgttttgcatgggagatgatattccattggcagcattgtctcagaaacctcacatgctttttgattatttcaagcaacgtgcaaagttacttatctcattacatctggatcatgttacaaatcctgcaattgatcctcttcgagaaggattggttatgtctcttgaagtgaatattgggaagagaaggaatatattggaaactgggccagagaatgcttcacaggttatgttatctagtccagtattgaatgaaggggagcttgagtcattactaaaagactcatacttgaaaccacaagtattacctacattttttgatataagtaagggcattgaaggttccttggagaaagcattaaataagctttgtgaggctgcagatgaagctgtcagaaatggttcccagctgcttattctatcagaccattcagaagcactggaaccaactcatcctgcaattcccatactccttgctgttggtactgttcatcagcatctaatccagaatggcctgcgaatgtcagcttcaattgtagcagatactgctcagtgctttagcactcaccagtttgcctgtttaataggatatggtgcaagtgctgtgtgtccgtacttggcattggagacatgtcggcaatggcgtttgagtaataaaactgtaaatctgatgaggaatggaaagatgcctactgtatcgattgaacaggcacagaagaactattgcaaggctgtaaaagcaggtcttcttaaaattctttccaaaatgggcatctcattgctatcaagttactgtggtgcacaaatatttgaagtctatggattagggaaggaagttgttgatcttgcattcagaggaagtgtgtcgaaaattggtggattaacttttgatgaggtggcaagagagactttgtctttctgggtgaaggcattctctgaagatacagctaaaaggttggaaaattttggatttatacagttcagaccaggaggggagtatcatgcaaataacccagaaatgtcaaagttgctccacaaagctgttcgtcagaaaagtcaaagtgccttttctgtttatcagcaatatttggctaatcgacctgtgaatgttctccgtgatcttcttgaattcaaaagtgatcgtgctccaatacctgtggggaaggttgaacctgcttcatctattgtgcaacggttttgcacagggggcatgtcacttggagctatttccagagaaactcatgaagcaattgcaattgccatgaacagaataggtggaaaatcaaattcaggggaaggtggggaggatcctgttcgctggaaaccacttacagatgtcgtagatggttactctccaactcttcctcatcttaaaggtcttcaaaatggggatactgcaactagtgccatcaagcaggttgcttctggaaggtttggtgtcaccccaacattcttggcaaatgctgatcagttagaaatcaagattgcacaaggtgcaaaacctggtgaaggtggacaattgcctggaaaaaaagttagcatgtatattgctaggttgagaaattctaaaccaggagttcctcttatatctccacctcctcatcatgacatttattctatcgaggaccttgctcagttgatctttgatcttcatcaggtgaaccctaaggccaaggtgtctgtaaaactggtggctgaagctggaattggcactgttgcatctggggttgcaaagggcaatgctgacattatacagatttcaggacatgatgggggaacaggagcaagccctataagttccatcaagcatgcaggaggtccttgggaacttgggcttacagaatctcaccagacactcattgaaaatggacttagagaaagggttattctcagagttgatggtgggtttagaagtggagtagatgtcatgatggcagcaataatgggtgctgatgaatatgggtttggttcagtggcaatgattgctactggatgtgttatggcccgcatttgccacaccaataattgcccagttggtgttgccagtcagagggaagagttgcgtgcacgctttcctggtgttcctggggaccttgtcaactactttttgtatgtagctgaggaggtaagaggcatattggcacagctggggtatgagaagttggatgatgtgattggccggactgacttgtttcaaccacgagacatatctctagcaaaaactcagcatctagatctgaattatatcctctctaatgttgggttgcctaaatggagcagtaccgaaattaggaatcaggagcctcataccaatggtcctgttctggatgatgttttgctagcagacccagaggttgccgatgccattgaaaatgaaaaggtggttaataagaccataaaaatatacaacattgatcgtgctgtatgtggacgtatagctggtgtcattgcaaagaagtacggtgacactggttttgctggacagttgaatataacatttacaggaagtgctgggcagtcatttgcatgctttctgactcctggaatgaacattcgccttgttggagaggctaatgattatgttgggaagggcattgctggaggtgagttggttatcactccagtcgacaagaccgggtttgaacctgaggatgcagctattgtagggaacacttgcttgtatggtgcaactggtggacaggtcttcgttagagggagagctggtgaaagatttgctgtcagaaactcacttgctgaagcagtggtggaaggcgcaggagatcattgttgtgagtacatgactggtggctgtgtggttgtcttgggaaaagtgggtagaaatgtagctgctggtatgactggagggttggcttacattcttgatgaggacgatactttcatacccaaggtaaacagagaaattgtaaaaatccaacgggtgtcagcccctgttggacagatgcaactgaagagcctgattgaagctcacgttgaaaaaaccggtagtaccaaaggtgcggctattctgaaggactgggataagtatttatcactattttggcagctggttccacctagtgaagaagatacccccgaggcaaatgccaaatatgacacaactacggcagatcaggtcacttatcagtctgcttag

SEQ ID NO: 71865 - DNA, 2328 bp, Glycine max
  Peptide Sequence Number=SeqID_163550
atgattggaaaagatagtggtgttatgaaggcatgggaggcaacgatgagaaagacacatgcagttgcaaagaagcgtgcaaacagcatatttgggacgatatctttggcacatgttgtggatgaagaagaaaataacaacaatgatgattatgatgatgataacgaagagaatgggaaaaatgagacatttgatgtatacattgaagagaaggttctaccaaatggggattactacacaggggaatgggcaaataacttccctcatgggctggggaaatacctgtggacagacgggtgcatgtatgttggagaatggttcaaagggaaaaccaaaggaaaaggtaggtttagttggccttcaggagcaacatatgaaggtgacttcaagagtggtttcatggatgggaatggaacatacacagggtgtaatggagagacttataagggacaatgggtgatgaacttgaaacatggtcatggtttcaagagttatgcaaatggggattggtatgatggggagtggaggaaggatttgcaagatggggagggaaggtatgtgtggaaggatgagagccattatgttggggaatggaggaatgggactatttggggcaaagggtcatttgtttgggctgaaaatgggaaagtgtttgaagggttttgggaagatggtttgccaaaagggaaaggcactttcaagtggcctaatgggagtttttatgagggaaattttagtaaagatggtaaggatcaaaatggtacataccacaattcatgcgagtcatcatcagatggtgaagaagggcatagtgaattatgggatcctcaagagttgtatagtgagttgaatggttattcagtttgccctggggagaaggttcaggtgatgccatcacacaagaggcttgcggtttggaggtctacaaagacaggggagagtgctaagaacaggagaatatcgttagatggaagggtgagcattggcttggagaagccaagtgataggttgcaaatatgggatggtggggagagtgatgctagtggtgctaaaactcctactatggggagtgatttggatgaagatttgatgggtttgcgtgtggatgatggtggtgaaagtttgggtcaactccaacctattaaagcaccaaagaaatcaaagaggcagggagagaccatatgcaaaggacacaaaaattatgagctcatgctcaatttgcagctgggaatcaggcattctgttgcaaggccagctccaacagcatcacttgatctcaagccttcagcttttgaccctaaggagaaagtgtggacaagatttccacccgaaggatccaaatacactccaccacatccatcgtgtgactttaaatggaaggactattgccctgtagtttttagaacactaaggaagctattcaaggtggatccagctgattacatgttatccatatgtggaaatgaggcccttcgcgaactttcctctccaggaaaaagtggtagcttcttttacttgaccaatgacgaccgttacatgattaaaacaatgaagaaagctgaagtgaaagttctattgagaatgcttccatcttattacaataattttcgagaccaccaaaatactcttttgacaaagtattatggcctgcattgtgtaaagttaaatggacctattcagaagaaggttcgatttatcattatgggcaacctcttttgttctgagtatatcacccatagacgctacgatttgaagggttcctcacttggacgcttctcagataagcctgagacagatattagtgaaaccacaatccttaaagatcttgatcttaattttatatttcgactggagaagtcccggttcgaagaattttgcagacaagttgataaggattgtgagcttctagaacaggagggaattatggactatagtttgctattgggcatttatttcaaagatatatcaccagatggggaaattattcctttacaatctcggactcctgttggtgattccgaaaatgaagcaaatccccatacttcatgtgaagacacagaccaacctccttctgatccttccagtatcatattgggcatgaatatgccagcaaaggttgaaagaacagtgagaagaagtggttgtgaattacaacttgtaggagaaccaattggagaattctacaatgactatgacattagcaagaagcttgagcatgcctacaaatccattcaatatgacccgacttcaatatcagccgttgatcctatacaatattcaaggcgttttcgtgatttcatatttagaatatttactgaagactcttga

SEQ ID NO: 71866 - DNA, 330 bp, Glycine max
  Peptide Sequence Number=SeqID_163551
atggtagtcttggaggtatgtgggtgcatgtttggctcatgtagagcgtcgagatgtggtttcaatagaagggacgaagtgttcatggttactggagaatggtgttggggaaggagaactaggagatacacatggataatccctagggtcaagcttatgtctatgtgtattaagggtgttaatgtagcacaagcaaccaaagacccgaagggcaaaacaccaaaatttgtgttggagatttgcttgaaaaagaaaagcgtgggtaacattgagaagatgctggtgtttacgttcaactatgccattttgttcgagagtttcaacgcatga

SEQ ID NO: 71867 - DNA, 240 bp, Glycine max
  Peptide Sequence Number=SeqID_163552
atggtatatgaaaaaaggagatcttttggagtcgaaggtgatgggctaaagattggagaaaaagtggttgcagggcttgtagtttccgttggcaacctcgacgtacccattgcccagaggctcttcgctatgcgaaggtatgggggagggatattgtacgcagccttacccttgcatatgcaaggaggctatttccggattcgaacccttgaccaacaagtcaccaaggcacaactttag

SEQ ID NO: 71868 - DNA, 156 bp, Glycine max
  Peptide Sequence Number=SeqID_163553
atgttgagtcagagagcagcacgcttagtgtgcagccagcctgtccaacaaggattttgtctcttctcacacttagcgtgttcaagcccgcttagtgcccagtcactaactctcgttgagcaagacatgctcgctgagcacgcctttcttgcttag

SEQ ID NO: 71869 - DNA, 819 bp, Glycine max
  Peptide Sequence Number=SeqID_163554
atgggtcagctccagcgacatgcctttcacaaagcttacggtaaaatctgggacctagccatggcagaggtctccacagaggccattgcctccctcgcccaatattatgaccagccgttgagaaaacaagtcgaaaatggggtggttggagtaccgaggaaatgtttggaagcaaaagcaagaatcttggcaggtaaaggcgaatgggccccgttcatagacatcctcgcgcatttgatcttcggaggagtccccttcccaaatgtggatgggttggtggacctagcggcgatcgacgcttttctcgcctttcatgactgcaaggaaagcccagttgtcgctatcctagccaatctatatgacaccttcgaccgaagatgtgaaaagagcagtacaaggattgtttgttgtactccggccctctacgtatggttggtttcgcaccttttccgccaagaggtgagacatgcttgcccgctagaaagccaccgttcatgcacagagaaaaaagaggcaagttgggaccgactcttagcaagcaaagaaggagcgtctgtcaactggttcccccgatggaaagaaggaagaatcagggttcttatttcgtgcggaggatttccaaatgttcccttgatggggacaaggggttgcatcaattacaatcttgttcttgctataagacaacttggctaccctatgagaggggcaccactagaggaagagctcgcacctatcattgcacgaggtttcaataacaccaacgcgaaggcacttcagaaggtccgcaaggcatgggagatggtgcgtgggatcctctag

SEQ ID NO: 71870 - DNA, 519 bp, Glycine max
  Peptide Sequence Number=SeqID_163555
atgcccagcccgacgcgcaccatttggcgccacaggctgcgctttggccgcagcgcggcttccaccactttctcgccggcgccctcttccagcggctccgcgtcaggcgtcaccagaaacccctgttgcgcgtcgctgctaaaggtgtgcgccgcgcgcagggccggctccacaggctcctgcagcgggcgggcaaaatctatccgaggtttgagtggcgtttcatcgctcatcgcaatttatctcccagtaaaaattccagcgcagcatccatgcggatatgcggcaacggccgatcgacatccagctgctgcggccggaactgttcaaactgaaacccctgctgctgccagaagctgttgcccggcaggcgcggcggtacttcgcccgggtaaaaggtcagcggctcaccgtcggcaaggcgatgaccgcgcagcgccggtaatttttctccgcgatgatccaccagcccgctctcggtcgcctgcaccgacgccagccccagacaatccatgctga

SEQ ID NO: 71871 - DNA, 147 bp, Glycine max
  Peptide Sequence Number=SeqID_163556
atgaaagaaagaaagggactgttgaagtgggccttgggccttcgtaggcgcgctcagcgcgacacccctcgcttagcccgtgtagatcgcgcgcttagcgcgcgtgttgtaggcttagcgcgttcttctattggatcgcaggcttag

SEQ ID NO: 71872 - DNA, 363 bp, Glycine max
  Peptide Sequence Number=SeqID_163557
atggcggccaccggtggttgtgggtggtggagaagaagcttgggacgttggaaatggttttggggaagaggaagagaaaggaaagactgtttttccaaggctacacgaaaaataaggcttgcaacactcaagtgtttctgctctcgggaaaggaagcgtcttgaacacaccagaattcatatcgcaaatcgcaacagtcagatcgtggaaagctgtcctatgaacctccagaccaagtttggagatgatccaacggttaacaaatgcagaagggtgtttttaccgagagagcttcacacagcttccttgagaaacttttctcgagaggcttctttgagaagcttccttgagagacttatttga

SEQ ID NO: 71873 - DNA, 865 bp, Glycine max
  Peptide Sequence Number=SeqID_163558
aaagagtacatcgaccacctgctgggctacatcaatgtggcaaacctgaagccgctgaagctggtgattaactccggtaacggcgcggccggcccggtggtggatgccctggaagcccgctttaaagcgcttaacgtgccggtgacgttcgtgaaagtccacaacacaccggatggcaacttcccgaacggtattcctaacccgctgctgccggagtgccgcgacgacacccgtaacgcggtcatcgagcatggcgcagatatgggcatcgcctttgacggcgatttcgaccgctgcttcctgttcgacgagaaaggccagttcatcgaaggctactacattgtcggcctgctggcggaagcgttccttgagaaaaaccctggcgcgaaaatcattcatgacccgcgtctgtcctggaacaccgttgacgtggtgtctaccgcaggcggcacgccagtgatgtccaaaaccggccacgcctttattaaagaacgcatgcgcgaagaagacgccatctacggcggcgagatgagcgcccaccactacttccgtgatttcgcctactgcgacagcgggatgatcccgtggctgctggtgaccgagttgctgtgcctgaaggggaaaaccctcggcgagctggtacgcgaccgtatggccgcgttcccggcgagcggagagatcaacagcaagctggcgcagcctgccgaggccattgcccgcgtggagcagcactttgccattcacgcgctggaaattgaccccggtggtgcgcctgaacgtggaatcccgcgccgacaccgcgctgatggaagcccgaacgaaggacattctggcgctgttgaatcagtaatatttgcccctcccg

SEQ ID NO: 71874 - DNA, 1969 bp, Glycine max
  Peptide Sequence Number=SeqID_163559
atgaagctgagtaaagccgcaatcagcactttaatcaaagagatgcttagcgcaggactgcttgaagagagcattccggaaagtaacggtcagggtcggccttcggtgttattaaaaatgcgtgccgacagtgcctattttctcggtgcgtcgttgctcggtgacgatgtgtatctggtgctgacggatatgcacggccgcatcctggccagtacccacatgccgctgaatcccgatcctgcgctgctggctggtgcgctggccgccgccatccccggtctgcttgcacaaaaaggcatctccgccgaccagcttatcgggctgggcgtcacgctttccggctttgtggatgaaaaccaggcggtgtgcgttcagtctgccctgctgggctggaaaaacgtcccgctggcggcactgcttaacgcgcaaaccggtctggaggtgtcactggaaaacgatgccaaagctctggcggggcagctgcaccgcggcgcgcacggtggggccggtgaaattgctcactgtaccgtagagcccggcgggcgtccgtgccgctgcggcaagcgcggctgcctcgacacgctggcgtcgctcaccgcgatgcgagaaagcatgcgcgaaaaacaactgccgtgcaccagcgttgccggactggaaacgctggcggtgaaaggcaatagcgccgcgatcgccattctgcaccaggcaggtgacgcacttggcctcgccatcgccaatatcattcagatgaacgatccggagatgattgtcatcgcccatcagccggatgcgttcgacggcctgctcagaaccgtggtgatgcaggcggtagatagtcacgtgttgccttcaatcatgggcaagacgcccatcgccagcatggcgattgatcagttgagctgggcccgcgccgcagccacggagtctgttatgcgcattgcctatggtggaattcatactgaatgcagtacctggaatccggtgctcaattacgccgacgacttccgcatcgtgcggggtgaaacgatgacgtccaatccctatttcgcctttctgcaggattacgcggccgaatttctgccgacctttcacgcccgcgccattgccggtgggccggtggcacgtgtgacctatgatgccttcaaacaggagtttctccgtcggctcgaggcgtatttgcccgtggatggcgtttacctggcgatgcacggcgcggtatatgtcgaagggatggaagacgcggaaggcgactggattagcgcgacgcgcgagctggtcgggcccgattgtccgattagcgtcagctacgatctgcacggcaatgtctcgcagcgcatcatcgacgcgatcgatatgttttcgacctaccgcacagcaccgcatatcgatgtggaggagaccatgcgccgttccgtctcaatgctggtcaatagcctgcaaagcggcatccgaccgggcgtggtgtgggcaccgatccccgtggtgctgccaggcgagcgcaccagcaccgaagatgaaccgaccaaaagcctttacgccagcctgcccgggattaacgcacttgaacatatctgggatgcttcgctgatggttggctatgtctgggcggatgagccacgcgccacggcggccgccatcatgaccggtaccgatgccgatgtgctgtctgagcaggcggccaaactggcgctggcttactggcaggcgcgtgagcaatttgtatttggctgcgtgaccggcagtactgaagagtgcgtacgcatggcgatttccagccctggaggaccggtgattctcgccgactccggtgataacccgaccggcggcggcgtgggcgatcgggccgatgtactggccgagctgctgcggcaaaatgcgcaggatgtcatcgttgcaggcattaccgataaaccggccacggaggcggccttcgccgcaggcgtcggggcccggctctccctgactatcg

SEQ ID NO: 71875 - DNA, 1669 bp, Glycine max
  Peptide Sequence Number=SeqID_163560
cctgatcggaggtgcagtggtgacagagtcggtgtttaactggccgggtattggccgcctgctggtggattcggtgaaataccgcgattatccggtgattcagggcgtaacgttagtggcagtaaccggcgtggtgttgatgaatctgatcgtgaggtttttgcttggcaacccttccatcacgaccggaggcgggctggtactgctggtggtgctggctgcccttttcgcaccgctgattactcactgggaccccatcgagcaggatctgttgaatacgttgcaggcaccttccgctgcccactggttcggcaccgatgattacggccgcgatatttttgcccgcgtcatttatggcgcgcgcatcacgctgtttgaagtcagcctcagcgtagccatctcgatggcgatcggcattcctctgggcatcatctcggggctggccggacgcaaaattgatgcgctgatcatgtggctgatggatattattttcgccttccccggcatcgtactggcgattctgattgtcagcgtgctcggcgaggggctgacaaacatgctgatcgccatttcgttgttctcgatcccgtcgacgctaacggctggtgcggtggtgctttctgccgccagtctgtcgtttctcgggctcggcgtgcagccgccgatgccggagtggggcaccatgatgagcgatggccgcaactttctcgggctaaatatttacgtctccctatttcccggactggcgattttgattaccgtgctcggttttaatgtgctgggcgacggcctgcgcgatgatcggctaacgctgctcgatcagcaaaaaatcccggcgacggactggcaggcattttgcgccagagtcagcgagatgatcgccgggcagcataaccatttcagcagccaggcggctgtcgccatctctacggcgggcattgtggcaccgcaaaccggcgaaatgtttgccagcaacatcccggcttttcaccggcgtaatctggcgcgggaactgggtgaggtgctgcagcggccagtgatcgcacacaatgacgccgactgctttgccctggccgaggcgctggccggcagcggcaaagggcacaaagtggtgtttggcgcgattctcggttccggcgtgggcggtggtctggtggcggacggccgcattatcaccggacaaaacggcctgaccggcgaatggggccacgggccgattaccctcacggaagtgacgctggcgcatcgtcgcgtgcgcgtgccgcgccaggcgtgcccgtgcggccagacagggtgtctggacacctacggcggcgcgcgcggactggaaacgctgcatcaggtgctgcacgctgaaagcgccagcagcgtggaaatcattgcccgctggcagcaggcagaagcgcgggcgcagcagacgatagaagcctggctgcaactggtgagtgagccgctcgcctacaccattaacattaccggcgcgtcgcgggtggcggtaggcggcggactggcttcggtcaccccgctgattgctgcgcttaatgatgcggtgcagcgctgtgtgttgcgcagcacagcgcatgcgctggtggtgccgggcgagtttgcccaccagggcggcatggtgggcgcggcgctgctggcgcggcaggcgctcagcgcgtcctga

SEQ ID NO: 71876 - DNA, 561 bp, Glycine max
  Peptide Sequence Number=SeqID_163561
atggacgaatattttagtatttggcacaataataaaaaaggctttggtcttggaatcataataattccaactgttgccactggtatggagtcctctgccacaaccttacttcccatcttcttcagcttcacctcaacactgattcctcctcagattgggaatctctctaagcttcgatatcttgacttgagcgacaatgattttgaaggtatggcaattccttctttccttgggacaatgacctccttgactcacctcgacctctctgatactggattcatggggaagattccatctcagattgggaatctctccaatttggtctatcttgatttgagttatacaaacctatccaaagcatttcattggctacacactctccaatctcttccttctttgacccacctatatttgtcagactgcacactccctcactataatgaaccatccttgctcaacttctcatctctgcaacacttgtatttcccatggactcacaacacttgcagttcagagttcacgactttcaggcaatccgacagatcatattggggcatttaa

SEQ ID NO: 71877 - DNA, 207 bp, Glycine max
  Peptide Sequence Number=SeqID_163562
atgacgaaaggtgccgataaccagatggagatgatgttagtctctgcgtgctactggactctgagtctgacggatagcaaaagagtgtgtgtgggttaccgtatagggcgtctctacgtgccaacggactcatgggtcacgatagcgaaaggtggggcggttgacaaaagcggggcttttgctcctacgtatcctcaatcgcgatga

SEQ ID NO: 71878 - DNA, 159 bp, Glycine max
  Peptide Sequence Number=SeqID_163563
atggtgaacaaagtttggagctttaatggagaggaagaagaagagaaaagcaacgtgagaagtttgcgtgccgcttctctggttccagttcctcgcgtttctctgcacccgtcggggcccgttttcgaaagaaaacaatatatatcaaaaccctcataa

SEQ ID NO: 71879 - DNA, 156 bp, Glycine max
  Peptide Sequence Number=SeqID_163564
atggtttttcacttaaggcttgtagtgagcttcacaacaaggaaagggaaacataggctcaaaagggctatcaaaggaattaattcaagaagtatcaacaagagtcaagccaaggctattgcgcaagtaatcaatggggcaaagcacaccgaataa

SEQ ID NO: 71880 - DNA, 347 bp, Glycine max
  Peptide Sequence Number=SeqID_163565
aaaacctgtacagagaactgtgtcgggcatcatcggaggttggtagagttataggtggttatgccatactattgcagtcatgggcttggtatcacatgccttttattgcaccaaaagtcttaggacctgaaacaacttattcactcgctaaaagatggagtggtggtcgattagaacataggagcacacctcatggtgacttggtcgggtatagatctcgtatagatcatatggagagtcatcaggatttgaagagcacttaccgagacatacatacagagacagggagatttgttggacaaatggcctcagttatcttaaaagggggtgaattaatttcccactaa

SEQ ID NO: 71881 - DNA, 288 bp, Glycine max
  Peptide Sequence Number=SeqID_163566
atgagagtcattttgcaacaaaaaggagatattaagagagcttttcttctcaagaaatctttctacgttttcctctcaagggagacttcccttagcactatcacaattcccacacttgagaccattcccccaaagttactttttgatccactttttctttatgcaaatattttcaagggaaatccgggtttgttggaaagagcatcggatcgtcaagtatttaaaattaaaacggatgaatccgagtatcaaactcagggaactagtcttagacagggtcaaatttag

SEQ ID NO: 71882 - DNA, 109 bp, Glycine max
  Peptide Sequence Number=SeqID_163567
atgctccaactatatggaatcaacataggcttaaaggagcactcaaacctgatgacccccaagacctacactcctaagagtccgtcagggtctctccctcctgattcag

SEQ ID NO: 71883 - DNA, 866 bp, Glycine max
  Peptide Sequence Number=SeqID_163568
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatgatcgaactgatgcccatcaggtgaatggcaaagataaagaacgtcacgctttccggcgcataggtggtggagagcggggcatagaaggtccaaccgaaattcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71884 - DNA, 324 bp, Glycine max
  Peptide Sequence Number=SeqID_163569
atgaagaatggtggaaaaccgtcacgaaatcgcccacagaaacgcctcagaagcgggaaaatagggaggtggttgcctcctagctcgcccaggcgagctgggttgcttccaccagaaggcaccgtcttctgttggaacaccctggaagattgtgcaacaatgcttcctttcgactcccgacatattgtggaacttcacgaattgcgtaacgatgggtttcaagtacctcgaagcggtcaagcgaaggtcgcatcccaccaaacagatggtccttggatgaaattagggtatgacacaaattttcaaggattattcaatagttaa

SEQ ID NO: 71885 - DNA, 435 bp, Glycine max
  Peptide Sequence Number=SeqID_163570
atggctgaagagccaaagagagtgatcctagaagattactcaagttcaagcaacaatcttaagacttgggatgaagtggttgagaaatttttgaagaagtatttcctagagtctaagactgaagaaggaaaagcagtcatatcatctttttaccaatttccaaatgaatccctgagtgaggccttagaaagattccatgatgcttctgctgggggaaagataaagttgaaaacccctgaagaagccatggatcttattgaaaatatgtttgcaagtgacattgctattctcatagatagagcccacataccaacaaagagaagccttctagaacttacatcacaagatgcgttgttggcacagaacaagttgcaaggtgtgccatctgtggtggagctcataattctggctgctgtatccccaatgaagaactag

SEQ ID NO: 71886 - DNA, 540 bp, Glycine max
  Peptide Sequence Number=SeqID_163571
atggcgcctactaggcaccctttggacccagataagtccaacagggccctcggatttcccgcactgatcacaggactctgccaatcgttcggagtccccgttgcacctaccaaggtgattcggccgcccatcacccgggcttttattgagaagtactgcacccagagatgggctcagggggatgctccacaggccgcgggcgagccaccaccacctcatcaggctggcccggctgggtcatttgacatggagcagtatttacgacatttggttcgccagcaggcagccaaccaccgggcacatgtgcagacccatgattgtctataccagatgagcctcagcatgcagagccagggctttgcttctttttcatgccctactccagaccagttcagggcagaggtcgcatggcccggggattggcccgaggcccaagcaggaaaggcacccccagaggctcccggcgatggagaagaggcccacgaggacgaggagatggccgatttgcttgacttcttgggagggagtggagcttcatga

SEQ ID NO: 71887 - DNA, 237 bp, Glycine max
  Peptide Sequence Number=SeqID_163572
atggagaattgcaacaagcaactaactgcgcatgactccaaactcatgggtggaggacgcatgaacgaaaacgcaattcatggggctccaaaaaagggtagagaatggagaattgccctacgcaatcactacgcatggctccaaactcataggctccaaacgatgggtggaggacacatgaacgaaaacgcaattcatggggctccaaaaaagattgagaatggagaattgcactaa

SEQ ID NO: 71888 - DNA, 192 bp, Glycine max
  Peptide Sequence Number=SeqID_163573
atgggtgccaagtacctcgaagtagtcaaacgagggtcgcatcccaacaacggatggttcccggacaaaattagggtgtgcggaattaccataatttgtctccgcccacctctcgacttgctgttcctgaatgacaaagggcgcagaatttgtctctgcgcgtttatcactcaacttgcgaaatctgaatga

SEQ ID NO: 71889 - DNA, 411 bp, Glycine max
  Peptide Sequence Number=SeqID_163574
atgaccatgattacgccaagctcgaaattaaccctcactaaagggaacaaaagctggtaccgggccccccctcgagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagccgctga

SEQ ID NO: 71890 - DNA, 246 bp, Glycine max
  Peptide Sequence Number=SeqID_163575
atggtgaaagttgggaactcttacgtgccgatcaacgtctcattttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 71891 - DNA, 453 bp, Glycine max
  Peptide Sequence Number=SeqID_163576
atgatttctgttaatcctgacccgagaagtcaggtggtaggcggagatacccaagtggttatccatataaacactcttttgctatccgtcagactcagagtccgagacggcgagttcaatgacatgcgaagaaacccaagtggttattcgtacaaaacgatttctgttaatcctgacccgagaagtcaggtggcagagacggtgagtccgatgatatgcgcagatacccaagtggttatccaaacaaaccaacttctgttaatctcgacccgtgaagtcaggtggcaggcggaagtaccccaagtggttatccgtacaaacgtacttctgttaatcctgacctgtgaagtcaggtggcaggcagaaataccccaagtggttatccgtacacacagttctgctaccccgacctgtgacaagtcaggtagcatgcggagacgccctatacggtaa

SEQ ID NO: 71892 - DNA, 517 bp, Glycine max
  Peptide Sequence Number=SeqID_163577
ggggatgccctctattggtggacttcccttgttaaagaacgaaggattcatgagggtggtcctgtagagtattgtaatgattgtgagagtgcctttgggaggaggcaaattcgcccctactatgaaagagaggttaatgatccctccaccaatagacaaaggagtatgagtgttgaagaatatagacaacaaatggaactactccttttaagagctggacttagggaggaggaaagaacaagcatagctaggttccttagtgggctcaatatggaagtgagggacaagggggctgcaccttcaaaacccaaggaagataagggtcacattgcctctcaatgccccacaaagaaaaccatgatcatgaggggtcaagacatttatagtagtcaagaggagactacttcttgcccttcctctagtggaagtgaagatgatgtaaggggtgaaaattctagtgaggaagtcaacccccatgaagaaggtgacctcttaatggttagaaggctccttggag

SEQ ID NO: 71893 - DNA, 305 bp, Glycine max
  Peptide Sequence Number=SeqID_163578
ctgtccctcctgttcagctactgacggggtggtgcgtaacggcaaaagcaccgccggacatcagcgctggcaagtgtagcggtcacgctgcgcgtaaccaccacacccgccgcgcttatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 71894 - DNA, 330 bp, Glycine max
  Peptide Sequence Number=SeqID_163579
atgactgaaatagaacttagaatttttcttcttctaaaaatcagtcctatcgctaagtgcaagcattgcgctaagcgcatcttttgtcatgcgctaagcggagagtctctagcacttagcgctcaacccttgcatctcatgctgatttacaatgacttccaagattattttgatgatgccaaagaatcaagagttaagcaagttccaaagaatcaggcttcaagaatcaagtctcaaagaatcaagattcaagaacaattaagtttcaagattcaagattcaagaaaaatcaagatcaagattcaagattcaagattcaagagaagttga

SEQ ID NO: 71895 - DNA, 220 bp, Glycine max
  Peptide Sequence Number=SeqID_163580
gtcgactctagaggatcccacccaggcccacttggaccttccagggtgttccaacagaaggcggtgccttctggtggaagcaacccagctcgcctggaaaattcaagccgaggcgtttccgtaacgcttctgagacgtttccgtgggcgatttcgtgaaggttttccaccgttcttcatcgttcttcgttctttcttcgtcgttcttcggtcttcaaccg

SEQ ID NO: 71896 - DNA, 222 bp, Glycine max
  Peptide Sequence Number=SeqID_163581
atgttggacatatgttgcttggaagaccttggcaatatgatagaggtgttgtccacaatggggtcacaaatcgatattagttcttgcataaaggacattccctatggcttgcctcctttaagaggaattgagcatcaaatagagcttcacttcttaatagggcagcctataggagtaatccggaagagacaaaggagatccaaaagcaatttgaagggctga

SEQ ID NO: 71897 - DNA, 459 bp, Glycine max
  Peptide Sequence Number=SeqID_163582
atgaccatgattacgccaagctcgaaattaaccctcactaaagggaacaaaagctggtaccgggccccccctcgaggtcgacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71898 - DNA, 782 bp, Glycine max
  Peptide Sequence Number=SeqID_163583
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctgttaattttggagaatgcaattgccttactgacgtaagccacccatcaaccaaaaaggtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71899 - DNA, 300 bp, Glycine max
  Peptide Sequence Number=SeqID_163584
atgaccaactactatccaccagaccttcctccttctattggagttcctcgaggcagccaaggagcagtgctgaagaaagttctccataggattgctgtgcagagctctaacttccttgacccaggaataaaattcccaccacaaaggcattattttatgacaagagaaaaaaaggtgggatgcagattcaacttgactttggcagaaggggcagaggtcattttgaaggacaatctgcctcctaataaggttttccttagatggaagcctatcccagagaagtctccaagcaaaagctag

SEQ ID NO: 71900 - DNA, 535 bp, Glycine max
  Peptide Sequence Number=SeqID_163585
atggcagaatcgtcaaagaagcgaaagggatcatcctccaccacctctgctgctagccatcaccgccacggaccatctgaagctcccacagcaccaagtcatccttccttatcatctccacgatcatcaactctattttcttcagatgatcaatgtctacggtacaattctcaattttcttctaggatcatcttacaccctaagtacctagacatagatttctttaatgatgagacatttgactgttatcaagtgtttcaaaactctgcattggttgaatttatgtccttaaaattgccttactatcctgaacttgttaaagtcttctatagcaatttaaaaattcaggatggtattatttcttctgaggtgcatggtatatctatgatcattgatcaatctctgttcttttcattgactaaattacctagtcaaggtgcaccttttgagggcaccattgttgatgactggaaattcgattattctagtcatgatgctcaccgtatggtttgtaatgaccaggctgaaatgactg

SEQ ID NO: 71901 - DNA, 420 bp, Glycine max
  Peptide Sequence Number=SeqID_163586
gatggaccctcgggtactagtaccctggtcttcagaggactacacgtcctcgccaacagagggctgcacaccctcacctttagaggactgcgtgtcctcactttcagaggactgcatgtcctcaccttcagagggctacacgccctcgccatcagaggactgcacgccctcacctccagaggactacatgtcctcgccttgagagggctacacgccctcaccttgggactacacgtcctcgccaatagagggctgcacgccctcaccttcagaggactacatgtcctcgccttgagaaggctacacgccctcaccttgggtactagttaccctcaccatcagagggctgcacgccctcacctcgagaggactacatgtcctcgccttgagagggctacacgccctcaccttgggtactag

SEQ ID NO: 71902 - DNA, 773 bp, Glycine max
  Peptide Sequence Number=SeqID_163587
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctggtcggatcaacactgatcacaggattatcaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71903 - DNA, 447 bp, Glycine max
  Peptide Sequence Number=SeqID_163588
atgaccatgattacgccaagctcgaaattaaccctcactaaagggaacaaaagctgtgttgatccgaccagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71904 - DNA, 126 bp, Glycine max
  Peptide Sequence Number=SeqID_163589
atggtggagaagattaagattcctcacttcttcaaaagagtttggataggttcgatggtcgaagaagatatctcttacatccgtacaagctttgatctaccaccaccaccaccaccatcatcttag

SEQ ID NO: 71905 - DNA, 1854 bp, Glycine max
  Peptide Sequence Number=SeqID_163590
atgttgaaagttgacgtagttgggaacaaaaaaaggaagaggtgtgggaaggttttcaggttcaagaattttggtgaacctggataccctgttatgtttaatgggccatttcgtgagaacgtgaatgcattacttgaatatgcaaatttggagagtaatttaagcatggaaatgccaatgtggtcttttcaacttgaagttcatcaccacccacctttgcatatcttgttgtttgtgattgaagagccaatagaggcagcattgaatcgtcactgcaagcattgtcaatacgttgcacaggctggggcaatcatttcatttgcaataagaagtatcactttgtgttgccctcaaaggaggcactggctacctgcacaagctgtgaaggttgctgtgatgcagttactacaattaataatgatcatggagttttggaaccgtttgtgctacggattgcaagcaaggaaggtgagtttgaatgacatttcacaaaagagaggaatggaactaagacttgtgaatggaatagcatacaacgagtcatggtttggccattggggttacaaatttggtcgaggatgctttggtgtaactcaatccatgtaccacaaggccatacaagcaataagaagcatgccattatacttaatcatacaccacattgccaattccaaccatggcattccactcatattctcaaggtaccaaacactttcagatcaatccctagtgacccttggtgacctattttgttacatgttagaccttaaatcgcgccttcctcgtgaaacatgcattagttcctataacacaaataccttagcagtcgagaccaattgtcgttggtcccctaaaaggattgagatggcaacaagggtaattgttgaggccttgaaaagaacaaagtttagatgggtttcaaggcaagaagttagagatgctgctcgtgcatacattggtgacacaggattgctagattttgtattgaagtcactagggaaccatgttgtaggaaactacttggttcgtcgaagcttgaaccctgtgaccaaagtcttggaatattgtttagaagacatttctaatgtgcacccttatgataatgaaggcttggttatgagtaacaaagtgaaggacaagtataagatcacaagggctcaactaatgaaggacatgctttatttgtataagtacattcttatagatccaaaaccaatgatggggtcagaatttctctcggctataccattggcagcaaggataattcttgataccaagtattttataaaagattactttggagatattccttaccaggttgaattaggctcgaatgataaactcaacctttattgtacaatttggttgagaaacaatgttggcagtgatgagtacttaaacaaagccattatgccaccccatgaatgtttcacattgaaaagaaatgctactatcaatgacttgaagctagaagttgaaaggaattttagagaaatttattgggggttaaggagttttgtagtggaatcatttcggaatttaagtgtcaataatgagacagaaatggtttttggtctaattgaagtgggtggaaaagttgtgcttgagggttggcaaggtgacataggaataaacatgattgagcaaatatgtgaaagtgatccgaacaatggtataatggattgcacttgtggaactatagaagatgatggtgagaggatggtctcgtgtgatatttgtgaaatttggcaacatagtaggtgtgttcgaattccaaatgatgaagaaattcctcatatttttttatgcaaaaagtgcgagcaagaaattgtcttgtttccttcgttgccatag

SEQ ID NO: 71906 - DNA, 1113 bp, Glycine max
  Peptide Sequence Number=SeqID_163591
ctgttgtagacagatatagtgcttctgtgttcgaatcctgttactgctcaaatcattggaagatgacaatgattaaaaatgagcaacttaaacatggtcaacaagaaaagtggtttaataattttcatgaaaatcttgatctgaatgtgactgctcaagagctggagcagcagcctgattttcggtgggaattgttagaaaaccgctatagccaatacagtgaactatctggaaagattgagaagcacagagatagcattagtttggaggcccaacaacaaggaaatcagatacctcagacaaagatttctgaggcatgtgttaatgacttgttgattcttgcacaatctgctgagatagtagcacaatctgaagatagtgtggctggggagcatacaaataaccaaaaaaataaagacttacaaagtgacctgatcgatcaaatgtcacaagagcatgctagcaatatcaatgtggatgatcaggaatgctctctagagctacttgatagactgtcagcagtttgtcacatgaaacatcgagctcggtccaaaggtaattcaacagtgaaagatgggactgagaagcatatggatcagagtctgccttgtaacagatttaaagattccagtccttctgtcgaagatgtgcctgcacataactttagaggagccattcaatcatctgttgtaaggcgggatattgaaaatcttaaggaacatcaacgtattgcaaggcgattaagggcattcaagactaaaaaactgaggcaacagttcaggagagagtgtaaaagaagtgtttccagtgcgggactgcatgcaatggggacaagcctgactgggttaaaaggttataaggtcttgggatctccaactacaatggctagcttttgtagtgtggttctcccaagatcttaccaattggtatcatgtttctccaactacaatggtgtggatgatgatgccattgttgcaattaaggagtggatgctgtatatgaaccatatgcatctaaaggaatatcacagggttgttgcatgccagcatagagcagagtgtgttgaagagaaaagggcatcaaatgttaagaagaaaaataatcctgcactag

SEQ ID NO: 71907 - DNA, 192 bp, Glycine max
  Peptide Sequence Number=SeqID_163592
atggagacgccggaggatttgccgcactcgtctggctcgaccccggcttgtgggctatggtggtggagttttgatggtgacgagggcgcgcggtgtttggtcggaggtggtgggttggattcggggctaggtgtggttgtgctgatcttgacaacgctggctaggaggtgcgccggagttgttggtggatag

SEQ ID NO: 71908 - DNA, 810 bp, Glycine max
  Peptide Sequence Number=SeqID_163593
atggcttcagagacagaggtgccggatattatttcctctgttttcgaaaggtttcaacaaaacagagacatgtctctgtttctgcccttcctcttcggcttctctgacgccaccccaggacgaaatagcgacgacccagatcacgaaactgctcccacagaagccccacaacgtcaaagaataatcttggtgaaccccttgactcagggcatggtggtgatcgacggtggttcgagcctcgaggctctgtttcgcgaattcaccaacggaaaaggtggtcgaccaccggcttctaaggagtccattgaggccttgccgagtgtggaaattggagaaggtaacgaagattcggagtgtgtggtttgtttggaggagtttggggttggtggggtggcaaaggagatgccatgtaagcataggtttcatggtaattgtattgagaagtggttggggatgcatgggtcttgccctgtgtgtaggtatgagatgcctgtggaggagattgattgggggaagaagagggaggaggaaggtggtgagaggagaaggagtgatggtggtgaagtttgggttagtttttctttcaataggagtagtagaagaaaccaagatcatgatcaagctgattctggtgattcaaatgatgatgatggttcttcatcaagtcatggagatggtgctgctgaagagaatcaaggttttaaattgcggtcacagttatggaaactacagacaaatgcagtcgatgttgttggaattgaggtcgtggtggtgactccaaaaacattgattttgtggccaaaattgtga

SEQ ID NO: 71909 - DNA, 1054 bp, Glycine max
  Peptide Sequence Number=SeqID_163594
atgccgacactgaaactctccctcttcgtctccctcccaaaacccttaaacctcagaccccaattttcgcgccacccaataaacccaaacccgacaacctcggaccgtggcctcgtattccacgaaaaagtgctctaccttaaagccctcaaagtgaaccccgacaaggccttccgcttaaaccccaccctccgttcctctcctctctcaacccttaaatcggtgacgcgctccctttcttcattgggcattccacgcgcctccatgggtcgaatcctcgacatgctccccgtgctcctcacgtgcgacccctatttccaattctaccccctcctcgacttcctcctccacgaggtcccaatcccctaccacgacatccacctttcaatcctgcgctgccctagattactcgtttccagcgttaacaaccgattgcgaccaactttacactttctgaggaaattagggtttaatgggccccactcgctcacgtgtcagaccacattgcttctcgtttccagcgtggaggacacccttttgcccaagattgagtttttgaagggtttggggttcactcacgaagaggtggctaacatggtcgtgaggtcacctgggttgttgactcttagtgtggagaagaatttgaggcccaaggtggagtttttcttgagggagatgaatggggatgttgctgagctcaagaggtttccgcagtatttttcttttagcttggaacggaggattaagccgcggtacgggatgctgagacgggttggcgtgtcgatggatttggaagatatgttgaaggttagtgatggcgggtttaaggctaggttgcttgatttgaggtttaagaaacttgagataggacaactgcaattttggcggcaacctcgagatcttttgaggatgcaagcgactgcaattgcagctgcatttgttcgcaatttcctgcagtgtcaaggattgcggcatgactacgactgcaatgtggattcttgtgattcaaaggaaatgagattttggtttatggaaaacaaggagttggatttag

SEQ ID NO: 71910 - DNA, 642 bp, Glycine max
  Peptide Sequence Number=SeqID_163595
atgttgactgttagtttaaaacgttcctatcacgtgttcttgctgccattcaaaccaagcatagcggtggtggtgtgcgttttgacaatcataatctctcttacatcactccttctcttttacatcaaactctgcaacgatggcatcacagacgatagaggcaaaaactcggcttcatggatggtggtgtcgttcaccgaaaggaaaaacttcggcattgactggtctatggtggaatcattaccgaacttcaaattcagagtgctacgggggcaaaaggaaggactcaattgcgcggtgtgcctgaacaagtttaaggtcgcgaaggttctccggctattgtcgaaatgcaagcacgcgtttcacgtggagtgtgtggactcgtggttggacgtgcattctatgtgtcctctctgctgctattgcatggatccagaggacattttcttggtagaggaagcaaagcctttccaccaaagtcatcaacaacagaacaacgatcagggatgcgtgtgtttgaatctggacctggagaagcaggggatagtaaagtctcgacagaggcatttgttcgtttggggtgggggaaggagaaacaacagaggagtagcaacagagtcggaggtggacgacgtcatttag

SEQ ID NO: 71911 - DNA, 1505 bp, Glycine max
  Peptide Sequence Number=SeqID_163596
atggttatctcagcagccacttcaaataacaacaacatccatcagttgcaatctttcaactctcagaacaacaattaccaccttcgcgacgcgtccttctcttcgtacttgaacaacaaagaagagatcctgacagagtcaggccatggctatgtcagcagcagaaaggatcctctcggagtaaagaaggaagatgatggagaaattggagtatttgaagctgaaaagtacttcaatggagaagagattggaagccccccaagagttgctgataatgatgcaaacaagcaccggccccagaaagatgaacaaacagctcttgtaaccagaaagtacaaagttcagaatggaactccaagtgtaaggtctgaatcaagcttgaatagccaaagtgcacttttgcaaagtgctgtgaggaactcctcaaggaacatgaaaagcaaattgcataggaagagttttctagctggtcttggttgcaaatgctattgttctgacaagaattctgttgatattagtgaccatgcaggtgaaatcagtttcagcaaaaattctagtcatggaaaaacaacttcaagaaatatgttcaatgctgatccagaggctaatcattcagttaaagttactaggcctcacgcagccgaaatctcgattaacaaagatgtttacttccaaaggccagagaagttaggggtgggattgagcaaagagaacagtttagcactctcaggtttgaattctagctcaggaaataatccggcgaaaatgcaacttcaacaagtagagaagtcaaggaattcattggaagtgtttggctccccaatactgagtagcaggagcaagtctttgagctttgataaaaggttggcaaagacctcttcctcttcttgggatgctgctcctaaaattgaagaaactgacttctcagcaaattctggtggaaactacaatgatgctgatagtgatgcaagttcagacttgtttgagattgaaagcctcacaggaaaatccaactccttcttccttggtagatcatcatccaatgttgtttctagctgtgccagccccacaacttgttatgcaccgagtgaggtaagcatagaatggagtgtggccactgccagtgccttggagtactcagccatgtcagattatgatgatcaaaggtcaataggaaccacaaggagtccaattacgacatccttagtttcctcaaatggtaaaccaaaagtcgttgtcaaagagacgcagaggcggcgtcctagcatgctgttgggttgcaagagccagaaagctgtaggagttgctttggatgccttcacaacatatgagaaaacaagttctaacgcgaatagtcgtcgcaggtctgacaccttccctcaggtgacagagtttaagacagagacaacaaaggaaggaagttttggtgcaagacataataagcaacatgcttatgcaacaaacccacttcagcgctcactctcaccacatccttcacaactctt

SEQ ID NO: 71912 - DNA, 270 bp, Glycine max
  Peptide Sequence Number=SeqID_163597
atggtagtcctcgtcataaggcttttcagaaagctattgtgcgccatattacttcgtgacgccacaaacaactacctattaaccagtgcagagtcacatccaaaacgaaatatagccatttgcctgcagttaaactgtaagaaattgacaaagatgcaattgcccaagatttaccctatgggaactgtttttcccccttttatgaagaagaaaggtggagttggtttcatgaccacaaatcagaggcagtgggacgtattatgtacctag

SEQ ID NO: 71913 - DNA, 911 bp, Glycine max
  Peptide Sequence Number=SeqID_163598
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattcaaaagagagcattggaaattcaagagcaagagaacgctctgttggaaaatgagcgcatccagcaagatcgactgccattaacaaatttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataagataccaggcgtttccccctggcggctccctcgtgcgctctcctgttcctgcctttcggtttaccggtgtcattccgct

SEQ ID NO: 71914 - DNA, 846 bp, Glycine max
  Peptide Sequence Number=SeqID_163599
atggacataattatgcctagtaagttgttaccagaaaggaatgtggttgtatattatactgaatttgatgagttcaatgaggaacttgagagaagacactgggatgaggagttgactagttttgctgacggcaacatcgatgttgccattgtgaaggaattttataccaacctctacgacccagaagataagtcacctaagcaggtgagggtcagaggtcatttgatcaagtttgatgaagacacattgaacacattcttgaagacctcggtaattttggaagagggggaaaatttgtgtgcttattccagatttgcactcctgaggcttgatcctcaggagttggctgctaagctctatatcccagggaggggatttgagctaaacgctgatggtcagcccttgaagatcttaaggaagaacatgaccatgctcgctcagacatggagcgttctttccttctctaacctgattcctacctcccacacatttgatgtcaccttagacagagccaaattaatttatggcatcattataaagatggatatgaatgtgggaagaactgttggaatcttgatgatccaacagtgtcatttagagggccaaggaaggccaggggtaagagatcagaggccccactacttcagcggcaccagagacagcagctccttcttcttccacagctcctgcacctcccattcagactccagctattcctcctgcacctactcagatacaacttcctgctccatctccattccagcttctagctcctttatctgcaggaccatcagactttgtatttacaccacagatgcttcattccatgctccagagcttacatag

SEQ ID NO: 71915 - DNA, 801 bp, Glycine max
  Peptide Sequence Number=SeqID_163600
atgcaggttgcaggatgtacaatttgtggtggagctcatgaatctggatgttgtatccctaatgaagagaaaattgcacatgaagtcaattatatggggaatcagcccagaggtaatttcaatacaagtggatttccaagatttcagaacaaccaactgtatcaacagcagaggcagtggcaaaatctccctggttcatctacatggccacaacaacatatgccaagtctttatgaccgaaccacaaagttggaagagactctagctcaattcatgcaagtgtcaatgtctaaccaaaagagcactgagtctgcaattaagaatttggaagtccaggtgggccagcttgcaaagcaattagctgaaagaccatcaaacaactttatagcaagcactgagaaaaatcctaaagaagagtgcaaagctgtgatgactagaagaaaaatggcgattcaagcagaggaaagtggagctgatcagaaggtggagggagttaaaccacagctggctgatgaattggcactagaactggttgatgatttagttgaacttgaagaaattgttgaggaagcagaaggtgatgaagaaggagagacaccaataagagactatcaagagaaaataaagaagaaggaagaaaaagaaaaaggaacaaaagaaaaagaagaaaaagaagaaaaagaaaaaaaattgaaaaatgaaaaacaaaaagagaaggttgttgagattgagaagaagaagggcaagagtgaggctaacatagaaaagaagaaagaggctactcctattgaatgcaaagag

SEQ ID NO: 71916 - DNA, 429 bp, Glycine max
  Peptide Sequence Number=SeqID_163601
atgtcttaccaagcgatcacaactccgatctccctctgcctaagtgccagttggtgtatgatgcctaccagggaccctctggacccagataagtccaacagggccctgggttttccggcgctgttcacgggcctctgccagtccttcggagttcctgtcacccccagtaaagcggccaaccatcgtgggcaggtgcagatacatgagtgtctctaccggttcagccttagtcagcaggggcagggttccgccccttttgcatgccctactccagagcagtttggggctgaggtcgcatggcctagagactggcccgatgtccaggcaggggaggagcctgcaagatcctctggtgagccagatgcgtcccatatggatgaagatatgacggacttgcttggtttcttgggagggagcggagccacgtga

SEQ ID NO: 71917 - DNA, 312 bp, Glycine max
  Peptide Sequence Number=SeqID_163602
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcaggctgcgcaactgttgggaaagggcgatcggtgcgggcctcttcgctattacgccagctggcgaaagggggatgtgctgcaaggcgattaagttgggtaacgccagggttttcccagtcacgacgttgtaa

SEQ ID NO: 71918 - DNA, 420 bp, Glycine max
  Peptide Sequence Number=SeqID_163603
atgacgtgtagccctttgaaggtgaggaagtgtagtcctccgaaggtgaggacgtgtagtcctttaaaggcgaggacatgtagtcctctccaggcaaggacgtgtagtcctcttaaggtgagggcgtgtagccctatgaaggtgagggcgtgtagccctatgaatgcgagggtgtgcaaccctatgaaggcgagggtgtgtagccctttgagggcgaggacatgtagtcctgtgaaggtgaggacgtgtagtcctttgaaggtgagaacatgtagccctctgaaggtgagaatgtgtatccgtatgaagacaagggcgtgcaaccctctgaaggcgaggacgtgtagccctttgaaggcgaggacgggtagtcctctgaaggtgaggacgtgtagtcgttgtagatgcaattggctttga

SEQ ID NO: 71919 - DNA, 555 bp, Glycine max
  Peptide Sequence Number=SeqID_163604
atgacccagatcagtgttcatgtggcacagcttatctcatatgccatccaccagtttgtaggtattgcacctccaagacacccagtggactcagagaagtccaatagggcactaggatttccgacattgattacaggtacaacagtcggggcaatactagcagcactagccggctgcagatgcaccgccaccacctccacatcagccaccatccttagagtccatctcagctcacatgcaaaggatggagctccaaatgcaccatacatgcagcatttggctgatcagcaggcaacaaaccataggggccagatgcagttgaatgacagcttctatcagtatacactgcaccagcatcaccaggaccctaacctttacccgtggcctactctcgagcagttcagagccactatcgcatggcctggggataggcctaattttcaggaggaggcaagtcctatagaagctcaaggagctgcccaaggggacaaaggtggagctgaggatgatggagacatggtagatttgcttgatttcttcattggaggaggctga

SEQ ID NO: 71920 - DNA, 240 bp, Glycine max
  Peptide Sequence Number=SeqID_163605
atgcctcgggtaccccccatgatacgcgcaggttgcgttgggattgtaccactgagggaaaggagactggtaaatccttccgggggtcactaccaccatttggttggcgatcaaagatggaaacaagtccccggttccaaccaagtaggagccgaggtcacgacatgggcatccccttctttcttctttgccccagttgctccgagtcttttgttgcttgtaccgtcaggggcgacatag

SEQ ID NO: 71921 - DNA, 1302 bp, Glycine max
  Peptide Sequence Number=SeqID_163606
atggatgagcaaagactggagaggcagcttgataacaacattttcatcgacggggtgaaagtgttcgttaatagaccgaagttcgaaagggggaaggtggtaaacactcgtgaaaaagggacctctattcgtggtgagggggatattccacaggtatacaaagatggtaatggggataaagctgatcaggtggaaaacaatatccgggataaacctcgatcatatgctacggtagtgaaggaacctgtacatggcgaaacagaacctatgaagtcgttggtagtgatgcctgggtccgataagacgaactatagcccagtcatcctgcaatcaaccaaggcgaattctgagtggatttctaaggcctggacagcaagactaaagaacaggggaatgtttgagaggttggaggaggagttgaaatgggtggttgaagacgattctagtccttgctactgggcggacgactgggtcatcttccctgacatggatgagtccaaggctgctcgtctcatagaccaagagaaggacaacaggtctactcccatatcggagctccaaaaatggtctccggagataagacccacacatagactcacctgggttcttctctggggtctccctctgacagtgtgggaagaggagcttatggcgaaggtgttggcggaagtgggggaggtggttgaagtagatgaatacgtggaggctaggcggcgactggatgtggcacgtatcctcgtacggacgcagaaggaacctttgcttcaggcgaatattccggccattattgacgggatcgagtacgtcctccaagttgtggaggacacgacgagcctgggtaggtcaaagaagtgtccttaccatgtatcctggcttcccccttccccatactcgacccagccaaacaccccggcatcaggggacgtgctccacccaagggtcttttccggcgtcgatttccccgacggagtatccgacgacaaccttggtgcagactttgacgaccgagacactctcctctcgcctaatctgcgtagagaccactgggtaaagaccctggctcgtagctgcaaggaccggtccttcatccatgatgacgcgaaaccatttcagaaggataaagttcaaatcatgcagggtataggggcagaggtggcgttgacatcgtccaacggccaacttccccgaaatggagcagccttaaatgaagatgttgaaagggatatgcagggtatcatgttaaaggcaaagcatcctgtcaaagacagctttctagtccacgcccatttgacttacactatt

SEQ ID NO: 71922 - DNA, 1242 bp, Glycine max
  Peptide Sequence Number=SeqID_163607
atggcggaaactctggcaagccaaggagagtgggtatcattcatggatgtattagcactactagtgttcgagatagtactatttcctaatgtagacagacttgtagatctagcagcaattgatgcatttcttgcttatcaccacagcaaggaaagctcggtcattgctgttttagcaaatgcatatgatacattcgacttaagatgcgagaaaagcagtgcgataattgtttgttgtacgcctgatctttatgtatggcttatatcccacgtctttaatcatggaagtagatctgtctatcccttacaaggtcatcacatgtgctcgagaaaggataaagcaaattgggaagaactcttggcaggcatgacaggagcatccattagttggttcccacggtggaaagaagggggggcaggagtattgtgctcatgtgaaggatttctaaatgtccctttgatggggacaaggggtttcattaataataaccctgtgttggccataagacagttaggatatcctatgagaggtgtgccatcggaggaaaccattacgcctttcatcgcacgagggttcaacaaagctaatacaaaaatacttcagaagatctgtaaggcatggaataaagtgggaagaaaagataaagaacttagaggaagaagcaatgaagtgcctgaggagagtgaagaggtgaaagccttgaaagctgagtttgaaaagacaaaagtagcgaaagagaagctaaaggtggcagccactagagttaggaaaaaaagtgataagttgagggatatcaacatgaccgcgactgaagcgctagagcgggaaacgaagaaagccaaaaaggaagagtggagtagaaacaagtttcgaggggctttgttaggaagaagtaatgagctcaaacttagaaaggccgagagggacaaatcaaggatggaaagcggaagtttgaaagagcaattgagaaagacggaagagaatatgttgataatcattgatcaatataaagagaaggtgaacctagctgctagtcacgggcagatgctaagagacaagcaggcgaaggtgtcggccttgcgggttaaaagggaagcaagggaagaggtgatggagttattgcataaagaaggcatgaaatggatggataggtttgctctcactctgaatgaaagtcaagagcttccaaagttgttagccaaagccaagacagtggttgacacatactccgctcctgatgaa

SEQ ID NO: 71923 - DNA, 186 bp, Glycine max
  Peptide Sequence Number=SeqID_163608
atgaagcttgataggttcagactctggatggaggctcttgtctttgctgaaattgcatattctggatggtcattcgcctcactaactcctctaaggaaggttgagaagaggcctcagctgcttgttgtctttgttatgactgttgctgctgtattggaggaggaacatatggcttactcagactag

SEQ ID NO: 71924 - DNA, 447 bp, Glycine max
  Peptide Sequence Number=SeqID_163609
atgccaccgcatgtgtgccgagaaagggaaagaaaattgggaagaactcttggcaggtatggtagaggcatcgcaaacgtccccttgatgggaatgaggggttgtattaattataatcccatacttgccataagacaattaggctaccccatgagaggggcgccaatagaagagagtattgcgcttttcatcgcacgaagtttcagtgacccctatgaaaaaatgcttcaaagagtccgaaaagcatggaatgcggtgcaaaggaaggataaggatcttagaggaagcagcaacggtgttattggcagatatcataaatggttgaaggcttggatgcaagggataatttggctcccgaagctaaagatttcgagtggggaagaggctggagtccctgaggagagcgaagaagtgcaagccttgaaagcggaacttgaaagaacgtga

SEQ ID NO: 71925 - DNA, 129 bp, Glycine max
  Peptide Sequence Number=SeqID_163610
atggataagagcttgaaggtaggagaagatgattggagggagaaggagagaatgagcatgaaattttgtccctcaaaagagcccactaatccaaaatcaagtccaagattctccactaagtgtgcttag

SEQ ID NO: 71926 - DNA, 294 bp, Glycine max
  Peptide Sequence Number=SeqID_163611
atggtgaattggtgcaaaagtgtaaaggaaatatggaaaatgcttgaagccactcatgagggcactgcggatgaaccaaagatcacaacgatcaaggaatccaaggacttagcgtcaatgtcgatggaagttctctttagaaaattgcttgtatatgaacactcaatggatgactcctcaaccattgaagaaactgaggagttccaaaaggcaagggactcactatggtacttggatagtggctgctctaagcacatgacgggtgacaagtccaaacttactgacattgtataa

SEQ ID NO: 71927 - DNA, 216 bp, Glycine max
  Peptide Sequence Number=SeqID_163612
acttatcaaggtaatccttgtggcgtctaccctgacttatcttccttcactggaagtggcgtctacccggacttatcttccttcaccggaagtggcgtctatcctgacttatcttccttcactggaagtggcgtcatccaaaacctccgtagcctgtatcaaacgatccgctcctactcaggttcacatcacaattgccgacatcggtcattgtaa

SEQ ID NO: 71928 - DNA, 483 bp, Glycine max
  Peptide Sequence Number=SeqID_163613
atgtggatgacactatttgcgaaaaatacggcattagtaaggaggagcgagcccagttttgtcagagtcgcagagacctctcgtgggaggtataaaaaggcacaagccatccagaagcaaaacactgccccctacatgttgtctcgtaggggttatgaatatttagaacaaaagctgatggctgagaagacaaagaaaaaactggtggaagctgctcaatccaaaagcactgaggtcgtgattgaccctccatctctcatcagatggcacgtgaagtggaagatggcccgcgcgaagaaaactggccagatgacgtctaagtcagcaaaggaaattgctgagaagattgactcattggaggagcaggcatcacagggttcctttgtcctccatggatgtcaggatgtcctgactactgccattgggcgaccagaacatccaagttgtgtgcgtgctgctagagccggtgtgactatcaagtaa

SEQ ID NO: 71929 - DNA, 304 bp, Glycine max
  Peptide Sequence Number=SeqID_163614
cgaggcgaggctcaagggtgtgtcttccaaaggcagaaaatgcgcggagtcgccaccaacgtttatttgtggaaaacgtcgaaaaaaccgaaggaaaccggtcatgaagaatactccagattcgggagttgtatttatgtttgaggaaggtattagcacctctcacgtcgacaaaagcggggctcttgctcctacataccctccatcgaagaggaaatcagacctacgtatcgaactgtcataccctaatttcgtccggggacctttgcttgatgacatgcgacctttctttggtccttgtgag

SEQ ID NO: 71930 - DNA, 297 bp, Glycine max
  Peptide Sequence Number=SeqID_163615
cagagcccctcagctcatctacataggctggagcattgcctacaacccgtggctgaccagcaggcgaccaagtccaaagccaaaggtagcgcaaataccttagatatgcatgtagcaagataccttggatacgcatatgatcacaaaaagctcaaaagtcaagatcacttcatgataacaaagatgatgacattcaagaatgagttcaagattgagtcaagaacacttcaaggatcaagaggaaatttgatttcaagaatcaagaatcaagattcaatattcaagattcaagaataa

SEQ ID NO: 71931 - DNA, 102 bp, Glycine max
  Peptide Sequence Number=SeqID_163616
atggcaaggagcagaatcgtctcaggccacggtcagaagtcaagacaagtcagtggcagaaatctaccaaggtacttagggatggaggcaaatggaggatag

SEQ ID NO: 71932 - DNA, 1170 bp, Glycine max
  Peptide Sequence Number=SeqID_163617
atgttaagaaatgagttggagcttatgaataaatcacttgaggaatctgaggctcagttacagagtagaacagtggaaagcaatgagctggtgagccaaattgctttattgaagaaggaagaagaaaggtcactcgataagctaaataggatgaagaatctcaagtatgaaaaagagttggcaggtagagtgttgcagccagagttagaagcacttagaactcaatataatgacttgaaaagttatcttcttggggatgaggctgagaaagaaaatgtgagaaagcaagttttccagctaaaggactataacaagttttatgaagccttctctaacaacctgaaacttggtcttgatgaggattctcagaacaagacaaagctagctgaattgctgaggataagggatgcaaacaaagtcttgaatgagatgactgaaagtaaaattgaagctcagaatatcacaggcaacacactaattaatgcttactacaagtttggagaattgaaatcagctttgaaatttaagaacaagttgttagaagctggtctaaaacatgatccatttacatatgaagcattaattcatgggttctacaagacgaatgaactagaaagggcaaatgagttaatgatcaacatggttgatgctggatttacacccagttattgcacattctcatggattggagatggctacaataagaaagacaatatggatgcagttttagcacttccagatgacaatgtggctgatgcattgttagttccggttacttgtagtcaagatgttctagacttgatgagaattgttcagaagaaccgtgttgtaggtgctacaggaagggagttagtttccaactccattgttaaaggttgtgttgatgttgtggatttggctgaattggaccaatctaactcagtgactgagagtgtttgtggtggggttcctatgatctgcaggccattctttggtgatcaaggggtggctggaagattgatagaagatgtttgggagattggggtggtaatggaaggaaaggaagagggaaagaagattagagacaatgctcttaaggtgaagcagactgtgcaagatgcaactaggcctgaaggacaagcagcacgggatttgaagactttgattgaaataatttctactacatcttaa

SEQ ID NO: 71933 - DNA, 339 bp, Glycine max
  Peptide Sequence Number=SeqID_163618
atgacccctactcatgatgccctgctatattacaatgtgaggtggaacatgtcacgccaaaatgagtttgttggttactcgttcacaggaaaaaatcccaaaaactttgacattctcaccggatgtaccatggatgaactgaaggatttgatcaaacaagttgtgtctcgtgggattcccccttatggtgttgatgaaacacaaatgtctcttacggatcaagttgatccggaagttacagatcaagttgatccgggaagtctcttacagatcaaggtgatccgtatgttgatccataagaaacttacggatgaacttcatccattgacatgtccttaa

SEQ ID NO: 71934 - DNA, 849 bp, Glycine max
  Peptide Sequence Number=SeqID_163619
atggaacagctaggaaatgttcaatgtctgccaactgatcaaaacacactcaataagctaatggctctgaatcctggattgaacaaccatataaacaactctcataatatggtaaatcgtggtgctttgagtgggtcagcccaagcagctttagcactgaacaactaccaaaatcttctcatgaggcaaaattcaacgaattctagccctggctcacttcagcgggaagggtcctctttcaataattcaaaccagagtccctcttcagctttgcaaggagctagtcctgctttaatttcaggctcaatgcagaattcatctgttagtggtttcccaagtccccatctacccccacagcagcagcaacaccacctacaacagcgctcattaagttcaaatgctttactgcaacaaaatcatcatggttcccaaggaaatcaagctctacagcagcagcagatgatccatcaactgctgcaggagatgtcaaataacaatgggggaatgcaaccactgtctcttggtggacccaatgcaaagaatgcaatgggttttggaggccatactccatccttaagcggaggttctgccaatgttcctccatccttaagcggaggttctgccaatgttccaggaaacaatggacctatgtcaaggattaatagcttcaaaacagcttcaaatagtgattcttctgcagttggtggcaacaatcgattcaaccagagaacatctgacatgccacaacatttgcaaaatgtggttcaggatattggcaatgaattcacggataatcccttcttaaacagtgatcttgatgataacatgggttttggctggaaggcatga

SEQ ID NO: 71935 - DNA, 1746 bp, Glycine max
  Peptide Sequence Number=SeqID_163620
atgtctgaagtgaagaacaaagtggatttcatccagttgcttggacctgacatgtcaatcaagattctcacccatttggatgacccttgtgatcttattcgggtttcggctgtttccagttcttggcaccgatttgttattgaacaaggcctctgcaagcaactttgcttgaaaatgtttcctgaaatatctggtgttgctcatatcgttgaacttgacaacattattgaaccactaatcaacactcttggcagttatgtaaattgggagtctcttaagagaattcatagagtctatgcattcttggcttctggtcttactcctatgaggaaaaattgcatctcaaaatctattagtgcatctagcactgataactacccagaagaaagcattctacatacattggagcctggggatagaactcaatatagagcatcatactggtcaagcaaaggggaaagtcatccttctgttcctgagactttagtttataagcttgcttcaaaattatgtcttgttacggaaatctatgtccatcctttccaagcatattttcagcatggcttccctatatactcggctaaggctgtccgattcagaatgggccatccgagacacccaatggaattagagagtgctgtggataaaatggctactaatgacgtcttgggcgataatcaatttatatggacatatacttcacctgaatttccaatgtttcaagtgagttgcactatcaaaatgcagatggcatcaacctctgatgtggtggattgcttggatgaagaagcttttcaaaatgttggtggtgcaaatgtctggacacatggtggtgctagcaatattatgaaagccctaaatccggcctttgatagcaaagaggaattgcttgtaccctcttgggacctcagtcctatgctctggggcacacttcagttatcatccagatggagtatttatgccaggaacaggggaagtagagctacaatgtgctccaccactaagcccagtggtcatagggcatacacacaacaaagcggcgagctaggcagctgtcatatcatgaatttggcagaagggaaaagggtagatgttttcagtgtggccaactatttggtcttcatgcctaggaggaaggacagtgggaaggatatggctactatcagatcttggttccccaatttcaccattgtggacaaggttgaaggaacggtattgatagagcctgatgagttgtttgttagttttggaaacagatcagagactgctgtcaaaggagaaactcttgaaactcagaagcaggattctctcccatttctgttgagattcaacaatccttcacagttttgttctctttctctctctttagctttctcagttctttctattgtggagaattgccgtagctttgcatatctgttttccatcattgataaattggattactatgtgcacttgtgcagcatctcccatgttcaagccatgggacgatcaatttcgccagaatttgacgtcaaaattcatcatccgtcagggaagtgtaccttgaaatactgccctcaaatagattgttatgtgtcttcttcaacatcatcacagagaagtgactcaagcaatccgtcgcgcttgcgaacaataacctcaaacataatgcagaggggtgtgagacgttgggagcaatttctcttgagtgcgctgcttggtactgctactgatcctgttgtagttgataatgatgatcaatga

SEQ ID NO: 71936 - DNA, 168 bp, Glycine max
  Peptide Sequence Number=SeqID_163621
atggcacaagttcttttggtagttgaacaaaggataagaaccaacaagtggcgccgtctgtgggaagatcaagatcaagaaaaatggaaacaacaaagtacgatattgagaagttttcagggaaaaatgacttcgggttatggagaatcaagatggaagcaatcttga

SEQ ID NO: 71937 - DNA, 471 bp, Glycine max
  Peptide Sequence Number=SeqID_163622
atggtatctatatatggagatgctcaatctaatgacccgaaagcaaaaatgttcaagagtgttgcatatcttcaacaaatgtggtgggttgaagtaataggggagctagagtttgagtttccaaaagggaactatagtgtattttttaagcttcaattgggaaagccctcaaagagattgggccggcgagtgtgcaaccttgatcaagtgcacggctgggacatcaagcccgttagatttcaactatctacatcggacggccagcgttcactctcccagtgctacttgcgtgggtccagagaatgggcctactaccatgttggagactttgcaatcgataagcccaatggaccaaccaacattaacttttccttggcccaaattgattgcactcacaccaaaggtggtctttgcatagatggggtagtgatttgcccaaaggagttcacacaaggattgaaacaattttag

SEQ ID NO: 71938 - DNA, 757 bp, Glycine max
  Peptide Sequence Number=SeqID_163623
atggttggagcattctcgcaaaacatcgtgaccctgactggtctccctatgatcttacttagtgagagtgacctgacaaacccattgtgtggggtagagggtgtcacgcgcgtctccatccccttggcttcggtagtcaacacaagaactcaatcctccaagttcttgttgtccccaaccaacttggtgttagcctgcaacgctgagttcagagactctccggccttcaatagcttatccttcaaggcatcagcattcgaggacccctggagatttggcggcgtcatcgctcttgctcaacacttgcctcccgtggtcaaagatcattgccggagggatgagacggtccaactaaaagaccttaacggaaaaaaaccttggttggtcaaggccgacaagttggccaagagctcccctccttatgatcagaagcctcccctgagccactccggtgatcgcagtgactcctcttcttgtgcttgtgcttcccctttgggtctttacagggaggaggcaccacatcagccagtgcatcacgtggccccggcggaaggcgctcatgtcagcaccagcttgcgtcatgattcctgcaaaataacacaagtgataaatgcacaagttaaagcagttgtcaagggagcgtttcaaggaactcaaggtctcaccattcgttggctctcagaagctccttcgggtacttgtcatatcgacgagggcattgttggtagtagaaaggaaacaatgggtttcccgccga

SEQ ID NO: 71939 - DNA, 867 bp, Glycine max
  Peptide Sequence Number=SeqID_163624
atggctgagagaaagggacctccatcccctactagagatcataggatgttgttagatgccttaagtcaaaggatgaaccaagttttgagggagcatacggagggaatgtatgaaaggcttgagagtttagaaaaccaaaatctgaattgggaaaatgagcaacatggagatagggatagacatgagtttgaggctccactagtcacatcgtggactgaggaaaatccagggaggcgtttttatggttgtggtctatacaaggatacaggtaggaaagggtgtaatttttttcagtggcatgatccagttggcaacaatcgtcaaaagaaaatcattgtagggttgatgaaggaggttgatgaattgaagttgagggaaaaggatttgcaagccatgattagtgacatgaagatgaaggaaaaatgtttatggattgtattggttgatggtcatgtattaaccgcaggcatttacatgtggcatgacacaatttggaagggtcgcggtgcaccatgcattgactgggaaatttcaattgtccaaacatactctcttgagaacaagagtggcctcccgcaactttggtgctgtagatcggggtccatcgacaaagtagactttgttgtgaagctgtctaactctgatataaaacggtgttccaagatatgtcaagcggacaaagctaggtcctctgttccaatcgtgctcaacgctctgcttcgatggttttaccacgacaaagacaatgctctattgctctactcaatggtactgaatgctgcttcaatccctaggcctagagggtatgctgggctaaccttcaatggcgaaacagggagacctcaaacacaactccgcgcctcctga

SEQ ID NO: 71940 - DNA, 189 bp, Glycine max
  Peptide Sequence Number=SeqID_163625
atgattcagagctttgcactagataacaacgaagaagtaatgatgaggacatcaggcttcaatcccttcttcttcacgtttgagaaccctatgcaaccagaggaaaaacttgaggaatctcaagaaattgttagagattccgctatcgctgtcggaacatacatgagcctggttagaggtaacggatga

SEQ ID NO: 71941 - DNA, 591 bp, Glycine max
  Peptide Sequence Number=SeqID_163626
atgaaaactggtgttaagatcattcacccaagttcctattacgggaaagttcctgttactcgcaaaggaaagagattcgtgaagccattcaaggttacagaggatatggatattgatcatcttagacttcccaatttgcttttgacttcatgttctgttttcaatgtttctactgagtggcctagctttcctcttggtgtaaagtttgatccttctgatgtagaactcttagaacatttagcaacaaaatgtggcattggaaacactcagcaacacatgtttatcaatgagttcatcccaagactcgaaggagaccatgaaatttgctacacacatccagaaaatcttcttggacagaccaagaagacgaaagctataatagaagatggaaaagagaaattaaatatatattctacctctgaaacaagccagtataaaaaagataccaagacaatccctggagaatctcatgctccaaaatcagatattcaggatcaagactttcctggcaatgctgcatggttagctggcgaatcgcgggctgaggaaagcaccgaatatgatggctgtgacgacatcttattgtgctag

SEQ ID NO: 71942 - DNA, 528 bp, Glycine max
  Peptide Sequence Number=SeqID_163627
atggctcccgaagacctagagcagctgatgcaacaaattaaggaccagctggaggagtcgatcccagaaaaaggactcgcactgcctcctgagcctaaggttggtccttcaactgctcatgtcagcacaaatgagagttgtgttgatcccttagggaacgatccagacacgggtgactcagataaattcaaggttggtgttgaagaggttagagatgtagatgctcccattcatgtacccactgcagaggttaagttagtggggcatgcacttaacaccttccttgcttggctgacacatctttttaagcgtttatcagaacaagttttgtgcgatgctaccgtgttcaggctgtttaatgaagactttcccttgtacataaagcatgaagatctatttgaaataccacacgatggtcaatgtctcaacatctttgttatacagttgcggattctgccagacaattacctcaaaggaataattaacagtattccaattatgctagaccattggaaccagagagattga

SEQ ID NO: 71943 - DNA, 1074 bp, Glycine max
  Peptide Sequence Number=SeqID_163628
atggtggccacaagcacaaatcaatcagagttagaaacaagtaagaaggattccacttatgacagaatagctgaagtcaaagcctttgatgaaacaaaacttggtgtgaaaggcctcttcgattctgggatcacaaagataccacgcatgttccatcatgccaaggtggaggaccacactgaaaccacgccaaatgactcgaacttcagtatccccatcatagatctccaagatatagacacaaactcatcccttcgtgtgaaagcacttgacaagattcgaagtgcatgcaaggagtgggggtttttccaggtggtgaatcatggtattgctgttgatcttttggatgagatgatatgtggaatccgtaggtttcatgaacaagatgctgagggactcaattgtttttttgttactcctgatcctccgtatcccgaagaaataccagcagtatgcagagacattgtgattggatattcagagaaagtaagggcattaggctttacaatctttgagctattctcagaggctcttggccttcattcttcttatcttaatgaattggactccgttgatggacaatatcttttgtgtcactactatcctccatgccctgaacctgaattgactatgggtacttcaaagcacactgatattagcttcatgacaattcttctgcaagaccagatgggtggtcttcaagttcttcatcagaatcaatgggttgatgttcctccggtgcatggatctcttgttgtaaacattggggatcttctgcaggtgaccacaacctcatatcagttagagttaaaaacaggtaaagattccacttgtgacagaatagctgaagtcaaggactttgataaaacaaaaattggtgtgaaaggcctcttagattctgggatcacagagataccacgcatgttccaccatgccaaggtggaggaccacactgaaaccacaccaaatggctcaaacttcagtgtccccatcatagatctccaagatatagacacaaactcatcccttcgtgtcgaagcacttgacaagattcgaagtgcatgcaaggagtga

SEQ ID NO: 71944 - DNA, 555 bp, Glycine max
  Peptide Sequence Number=SeqID_163629
ttagcgattatatctgaagagcaagagagaattactgagccagtgtcacatggtccagcatcagagcgtgaattcccagcccaagagtttcatattcttcaatcaagtgttgaaactcggggtataggcagacgaagggagcctgttgaagcggaacaatattcccaacaaatgatggagtgtggtcatggaatgtattacacgccagcaacattttccgaatatcgttcacagatgtatcagtatccttttgcaggtcatcatactgatacttttgagacctcacattcgttcggtggtgttgcggaaacacagcctcatttttcatggctgagcaagcagaagcggggagacaacgcggcggcagaagaaatcctgatcgtcaagcgcgaagatgggatcgaccatgcggcacatcttcacgacatcacggacaccataatgactaattttgatggtttaggggtttatggattatgggttagtgtggcctatggcttggggttacggtttatgtgtttaggtttagggttagagcttatgggtttggattag

SEQ ID NO: 71945 - DNA, 360 bp, Glycine max
  Peptide Sequence Number=SeqID_163630
atgacgtggatgccgccattgttgccggcgggaaagcttgtaccgccattgacaactgcgggaacaaggatcccgccattggcaactgcggcactcagcctaaaccgccagtacgaacggcgggacaggctgagtaggagagagagaggatgtaccgctgatagcaacggcgggacgaggagagagagaggatgtcccgctgatagcaacggcgggacgaggagagaggctgtgccgccgttcctcctggcgggacatgccaacgtggcagtcccgccactgcctcctacggaacaccttgacgggaaagggcacatgcatgctgaatcatttttatgcagtttatgcaggctaggctag

SEQ ID NO: 71946 - DNA, 438 bp, Glycine max
  Peptide Sequence Number=SeqID_163631
atgcgaggtagaaccgcaactggagatttagctcctatcaacttggaaattgaagccacttgcaggtgtagcaacactgcaagaaaaagaaaagagcaagaagcacaaggaagcagtcaaacctcatctcctccctctccacaaagctacattcaaatggaagaggatcatgcacgacgaatgacgctagaggactactctagcactacaactccacaattcttcacaagcattgcaaggccggaggttcaagcggtcaacatttcttacccttattctctcatacagctaatacaaggaaacatctttcatggtctaccaaatgaggattcttatgctcatttagccacctacatagaaatttgtaatacggggaagcaaaaaggtagctacactcctttaagggtaatagcttgcgtacttaggaagaagtcgtag

SEQ ID NO: 71947 - DNA, 396 bp, Glycine max
  Peptide Sequence Number=SeqID_163632
atggaaatatcttcattccatcaatttccaatgaatccctcaacgaggcgcttgaccgtttccacggactactcagaaagatgcctacacataggatacagtgagccaatgcaactaaacatctttataaatggcttacgaccacaatcaaaacaactccttgatgcatccgcgggggcaaaaatcaagctgaagataccggaggaggcaatggagctgatagaaaacatggcggctagtgatcacgccatcctttgtgatcgagcatacacgccaacaaagagaagccttttggaactcacagcccaagatgcaactttggcccagaacaagctattatcccagcagatagaggccctaacagagaccctcagcaagcttccgcaacaattataa

SEQ ID NO: 71948 - DNA, 1695 bp, Glycine max
  Peptide Sequence Number=SeqID_163633
atggaagtccaagtgaaattctcaccaatgcgtgccatggttttcgagataccgaggtggccacctggtggtcatggggttgtccagaatacgctggcggaaaaattggccggcggggagagggtccatctggcgggagaaggagtctgccaccatgttggccttgccggcgcggctgcggtggtcggtgagaatggtgaaagggtgccccaaaaggtattggcgccattttttaatggcggtggtgacggcggcgagctagcgaacataggtagaggcgtgcaagagcttggcgaagaaggtcttgctgaaaaaggtgatggggtggttctgctgagagagaacgactcctatctcgacgccggaagcatcagctttgtcagccatgtcattccagcagaaggcatccttcgcaaggaggagggggtgggccattgctggaccgcctcgattttagctggtactgggtgtactccccccggggagacaatatggcccaagtactccacttctgaggtcgcgaagaatttggaaggtggtctgaagatgagtcaagtgctctgggaaggggccaaaggtagagtttattgtagcttggaacgtagatggggcgttgcaaagcccaaaaggcattacgaggaactcgtaatggccatgaaccagtttgcaccaccaagtttgtctaaaagttcatctattgtagggattggaaaacggtccttcacggtcaagtatgggtaccggtatggtcggacgttgaccggggaagcgcaaggagtaggtgtatctggtgactcaaagatgaaagaattcattgacggcgtcggtctgaaccatacgacgcagctgggtgggggagatagcttcaatgtaatgggtggtatcgccgcgaagttcgatgatggtcccaatgactttaaccagtggactccgaggaccacatcggcgccgcaaatgggaaggacatggaggtccagggtaaaggggaggggtgggttgggtggtgaggtcaaggtggcggacgaggcgggcctgcatgaagttgtgcgtgcttccgccgtccaccagaatgatcacggggcggttagcaaggctcagctggggcatttgggtcgtcctcatcagccactaagagaaagaaccgagaggcgcagcgatgccctctcgcggcgaaagggaagtgggggtggtttcggtggagtggggagtaaaggggtagacgaagagggtgaggaaaaaacattagggttgggtggaggtggtaaaggaaggggatttgggggtggaggaagggtgaggggttgtaacgcctgcacctcgcagcggatgtcggggtccaagcttgagatgaagcagctaaggagcatggagggttgcagaccgacaatccgattagccagggattcgaactggttgagaggatcccgatggggtcctcgtaaggtgaaggtgagaatcgtgcctcgagtgcttctaaaaaaccagcccaagtggtcagctagtggtttcgggtcatccactaaaaccacgctaacgctgggccctccatgtgtgggtgaagaggatgagggatatgtgtttgagtgtgctgtctgttcgagggcggaagggttatggtcagacatgggaggacgaaatgaaagcaccaattttgttatgaacaaggaaggggggaacctagctttcgagacctag

SEQ ID NO: 71949 - DNA, 264 bp, Glycine max
  Peptide Sequence Number=SeqID_163634
atgacactcaatattcttgtaccgggacctaaacttgcttttgctcttgtctctatcacccttcatatgtgccttcattgttcaagcaactttgaacaccttcaccgttgggatgtgagaaatagtattcgcgaagagagaaaacggaatcacacaaagacaatacaaaatggaggcttcaatcccttctccttctctctgatgtttgggaaccctatcagagcaattggaggaaaaactagaggaatctcaggaaaccactag

SEQ ID NO: 71950 - DNA, 237 bp, Glycine max
  Peptide Sequence Number=SeqID_163635
atgaattacttcgacgatggtcttggtgacgtcggcagcagcgcgttcggtttagtggcctcaggccatgatgcgatcgaagagctccccgccctcgcaaagctccatgacaagatgcacaaaattatcgtccttgaagaaaagggagaaaatgggactcaggaagagttgagtgagaagaacaggaacgtaacggacgcgaaatttgtgaaatatgaacgaacgccaaatttgtaa

SEQ ID NO: 71951 - DNA, 1458 bp, Glycine max
  Peptide Sequence Number=SeqID_163636
atggttagaacacgaggtttaggtcgtgcgttaggagctggtagaggtagaggcattagtgaggatacgcatgaggttgatgttcctctgcatcgcagacttactgcttcagcacgtaggcaacgggttcgtctgcgtgaggacgtgacagagagacatgaggatgtgcctcagttgcatgaggatgttcctcatgtgtctgatgccacccaagagatgacaggcgccgccgatgctgttcagacagagggagtggctactgatgggagcttggggtcacctgctgcagatgagggtttcctcggtggaccacgcgacccatcgattttgaccgattttgccgagcatgtcgcacacaacatctggagtggacaggaacgacccgatctgaagttggtctcccacggtagaaaagtagataaaattgggagaccagcgcctgagatcgaagggttgattgctggcaccggattgagtccactgatcaggtgttctgttatcaccactgatcctggactcatatccgccttcgtcgagagcttcttgaggtcagtcatgaggaggctacatttgagacctgacaggctagtgggcctcatgtccggttggggtggcttcgggacttgtatcaaagccagtgcaggaccagacgatgggttgttgcagcttgcacgtatctgctccacttggtgggctgtactcttttcgccaacaagagttcaacccatggacctggcccaggcaaggggatttgcctggggagcgactacattagtccacatgtacgaccatctgaatgacgcgtcgcaggcctctacacgacagctgggcggttatattacacttctccagtgctggatatacgagcactttcctatagtgcatacatccgtcgtccatgatgcttatgatgacgggagcccacgggcctgcaggtggcttacgggtaaggctcatatgacggggatcaagggagttccgtatcggagacgtttggatgccctgaatgtgactgacgtgtgctggatgccctatggttctttgacgggtgatgatatagatgaccggtggctgcatttttcagaccatttggtgccttcaggggagctctgtgtagttcctggacaggtggcgccagactacatgaagtggttttttcggatatcgcacccattcatcacgtggaccgaggagactgctacaccgagacatccgcctccccctcatcatgaggagttcgtcgagccacccatccccgaggttttagtcgcgatcaatctccctacgcattcagtggatttaggagcgattgctgaggatttggagcgggtcatcaacctcaggatggtcattgagggcactgacttacatgacatcatgactcgttgtctgaggagagctagaggtgacaccgcatatgaaagtcttaggccgcgccagagacgccgcatagattag

SEQ ID NO: 71952 - DNA, 219 bp, Glycine max
  Peptide Sequence Number=SeqID_163637
atgcccttttgcctatgcaacgcccctggcaccttccagcggtgtatgcttagcattttcagtgattttttagagagttgcatagagggttttataagcgttttatcaaggattttagcaaggtggcccttccactatccaatttgctgcgcaaggaggtggagtttgattttgattaccggtgtaaagaggcttttgattgcctcaagcgtgcaatga

SEQ ID NO: 71953 - DNA, 1023 bp, Glycine max
  Peptide Sequence Number=SeqID_163638
atgatgggaatgaggaatattagtagtagtaataacaataataagacaaatggtcattcttccatcatgaacaatggaggttcagatggtaacagagctgagccaggttcaaaggaatgggagatgaggccaggtggaatgttggttcagatgagaactgctgattcggatcggaacccagcacttgtgccaacaattagagttaggatcaagtttggttcaatttaccatgaagtcaatattagttcacaagctacatttggggagttgaaaaaaatgctgtctgggccaactgggttacaccatgaagaccaaaagctgttttacaaagacaaggagagggattcaaaggcttttcttgacatggttggggtgaaggacaaatccaagatagtgctagtggaagaccctattagtcaagagaagaggttgttagagagaaggaagaatgctaagatggagaaagctgcaaagtcaatctcagcaatcagcttggaagtagataggcttgcaggacgggtatcagcctttgagtccattattagcaaaggtgggagagttgtggaaacagatttgcttaatctgattgagttattgatgaatcaattgcttaaattggatggtatagtggctgatggggatgtgaaactacagaggaaaatgcaggtaaaaagaattcaaaagtatgttgaaacacttgatgtgctgaaggttaagaattctatgtctagtagcaatggagaccatgccacagtgcagcttcaacagaagcattcaaatgggcaacaacaaaagcattcaaatggacatcatagatcagccttagcaccaattcaagagcagcaacaagaacaagaacaacccccaaggaattccacctcaggagttgtagttaccacaaactgggaattgtttgattctgtcccaccattaatccctgtgccatccacatccccatccccacatccctcggagaccaataaatcaggtcctcccaagttcaattgggaattcttcaactaa

SEQ ID NO: 71954 - DNA, 396 bp, Glycine max
  Peptide Sequence Number=SeqID_163639
atggaggattgggggattttctccactgaatccttgaggaggattctgctccaattaaagtgttcctcttggtgtaggggttcgacggcaagcaacagcgactcgcggtggtcaccagtggtcgtgggtggtggaaaaatgaagtgccaaatctcactcagcgcaattccctctcgagttggaattgtgcttagcgcgcccttctcgcttagcgagacatcaaaggttgttattttcaaaatcccaacagtcagactgtggaacaatgtcttaggtgttactgaacactcaattggagttcatagttcgttggagaatataagtacccagctagaaaacattgagactaggttgagccttagcaacctccttaaccttgatgaggatgaagcttag

SEQ ID NO: 71955 - DNA, 63 bp, Glycine max
  Peptide Sequence Number=SeqID_163640
atggagcttagatcagttagtcctttgaatctttataaggggaaacaaaagatatctcaggcg

SEQ ID NO: 71956 - DNA, 416 bp, Glycine max
  Peptide Sequence Number=SeqID_163641
atggtgaagaagaccaataagatcctttttaaaggagttgttggtgctaatggactttactcctttcataatctcaagcttcaagagagcccttcactactgatgtctgcatctgctgtttcaagtgctgcctcttcttgttcagctctcactattaataataatagctctactgtaatgtctaattctgtttcttcttctttcagtattgctaatctatggcatgctaggttagggcatcctaatgatcatggttttgtgcttgttgtatgggtaaatcttagattaccttctcatacttctacttccgtttattctcctgtagagctcatttttacagatttatggggaccttctcatattacctcatattctggttataaatattatgtctctttcattgaagctttctctag

SEQ ID NO: 71957 - DNA, 459 bp, Glycine max
  Peptide Sequence Number=SeqID_163642
atgggcccagttttgccagactcgcagagacccttcttgggaggatgtgcgaaagaaggcacaggtcatccaaaaatagaacactgccccccacattttaagctcctcgctgagaagaccaagaagaagttggaggaagctgcacagtcaggaagcgttgatggcgtcatcgaccctccatcccccgtcaaacgccacgttaagtggaagatgacccgcaccaagaaatcaggggagatgacgactgaggccgcaaagcaaatcgctgagaagatcgcgacaccgggatccttcgtcccccatggacgtcaggatgttctcaccgctgctattggacgtccagagcaccctggacatgttcgtgctgttggaaccggtgtcaccatcaagcaatacttcggatcggctccacggacgtcccgcagctcttccttgctacctcctgaagaagtgcagtag

SEQ ID NO: 71958 - DNA, 964 bp, Glycine max
  Peptide Sequence Number=SeqID_163643
aggtcatctagtgaagtttgacgaagacgccctcaacacattcttgaagaaccctatgatcattgaggaaggggaaacactacctgtttattctaggttcgcactcctaaggcttgatcctcaggaattggcagccaagctctgtatcccagggagaggatttgagcttaatgctaatggcttgccattgaagatcctcagaaagaacctgactaccattgctcagacttggagcatgctttctttctcaaacttggtccctacctcacacacatcagatatcactctggatatggccaagttgatttatggaataactcagaggatggacatgaatgtgggctacttaatttctcatcagatctctatgatcgctcagcatgactcctctaggcttgggtttccagccttaatctctgctttatgtaaagctagagaagtcacttctgattctaagatgctggagaggtctaggaaggccatggggaagaaatctgagactctcccatcttctgaggttccccttaccacatcagcttcttccacatcaacaccagcttattcccaactacttatagatgctacatgccatgatgcagagcctacaccaagggtaggtcattattatgcagagcttctagagcttgggcctgccatctatcatgagcatggaagactttcacacttagcccaagagcctgagcccacagcggagcatacaccagcagcagaggatgagctcacttctcctgagcccttttcatttgcttttgattcagttgtggctcaagaggaagtaccttcaccagagcctattccaaagccatcccctgcacctatctctgaggataccctgccatccgtaccagcattggagcaagagcagcccatttcacaggatccaccagctactccagcgctagatctgaacgagcatgcagaggatcacccacaggaggattga

SEQ ID NO: 71959 - DNA, 331 bp, Glycine max
  Peptide Sequence Number=SeqID_163644
atggctccgaaaaagctttccgcaaagaggtctaggagagacgccgtgactgaagggaccagtgccgcccccgagttcgatagccaccgtttccggagcgtcgagcaccagcagcgctttgaggccatcaaaggatggtcattccacagagagaggcgcgtccagctcaaggaggatgagtacacagattttcaggaggagatagctcgtcgacattggacgtcgctggtgactcccatggctaagtttgaccctgaggtagtcctggagttttatgctaatgcttggccgacagaggagggagtgcgagatatgcgttcatgggtgaggg

SEQ ID NO: 71960 - DNA, 558 bp, Glycine max
  Peptide Sequence Number=SeqID_163645
atggaaacatgtccaatagcagaggagttgctgcagggattgataaacgagggtcaaatggaaatctgcagtgcaaataaggaggaatggaaggcatgcatgcaatcaggtgacaaaaacccaagtaagcctaaacctttggtgatccatttcaccaaggacatcaccactcagaggcctcgaggtttccaaccttctatagcaaagacgccaacacccttcccttacaagagtgataaggcagtgccatggaaatatggcgtacaggggcccgacggaaggaagggcacgtccatcatacgtgtcaggaatggcataccggctgctatgatcataaatattttcggtacgagtagcatgacttgtagtggatgcatttttgctcctcccaaactaccggcaaggttgaaagaaaaggggaaggcaaaggcggatatagatgagagggagaagacaggcctgactgtgaatgacaaggcccctattggaaagattgcaaaggaaggagacgactttagcaagagagagtatcagctgaggaggcgactgagtttctga

SEQ ID NO: 71961 - DNA, 594 bp, Glycine max
  Peptide Sequence Number=SeqID_163646
atggtggtatgggcttttgacgacagtcgccacgacgtaagaggggagatcgatctcccaattcagattgggccctacacatgccagatcacttttcaagaggaaggaatccttgtgacttgtccctctactacaccatatgtggaagccaccgaagaatccttggaggcatccttccaagctttggaagtggtaagcaacgcctatgtcgagtctctcccagtgcaaccccgctcattcagtgctgcattgatggtagctcgtgtaatgttggggcatgggtatgagcccggaaggggtttaggttggaacgacgacgacatggcaagtttggtagagttcaaagagaaccgtggaaggtttgggctaggatataagcccgcatgcatcgaccaaggaccgcaagtgggagggactcccttaggtcatatcaatgatagcttcatcattacaggatggaagtgtgaatggcggattgccatgatcaacgatgaagacccagacgtcgattttgagaggctagtgaaaaacgttgaggatgaagaagatgaggattgggggcttcccccagaactccaaagaatggttgaatag

SEQ ID NO: 71962 - DNA, 453 bp, Glycine max
  Peptide Sequence Number=SeqID_163647
atggcacctaccaggcaccctttggatccagataagtccaacagggccctgggatttccctcgctgatcacaggactctaccagtcattcggagtccctgttgcacctaccaaggtggttcggccgcctatcacccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggcggccaaccaccgagtacatttcagggcagaagtcgcatggcccggggattggcccgaggcccaagcaggagtggcacccccagaagctcccggcgatggagaagaggcccacgaggacgaggagatggccgatttgcttgacttcttgggagggagtggagatacatga

SEQ ID NO: 71963 - DNA, 383 bp, Glycine max
  Peptide Sequence Number=SeqID_163648
atgagtgtcgagcagttcattaagcaggtggcctggcctagagctcaaccttcttttgatagtgataatggaagctctacagcccaggcacctcagcagcaaaagctagagccagaaaacaaccaatcctctgaagccactattcctggagcttttgatgttgcgaaaggtagatcacagatgagatctggggaggccacttatcctgagctagtaccagtaccagctgatccaccatccccagtggtggatccatcttctcccgttccagaagcatctctcccatctacacctattattatatctgatgacccttgtcataccctaatttcgtccggggacctttgcttgataacgtgcgaccattctttggtcctcgtgag

SEQ ID NO: 71964 - DNA, 137 bp, Glycine max
  Peptide Sequence Number=SeqID_163649
gcgagcgaggcgaggctcatgggtgcgctttccaaaggaggaaagatgcgcggagtcaccaccagcgaaggtattagcacctctcactcacttgaccattttggagtgacgacaatggagccgtttgaaattccagg

SEQ ID NO: 71965 - DNA, 326 bp, Glycine max
  Peptide Sequence Number=SeqID_163650
atggctgatatatttttgaaagagaaaaatagtttggaggttatgagtgatcagaaagaaatgaatctgaatagagttgtgaactggacattcaggactctatattatgatggtattgatagttctcgttgcggatgtgtaatgagaactacttatggtctttcttgtgcatacgagttagctggatatgttgttggtagcatacctctcagtgtaatccatatgttttggcggaggctaagtttttcataccaagggttatctgagcccaaagtcagcataaccgaagagatggaaaccatattcaagcggttgaagagcttgat

SEQ ID NO: 71966 - DNA, 221 bp, Glycine max
  misc_feature (8)..(8): n is a, c, g, or t
  Peptide Sequence Number=SeqID_163651
tgatcaangggttcccacggaccctaagagaataaaggtcattcctgattggcccactccaccaacaccactcatcgagttggtgaggaaccatgttccctcatgggaagatgtccatgaaaggggtgtcaagggaaggagccctgggtatgaagaacctcgggatttgaggtcaaatcctttccaaggtggagggcatgatgcaatcctaccccccaagg

SEQ ID NO: 71967 - DNA, 429 bp, Glycine max
  Peptide Sequence Number=SeqID_163652
atgaatcaaaaatctgcacctgtcgccagactctgtggtttatgctcctctgccgaccaccacacagacctttgcccttctatgcaacaatttgaagcaattgaacagcctgaagcttatgctgcaaacatcaacaacagacctcctcaacctcagcagcaaaatcagccacaacaaaataattatgacctctccagcaacaggtacaatcccgggtggaggaatcatcccaacgttagatggtcgaatccttcaaaacagcagcaacaacaacaaccttattttcaaaatgttgctagcctaagcagaccatacgttcctccaccaatcgagcaacagccccagaaacaacaaacagttgaggctcctccacaaccttcccttgaagaacttgtgaggcaaatgactatgcaaaacatgcagttttaa

SEQ ID NO: 71968 - DNA, 708 bp, Glycine max
  Peptide Sequence Number=SeqID_163653
atgaccactcttacacagatatggatgacattgctacttagcaacattctgctcagggaccacaatgccgatctccccctgctgaagtatcagttgggatcgcgcccacaagacacccagtggacccgaagaagtccaacaggaccttggggtttccaactctggttacgagcctctgtcagtcctatagggtgctcgtcccccccagcaaggtcatgccatcgtgacgtaggtaaggatcgcgcccacaagacacctagtggacccgaaggagtccaacagggccctggggtttccacctctgggattgcgcccgcaagacacctagtggacccggagaagtccaacagggtcctagggtttccagctctgattaccggcctttttcagttctacggagtgcccgttgcccccaacaaggtcatcaggccccctaataaccgggctttcatcaagaagtactgcgccccccaggcaagcgcagggcgagacaccacagtagcctggggatggccggcagcgggcaatagacgcaccgcctccaccttcaaagcccctcagctcatctacaaaggttggagctttgcctacgacccatggccgaccagcaggcaaccaagtccaaagccaaaggtaagcaaaagtactaggtccgtgaccgacaagtcatcacgcgtccagctcaagacattaaagaagcgctactag

SEQ ID NO: 71969 - DNA, 312 bp, Glycine max
  Peptide Sequence Number=SeqID_163654
atggggacaagtcaaaacggcaaaaggttttatcaagtcaagtttaaaagtctagatgtcactagcctcaaggaatttggacgattgatgggacccctccaaaggcaagccttccgcaaagtgtacaggaagatcctagatttggccgcagcggaggtatttacggaagctgtcgtatccctcgcccaatactatgaccatccgttgagctgtgattggagattcggcaaaagagttggatcgcatgaagcaaattcggaatggcgtagtgggcctgcctcagaaatacttggaagacaaggcaagggataa

SEQ ID NO: 71970 - DNA, 87 bp, Glycine max
  Peptide Sequence Number=SeqID_163655
atgaagagtaacaaaagtgaaaaagcaggattagagaaagagatggaaagaacaacgccacaatcttgggagattgatttgtcataa

SEQ ID NO: 71971 - DNA, 771 bp, Glycine max
  Peptide Sequence Number=SeqID_163656
atggctagtttgggcaacacagtattagcgcgcgtgcttcttagttctatggctacccttggattaacagcgtgcatgcacacagaaatgcccgcactcaatgacgacatccccactaactggaatcatcgcgctacgtcacaaatcgctcaaaattcgcagccatggtggcattcgctcaatgacgcattactgaataacatcgcccaaactgcattaactcagaatctgagtttgcaacaagctagtgagcgcattatgtatgcacgagctctccagcaacaagaattggcttcggagaagccgcaattgagtttctatgctggcccaaataacctgtcgagggctttagccagcaatggagcgggatccgggcagtctaatcaatctcaacttgtgtcttccggcgcctatctggcggggtttgatttattttgggaattacctctctttggtcaacagtcggggcaacgccagatcacccaggctgagctgcaaatctcagaggccgatttatctttaaagcaaatttcattaatctcagaaattgttcgtgtctatgctgaactagccgccgctgtgcaacgagataaacaactgaaaatgaccgagacaaattatgtgaactggaagacgtctgcaattaaaggcgttgagcatgcgattgaggcgccaaaatcatatccagcaggaaatcgcattgcaaagactggctgtcctatgcggattgaacgctccaatgaatacatggttgcaggagttgcaatctag

SEQ ID NO: 71972 - DNA, 363 bp, Glycine max
  Peptide Sequence Number=SeqID_163657
atgtccggaagacttcttgccagttcattgccttttgagagcagcatccttcattatctcatggtttgtatcgtgcttccaagatcttcaaaccttgcacaggctttgcgattaaatgctccatttccaaatctacacctagtcaccctcttccttcaacacttcaacatccctcttgattttgaaccttatgttccaatcaagagatcctttctaataggcgctgttgtgattgcatcctttggttatcaaaaagagcatgatggctcttgggtgaaaaagggtgctcgacccgttgatgaagaaggacatttacatggtggagaagattcctgtcttcttcaaaagattttggataggtga

SEQ ID NO: 71973 - DNA, 234 bp, Glycine max
  Peptide Sequence Number=SeqID_163658
atgggtgaagacttttggtcggtggttcgctaccatcttcttaaagaacttgggaatttctcagaagactatacccgactctttggtggcacgaagagatttgaggaattaagaatgtcactacatgttgatgggttaaccaagcattgttgtgatctagcaattatcatcctcaggcgaagccgtgaccaactccatatattagcagaatgcagcattacaagagcttcgtga

SEQ ID NO: 71974 - DNA, 167 bp, Glycine max
  Peptide Sequence Number=SeqID_163659
caccacccattgagttggtgtggaaccatgttccctcatgggaagatgcccaggaaagaggtgtcgagggaagaagcccagagtttcaagaacctctggatttgaggtcaaatccttttcaagggggaggggatgatgcaatcctaacccccaagggcattggatag

SEQ ID NO: 71975 - DNA, 723 bp, Glycine max
  Peptide Sequence Number=SeqID_163660
atgagtctgatgagtagtcttctacctcctcttgcttcttcttcttacataaacacagctcctaaactgaaaactactcacactccaaaccttgtacttggacagagggtcctacctaatctcctctctttggcccttgctgtaaccttagcctctcctttaccatctcatgcaatcccatccctcaattctcaaccccctccaatctccctcaccactcccttttctcaatccaagaatttggagcttggacttgaaaatggaaaaattagaccttgcccatcaatcaatccaggttgtatatcaacaaatcccaagtcatcatctttttcgtttccttggcttattccctcaaattcctcggatgatgctattcagaaactacgtgaagcaatcctgaagacccagaaaaatgtgaaatttcagcctgtggaagatactccagatggccaatatctacaagctgaagttgatggaggatttggtagagatattcttgagtttctggtgaaaggtgatgtggttgcatacaggtgtgtggcaatgaaagtaacttatgtgtaccctttcactactgcattcggagattcaaagggtcaagaagcaagactgaagcaaatcaatgaccagttgggatggtatgctccaaactcctttgagatgttgagttacacgtgcaagcttgttgagctcaagaatggtacaccctcccccttagtttga

SEQ ID NO: 71976 - DNA, 549 bp, Glycine max
  Peptide Sequence Number=SeqID_163661
atggaccttgcaaagggaaagtggaagcaaaacatgattttcaaggcgtgggagcgttgccgattaacttcaaggccacacttgaaactaaaatcactgtcagagaatgatgatgatgatcatcatgagaagaagaagaagaagaatagtcaaatagcccctcatggttgtttttcagtgcatgttggaccagagagaaaaaggttcgttgtgaagaccaaatacgttaaccacccactctttcagatgctgctagaagaagcagaacatgaatatgggttcgagagtgatggccccatttggcttccttgcaacgttgatttgttctacaaagtgttggctgagatggatggagaagagaatcataataataataataacatcattttccatggttctcgaagaagcttcactaccatggctaagcgttatggattcggaattgctcagaataaaccgattccattagtatcttgtaagttcgtaattaatgtgtatatttttttatacactgttgtagaatatttctggcttgtaaatccaacgtga

SEQ ID NO: 71977 - DNA, 219 bp, Glycine max
  Peptide Sequence Number=SeqID_163662
atggagattaattccccaaagctaatgaggaaacttggaaaaggaatccgaaaagcttttggaggggtgggaactaggaagttccctgcagtgcaaatgatctttaagaaggaactactgctgggaagtgttcactgttcatcgttagggcgaatgtcaataaacaatgaaagacccatgatggacgatgttattggagtatgcaagaacatctcgtag

SEQ ID NO: 71978 - DNA, 190 bp, Glycine max
  Peptide Sequence Number=SeqID_163663
atgcgcctgttgcccactactgtgatgcctcgccctgcgcttgcctggggcgcaatacttctcgatgaaagtctggttaatagggggcctgatgaccttgctgggggtgacggacactccctagaactgacagaggcccgtaatcagagctggaaaccacaagaccctattggacttctccgggtcctct

SEQ ID NO: 71979 - DNA, 387 bp, Glycine max
  Peptide Sequence Number=SeqID_163664
atgcttaacctcctcaccggaacaataccatcttccttcagcaacctcacttcattaaaacaccttcaactcgcttacaactcgttctcgtcgagtcacatactgagtcaactccgtaacctcaggaacctcaaaacgttgatcctcactggctgcaacctcctgttatgcgagttaactgggatgattccgaccgagttatgcaaattgtcactcaggtcgttgaatttatacgagaacaagctcgaaggggtcttaccaccgattcttgtgcattctcccaacctctatgagcttaaattgttcagtaacaaacttattggaacgttgccgagggatttggggagtaactcgccgttgaagcacattgatgtttcatttaactga

SEQ ID NO: 71980 - DNA, 381 bp, Glycine max
  Peptide Sequence Number=SeqID_163665
atgggtgtcattgaattgtgcgttgaagtagatattgtcggtgcttctgcgttgaatgtgacaaattcgctattatcatgtgggaataatataactgtcaatgaatcaaaagttctaagatttgcaataaatttagatgaagattctaacaatgatgattatatgatatctaattcatatgttgaggactcgttggatgaggaagaagatatcgatgatatatctaacacaaatgaagaagctacccgcatgatccaaccccttacaatcatgcaaccaataaaagtaacattaattggagtcatcctgatgaaaaagacatccatggtttcgatatggcatcaaccttcaatattggccaagaattatttgttggcatga

SEQ ID NO: 71981 - DNA, 351 bp, Glycine max
  Peptide Sequence Number=SeqID_163666
atgccactagggtcaaagtcactccgaaagtcgtggtcaatggcgacagaggaagcacacgaagatctaaaacccatcattgtcgcacttaggaagccattgccaatgggtgatccaatggagatgatgggtggtaaggcgaaggatgagtttggtgtaaggatcgtcaatgatggtgttgggctattgaggcttgggtcgatggtggtattgggtggaggtgggacctgcttgggagaagtaggagtatttgtgtttgttcaggtctcttgggtggttcaagaaacaaaaagtgaggtgcaggaagcatatgccttaacaatggtagctagagttggttcgtatcattag

SEQ ID NO: 71982 - DNA, 255 bp, Glycine max
  Peptide Sequence Number=SeqID_163667
atggagaaaggtacgagtcttcctatggagaaagatatgatgaatgcaagaatgaaggatgggagtggcaatctatcttttgtgcttggacccatctcaaacaggctttccattatagggttggtaaagaggagaacatcactcacctcctcggcttaccctgatatcaatcctgacttctacaacctagttggcccaaacagcttcgtcaagacaaccacatcctctttgcttgtccagcaggggcctaactag

SEQ ID NO: 71983 - DNA, 753 bp, Glycine max
  Peptide Sequence Number=SeqID_163668
atgccgatatttgtagtcaaggcagatggaaaagtgatatattcagataaagtaaatggacactttatttgggatgttgctcctgaaatgtgtgattcggaatgctcctacgatgaccatgatgaagacacgaatgatgaagatgaagagtttccatctcttgatagaaagacaaacccagtgacaaaaatttcaactaagtctcacataattcctacagaagtaggaccaaaagggaagcttaaatctcttagccaagctgaagaagtcttaaactggcaggcagataatgctagagcccaaaatcatctcttgaagaagataaatgagaagattgacaagatctatacccaagtacgcacaaatgatgaaaggttacaatatttgtctgaaaggatgaagaagcaatatcatcaactttccaaagaaatttcttatcttgaagaagaatggagaaaacccatttttggagcgatttcaaacgccaaagaaagagaaataaggaggtttaaagcccaagttcaggatttggatcgatacataaagttaaagatgatagaaaaacaaaaatttgttagatccttactcctttttagccccctccttctcctacttgctattctccattctagaatcctccagattatttttcccaaagctagttcatcacggtctttacctacaacttctgcctataagaaaaaatcagaactaccaaagaaaaaacctgtaaaattaaatatctcttcctaa

SEQ ID NO: 71984 - DNA, 219 bp, Glycine max
  Peptide Sequence Number=SeqID_163669
atgaggcagttggttctagagcaagctagtgtctgtgggaaaaagggtaggattagacacaccctcagttggaaaagacacatagaagaagatactgcatatgattggagaggacaattcaacatgcgggtcgacacagagaaaacaggtggaacacaaaatccacatggactgtctatatccatagaggcaaagcttaaggggaaaaaatttctttaa

SEQ ID NO: 71985 - DNA, 543 bp, Glycine max
  Peptide Sequence Number=SeqID_163670
atgattcaccaaaacgatgccgagaaaacgacgaggaggccctcttccgcgccactggaggccactaaggaggccctcttccggatcccaagcgcgatcctcaacctcatcgacaaggactatagcgtcgagctcgtatgcggcaacttctccgtgatccgcctccggcagggcgacaacgtcgtcaccatgtacgcgtgcgtcgctgacgagatccaatggccgctcacgaaggacgtcaccatcgtgaaagtcgacgattcacactacttcttctccttccatgtccccaagggttccgatcccgatgaggaggaagaagatatgctcagctacgacttaacgatcgcgtcgaaggggcaggagggattactgaaggaactaaatggaggtttcgccgaaagatttggagtcaggaaagaagaaggagatgatggaggggcagtgcgcgacatattggtcgagggtgagctgataagaactcttggctcagggatttggaagttcaagagagaaaccagagagagagaagttcatgagtga

SEQ ID NO: 71986 - DNA, 292 bp, Glycine max
  Peptide Sequence Number=SeqID_163671
atgcctttaaaatgctctatcaaggggaaacccgacatctccgttacggttcaggaggttctagagaaggccaggagtgagcatgtgttcaagaattcgcaaaagatctgtgaaggggtttacttcaatagagttgcagatttgatctctgtcgtcgaggtcgctgcgtcggatcgcgttggcaacattaccatttacaaggatgttatggggaaagaagcaatgaagactgagtatagggcatttgatgagttactagggattgaagtggcttggaaccaagtcaagcttg

SEQ ID NO: 71987 - DNA, 126 bp, Glycine max
  Peptide Sequence Number=SeqID_163672
atgcgtcaaagaattcagccagacaacttgcaggatatatcaaactgttacagtgaacatttccctactattgcttccattgttgctcatgaggattatcatgaaaggaaactgcatgcttgttga

SEQ ID NO: 71988 - DNA, 322 bp, Glycine max
  Peptide Sequence Number=SeqID_163673
atgaagttaggtgacatgcgggggtaccgtatggttatccgaacctttcatcaaccaggggcaaacaagcctgttgacacgcagagactaacgtcgtcttctgcaccttttgtcatcctgacccatgaaggacagcgagtcaggtggcaggcggagataccttatggtcatccacacctttcgtcaaccgaggcgaacgaattcgacggtatcaggatgatgtttactctagtcgtcaggagacattcaagcccaacgatgcacaaaattcttctctgctgggtggggacgatcaagttcaatagcgtgtgcaaacttcgtg

SEQ ID NO: 71989 - DNA, 252 bp, Glycine max
  Peptide Sequence Number=SeqID_163674
atgacgttgctatttagcaatattctgcccagcgaccacaatgccaatctccccctgcagatgtatcagttgggatcgcgcctgcaagacacccagtggacccgaagaagtccaacagggtcttggagttgtcaagctctaattacgggtctctgtcagttctacggagtgcctgtcacctccagcaagggcatcaggccccctactaatcgagctttcatcaagaagtactgcgtccccaggaaggcgtag

SEQ ID NO: 71990 - DNA, 698 bp, Glycine max
  Peptide Sequence Number=SeqID_163675
gggcaccaacacgggggtgcttcagagggcccgcaaggcatgggaaagggtgcaaaagaaggacgaggaacttaggggaagtagcaacgggcccatcggcagttaccataggtggttgaaagcctacgcacaaggtctggattggctcccgaatttgagaactactaaagaggtggagggtgaagcttcagaagaagatgaaaaggtacaagccctcaaaacagagcttgagagagcccaaacaaccaaagaaaagtccaagtccatagctgttagcatccgaaaagagaacgccgaactaagagacatcaacatagccaccatcaaggcgttggagcaagagaccaagagggcccgcaaggaagaacatggccggaacaagttccgaggggctctgtggggtagtaacagcaaacttaagctacaaagagaggaaagggaccaatcgtacaaagaagaattaaatttggccaccgcccacgagcacaaagtggcgaacgaatacgcccgagtgtatgcggaaaaggaggctagaggaagggtgattgactcattacatcaagaagcaacgatgtggatggaccagtttactttcactttaaacgggagtcaagaacttccccgattattggcaaaggccaaagcaatggcggacgcgtactccgcccccgaggaaatccacgggctcctcagctatt

SEQ ID NO: 71991 - DNA, 561 bp, Glycine max
  Peptide Sequence Number=SeqID_163676
gtggatgacaaagggctgtcgtacaaaattcactgggggctcagcaacggagggctgccaacgtccgagctggcggcgcactttcagtcacacagcgtacgcaaggcactgagccacggtgcggaccgggtgattatgcactgtcacgccacccacttcatggcgctcagctatgtggtggatctggatgcggcgcgctttacccgcctgctgtgggagggcagcaccgagtgcctggtggtgttccccgatggcgtcggcattttgccctggatggtaccgggtaccgatggcattggtcaggcgacggcagaagcgatggccagtcatagcctggtgatgtggcctttccacggaatctttggcgccggaccgacgctcgacgaaacctttggtctgattgataccgctgagaagtcatcgcaggtggtggtcatggcgctgtcgatgggcggcattcgtcagagcatcaccaccgaacagctgattgcgctgggcgagcgctttaacgtgaagccgtggccggcggcgctgcaggcggagcgcagtgatgttgcgtaa

SEQ ID NO: 71992 - DNA, 558 bp, Glycine max
  Peptide Sequence Number=SeqID_163677
atgagtgtttgttccttggttattccacctctcacaaaggctacaaatgttatcttcaatgagcttaaatatccatacagtgatctttttccacctttatccacctctgtcttttctaagagtgattttttacctactgctcatattcctcttgtttcaccttcccctaatgaacttactcattcttctcaacatgctgaaactaattctacttctataagtgctgatccctctagatcccttaatatcaaattccctaattctcaaaatctcatgtcatcttctcctctttcaaatgttgaaccaaattctgttactaatgaacactctaacactgtttctgacttaaacagatatccaagtgaactgtccagtacctcttcttctcagtctcacactgtcagttctccttcttataatcatgttcttcccccacaaaatgtccatcctatgcaaaccagattcaagtttggaattcatcaatctaggttgcatccttcactgtttatggcacattgtgaacctaagacagttaaacaggctcttgctgacccttaa

SEQ ID NO: 71993 - DNA, 324 bp, Glycine max
  Peptide Sequence Number=SeqID_163678
atgatttccacacaaacccccaaaaatccgattaaaaggttagatgttttttacgtattatctgaaggtgtagtagtagctggagacgtagagagtaagagtaggaagggattattgcattatactaggattgttctggatcctctaacaatgaagattactaaggcttcctgcgactgcgagggttatactttcaggcacaattgctggcacatcaagactttagagcagatgattaaggaggacagggagttaagggaaaggatagagaaggcaaggcaggaaatgatgcaaatagaagaagacatagcaagctggggatga

SEQ ID NO: 71994 - DNA, 1066 bp, Glycine max
  Peptide Sequence Number=SeqID_163679
gagatccagtaaggataaagcggctgaaggaacctgttccgctcccgaatatgacagccatcgttttaggagcgctgagcaccagcagcgcttcgaggccatcaagggatggtcatttctccgggagcgacgcgtccagctcagggatgacgagtataccgacttccaggaggagatagttcgccgacggtgggcatcgctggttacccccatagccaagttcgacccagacatagtcctcgagttttatgccaatgcttggcctacggaggagggtgtacgagatatgcgatcctgggtgagggtactggaggagggccaggagtgcgagtatggccagaggaggaaccgggccgatgggtttgatgaggaggccatcgcccagttgctgtgtataccggggcaggattttgcccggactgctgctggaagacgggtgcggatcatgcgcaccaacatgaccaccctgactcagatctggatgactttgctgctcagcaacatccagcccagcgatcataattccgacctccccctaccgaagtgtcaattggtgtacgccatcctgacacggatgagcattcatgtggctcagttaatcgctgatggccctgggatttccgctttgatcacaggactctgccagtcgttcggagtccccgtcgcacctagcaaggtgatttggccgcccatcacccgagcttttattgagaagtattgcacgcaaagacaggcccaaggggatgctccgcaggccgcagacgcgccgccacgtcatcaggctggcccagctggatcatttgatacggagcagtatttgcagcatttggttcgccagcaggcggccaaccaccgggcgcatcctgtagagccaggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgaactacgaacttttaagtgaaaggttcgggagttgtatttacgcacggggaaggtattag

SEQ ID NO: 71995 - DNA, 842 bp, Glycine max
  Peptide Sequence Number=SeqID_163680
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggacttcgatagtcttgaaaatgtaaagaaagcggatgaccatgattgtcttcgcatgacgacagactttgatagtcttgaaaatgtaaagaaagcggatgaccatgattgtcttcgcatgacgacagactttgatagtcttgaaaatgtaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 71996 - DNA, 225 bp, Glycine max
  Peptide Sequence Number=SeqID_163681
atggaaggactcgcaactggctactgggatgagatgttatcccggctttcttacctttcttggctttcctgtcgctttgactcttactgctttaatgaatatctctttcttgtattcctaatagagagggcaggcatggaagcgggaatggaggagggtagcagtcgaaagtggcacgcgaatgaactagctcttgtggcatggtccggtattctactcacatga

SEQ ID NO: 71997 - DNA, 452 bp, Glycine max
  Peptide Sequence Number=SeqID_163682
tccgagctatgaagtacccacctctggttcagctcctaccaatggtagtaaaacctacttgtttcaaccggttcaagcggtacattcagtagtgaaccctcatgaaggtagaagctggggtcaggtcatagtagtagtcacgctccctacggctggttcggtccctcaccacgaccctactcaacagcagctaggttggatgcaactagctgttatggatagtagtatcaaggcgagttcagctaggattcaagtagtgcaagtagtgcatcaacacgcgggcatcatgatggccatggatggaggacagggtaggaggagtcgtccaggtcaagtagtggaggctggagtcggtacctaccacgagggtgttctcgttccagtagtgagtagagatgggttaggtaggaggcgcgagtacataaacctagcctgcaaatcgggaagcgaag

SEQ ID NO: 71998 - DNA, 423 bp, Glycine max
  Peptide Sequence Number=SeqID_163683
atgacaaacaacaacttgtatattttcaaggtatttaacactgtgttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 71999 - DNA, 198 bp, Glycine max
  Peptide Sequence Number=SeqID_163684
gggaaggagggcagagcaaatgggttcaacccttctggtattgagaaatctatcaaaattagtgagaaaaattgtttccgtgaaaaaaatccaagccgaggtgcttccgtaacgctttctagacgtttccgtaagcgatttcgtggagattcttcaccgttcttcgttctttcttcgtcgttcttcggtcttcaactg

SEQ ID NO: 72000 - DNA, 66 bp, Glycine max
  Peptide Sequence Number=SeqID_163685
atgtcgagaccagttgacagcagaagtcaaccaaggtacttagggatgggggcaaatgggggatag

SEQ ID NO: 72001 - DNA, 228 bp, Glycine max
  Peptide Sequence Number=SeqID_163686
atggtgaaagttggaacctctacgtgcccgatcaacgtctcattttcgccaaaagttggcccagggcttccccgtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 72002 - DNA, 581 bp, Glycine max
  Peptide Sequence Number=SeqID_163687
gcagtggcacaacgcgcggcggttggttaaaaccccctccgcaggcaccggtaaaccgcacaggcacgccggttgcctataacgattacattcgtcaggccgccagcaactacggcgttgacgaaacgctgattaaagcgattattcaggtggagtccgggtttaacccgaacgtggtcagcacctcgaacgcagtgggattgatgcagcttaaggcttctaccgccggccgtgacgcctatcgcatgaaaggaagaagcgggcaacccagctcgcgtgagctgaaggatccggcggtcaatattgatctgggaacggcctatatcaatattcttcaaagccagcagctagccgggatcaacaacccacagactttgcgttatgccaccatcgtttcgtacgtgaacggggcgggcgccatgttgcgtaccttctcatcggacaagcgcgtggcggtcaatcgcatcaatcagatgagcccggatgagttttatcagcacatccagaaaaagcatccggcgccgcaggcaccgcgctatttgtggaaggtgaccaccgcctatcaggcgatgtcgcagtaa

SEQ ID NO: 72003 - DNA, 492 bp, Glycine max
  Peptide Sequence Number=SeqID_163688
atgatgatgatgtggggtctgaagaaagtgataaggattatgttgggggatgaggaagatgatgatgatagcagcgactgtagtgaagtttcatatagtgattttgaagaaaactctgattggacagcatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 72004 - DNA, 366 bp, Glycine max
  Peptide Sequence Number=SeqID_163689
gcattacgggccaatgcacctctctcttaccctcaattgataactttgtttctgcgtcattttcaaatttcgcttgatgatgaaccatttgttcaagtcaagcgttcctttgcaattggtgctggtgcagtgacttcctttggataccatgaccgtactccttcacctcctcctcagcgagatgattcagcactcatgattgaagttctttccgaattatggggtcttcgttcttatgttggtgaatgtttcgactcactggatactcgttttgccggaatggatattcgcctcacacagcttgaagaagatgtgggttacattcgtcagagtttcgatcttccaccaccatctccaccttcttag

SEQ ID NO: 72005 - DNA, 357 bp, Glycine max
  Peptide Sequence Number=SeqID_163690
atgtggctgaaatgggtgaagacccctgtggttttgtttggaaatcacgatgaacgcactaaatggcatcagaaaaggaaggctccttctacaccttcccaagttagatttgatcggtctaggttcacatctcaagaagcttgggagaggtatatcaatattgtggtgcctaggaaactactaccagagaagaatgtggtagtttattacactgagttcgatgagttcaaggagcaactcgagagaagacactgggatgaggagttgactgattttactgacagtagcatagatgtcgccattgtgaaggaattttacacgaacctctatgaccccgaggataaatcacctaaatag

SEQ ID NO: 72006 - DNA, 468 bp, Glycine max
  Peptide Sequence Number=SeqID_163691
atgcaaagcttgcaagaactggctcagcaaaggccaattatgagtgtagagcaattcattgagaaggtggcctggcctggagcccgaccctcttttgtgggggataatgaaagttttacagcccagacacctcaacagcatgagctagaactagaaaatgatcactcatctgaaaccatcatccctggagccgttgatttttcgaaaggaagattagagacgagatccaatgaggctgctcatcctgagccagtgccagtatcagctgatgcaccatttccaggggtggatccatcttcacctcaacatgcagcagactcttccattcctgtcttagagatacctgagggccagaccataccagtcctgactctagacacttctcctccagctactctagtattgcatctgatagatgaggaggatgttcagacacaggacacccaggaccaatcacatgaattttga

SEQ ID NO: 72007 - DNA, 507 bp, Glycine max
  Peptide Sequence Number=SeqID_163692
atgttcgacgatggaggagctgttacaacaattgatggaccaaggccgttggcggacaaagaaagccctgctaaacccaagcctttggtgatacacttcaccagggatgtggcctcccagaaaccccaaggttctcaacctatctcgggtagaaaacctgtccctttcctttaccaaagcgacaaggcgatcctgtggaggtacacccctcagaagccaagcaaaaagaaaaaggaggccactagcattgacttacttttcgccaaaattaccaacatcaccgacctaagtggtgtgacccgtagcagttgtctcttcatagcgcctaacccatcggggcgacccacggatgccaaagggaaagcgaaggtggtcacgaaagaaaccagtgaagcaagccgcactctggaggaggacgttccagccgagagatcgcggagacttcagcggaaagaaagtgtccatggaagaggccaacgagttcttccggatcattcagtacagtga

SEQ ID NO: 72008 - DNA, 553 bp, Glycine max
  Peptide Sequence Number=SeqID_163693
atgatgatctggcctctgtgtaggctctacagcatagcaaataatgttttagagtttaatgaagatggtcctataggaggagctggagcaggaactggagcaggaactagagctggtaagggagtgggagttgaagctggtaactgtggaagatgtggagtcaaagtggatggtgctgaaggatctagtaaagtagatgaagaaagagtagaagtatttggtgctgctgaagtagggggaacctcagatctcttacccctggccttccttggccctctgaatgtcactattggatcatctagattccaacagttctttatatatgccaagttaatgacagggctaaggctttccaatgatctggaatctaatgtgactcctctagctttacacaaagttgtgattaaggttggaaatccaagccaagaagagtcatggctgggcaatgatagaaatctggtgggagatgaggtagcccagattcatgtccatcttcatgataatgccataaatcaacttggctcgatccagtgtgatgtcggaagtgtgggag

SEQ ID NO: 72009 - DNA, 270 bp, Glycine max
  Peptide Sequence Number=SeqID_163694
atgtcaggattcacaagcgattctcctcaaatttcagccagcccacatcaattagactttgcaccttacgcttcgaggtcatatagtgcccaatggaatgcctcgaggcttctccttgacaagcacacgttgcgttcgagttgtatcctcggaaaaatggagtttgaggaaccttggctgaggttatggctaccattgaactatcgagtaaatatgggagcaaggatggcctttgtggataactgggtggtgggtaaggagaagggttga

SEQ ID NO: 72010 - DNA, 1255 bp, Glycine max
  Peptide Sequence Number=SeqID_163695
cgccactccaatcccggcgggaaccgcgatttataccctggaatactatgctgatcccatcaaaactgagccgcccggtacggctgcaaaataccgtgatccgcgatcgcctgctggccaaactggccagcgcgggcaactatcgcctgacactggtcaattgcccggcgggatacggaaaaaccacgctgatcgcccaatgggcggccggcaaggccgatctgggctggtattcgctggacgagagcgacaaccaaccggagcgcttcgccagctacctgatcgccgcgctgcagcaggccagcggcggccgctgcgtcaagagcgaggcgctgagccagaaacaccagtacgccagcctgtcggcgctgttcgcccagctgtttatcgagctggccgactggcaccagccgctgtacctggtgatcgacgactaccatctgatcaccaacgacgccattcacgaagccatgcgcttcttcctgcgccatcagccggaaaacctgacgctgatcctgctctcgcgcaccctgccgccgctcggcatcgccaatctgcgggtgcgcgatcagctgctggaaatgggcacgcagcagctagcgtttacccatcaggaagccaaacaattcttcgactgccgcctggcggcgccgatggaacagcaggacagcagccgcctgtgcgacgaagtcgaaggctgggccaccgcgctgcagctgatcgcgctgtcggcccgccagtctgcctcgtcggctcagctgtcggccaagcggctggcggggctgaacgccagccacctgtccgactatctggtggacgaagtgctggatcacgtcgatgccgaggcgcgcgccttcctgctgcgctgttcggtgctgcgctcgatgaacgacgcgctgatcgtgcggctgaccggcgaagacaacggccagcagcggctggaggagctggagcgccaggggctgtttatccatcgcatggacgacaccggcgaatggttcaacttccatccgctgttcgcttctttcctgcgccagcgttgccagtgggagctggcgctggagctgccggggttgcaccgcgccgccgccgagggctggctggcgctggggtatccggcggaggccattcaccatgcgctggcggccagcgacgtcagcatgctgcgcgatatcctgctgcaacacgcctggtcgctgttccaccacagcgaactggccttgctggaggagtgcctcaacgcgctgccttatga

SEQ ID NO: 72011 - DNA, 564 bp, Glycine max
  Peptide Sequence Number=SeqID_163696
atgcattcatgcttgtgtgtctttctagtgtggttgcattgctcattgcattctttccttgaaatcataatcgtagtcattgtaaccaaagagaaagattgcgctttacgacacccttaccagactcgtgccaaggctagaataatgagtgaaattgatgaagtacatgaacaaatgaaggtcaatatggaggccatgaaggaacaaatgacaacgatgatggaaataatgatgagcatgaggaagatgatgaaggataacactactacaattattgttgtgagtactgctactgagatggactcgattcatccacccgatttcaataaagtgaatcgtccaatctcagatgtagtaggtcaaggaggcaaggcagtgaaaaatgaatatgggttgcctcctaattatatatcgcccactgttgtatatgcttctggtgagaatatcagtaattttgcgaccgcactcattgagaatcaacaaccccaatttgatcatgcatatgtttctcatcccatgaagttccccaagaccatactcaaattgggtccagggtttatctag

SEQ ID NO: 72012 - DNA, 1006 bp, Glycine max
  Peptide Sequence Number=SeqID_163697
atggggacaaatcaaaacggaaaaagattctatcaagtcaagattaaggacctagatgtcaccaaccttaaggagttgggacggttgatgggacccctccaaaggcaagcctttcgcaaagtgtacggaaagattttagatttgaccatagcaggggtgtttacggaagccgttgtatccctcgcccaatactatgaccagccgttgagatgtttcacgtttggggacttccaaatagtaccgactgttgaagaatttgaggagattttgggatgccctctttgggggaagaaaaccgtatcttttctccgggtttcttccctccttgagcaagattgcagctgtggtcggagaatcggtgagagagttggatcgtatgaagcaaactcgaaacagcgtagtgggcctaccgcggaaaatacttggaaggcaaggcaagggatatggcaaatcaagatgagtggggtcccgtttgcggatatactagctttgctaatcttttgggacttatttgatacatttgaccgaaggtgcgagaagaacagcgcacggatcgtcaactgcttacccgctctctgtgtgtggttggtttcgcacctattccaacaagacataagacacccgtgtccgcttcaaagttatcactcgtgcgtcgtaaagagaagagtcaattgggaccaacacttggctggaataggaggcagcacaatcaattggtttcctcgatggaaggaaggaaatgagggagttcttttctcatgtggggactaccctaacgtcccgttgatagggacgaggggttgtattaactataatcccacacttgccataagacagctagggtaccccatgaggggagcaccaacggaagagagcctctcgcctttccttgtgagagatttcggcgcgcaaagtctcaaggttgtacaaagagtccacaaggcgtggagaagtccgttgaggaaagataaagaacttaggggcatccgtaatggcatcatcggtg

SEQ ID NO: 72013 - DNA, 405 bp, Glycine max
  Peptide Sequence Number=SeqID_163698
atgggtgaagtagaggaggtgcaagaaaaggtgaaggccgacatggaggccatgaaagtgcaaatggccacaatgatggaggccatgatgagcataatggaagcaaatgcggttgtagttgccgctgccagggctattgctaaggtgaacccgatgcccccttctcatatcaaccaaatgaatcatccaacctcagctagggtaggcaaagatttgggaagtacgagcggcccccattatgcgcaaattcaaaacaagcatgccttcccgccatatggctcgcctcccaaggaggatgtcaataactctactcccatactcattgaaagccaacaacctcaagctatcatgcacatgtctctcaacccatgggggagacacatggaatgccccaccacaatctag

SEQ ID NO: 72014 - DNA, 1050 bp, Glycine max
  Peptide Sequence Number=SeqID_163699
atggactacagcaatgacaacaaggagccatgggattggcatagggaggattattgtctccaaaggagtttcgattatgaaaattcacaagggctatggaatggagttcctcaaaatgaagatctttccaatgtgttcaatgatgaaacaaccccagtgaaagcttgtggggactttgcatacaatgtcaataatagtgggatatatctgtgtacatctatctaccctccccaggttccactaggttggagcctcatgcattgggtcaccgttaatttctattattattgttattcctgcatccttcttttatatgcaatgctatccttaattcaaataaggtggatttcagagttacaaaaggaatcagacaaatgtttgaagagttctgaccaaattaagagaaggcggatgctacaattcaatactcaagatgggggtcatttcctctccaatgaacatatgtcttcagcatatttgaaagggaaggaggagtcaaatgaggatgttttccctgaattatcacattgggtttctggggcatcaggaagtgcatctgcttccaattatgaggaccttgagtcagctgaagggtggctagcagattgctttaaggatgctgaaatgcaattatgtcccgatgatttgaatttttctggggcagatgctgttcaaattgatgttgcagatctgtgcaacttcccacctgcgtgtgaacaaaatgtgcttcagcatcatgtcacccaaactcccaaaaatattgtcttcaaaggaggaaaatcatttatagaaacaccgacaaagctagctgcttctgtggcctatccatttaccttcattaaaccctgtggtgcccatggagatgtcactctgaaggaaataaatcagcgcattctgtctccaccacctcctttgaagtcccaacaaagtatggaagatccatcagcttacccaaaatcagcattttctgggaagcctgtagttggaaaaacaaaaattcacattgaagggggaaaaggtagcatcaccattatgagaaccaaaggctaa

SEQ ID NO: 72015 - DNA, 633 bp, Glycine max
  Peptide Sequence Number=SeqID_163700
atggatctattggataataaaagcataaagatgatcagcattatgattgttgttgatcaaatccaatgccacaagagaatcaaacttgcatctgatatgcctaaagggactcgcgggcctcacttggcattcctatctagagcggagttgtatccatggcctaagaggcttagtggcagtgttgggcccaagaataaggactctgtgagacttgatgttcgtgattcgatgttaaacacaccgtcgaatctcccattcttcattgatgccattgagacacgatgggaacatgatgatacgcttcatatggatcatttctatgggttcctctattgtcgttgtgcgccaatagatgtcattattccttctgagtcacattcactacctacagatgatatgatgtccttttctagatctaactcttcatctaaggatacgaagaccatttctcctactctgatgtctcatagatcaatgttgcatgagtctcaagtacaacttggggacgagggagaggaattggatgaggacacatcttttgaggaggatccatcgatggatgaggaggaccctgtcacagagccggagtttatgaaggaggattcttcacatgattcctctaaggagtcttga

SEQ ID NO: 72016 - DNA, 405 bp, Glycine max
  Peptide Sequence Number=SeqID_163701
atgtccacatcacctaaccaatgtataagtgtattttcagaaagtgagcaaaagttacacaatcaactcttgaaaatagtcaaagggacatggccaatagtaagcagggcaatacaagaaagtaatggcgaaagaaagaaacacaaacataggaggtcaagacacatacatattgatgcagcacaaaaggagttgcaggggacttcgaaagcaatgcccaagtccccatatttccggttccctacagaggcaatcctatccgaaagactgtcggacactaaatgtggaaacctctctacagggattcgaaccttcgttcgccacgttgctgggactataagcgcaagtccccaggtcacaatcgttgagcctctcaaacattacaacgagaaggacaaggactag

SEQ ID NO: 72017 - DNA, 279 bp, Glycine max
  Peptide Sequence Number=SeqID_163702
atggagagaagccataatttcaacaatgggaaaatatctcaagaagtttctcctacacttaaatgctacaagtgtaatcaacctggtcacataaaagcaaactgccccacaaatgagtcatggcccaaaaagaatgagaagaaaagctataaagaaagaagatccaagaaggcgtatattgcttggggtgacaatgacttatccgatggttcggagaaggagatcaaccttctatccaaagactatgaaagcgatgagaacataactcaagaagattaa

SEQ ID NO: 72018 - DNA, 414 bp, Glycine max
  Peptide Sequence Number=SeqID_163703
atggttattagtgacaaatggtcttcttacaaggaggatgatgttgataaggcaaaatttgtgaaagaaactttgatgaaagatatttggtgggacaaggttgattacatacatactttcataactcctatctatgacgttcttagaaaaacagatacgtatttggcttctcttcacttggtatatgaaatgtgggattcaatgattaaaaagtggatgtaccctccactagaactgatccacaagagatgtaccctctcttgttctcagtcaacaacccaagtagatgtaccctctacttgtaccacaaaggatgtaccctccaatgtgttaagacaaagatctcaggcggttaaacctttgatactttgtgaatggggatacaaaagaattcttagacggtttgtcctttga

SEQ ID NO: 72019 - DNA, 801 bp, Glycine max
  Peptide Sequence Number=SeqID_163704
atgaaccataaattaggttacagtgcccaactgtgcgctaacctagaccccacaaagtgtgttggtcggttaagaccgcatgatgatggtcatggaagtagaaatcctctaaggagtgtcgtgcgacatatacccagtcatcggggcaaggaccaagccccgatgagtaggagggtacgactgtcgctgcaaaacccagggcgagagcccaagcagagtggtcgtcggtgcagtcttggtgatagtataaaatattcaaatgagaactttgaaggtcgaagaggggatagtttctatgtgaatggcacttgcacatgggagtttgaagacgtcggtgagggctccgaaaagagttatcttttttttaacagtctgcccatcctagaaacagctcagccaaaggtagggttcagcgactggaatagcactgcatgtcgcatggtgtccagtgcgcccccaacggtccttgaaaatccaaggaccaagtgcctctcatgcccagtcatactcataaccgcatcaaggctccaaggcaagggaagtcgacaaaatggatccataacctcgggggaaaaattggctctaaaggctaggcacgggggccctagtcccgaacctgtcaactttcagtggaccgctcaagttgcttccatggtgagagcgggttgtcacatgccggtcgggggacgaattgggaacggccccttcagggcctcttccgaaggcgtcaaacagccaactcggagtttattatgttccctgcggatgttgacgcaatgtgatttctgcccaatgttctaa

SEQ ID NO: 72020 - DNA, 331 bp, Glycine max
  Peptide Sequence Number=SeqID_163705
atggaaagtagtatagttgatgcttcggctgcttcaagaaaacgtagaagagatgaagacgaggaagaagaacttgaacaagtatttttcattattgttagtgttgtcactatgctttcgggtgcactgacttggtatcatgacaagtactttgttaaggaacctacccgaaatttggaattagaaaggcatagtttcctcaatcgtctatacaggggaacagaaactgattgcattgaacaattaaggaattcgattggagcacttgatgggatacatattccagtaacagtttctgcagaagatagacctagatatcgtaatagaaaag

SEQ ID NO: 72021 - DNA, 153 bp, Glycine max
  Peptide Sequence Number=SeqID_163706
atggagggaggtgaaagaagagtgaaaaagggagaaggcgtgagggaaagagctttgacggcaatgaatatgagtttcaatgatgatgacaactgtgatggagagcgcgaggttgaaaagatattgagcatgatggttagagcacgaggatga

SEQ ID NO: 72022 - DNA, 399 bp, Glycine max
  Peptide Sequence Number=SeqID_163707
atgaaactggccaaatacaggctaaaggcccaagtggagaaggacaaagcccccgagtggagatggatgaaggcccaaacttatcaaggtaatccttgtggcgtctaccctgagttatcttccttcaccggaagtggtgtctaccctgacttatcttccttcaccggaagtggcgtctacccggacttatcttccttcatcggaagtggcgtctaccatgacttatcttccttcactggaagtggcgtcaacccaaaaactctacagcctacttatcaagttaatccttgtggcgtctaccctgacttatcttccttcaccggaagtggcatctaccctgacttatcttccttcactgaaagtgacgtcatccaaatctctgtaacctgtatcaagtga

SEQ ID NO: 72023 - DNA, 201 bp, Glycine max
  Peptide Sequence Number=SeqID_163708
atgggctcatacttagcccatgggcccaaaatctatcctaaggctcatgagaaccttagggccttctcctgcatctctggctcaagaatctaccctgaggttcatgaaaacccttgggccttcttcagcagctctagctcaatccttttggagtttcttgctcatgactctggtgactggtcccttcctagggtttcatag

SEQ ID NO: 72024 - DNA, 202 bp, Glycine max
  Peptide Sequence Number=SeqID_163709
gaattgggttcaacaccaagcaaccagcaagacgaacaacaaccatcaaccaacacccagcagcaacgaagaagacgaagcagccgcagcgcacgacacaggaagcaacgatgtgcgtgagaagaagcaaagaaaaaagaagctaaggaacaacgagcaaaagaggaagaagatggagcagaagaggaagaagacgaagtag

SEQ ID NO: 72025 - DNA, 989 bp, Glycine max
  Peptide Sequence Number=SeqID_163710
caaaacaactccatagaggaaccaatgatattgtttggtacaaagagaccaaatgggcagcagaatgtgcaaaagctcaagcagaagctgagctttccaatgctaaacagacagtgaaagatcttttctctatgattggggaatctatgtacaaggcaaaagccgaaatgcgagacatggcaccactaaagaagtatgtcaaaccgagaaacgatgataatcagtattcacgagttatgatagaattggaacatgctaagcgggaattgttccaacttaagcttcatgtgggttctgttttggaggagaaattgcaagcggagaacgaagtcaaagcatcgagatccagcatgctgtccttctcaagagtagcacaaaaactgacgaacgagattgaggaagccagggaagaacaattggtggttcaattggacagaatggatgctttgaatgaacttagagacattgaacaacttcaaaacacaaggaacaaattgaaagaggccattcaagcgatagatgagacaaaagagctcgaaatggaattggccacaacattgtctgatattgatatgttgaagaatgagttcaagtttgttagggaaaagcctacaaaagaagaaatagaggcagcaaagaaagacttggcttccattacaaaacaagtttttaagtttatggcctctatgtatgtcacaagaaaacaactgaagcatgtgagtgcagccacgattcatttaaagaacaaggaatcgaaaattggtgcaaaagttcgaaacctcagttacaagctcttgagagaaaaatctaaattagaagctgtgtctgctgcagaggaaaaggccaaatcaatattgagtaacttgacacaaactcttgataagctcaagtccaaaatagaagcagcaaaaaaagaaaaagaccttataataaatggagaggttgcagaaaccaaagaagagattaaaaaggccttgttggagataaag

SEQ ID NO: 72026 - DNA, 781 bp, Glycine max
  Peptide Sequence Number=SeqID_163711
atgggcgcggagcaaattggacaatcttctaaactccgtttcgaccacgtagcttttaaacatcaaatcactggcttccaagtcttcaagattaggactcccagaaagaagctgcgcaagatctctatctttcgagaaagcgacgctgctcaagtgcaggatcttaagccggggaagatagacacaacaagagttattaaacgacaaaacaacattcaacagtttcaacaccacaagggttttgcagctgaaaagcaagaaggagggcaattctaccgcacaacccagagagaggtcgaggtgctcgactctgtgttgcgttgcagcggaaatccatgcgttcacatgaatgggatcgagagggcaagaagaactgaggcagaatcttgtgaagggttggtccatgtcgtgcatgaggatgaatgcgtgcaccctctgagcaaagagggaacaggtttcgtggttgttgtcgtcatggtggctgtggttgaagatgtgagagagcactacgtcaggcaaattactaatccggtcagccattgtttacaagctttagatgaaggatggaaattatttggttttccacacgggtctcctcctttggaagcaatcctcttcaggagggatcgtgatcgcgaaagggctcaggctagaaccggtggtaaaggcaagcagaaagatgatgggttgacccctgaacagcgcagggaaagagatgcgaaggcgctgcaggagaaggcggcaaagaaagcggcacaggatgcaggagggaataatgcag

SEQ ID NO: 72027 - DNA, 171 bp, Glycine max
  Peptide Sequence Number=SeqID_163712
atggctgtcatttggaaggaaatgactccaaagaagcttctagctaagagagcaaggaaggatgccactagagaaggttccagtgcggccccacaagtggatgtggagtttgacggacatcggttccgaagcgaggaacaccagcaccgttttgaggcaattaagggttga

SEQ ID NO: 72028 - DNA, 309 bp, Glycine max
  Peptide Sequence Number=SeqID_163713
atgggctcaaaaatctaccctgaggttcatgagaaccctagggccttcttcagcagctctagcccaatcctcttggagtcacttgctcatggctctggaagccttcttaacaacaaagagaagaacaagatgaaagattgcaaaaatacaagtggtgaggatgtctccttcacctctaggatctcacaatcactcacaaactcatctcaagctctcaaaccggctcctgcttctagctctggtctctgcagatcttcacacagcaaaatctctaaaaactctctggaacttggacctttctctatctag

SEQ ID NO: 72029 - DNA, 288 bp, Glycine max
  Peptide Sequence Number=SeqID_163714
atggcattgcagttgaacctgaatgggtctggagctggagtttcaactcccagttcaaccttctttgggagcagcttgaagaaggttattgcctcaagggtccccaacaccaagatcccctatgagtacattagcactggacttcgccagagaagaggtgagaggaggcgccatccactaggaaataagccatggaaaaaggagattcaccaacaagagagtgccctggataagaagcttaaagaggaagcttcaatggatgaaaaaaagagagagagaagggggtga

SEQ ID NO: 72030 - DNA, 435 bp, Glycine max
  Peptide Sequence Number=SeqID_163715
atggttctagaagaggatagagctatgttcgggatagagctaacgaccatggctactccacctgcctcgcctcctcctcctcttcctcctcctcctgcagacgcatcagcgtctccatctacgttgaagcggacacgcaaggtgacacggctacgatcattggccactagaccacctggggcagaaagacctgtggtcaacgtcgatcctgctactggtaaggccgacggtccccacaagaagaaattaagaacatatttggggattgtcgctcgtgataaggttgacgtgacatatgacacctggaaggaagtccctactgctcagaaggatttgatatgggaggatattcaggcggaatttgaaatccctgaagcttctgacagtaggacaaagaagaaaattattcagattgtcggcgagcgctggaggtag

SEQ ID NO: 72031 - DNA, 228 bp, Glycine max
  Peptide Sequence Number=SeqID_163716
atgacgagagtgatgagcaaaatgacggcgacggcgacgaagtctatttcgttgaagcctttgggaagagacggcactgtgaggcgccatttggtggaggagattccgattgtgaccaaaggtgacgcggaggtagctgaaggcgccgctggcgatgggcatgtcgatgacaaacttagtgtagcagaaggcggagaggagggtgcagaagccggcaatggcaattaa

SEQ ID NO: 72032 - DNA, 300 bp, Glycine max
  Peptide Sequence Number=SeqID_163717
atgaaactggccaaatacaggctaaaggcccaagtgaagaaggacgaaggcccaagtggagaaggaaaaagcccccgagtggagaaggatgaaggcccaagtaatccttgtggtgtctatcctgacttatcttccttcactggaagtggtgtcatccaaaactccgtagcctcactagcgatagcgacgatgaaggtatggttagggagggagctggcagagagggatggacatttggattggagaaggagaaaaggaaaaggttgtggtgttgatggcagtgagcaagaggagtggtga

SEQ ID NO: 72033 - DNA, 681 bp, Glycine max
  Peptide Sequence Number=SeqID_163718
atggcttccatgatggaagccatgctagatatgaaaagattgatagagagtaatgcggcaacagctgccgccaccagcactgtcgttgaagcagacccgatccttccgtctacagcaaatctagcacatcaactcgccccgaatatggtgggacaaggaagagacacattggggaataccaacagctcgtgtttggggtacaaccgaagtgcttacccctatggtctaccccccaaggaagagacacattgggatccttgcttgatgcatccaggtgcatcgcatgatatggaaacatgttcagcggtggagcagttgttgcagcggatgatagaccaaggccgactcgagatcggtgacgaggacgagaaagaacaacataagccgaacgagaggaaggagaaggccaccgacactgattccacttccgccaaagtgaccaatatcaccggactaggcggcatgacccgcagcggccgcatctttgtggtgcttgacttgtcggtacgacctgtgaacgctaacagaaaagaaaaagtggtcgcagaagaggccaacgaagcaaaccccaccccggatgaggatgttccagcggggaggttcactgaaaaaggggaaggactcggcagaaaagaggtatccttggaggaggccaacgagttcctccgtataatccaatag

SEQ ID NO: 72034 - DNA, 108 bp, Glycine max
  Peptide Sequence Number=SeqID_163719
atgtcctatctatctcaggatcaaagggttagacctcagtcggcctatggtggcttgccacaagcaaaagtggtcgctaaatccgtcgcaagcaaaagtggtcgctaa

SEQ ID NO: 72035 - DNA, 492 bp, Glycine max
  Peptide Sequence Number=SeqID_163720
atgttggggcacgactacgagcccgaaatgggtttgggcaaggataacgatggcaaggccagcctagtaagtgtcaaaggaagccgcggaaaattcaggttaggctataaacctacacaggctgacgtaaggaaaaacatctcgggaagggagaacaaaggccaaggcccacggtcaggacagcaagccaaagaggttccaccgtgccacatcagtagaagcttcgtgagtgcgggtttaaggcgagaaggacaagtcgccacaatatgtgatgaagactccccgaggaggtcgaatttggtgcagccatgccctcttggcttccagctagggaactggcggtcccacgaaggtactaataccggggacccggccgtcgatttcgagcaagaaacgagtcagatggaggatgaagaagacgaagatgtgggacttcccccagagctagagaggataattgctcgggaagaccgagagatgaagccacactaa

SEQ ID NO: 72036 - DNA, 174 bp, Glycine max
  Peptide Sequence Number=SeqID_163721
atgagactgaagttcggtacgggttgggagatcgaggttcagatcaaaacagactctttgactaaggcttgtcgcttcgacctagtaagccagtccctctacctcttccgcatgctgttcgtcacttgttggcaagggcaagggcttcggtgtaagcaccagttcgaactctga

SEQ ID NO: 72037 - DNA, 348 bp, Glycine max
  Peptide Sequence Number=SeqID_163722
atggtcatcattgtcaatgcggaagctggtggttacgtgagcatgaactactaccaatatatagatgttgtttatacaaatgagcacatcttaaaagcttactccgcacaatggtggcctcctgggaatgaagcggttattcctccttctgatgacgcatggacacttacccctgacctaactacaattcgtgcgaaaggtcggccaaaatcaacaaggataagaaatgagatggattgggtcgaaccatttgagcaccgacaaaaatgtagtagatgtggagccgaagggcataacaggcgtcgctgtccaatgcaatctgagcgtgggagttgttcaaatcgttga

SEQ ID NO: 72038 - DNA, 327 bp, Glycine max
  Peptide Sequence Number=SeqID_163723
atggccaagcatttttcgatggaatgccccggggtattcccatggtacgtgcaagttgcgttaggatcataccactttgggaaagggggttggaagatcttcccgagagttattacggccaattggttggcgatgagggacggcaagaggtcctcatacgtcattgggagtggggtgaattctggaattggcctcggcggaaagttcctcattgcgttggaattgccggctgggcgagtcgtggttggagttggaacttggggggcctccctctggacgagtgccttaggctgcacgggtgctgaattagaggagttcccggcgtga

SEQ ID NO: 72039 - DNA, 1041 bp, Glycine max
  Peptide Sequence Number=SeqID_163724
atgagaaccatgaacacttccaaactaatcaatgtcattaatgatgataatgaccaaaacttagaacaaacaactaaagaaggttcagtatctgaaaaagatattaatccaataaatgccaaacattggaaaacaccttctaaactttattaccaaagaccaaccgcccatgatcttttactggaagaaagaggcaaaacccaacactttattggtgacccgtcactttggaaggataggtcagcagaattattatctaatcttaagtgtagaactttagcaaactttaggtggtatcgagacaccttcctgactagagtatacaacagagaaaatagccaacaacctttctggaaagaaaaatttctaacaggtcttccaagattattaggagacaaggttagagataaaatccatagccaatctgtcaatggagacattccatatgagagtttaagttatgatcaattaatttcatatgtccagaaagtagccttaaaaatttgtcaagatgacaaaatccaaagacaatcggccaaagaaaaagcccagactaaaagagatttaggatctttctgtgagcaatttggattactagtttgcccaaaacaaaagaaaaaacacaaccctaaaaaaggatttcatgaaaataaaaccttcaataaaaagagatttctaagaaggaaatactcacacaaaccctcaaccagcaaaaatactgatactccaaaacctaatacaaaatccaaaatagtatgttataattggggaaaacaaagtcacattagcaaatattataggttgaaaaagaaattgagaaacctcaacctagacccatccatagaagagcatattaataatctgctcattgaaacctcagaggaagaaatcgaagatgtatcctctaaagaaaatcttaacgtaattcaacaggatgatcaaccatcatccacagacgatgaagatacccaagaaactaacaccctaacaagaaagcatgatcctttatttgaggcaatcaattccataccagacccttag

SEQ ID NO: 72040 - DNA, 741 bp, Glycine max
  Peptide Sequence Number=SeqID_163725
atgaacaaagcgactgtcgcggccaaacgctggtggtacatcatgcccatcgtgtttatcacctacagcctggcctatctcgatcgcgccaacttcagcttcgcctctgccgccggcatcaatgaagatctcggcatcaccaaaggcatgtcctcgctgctgggcgcgctgtttttcctcggttatttcttcttccaaattcccggcgccatctacgccgaacgccgcagcgtcaaaaaattgatcttctggtgcctgatcctgtggggcggctgcgcctcgctgaccggcgtggtgagcaatattccgatgctggccgccatccgctttatcctcggcgtggtggaagcggcggtgatgccggcgatgctgatctacatcagcaactggttcaccaaatcggagcggtcacgcgccaataccttcctgatcctcggcaacccggtgacggtgctgtggatgtcggtggtgtccggctacctgatccacgccttcggctggcgcgaaatgttcatcatcgaaggcattccggcggttatctgggcgttctgctggtgggtgctggcgaaagacaaaccggcgcaggccggctggttgagtgccgatgagaaacaggcgctgcagcagcagctggacgaagagcagaaaggcatcaaggccgtgcgcaactacggcgaagccttccgttcgcgcaacgtgatcctgctgtgcgtgcagtacttcgcctggaagcatcggcgt

SEQ ID NO: 72041 - DNA, 224 bp, Glycine max
  Peptide Sequence Number=SeqID_163726
acctcacgaggaaatgggcccttgcagccgatcaggacggtgtcgaggacactatctgtgagaaatatgacatcagcaaggaaaagtgggcccagttttgccagactcgcagagacccttcttgggaggattcatttgaggagcaggccgcactgggatcgttcgtcccccatggacgtcaagatgttctcgccgcagctattggacgtccagagcacccttga

SEQ ID NO: 72042 - DNA, 741 bp, Glycine max
  Peptide Sequence Number=SeqID_163727
atgttgaactgcaaagtgttcaggcgacagcaccgatttgtgaccagttcgcattttctggttcccggagatgacaatcgccagatagctcttcttgcccgcggtgggctagcgtgctcgttgacgaagcagggtgttaatagtacagcgatttcctctgcgaagcccttccttgaggatcatgccgagttgagcagctcgccaagtgccaggcggaattcatcgccggtatttaaagcggcgcaaccggtggatcgacatagcccagcttcccgccacagcggattgcggatcagccgcaggcgtggtcagagcaacgcagagcagatctacaaaatccgtatgctgcttgaacaagaagccgccagcgattgcgccagactcgctaacgatgatgataagcaccagctatatcagcagctccagctaattgcccaagcctcgcgcgagcaggatgatattaaacgggttgaagcctcacaggccttctatgaaaccctgttccgggttgctaagcacaccattgcctgggaaatcgttcaacgcctcaatagccgcattagccgtttacgtgcgctcacgctggcatcgccggagcggcaagttgccggctttgaacggatgtcgcgcatctatgacgccatcgaaaacaacgatcctcagcaggccagacaagcggtactggagcatctgaccgaagccgcgcagcttgccaaacagattctatcctcacaggagtaa

SEQ ID NO: 72043 - DNA, 464 bp, Glycine max
  Peptide Sequence Number=SeqID_163728
agaaagtccattatgaagcttgggaaagatctaacaaactcagtctaatgttcatgagaatgattgttgcagacagtattaagacaactctccctaagaccgataatgctgaagagtttatggggttagtgggagagcgctctcaaacgactgataagtctgttgctgggacattaatgagtacattaaccaccatgaagtttgatggttcgcgtactatgcgcatgaatcaaggagctgaaaagaaatttatgaagaagcatgataaaggcaaagggccattaaagatcaatgatgactctttgcaaatccaaaagaagaaatgtgagcttaatgctcttggattccctacaatccaaaccataatcccagatgagaagttcgctttaatggagaataaagtgaaaggtccaatggaagcaaccaagacttatcgtttcaaacttgatactaacatcatttag

SEQ ID NO: 72044 - DNA, 222 bp, Glycine max
  Peptide Sequence Number=SeqID_163729
atggattcattcagtggagtggtcttaaagtggaagttcctcagtggagtggattcagggatctttagtttctcaaagacagccattgacttggtacaaagaatacgaataggcaatgttaaagtgcgtaaaggaagcccacttgtcacttgtctcttggaaggttcccgtggcagtggtaaaactgcactttcagataccgtgggtattgacagccactga

SEQ ID NO: 72045 - DNA, 240 bp, Glycine max
  Peptide Sequence Number=SeqID_163730
atgggaagcattatggatagcactgtctatgaccatttggaagcacagaaacaacatggtcttcaacaaccagctcttcattctcgaaaaagtcatggacgaggcactattccatacctggtcgtggctaagggaggaattctcctaggggggctgacatatcttgtcattgtattcactcttacttgggcagtggctctcactgcttatgctatatgttgtacacttcagtacatctag

SEQ ID NO: 72046 - DNA, 432 bp, Glycine max
  Peptide Sequence Number=SeqID_163731
atggcagcgcaattgatccatgatcgcgttatgatggagtgcctagagggtgtttgggagaccctcgaaggcaatgagaggtgccgattccgtggcacaattcgactcactactacttcactagtacatccggagcaactcgcacacacacttcagcagcctgtggagtggatactacctacacctactccatgtcgactagttgagctggttcaagtgatagaggtgtcatcctctgaaggggatcttgaagaggacccagaggagttacctcctgaacctgctatggacgcccctgacttaccagaggatgatgaggacccagtccctgatgttgattctccagaggatattatgtcagcatctaaggcaaactctacagaggagagtggccctggagggatagcgattagtgacaactcttcatcgtag

SEQ ID NO: 72047 - DNA, 951 bp, Glycine max
  Peptide Sequence Number=SeqID_163732
gtcgactctagaggatcccactgcgacgaacaacacgaccttgctgctttccagatcggccacgggtcgtcgcgtgtgccggcacgaatcacggggtctggcttcatctcagcacctgcatgccggttcgctcaccgcgcaccgctcgtccggcgagcccgcgcagcagttgtgcgtcaggtactcgatcaagccgttcatggcatcgaagttggcccgatagcagacatggcggccctggctttcactctccaccagcccggcctgcaccagctccttcaggtggaagctgagcgtggctgggggcacctgcagggccgtggcgatgtcgcccgccatgcgccctgccgggccagcctccaccagcaggcggaaggcagccaggccgcccggcatgaccgagcgcgatctggggccgccacgcatcctcctgctctacggctcgctgcggccgcagtcgttcagccgcaagctggcgctggaagccgagcgattgctgcgccatctgggtggtcggaaggccaggtctgggtcagccccgagcggcatggcacggtcaccggcgtgttcaagaaccagatcgactggttgccgctggaagatggcagcgtgcggcccacgcagggcaggacgctggcggtgatgcaggtgagcggtggctcgcagtcgttcaacaccgtcaatacgctacgcgtgctcggccggtggatgcgcatgctgaccatccccaaccagtcatcggtggccaaggcctggcaggaattcgatgacgatgggcgcatgaagccctcgccgtactacgaccgcgtggtggatgtgatggaggagcttgtgaagttcacgctgctgacgcgagggcggtcggactacctggtggaccgctacagcgagcggaagggcgacgcgcatgccgcggtattggcgcgggccgcaggggctgcggcttcctga

SEQ ID NO: 72048 - DNA, 514 bp, Glycine max
  Peptide Sequence Number=SeqID_163733
gctcattggccgcgatgctaagggtgcttctccagaagacgacgttagtctctgcatgcttcatgctctcagtcagatggatagcaaaagaatgtttaaacggataaccccacttggggctcggatggcgattgacaaaggggataaccacttgggtatttccgcctgcgcccaacttcacgggttagtaatgacagagtttgattatgcggaagaggatgtacatctccgtgtgtcaacgggctcaatgtttatagggataaccacttgggtatttccgcctgccacctatcttcacgggttcgtaatgatagagattgactgcgtggaagacgtggtaaatttccgcgtttcaatgggctcagaccgcgattggcaaagggtgcagaagacgacgttagtctctacatgctatcgtgctctagagattgactctgcagaagacgatgtgaatctccgcatgtcaacagggtcgttggccgcgattgacaaatggtgcagaagacgacattag

SEQ ID NO: 72049 - DNA, 828 bp, Glycine max
  Peptide Sequence Number=SeqID_163734
atggcgaggacgtgtggtcttcttaagtggaggacgtgcagtcctctaaaggcaaggacgtgtagtcctctgaaggcgagggcgtggagccctctgaaggtgagggcgtgcaaccctctaaagatgcatgcaacctttgtcttgaaatgcggtaaatgtggacttcgtatgcagcaatgcaatgttgtggaaagttgtacaatgttcatgacattcttgctctattttattggttgtccttttgaaagaggtgataattcatgcaacgttatcctatcttttgcaaatctctccgggaactccgttagagtgtatgttctgtttgatcagggaacctattgggtgagaacttctaatctgcccctaggttcacttgaggtttatgcctggtgtctttcattgcccaagtgtagggctctgagaaaaactttccggaatgataaaacgaggtcacatgaacgtccatattttacgggtttaggcaaggacaacggtggcataactagcctgataaacgccagaggaaatcgtgggaagtttgggttaggctataaaaccacacaggcagatataaggaaaagcattgcgggaaggaaaagcgaaagtcaaggctcgcgattaagacaagaagatgaaggaagcctgccctgccacataattaggagctttataagcgcgggtctaggggacgaaggccaagtcgttgcaatatgcgaagatgatgctccgagtgggtcagatttggtacgaccatgccctcctgatttccgactaggaaattggcgagtggaggagcgcccagacatttacgcgacaagcataatgtaa

SEQ ID NO: 72050 - DNA, 225 bp, Glycine max
  Peptide Sequence Number=SeqID_163735
atgtggatgctcattcaagttgcatgcgaagccatttttgggaagagaatgatggatggtgaagttaatttgtgggattcacaatcacgaaatgacaaagtcattagttggtcatccatatttaaaactgtattcccggatgctacgaacttactatgtcgatttcacattgacaggaatgtgaaggcaaagtgcaaaaccctggttgctcaaaagaaagcatga

SEQ ID NO: 72051 - DNA, 710 bp, Glycine max
  Peptide Sequence Number=SeqID_163736
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggaaggccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 72052 - DNA, 367 bp, Glycine max
  Peptide Sequence Number=SeqID_163737
gttacaggttgtaccatctgtggtgaggctcatgaaacaggccaatgtattcccactgaagaaaacacacaagaaattcattatatgggaaatcaacaacgacaaggctatactcaaggaggattttcaggcttccagcagggtccctataatcaacaaggacagtgaaggacacaccctgacaatcagttcaacaaagaccagagtgggccttcaaacaggccaatccaacaaggacctaatgatgagaatcctaaaactggccaaatacaggctaaaggcccaagtggagaaggacgaaggcccaaggggaaaaggacaaaacccccgagtggagaaaaatgaaggcccaagtggagaaggatga

SEQ ID NO: 72053 - DNA, 480 bp, Glycine max
  Peptide Sequence Number=SeqID_163738
atcctagaggtgaaggagacatcctcaccacttgtgtttttgcagtctttcatcttgttcttctctttgttgtaaaggaggtttccagactatggaaagctaaatcctctgctggatcttcccttggaaacaggtctgattctaaagtccttggtagtacaggactaagttgttgtgctatcacgagggattcggtgcacttgtcggccgtgaacagttacatgccttcaagctttcccgatttagtgttcgtcgacgaaaggattgaagtgggtctgaggaaaggcaaatttgattgtcttgctttgacaaataaaaagcctagggcaaatgaagagaaggagaaggaggaaggaacccatgttgtggctgccattcctacatggccaaatttcccacctgttcaacaatgtcattactcagccgatatcagcccttctcattacccaccacccaatcatccacaaaggccatcactaa

SEQ ID NO: 72054 - DNA, 636 bp, Glycine max
  Peptide Sequence Number=SeqID_163739
atgactttgctgctcagcaacatcctgcccagcgatcataattccgacctccccctgccgaagtgtcagctggtgtacgccatcctgacgcggatgagcattcatgtggctcagctaatcgctgatgccatctatatatttgcaggtatggtgcctaccaggcaccctctggaccctgataagtccaacagggccctgggatttcccgccttgatcacaggactttgccagtcgttcggcgtccccgtcacacctagcaaggtgattcggccgcccatcacccgagcttttattgagaagtactgcatgcagagacaggtccagggtgatgcaccacaggccgcggacgcgccgccacctcatcaggctggtccagccggattgtttgatacagagcagtatttgcggcatttgatgagtctcagcccgcagagccagggccttacttcttttccgtgccctactccggaccagttcagggcagaggtcgcatggcctggagattggcctgaggcccaggcaagagaggcaccagcaggggcactggcagaggctctcgacgaggcagatgaggcccgcgaggacgaagagatgaccgatttacttaatttcttaggagggagcggggccacatga

SEQ ID NO: 72055 - DNA, 443 bp, Glycine max
  Peptide Sequence Number=SeqID_163740
accatgtatgggggctgatgcttgcccagtgcccgaaggtcaaggaagttggtgacctgatgacaggggagccaacgaccgaggccctagtgaacagaaatcgtaattataacgatcctaaggtagcaaaattccttatcgggcctccttctgggggggaagagctattagtgagataccactctagaagagttagaattctaaccttgtgcgaggacctacgggctgagggacagtctcaagcagaagggagcttgactgcaagacccacccgtcgagcagggaggaaagtcggccttagtgatccgacaatgccgagtggaaggactgccgctcaacagataaaaggttgggttgttcgcccattaaagcgatacgtgagctgggttcaaaacgtcgtgagacagttcggtccatatccaatgtgggcgttagagcattga

SEQ ID NO: 72056 - DNA, 171 bp, Glycine max
  Peptide Sequence Number=SeqID_163741
atggtgtggtgtctccaatcatctttcttccatctccattccgctgctattgatcttcaagaagcaaaggacttcattgatgaagaagattcaaggcctacaagctccacatggagctacatcataaaggaaaaagaacaagctacaataaattgtaagcatcagggttag

SEQ ID NO: 72057 - DNA, 1332 bp, Glycine max
  Peptide Sequence Number=SeqID_163742
gaggccgccgcacgtcggcagggagaagcggtgccggtcaccgcgcaggtcgtgcagtcccgccagtggagcgacaccctgcaggcactgggcacggccaaggcccgtgaatcgatcagcgtgaccgccaaggtcagcgagatcgtcgagaaagtgcatttcgagagcggccagcacattgcggcgggcgcgccgatcgtgaccctgcgcggccaggcccaggaggccgcactggtccaggcgcaggccaccttccacgaggccgaccagctgtacaagcgccagcgtgacgcggccacgcagcgccgctgccgcagtgccaccgctggaagcacgcctgatgcgaactgggaaggccagcgctggagcgccggacctcggaccggcgctggctttgccaccttcgcgctgaatgccgcgtaccgtttcagttcgcagctgcagctcagcgcgggcgtcgacaacctgttcgaccgtgcctacagcgagcatctgaacctggccggcagcgccgacttcggcttcccggccgacccggtgcgcatcaacgagccgggccgcagcctgtggatgaaggtgaactaccgtccgcccccgcccgacgccctccgtcgggcagcttcgactctacgatggctgtcgccgccatgggcggctggatacacctcgacacacgccgacaccgccgcgaccagccttgcatggaacggattcaaggcgctatcacggcactggaccgttcatgttggctcgtatcgcttcgaccctggcccttggcctcagcctggccgtgctggccgggtgcgcaggcaaacaggaggccgccgcacgtcggcagggagaagcggtgccggtcaccgcgcaggtcgtgcagccagcgtggcgtggccgggccgtactttcgagggcgtggtcagcaccatcgacgcacgcatcgatccggccacccgtgcggtgaccgtacgtgccgacttcgccaacggtgaccatgccctgcgcccgggcatgctgctggacgtgcgcctgttccaccccgagcgcccggcgctggtgattccggaaatcgccgtggtgcaggtcggtcgcgataccttcgtgtaccgcatcaccgccgacgacagcgtcgagcgcgtggacgtgatcaccggcgcacgccgtgccggcgtggtcgagatcaagcagggcctggaagcaggccagcgcatcgtggtggacggtacgggcaagctgcgcccgggcttgaaggtcgcggccaaggacgcggcaccggccagtggtgcaaagcccgctgacgccgctgcaccggtcgcggccgagggccacggcggatga

SEQ ID NO: 72058 - DNA, 429 bp, Glycine max
  Peptide Sequence Number=SeqID_163743
atggggaaaaggaagctggagttaggttttgaagaccagaaaattgattttgacttgtttgttgaagacaagtctgctctagaacacaatatttgcttgcaggtaatgggagaaggtcaagaggttctgaagcgcctgcttctcgctaagtgcataatcgtttatgtgctaagccacgagtttcaagcgcttagcgcacaaccctggcatctgagactgactaattctgctaagctagccaatgttagctacgccaaaatcaactcgaggtcatggagcttagcacttaatctgttggctaagcagatattcttgcggtttaaactggatttgatgcagcttagtgccactcatgatcccgctaagcgacaacaccctcccgctaagccaaatcctgtgaaaaagaaattgaattttgaatttggctaa

SEQ ID NO: 72059 - DNA, 399 bp, Glycine max
  Peptide Sequence Number=SeqID_163744
atgggtcgtaggcaacgcactaacctttttgtggatgagctgaggagctttggaggtggcggcggtgcgtctattgcccgttactgtgatgtctcgccctgtgcatacttacctatggggagatcggcattgtggtcactgggcaaaatgctgctaagtagcaacgtcatccatatctatgtaagagtggtcatgttggtgcgcatgatccgcactcgtctctttgcagcggcacgggtgaaatcttgccccggtatgcatagtagctgcgcgatagcctccctctctagttgtgctcgcacagttggtcaccctccaatatcagggggtggcccaggaactgataaaagcaaactactagcccctcacccgggagcgcaggcctcgattaagcattaa

SEQ ID NO: 72060 - DNA, 252 bp, Glycine max
  Peptide Sequence Number=SeqID_163745
actcatcttctccttgaagtggcgtctcctctctcgcttcctttcttcattccgctgccattcatcttccaagaagcaaaggaattcattgatgaagaagatcctaggcctacaagctccaatggagcttacatcaagagtagtcaagaggagactacttcttctccttcctctagtggaagtgaagatgaagtaaagggtgaagagtttagtgaggaagtctacccccatgaagaaggtgacctcctaatg

SEQ ID NO: 72061 - DNA, 309 bp, Glycine max
  Peptide Sequence Number=SeqID_163746
atgtcaatcacgtccgctcagcggctcctcacaagaatcttactccctgcaccctaccactgtcattctgctcccacgaacaaggttcgtgatcatcacagtcccaacacatgccggaaatcaaaaagaagcaggctaacgcaatccgtgaaattccgtaatgtggcggaaaccaaaaggaggtgttgttacgcaacccgcccttccggaacattttggaagttgggttgcttaaggaggaagcaactgggcggcaagctcctccacatttttgaaaaatggtttccggggcttccgcggcttccgtaa

SEQ ID NO: 72062 - DNA, 516 bp, Glycine max
  Peptide Sequence Number=SeqID_163747
atggcatacaccaactggcacttaggcagagggaggtcggagttgtggtcgctaggtaggacgttgctgagcagtagtgtcatccatatctggggcatctgcatcgaaggggatctagtgacccctcacccacgagtgcatgtcccgaaccccctcctcagagggccaggcgttggcatagaattctatgactatctccgggtcaaatttagccataggggtcacttgtcgttcccaacgcttgcgagctatctcttcctggaagtcaggctactcgtcctccctgagctggacacgcctctccctatggaacgaccatcccttgatggcctcgaagcgttgctggtgttcggcactctagaatcggtgactgtcaaactccatgggggcgctggagccttccccatgggcgtccctcctggacctcttcgtggaaagcttcttcggagccatctcttgttggggacgatcaacaatgcaaatcgggcttggaaacgcaaaagaatggtgacctag

SEQ ID NO: 72063 - DNA, 144 bp, Glycine max
  Peptide Sequence Number=SeqID_163748
atgggtgagggtactatcgcaacctacccttcggtgggagggcgacgcgaggctcacgggtgtgtcttccaagggaggaaggcgcgcggagtcaccaccaacgtttatttgaggaaaatgtcggaaaaaccgaaaaaggtgtag

SEQ ID NO: 72064 - DNA, 366 bp, Glycine max
  Peptide Sequence Number=SeqID_163749
atgaagaagattcaagattcaagagaagttgatttcaagatgcaagagaagggtacatcctttgtggtacaagtagagggtacatctacttgggttgttgtaactgagaacaagataggttacatctcttgtggatcagttcaagtggagggtacatccacttggttgttcaaagagaacaagggagggtacatcccttgtggatcttttgcttgtaaaggtttttacaagggtgaaaagaaatctcaaggagcgcaggttgcttggggactggatgaggagtctaagggttgtgccaatagtggcctcgataatacttttaagccagaattggcaggaaaaaatatttgtagtaatcaagtttga

SEQ ID NO: 72065 - DNA, 957 bp, Glycine max
  Peptide Sequence Number=SeqID_163750
atggcatataccagaccaaaatcctcattgagaagctacttgaaatcccaaaccttgactatgcacacaaaaaaccgaaacttgaatatgccaaataagcaacgagtacctgtcattattgccaatgatgagctagtggtacctacagactcagcagtggtacatgcggctgagcctgcggaagctgttgatgagtcgatggtagatgctgacatacaggacacaggtgtagacaccggtgcagaggctgctgcagatgagcctatgggatttccaggtggaccgactgacccatcagtgctgactgagtatgctgagcatgttgcagctagcgtatggaccggggaagaacgtcctgaattgaagttatcctcccacaggaggaaggtgcagaaattaggtaggcctgtccctgccattgaggggctagttgctgggacaggactaaatcctttgatcgtgtgtttagcagacaccgacgatcgaggacttatatcctcgtttgtggagaggtggcaccgagagatgagtagtttccatcttcctgtggaggaggttaccatcacgctagacgacgtggtgtctcttcttcatctgcccatcattggcgacttccataccttccaacctctgcacgtcgacaaggcggtgctgatgttggtcgacttactactggtctcaccagaggcagccagggccgagacaggacattgtcatggacctgcaatcgatgttcatgttgtgttcttcgatgctctgcgcgacctcagtcagactgggaggtatgcatggggagctgctgccctagtgcatatgtacgatcacctgaatgatgcctgtatcagcaccagccgacaggttgctgggttgtcatacctaatttcgtccggggatcatctgtttgttgggatgcgaccctcgcttaatcactttgaggtacttggcacccatcgttag

SEQ ID NO: 72066 - DNA, 530 bp, Glycine max
  Peptide Sequence Number=SeqID_163751
cattgcctctgtagattccttctccggacaaccttgcctgtccgatacggcgatgatagtggcccgggtgatgttggggaattgttacaatcccggaatgggtttaagcaagaacggcggcgacagaaccagcctgataagcaccagaggaaaccgtgggaagtttgggttaggctataaacccacacaagcggacataaggaaaagtgttgcgggaagaaagagcggaagtcaaggctcgcaattgggacgagaagtcgaagggagcccgccctgccacatcagtaggagctttataagcgcgggtctaggacacgaaggccaagtcattgcgatatgcgaggatgacgctccgagtgggtcggatttggtacgaacatgccctcctggttttcgactaggaaattggaaagtggaggagcgcccagacatttacgcgacaagcataatatccgatgacgagtccctcgaaggtactaatacctgggacccgaccatcgatttcaagcaagaaacagatcagacggagg

SEQ ID NO: 72067 - DNA, 843 bp, Glycine max
  Peptide Sequence Number=SeqID_163752
atgacagaaaaattagcaagcgagacaaagattgaaaaggctttgatggaggaagaagttgatccatcaataaaggagaaacacaaggaaaatagagtgacgaatgtgggctacgaagatgattttcttgataaaccaataacagatctgatcaagaaggaagttgaagatttcatcatgaagcgggttggagcatcaatggcattggaatcttggaatttcaacttgctgggtgagcctttagcatttgactttgttatgtctatgcatgaaagctcaacaatggagccaaggcagaagggattggccaatgggttcagagttgatcccccatggagggacaccaaggaggcctaccctgttagtgtaaatgattcagttctgaaggatgagaaaaagggggaggagaaacttggagttcaaactgggtggaaggattttgatagaggggggaaaaagatggggaaaggagaacgcaagaatggagacacgcatggaagctatggagaaagcgatagaggagaatcacaaagcagtagaatcgcagttgagctcgatcgaagggatgatacaaaggtggcggcagcatgggagaaaaaatctcctatgatgaatgtgcacacagttgacgtgagcgaaggagataaggggaagaggacaaattggagggaaagctctggattggttccaatggtgggaatcttagaatacaaaccattcttgggatgggttcaagattgctatcacccaaaggtttcaggcttcgagtctggaaaatccttttcaagcgttgctggcactggaacaagaagagacagtgcagggattcatagtccaatttga

SEQ ID NO: 72068 - DNA, 363 bp, Glycine max
  Peptide Sequence Number=SeqID_163753
atgcaacctcaatttagccagattaacatctctgttacatggaggggaaagaaatttgttgtcgagatgaatataggagccaatgtgaaggatctagggcaggaattgcaaaagttaacaaatatcaaagaagataccatgcggttcattgttccacagatttctgccagaacgtcaaaacttctggcccccttttccaaggaacatgcacttttaagtctgcaggaaacttcaattaccgagataaggtataccatactactgattccacaatcagacaaacatagtctgaaggagaaccaaagtaaggttataattgaaatttacatgtgttactttccaaactgttctatcctctactga

SEQ ID NO: 72069 - DNA, 364 bp, Glycine max
  Peptide Sequence Number=SeqID_163754
cacctccagtattttcgggcaggatgtccaggacattgtatccgacatcgtggatcctgcagcttcaattcttcatttgacacttcatcttgccttgtgcattcaccatcattatcataactttccacaacactaccacctttcaaaaccgccaccaccttctcacaccaccaatcaaaattgcatcgacgtcaccgtcatcgatgtccctttcggacaggggaacaacttccactgtgccgagcaccctcaggtgcttcgcaaggtcccttgcaaaggcattgaaggaatcgtcgtaggactagctcccgatgccgaagatgatgaagcggtagtgggagaggaggagggagtcggcgagtga

SEQ ID NO: 72070 - DNA, 271 bp, Glycine max
  Peptide Sequence Number=SeqID_163755
atggggggtgcaaatagcaattttgaaattttgaattgggctttccagagtatttttcgaagctggattgcttctggaggcagcaaaccagatcgccttggcgagctgggcggcaacctcctccccctttttcttataaataggctgaaggggactattccaaggatccctcagccccctggctatcgaatccgtgaaggttttccgtcgttcttcaccgttcttcatccgttcttcatccgttcttcgttcgttcttcgttcttcaacgg

SEQ ID NO: 72071 - DNA, 225 bp, Glycine max
  Peptide Sequence Number=SeqID_163756
atgggtttgccaggcttaaaggagcactcaaacccggtgacccccaaggcctacactccgaagagtccgtcagggcctctccctcctgattcaggcctaggatcttcttcatcaatggattcctttgcttcttggaagataaatggcagcggaatggagaaggaagagagagaggagatgccacttcaaggagaagatgagtctagaagaagctcaccaccatag

SEQ ID NO: 72072 - DNA, 84 bp, Glycine max
  Peptide Sequence Number=SeqID_163757
atgcaacggattcatattagtcgccttgtcgataaatacgaagatgattatcaggttttaaggtttttgttaatgcactactaa

SEQ ID NO: 72073 - DNA, 459 bp, Glycine max
  Peptide Sequence Number=SeqID_163758
atgatgctcaagttggaaccaaattccgatgaggaaagtgagcggagaagtgcgcaagaagcttatccgcggggaggttcgatggtctacggggagttcccaacagcaacgagttgcgtcaccgtcacacaaacgttgatgtgcttgatgggcttggggagggtgagaagcgcacagttgaggatgacgtacaaaggcctcctcgaggtcgccgaagatggagaagagagagcggaggccatcgatggtggtgtcccagccatggctgcggaggaagagcttgtgctgggagacatcgtggtccacgatggtgcgcagtggtggtgccccagccatggccgcggaggaagagcttgtgctgggagacatcatggtccacgatggtgcgcacagcagcaaggacatcgaggtggcacaccaccgcgtcctaaaggatgtcaaggaactggtcgggggtga

SEQ ID NO: 72074 - DNA, 612 bp, Glycine max
  Peptide Sequence Number=SeqID_163759
atgtctcctccactgctaggacctcacaatcactcacaaactcatctcaagctctcaagacggcttccttttccagctctagtctctacagatcttcacacaacaaaatctctcaaactctctagaacttggacctttctctctctagaactctctagacatgcagaagcttcaagaaaaggccaaactcctctcaaaaatctgatttcaggcttaaataggtggctttgttcatgctccggatggctcgaagcggtgcgcttagcgggatggccctttgatcaacgaacaagcacagttcatccttcttccagattctttctcgcgcttagccgaggattgttgcgctcagtgaatggctcgctaagccaacaaattggcttagcgggagggttcgtgcctattcaagtctttcatccaaattttatgattatcattgatgatgaaaacgaggatgttgaagaaaatattataatggcagcatctcttactagtccaaaggacatcgcttttatgattaagcacaaattagggatcgtttctattggcatgaaagacaaggatcttcaaagactgaacctccctcttatgtcaccagagactgaaagataa

SEQ ID NO: 72075 - DNA, 222 bp, Glycine max
  Peptide Sequence Number=SeqID_163760
atgcagtatcaatgttcatctcctcctcctgccgttgatattgagatggaaaaatgcactaaacctggttctggtgctgctaaagccgagctacggaaacggcggagaaaacgaaacgaagaagaaacaaatactaatagaaagaataaaagagaagcaagcacagcacaacgagtcgtcgaagtcgtcgggttgaatggaagaacaaagaacagtggctag

SEQ ID NO: 72076 - DNA, 1128 bp, Glycine max
  Peptide Sequence Number=SeqID_163761
atggagtatgatgcaaagtctggtcagtatgccaagaaaagctatacaatttttaataagtccagcataccacgttttgaagctggagttgttgttgtatctagattaaagtttgatgaaatgcaaatgcttcatcttcatgtggttaagattgcaacgtcaagaaagaagcattctgaattcattagctatccaatttccctttggattgacaagactattgaaaaggagatttttgatgatgaggatgaggaagagaacaaggatgaggagcgtaaagttgaagataagcctatttggatgaggaaacctcaagagattacgaaagaagaatatgttgctttctacaagagtgttgccaatgatttggaagagcgtttggctgttaagcacttttttgttgagggtcagctggagtctaaggctgtcctctttatccccaagagggcaccttttgatctctttgacaccaggaagaagcctaacaacatcaaactgtatgttcgccgtgtcttcatcatggacaactgtgaggagttgatgcctgaatatcttagctttgttaagggtatcctttgttctgaggatcttcctcttaacatttctagagaaatgttgcagcaaaacaagatcctgaaagtcatcaggaagaacttgaacaaggaagactataacaagttttatgaaggcttctctaagaacatgaaacttggtattcatgaggattctcagaacaagacaaagctagttgaattgctcaggtatgactccactaagagtggtgatgagatgaccagcctgaaggactatgttaccaggatgaaggaaggacaaaatgacatctactacattattggtgaaagcaacaaagctgttgagaattcccccttccttgaaaagcttaagaagaaggggtacgaggttctctacatggttgatgttattgatgagtatgttgttggtcagcttaaggaatttgagggaaagaacttggtctctgctacaaaggaaggcctaaaacaggtaaaaaatgttgatgttttagctgaacgtgaagcgtcttggtctcaacatgttttagttttagagcactttcccatgttcaaatgcttctcttggaagctttag

SEQ ID NO: 72077 - DNA, 141 bp, Glycine max
  Peptide Sequence Number=SeqID_163762
atggggctttgtgttgagctgcgaaagaggaaaacccaaaacgacaacaggaacacgaagccgtgtttttcaacgcccatgggtgaccggttcagccggttctccacagttgacatgtttatatattttggtaatgaataa

SEQ ID NO: 72078 - DNA, 507 bp, Glycine max
  Peptide Sequence Number=SeqID_163763
atgatgaccataacaacaaaacatttaccccgtgtttggatgagatatttaaataaggaattgaaattccaccatactcatatcggaggagtgggagggtcaagcaatgccgacgacgatgctagtgcagtgtgcttcttattcttcttcgtcttcttcttcaacttgggagtggggacctcagcgctgggtgctaccacgggtgtcggagttgtcggtaccagtgcagggggagagctcaccggaacaggcgatggtggagaactcattggatctggcactggcggcaagctcacaggtgtcacagcaggaggtgtagccgtaggaggagtggccgcgggaggtgttgccaccggaggagtgattgctggagctggagcagcagctttaaacggaggagatgctaccatgggagatggaacgagaggggttgcggttgcaacattggggatgaagatggagaagatgaagtgggagaagcaacaagcacagttgattttggtttag

SEQ ID NO: 72079 - DNA, 480 bp, Glycine max
  Peptide Sequence Number=SeqID_163764
atggactgttgttgtatgaggtttatgttgcctgaagacttggggaatgtgaatcccatgcatgaatttatatggggtgtagtgaccatgttggatatccttggaggggtgtcataccctaatttcgttcggggactattgttcattgatcttttgatccttgctagtcgacttacgcctgggcccccaaatgacttcagggtgaaggaaccagctcgcctgggcaagccagttacttcaggagtaagtcttagctcgcttgggcgagctgcctatgccccaagtgcccattttccaataaataggtgtgctagggaggccgaggaagggttgcaaggtttagaagttgagggaattgagagaagagagaaagaagaagaagaaagaagaggaaatgaagtcgaggcactgccgaatcacaactgtgatcaatctctacattgttccttgtttggtgtttttcgtgcgatcgtcggttag

SEQ ID NO: 72080 - DNA, 303 bp, Glycine max
  Peptide Sequence Number=SeqID_163765
atgccatcaagtttcagtgggattgacagacccttggcatcactctatgactttaaatcaggaaagtttcacttggtcacataccaaagggaacggaaacgtcacgcatactccagacatcttctcaaagatcccaatggtcagatcatggaaaagtgtcttgtgaagctgcaaaccaaccttcgagaagatccaacggttaacgaagtatgggcagcgtttttaccgagacagcttcatgtagcttccttgagaagcttcattaagaggcttcctcaagaagcttcctcgtggcttctttga

SEQ ID NO: 72081 - DNA, 237 bp, Glycine max
  Peptide Sequence Number=SeqID_163766
atggggacaaatcaaaacggaaaaagattttatcaagtcaaggttaagggtcttgatgtcaccagcctcaaggaattgggacgattgatgggacctctccaaaggcaagccttctgcaaagtgtaccaaaagattctagatttgaccgcagcggaggtatttacggaagctgttgtatccctcgtccaatactatgaccagccgttgagatgcttcacgtttggggacttccaaatg

SEQ ID NO: 72082 - DNA, 372 bp, Glycine max
  Peptide Sequence Number=SeqID_163767
atgactgaccccataaaccaacacgatactttttcaacatgttttgtcctcactcacacgcttctcgagaaactttccaaaaggtgtcgcaacatgcccttttgcgggcgtgcgagacgaggctcacgggtgtgctttccaaaggaggaaagatgcgcggagtcgccaccaacgtttatttgtggaaaacgttggaaaaaccgaaggaaaccggtcgacaaaagcggggcttttgctcctacgtaccctccatcgaagaggaaatcagacctacgtagttctttcttaagggtgaatcacgcgatttctttttacttgaaaggtgatcatttaaaggtgttggaccttaaaaatgatccatttacttggtga

SEQ ID NO: 72083 - DNA, 201 bp, Glycine max
  Peptide Sequence Number=SeqID_163768
atgtgcatgccctgtattagccacaatcaacaacaaatgatacaggtaacaaatgatgtgatccgatcatatgctcaagctatgccttttctagatcctagaattgaatctttgttggttcaagctaggttttcagatgttgcaaagcttggacaaattaaaattgatgatgctttagtgactgctttggttgaaaagtga

SEQ ID NO: 72084 - DNA, 492 bp, Glycine max
  Peptide Sequence Number=SeqID_163769
atgaccatagatgaattaaagatcctaaacatcccctcagagatgtttaaactctttaaccactctattttcccacacaggggacatccgacaagcatgcaacagggacaaacatatattctcatagctaggttccctgaccctaaccatggtgtaaaaacggtttttcgaaggaagcgtaaaacatacaatgatggttccaaagtcagaaaagatgcaaagataagcttaaattaccaaggaacaagcttaaaatcacggttacctcgaagaaaaccgcgaagggttcctctcggtgtggggtttcaacggagagctacggcggcttatggcggccaccggtggttgtgggtggtggagaagaagcttgggacgttggaaatggttttggggaagaggaagagaaaggaaagactgtttttccaaggctacacgaaaaataaagcttgcaacactcaagtgtttctgctctcgggaaaggaagcgtcttga

SEQ ID NO: 72085 - DNA, 150 bp, Glycine max
  Peptide Sequence Number=SeqID_163770
atgggtgcaagggataaatcaatcatgcacaagggaaataaaaatcctgatcctgtcaatgatcttgtgcatgctcattcagatccagtgatggtgcagatgatggatcttgagaaagaggcaggtctggcactggtgcagatggcttag

SEQ ID NO: 72086 - DNA, 531 bp, Glycine max
  Peptide Sequence Number=SeqID_163771
atggcgaatcaagaggagtgggttccatttgcggatataatagctttgctaatctttggggttgtcctctttccaaacgtggacggtttggtggacctagccgcaattgatgctttccttgcatatcaccatagcaaggagagcccggtggtagctatcttggcggacttatttgatacatttgaccgaaggtgcgagaagaacagcgcacggattgtctgctgcttacccgctctttctgtgtggttggtttcgcacctattccaacaagacataaggcacccgtgtccgcttcaaagttatcactcgtgcatcgaaaagagaagagtagattgggaccaatacttggctgggataggaggcagcacaatcaactggtttccgcgatggaaggaaggaaaggagggagttctcttctcatgtggggactacccaaacgttccattgatagggatgaggggttgtattaattataatcccgcacttgccataagacagttagggtaccctatgaggggagcactgacgtaa

SEQ ID NO: 72087 - DNA, 303 bp, Glycine max
  Peptide Sequence Number=SeqID_163772
atggaacaaattagtgtgaaggtgcacccggaaccattagctggacatgaagtgtctcatcgggtgaaagacatcatcactatttttggtaagacacaaaggaaggatcatgctgacaagaacatttggaagaaaaggcaagacaaaagatggtctgaaatgtcgtcaggatttggtggagatggatatacgatagcagtttcatccacaggccaaaggtcgccgaacgtatttttcctctgcatgttacacaatgtcaaccaaggagaagaaacaattttgcaattgtttgaaaaatgttaa

SEQ ID NO: 72088 - DNA, 465 bp, Glycine max
  Peptide Sequence Number=SeqID_163773
atgaccggccctctcgatgagtcaatcttttgctttctcatatgggtggacccttgggtactagtacctattgcctttagaggactacatgtcctcgactttagagggctgcacgccctcgcctttagagggctgcacgtcctcgcctttagagggctgcacgccctcaccttcaaagggctccatgctctcaccttcagagggctgcacatcctcactttcagatggctacacgtcctcgcctttagagggctacacatcctcacctttagagggctatgcgtcctcgccttcagagggttgcacaccctcgccttcagagggctgcacaccctcgcctttacagggctgcacgccctcgccatcaaagggctgcacgtcctcgccttcagagggctgcacaccctcgcctttagagggctgcacatcctcaccttcagagggttggatgcccttatgttctga

SEQ ID NO: 72089 - DNA, 591 bp, Glycine max
  Peptide Sequence Number=SeqID_163774
atggggacaaatcaaaacggcaaaagattttatcaagtcaagattaagagtctagatgtcaccagccttaaggagttaggacggttgatgggacccctccaaaggcaagccttccgcaaagtgtacggaaagatcttggatttgaccgtagtggaggtatttacggaagctgttgtatccctcgcccaatactatgaccagccgttgagatgcttcacgtttggggacttccaaatggtaccgactgttgaagagtttgaggagatattaggatgccctcttgggggaagaaaaccataccttttctctgggtttcttccctccttgagtaagattgcagctgtggtcggagattcggcaaaagagttggatcgcatgaagcaaactcggaatggcgtagtgggcctgccgcggaaatacttggaaggcaaggcaagggacatggcaagccaagagaagtgggtcctgtttgcggatatactagctttgctgatctttggggttgtcctctttccgaatgtggatagtttggtggacctagccgcaattgatgctttccttgcatatcaccatagcaaggagagtcctgtg

SEQ ID NO: 72090 - DNA, 91 bp, Glycine max
  Peptide Sequence Number=SeqID_163775
atggttgatcccatcttcgcacttggcgatcaggatttcttcttccccgatgtctccccgctactacttcgtcagcctcagcagaaagttg

SEQ ID NO: 72091 - DNA, 138 bp, Glycine max
  Peptide Sequence Number=SeqID_163776
atgagtgaaacacttgaagtgagggacaattttctagctacaaagggagaggaatttgaagaggtgtttccatcaagtgttccaagtaggttgccaccattgaggggaattaagcatcaaattgatctcatgtcgtga

SEQ ID NO: 72092 - DNA, 195 bp, Glycine max
  Peptide Sequence Number=SeqID_163777
atggtgtcggaggacatagagaagactatgtttgtcaccttgtggggaacatgctgttataaggtgatgtccttcaggaaagctactcggcttcgttgcattcggaaggatcaagaaatgccttatgaatcctcctgtgcttatgccttcggtgcccaggaggcctcttatcctatacatgacagtgttggatga

SEQ ID NO: 72093 - DNA, 270 bp, Glycine max
  Peptide Sequence Number=SeqID_163778
atggtcgcaaaagagaccaatgaagcaaaccccaccccggatgaggatgttccagtggggaggttcgctgaaaaaggggaagtactcggcagaaaagaggtatccttggaggaggccaatgagttcctccgtataatccaacagagtgagttcaaggtgcatgtgacccaagacatctccatagaaggctttgaggggattgtcaacaacatcactgccaataactaccttaccttcgctgaggaggagattcctgtcgagggacgatga

SEQ ID NO: 72094 - DNA, 666 bp, Glycine max
  Peptide Sequence Number=SeqID_163779
atggaatttgtaacgacaggagatggttcgaaaacattgtttaatgccgaaataggtgaatgttatcactcaacacatggtgcggtacaggaaagcaggcatgtgtttgtcaaaacagggctcgagcactatgtacaaacaacgggagcaaccgatgtcgatattttggaagttgggttcgggactggtttgaattttttgcaaactgccgactttcttcaggataaatcttttagggtcgaatatgtcggaattgaagggtttccattgcctttatctactgttgctgcaaccggctatgagacgacggtagatccgaaaatatggactgattatcttgatacctacgaaagggcattggtggagaatgtgcagctcaatgaacggctaaaactttatattgatcatactttattactgaattttcaatcggaacggttatttgatgttgtttatttcgatgcctttgctgcggtgcatcaacctgagatgtggaatgatgcagctttggggcatatcgcccagtttattaaacccggtggagtctttgtgacttacgctattaccggaaatctcaaacgcagcatgaaagcattgggattttcaattgaaaaggctcccggagcgccaggcaaacgggagatgcttcgcgcgacaaagttgtag

SEQ ID NO: 72095 - DNA, 90 bp, Glycine max
  Peptide Sequence Number=SeqID_163780
atgtgggaggatgaatttgtgcgatacaacataagagttggtcaggaaaaagacagatcaggaagctggttagcaggagttagtgagtaa

SEQ ID NO: 72096 - DNA, 267 bp, Glycine max
  Peptide Sequence Number=SeqID_163781
atggcttacactcacattccggattcaacaagcgattctcctcaaatttcagccagcccgtatcaattagacttcacactttatgcttcggggtcatacaatgctcaatggaatgccctggggcttctccgcgacaagcacacgttgcgttcgagtcgtattcttggagaaatggaggttgatgaacctcggctagggttatggctaccattgaattatcaagtagatgtgggagcaagtcagcataggacactggaattggggtga

SEQ ID NO: 72097 - DNA, 132 bp, Glycine max
  Peptide Sequence Number=SeqID_163782
atgaaaactccccctccctcgtttttaatatttgcaggtgcaggggtgcttgcccaggataataggctgccttgcagcggcgttttccatttgtccagagctaggcaagggacgacgacccatcgatcataa

SEQ ID NO: 72098 - DNA, 546 bp, Glycine max
  Peptide Sequence Number=SeqID_163783
atggtcgcaatggaagggaaggcactaacctggtaccaatggtgggaattttgcgagaaaaaccctaattggacagatttcaagaatgctgtgattcagcggtttcagccttcaatgaaccaaagcccttacaagttactactcagcctgaaacacgaaggaacagtagaagaatatcgggagaagtttgaattgtatgccggtccattgagaggaacagaacttgagtatttgaaaggcatatttctgaatggactgaaagaagtggtgagggcagagttaaagttggatccagtaaacaccctccctgaattgatggactatgcgcaatggatagaggagaaaaattcactaatggaaaaaggtaacgttggaggccttttaggaggctgtcagacgcggaattccaagaaagggcagaaaaaggactttgttaccgctgtaatggggaatttggccctggtcatacaacaacaacaacaacaacaacaacaacgccttatcccactaggtggggtcggctacatggatcaacttccgtcataa

SEQ ID NO: 72099 - DNA, 499 bp, Glycine max
  Peptide Sequence Number=SeqID_163784
tccttcttcctttacgccaatagctggcatccctgcatcttctacttcagccctacctccagctttagcagactatctgcccagagctctcagacttcagatgccaaatgtcaaagcttgtttgaaggacagattctcattatacaaagcttcccaagcacctcaacagcatgagtcaaaaccagaaaacaatcacccatctgaagccaccatctctagagctgttgattgtaaaaaaagaagattagagacgagatccaatgagcctgctcatcatggaccagtgccagcatctgctaatgcaccatttccaggagtggatccatcttcacctcagcacatagcagactcttccattcctgtctcagagatacataagggccagactataccagttctacctttggacacttctcctacagctactccagtatggcatctacctgatgagaagaatgttcagatacaggacaatcaagaccagtcacaggaattttaa

SEQ ID NO: 72100 - DNA, 201 bp, Glycine max
  Peptide Sequence Number=SeqID_163785
atgggtgccaagtacctcgaagtagtcaaacgagggtcgcatcccaacaacggacggtccccggacgaaattaggtaccgacacatcatccagataccatcaaattcgttcctctgggttgacgcaaggcggagaatgaccataatttgtctctacgtgttgttggacacgatcgagcctaggcggcaagacgcagaatga

SEQ ID NO: 72101 - DNA, 231 bp, Glycine max
  Peptide Sequence Number=SeqID_163786
atgggtctctgtcagttctacggagtgcctgtcacctccagcaagggcatcaagccccctactaatcgagctttcatcaagaagtactgcgtccccaggcaggcacagggcgaaacaccacagcagcctgaggatggccggcagcgggcaacagacgcaccgccatcacctctagagttcacctcagctcatccacaaaaaggtagaaagataccttggatatgcatgtag

SEQ ID NO: 72102 - DNA, 796 bp, Glycine max
  Peptide Sequence Number=SeqID_163787
agggctacacgccgtcgccttcataggacgagacgtcctcgccttcataggactacacgccctcgccatcagaggagcacacgtcctcgccttcatagggatacacactctcgccttcagaggactacacgtagtcaccttcagagggctagacatcctcgccttcagaggactgcacgtccttgcctttagaggactacacatccttaccttaagaggactacacaccctcgccttcataggactacatgcccacgccatcagaagagcacacgtcctcgccttcagagggatacacgccctcgccttcagaagactacacgtcctcagcttcagaaaactacacgtcctcgccatcagaggaatacacatacttacattcaaaagactacacgtcctcgccatcagaggattgcacgtcctcgccttcagagggctgcacaccctcgcaatcagaagactacacatcctcgccttccgagggctacacgcccttgcctttagaggactacgcgtcctcaccatcagagggctacacaccctcgccttcatagggttagactccctcgccttcataggactagacatgctcgccttctgcgggcaatatgccctcgcctttagagggctatacgccctcgcctttacagggctacacgccctcgcctttagaggactacacatcctcaccttcagagcgctacacgccctagcctttagagggctacacgcccaaacctttccttcagagggcaacacgccctcgccttcagaggactacacatcctcaccttaa

SEQ ID NO: 72103 - DNA, 153 bp, Glycine max
  Peptide Sequence Number=SeqID_163788
atgaaatgccccagggctcctccacgatatgcacatgttgcgttcgagtcgtatcctcagaaaaatggaggaatggtagtcacagcatgggtttctccctcatcctcaccctcttcatttgccccagttttctcattcgtccaagcaggatga

SEQ ID NO: 72104 - DNA, 324 bp, Glycine max
  Peptide Sequence Number=SeqID_163789
gtttttcaaaggaagcgtaaaacatgcaatggcggttccaaagtcagaaaagatgcaagggggttcctctcggtgtggggtttcaacggagaacaacggcggtttgtggtggctaatggtggctgtgggtgatggagaaagagcttggaacgttggaaacggttttagaagaaagaaggagaagaaaatggtgtttttcctaagctacttggactacaaggctcaaaacgcacaagtgaccaatgctctcgggaacggaaaattcgcgcacactccagacagctactcaaaaatcccaacgatcagatcgtggacaagtgtctg

SEQ ID NO: 72105 - DNA, 483 bp, Glycine max
  misc_feature (390)..(390): n is a, c, g, or t
  Peptide Sequence Number=SeqID_163790
atgggaacaaatcaaactggaaaaagattctatcaagtcaagattaagggcctatatgtcaccagcattaaggagttggggcggttgatgggacctctccaaatgcaagccttccgcaaggcgtacggaaagattttagatttgaccatagcaaagatattcacggaagccgttgtatcactcacccaatactatgaccagcctttgagatgcttcacgtttggagacttccaattagtaccgactattgaagaatttgaggagattctaggatgtcctcttgggggaagaaaaccgtatcttttctctatgtttcttccctccttgagcaagattgcggttgtggtcagggattcggcaagggtgttggatcgtgtaaagaaaactcanaacggcgtagtgggcctaccacgaaagtacttagaaggcaaggcaagggatatggagaatcaagaggagtgtgtcccattatggacgtattag

SEQ ID NO: 72106 - DNA, 519 bp, Glycine max
  Peptide Sequence Number=SeqID_163791
atgcataaggcattacgggccaatgcacctctcccttaccctcaattggtcactctgtttctccgtcattttcaaattccgcttgatgatgaaccatttgttcaagtcaagcgtttctttgctattggcactggtgtagtcacttcttttggataccgtaaggatcggaatggtcaatggctgaagaaagatgcacttccttcacaagatgagcgtactccttctcctcctcctcagcgagatgattcagccctcatgactgaagttctttccgagttacggggtcttcgtacttatgttggagaacattttgattcattggataatcgttttgccggaatggatatccgtctcacacaacttgaagaagatgtgggttatattcgtcagagcttcgatcttccaccaccacctccaccttcttcgagtttagtttataattttctttttaagccgtgtattttggctatggacttaaattgtcatcatcaaaaaggaggagattgtagaagcaaatga

SEQ ID NO: 72107 - DNA, 285 bp, Glycine max
  Peptide Sequence Number=SeqID_163792
atggagaagaaggggagaagaagaagaagaagaagaagaagaagaagaagaaaggggctgaacggcgctagggcctgtgtgcggaaggctgaggaagctaggtcattctgcacccatgatacgcggagataccttacggttatccgcacccctttgccattcagacacagtcgtgtccgatggcacgcagagaccaagtttggtcattctgcacccatgatacgcggagataccttatggttattcgcacccattcttttgctatctgtaagacagaacgcttga

SEQ ID NO: 72108 - DNA, 732 bp, Glycine max
  Peptide Sequence Number=SeqID_163793
atggatttcttttctaatgagagtttcgaatgcattcaagcatttcaaaactcaaatctcatcccctttatgtctttaaatctgcctgtgtattctgaattggtaaaagctttttattctaaccttgaaattcaagaaagtaccttgatttctgaggtttatgggataaagatggtcattgaccaatccctcttctatgatttgacccaattgtctagcgaaggtgtaccatttgaaggtacactggatgatgattggaaatttgatttttctgtgcatgatgcccgccggttggtttgcaccaaccaagcggatatgaccggaaggctgcttgctggttcattggctcttgaaagcctcatccttcactatctattgttcgtattttacttccaagatcttcaaaccttgctcagatctttcttgattggtgctgctgtggttgcctcctttggttaccgcaaagagcgtgatggctcttgggtaaaaaagggtgctcaaccaaatgatgatgaaggacacttatcggttgaaggggactcttctctccttcaaagtattttggacaggtttgatggacttcaaacctatgttggtgagaggtttgactccttggaacttcaagtgaacacacgattcgaggagatgaactcaaggattgcaaaggttgaagaagatgtcaccatcattcacgactgccttgatttacctccatcaccaccatcagtttag

SEQ ID NO: 72109 - DNA, 681 bp, Glycine max
  Peptide Sequence Number=SeqID_163794
atgcataccggggcaagatttcccccgtgccgccaaaaagacgagtgcggatcatgccccaacagggccctggggtttccagctctggttacgggcctctgtcagtcttacagggtgcccgttcccccagcgaggtcatgccatcgtgacataggatcgcacccacaaagacacctagtggacccggagaagtccaacaagggccctggggtttccagctctggttacgggcctctgtcagtcttacagggtgcccgttcccccagcgaggaatcgcacccacaaagacacctagtggacccggagaagtccaacaaggccctggggtttccagctttggttacgggcctctgtagtcctgcagggtgcccgttccccctggaaaggtcacgtcatcatgacggatcgcgcctacaagacacccagtggatccgaagaagtccaacagggtcttggagttgtcaagctctaattacgggtctctgtcagttctacggagtgcctgtcacctccagcaagggcatcaagccccctactaatcgagtttttatcaagaagtactgcgtccccaggcaggcgcagggcgaaacactacagcagcctggggatggccagcaacgggcaacagacgcaccgccatcacctctagagttcacctcagctcatccacaaaaaggttag

SEQ ID NO: 72110 - DNA, 373 bp, Glycine max
  Peptide Sequence Number=SeqID_163795
atggacaaaccagaatatgtttggcaacaaacatggcaatggatggcagatgatattaaactcaatcatagaaaacaagacgagcaaaaatctattattgataccattatccgtgtcgttgacactcaatcagcaggagtttacttcctctatggatatgatggaactggcaagacatttatctggacaacattatcatttgctatacgctccaatggtggtattgtttgtacagttgcttcaagtggaattgcttcagtactatttcctagtggtagaacaacacattccaaattttctataccagtgcctgcaacacagaattcaacatgcaatattcatcaaagcagcgacttagctaaatttattgaag

SEQ ID NO: 72111 - DNA, 189 bp, Glycine max
  Peptide Sequence Number=SeqID_163796
atgacagaacatgcctcacaatggggagaccagtcagggtcacgctgttttgcgagaatgctccaaccatatggaatcgacatagacttaaaggagcactcaaaccggatgacccccaaggcctacacttcgaagagttcgtcagggcctctccctcctgattcaggtccaacccaaaaaaacatttaa

SEQ ID NO: 72112 - DNA, 141 bp, Glycine max
  Peptide Sequence Number=SeqID_163797
atggatacccgtctccgtgtgattggtgatcccatgaatgaagttcaatgggggaggggtcacaaaccactctttgaggattcacctagtgagtgtggtggtggggctgccactgtgagatatgggctaatctctaagtga

SEQ ID NO: 72113 - DNA, 110 bp, Glycine max
  Peptide Sequence Number=SeqID_163798
atgggtaatgggtatagagaacaagaacaaggagtgaaaagagtcggtggcgttgccggcgccttgtcgcacgtgcacattataacagtagctgcacacatcaacgtctg

SEQ ID NO: 72114 - DNA, 963 bp, Glycine max
  Peptide Sequence Number=SeqID_163799
atggagcgctatgagatcctcaaagatattggttcaggaaattttgctgtggccaagcttgttagagacaactacaccaatgagctttttgctgtcaagtttattgagagaggccagaagattgatgagcatgtccagagggaaatcatgaaccacagatcattgaagcaccccaacattattagattcaaagaggtcctgttgacaccaactcatttagccatagtaatggaatatgcttctggaggagaactctttgagaggatatgcaatgctggtagattcagtgaggatgagcaaatctgtcatagagatctgaagcttgaaaacacactcttagatggaagcactgcaccacgagtcaaaatttgtgactttggttactcaaagtcatcagtattgcattcacaacctaagtctacggtgggaacgccagcttacattgcacctgaggttcttacaaggaaagaatatgatggaaagattgcagatgtttggtcttgtggagtcaccttatatgtgatgttagttggggcttatccttttgaagacccagcagatccaagaaacttcaaaaaaaccattggtaagatacttagtgtccagtactcagtcccggattatgtacgagtttccatggaatgtagacatcttctatcacaaatattcgtggcaagtcctgaaaagagaataacaataccagaaattaaaaaccatccatggtttttaaggaacttgcccatggaactgacggaaggtggaagctggcaaatgaatgatgtaaataatccatcacaaaatgttgaggaagtactgtctattatacaagaggcaagaaaatctcttaatgttcccaaggttggaggccttcttactgggggcagcatggacctggatgactttgatgctgatgaagatcttgaagatctagaaacaagtggtgaatttgtgtgtcctatttaa

SEQ ID NO: 72115 - DNA, 333 bp, Glycine max
  Peptide Sequence Number=SeqID_163800
atggcggaaactgctgacaaatctcaatctctcgccgaggaatattatgtgaatgacaagcaaacaactgtagttgaaaaagctgttgaggtcaaagaagttgaaaacccaaaggtagctgcttctgaggaaccagttgctgagaaaactgtggaagaaacaactcctgttgcccctgcagttgctcaggaaagcagtgaagtcacccctcctcctgctgaagaaagcactgaagagcaaagtagtggaaatgttgaggaaaactctggcaatgaagatgtagctgaagagacccctgaaattaagcattggacgttgttgattatctgctaa

SEQ ID NO: 72116 - DNA, 426 bp, Glycine max
  Peptide Sequence Number=SeqID_163801
atgaaggacaagtatcttgttctaagcttgttaaagaacttagaaaaaatcaagaacaagcttgttcgcacatcgttcgcgtgtatgaaatccactccacaagcttgtggttatgcgagcattaactactaccaatatatagatgttgtttacacaaatgagcacatcttaaaagcttactccgcacaatggtggcctcttgggaatgaagcggcgattcctccttctgatgacgcatggacacttatccctgacctaactacaattcgtgcgaaaggtcggccaaaatcaacaaggataaggaatgagatggattggctcgaaccatctgagcaccaacaaaaatgtaatagatgtggagtagaagggcacaacaggcgtcgatgtccaatgcaatctgaccgtgggagttgttcatttaattga

SEQ ID NO: 72117 - DNA, 225 bp, Glycine max
  Peptide Sequence Number=SeqID_163802
atgagttgcttcttcatatcaggctggggggggtctgagaagaggctggggggagggtgtggggggcaggcgcctgactgccctgcgctagcagtcgcgcctgcagcaggggcgctagccaaggcgccaggacccaaggcgcggaccaaggcgccctcgtgcacagtgcttccaatcttgcagtgccacgtgtcagtgtttcgcgggaaacgccttcaggagtaa

SEQ ID NO: 72118 - DNA, 783 bp, Glycine max
  Peptide Sequence Number=SeqID_163803
atggtggcggcagcggtggcgactccattgtggcagcctcaggagcaagggttcgaggagatctgcggcctacttgagcagcagatttcgcattcttcttccgtcgataaggctcagatttggcagcaccttcagcgctactcgcatctccctgacttcaacaattacctcgccttcatcttctcccacgccgtgttacttaggaactgtagctttttcagttgtgaatgcttttttctggttcctatcattcaagtatcatcaatgatatgttcacggtgttttgttgagaggcctaattctgaaagcataaggagaggcaagaactcaatagagaagagccttctggtttgggtggtcctcagtgtgagagttatgttcttgattcaagaggctcttttgtggagaggcaagcagtggtctctagaaataattatgagtgacaatggtgaagaagctggagaaaatcgtctagttccccgtttgaatgaaaggattctttcatcattgtcaaggagatcagtagctgcccatccttggcatgatctagaaattggacctgaggctcctcagattttcaattgtgttgtggagatcactaaaggaagcaaggttaagtatgaacttgacaaaaagactggattgattaaggttgatcgggttttgtattcatcagttgtttatccacataactatggttttatccctcgcacactgtgtgaagacaatgatccaattgacaaaattcattctaagacaaaaagaatgagcacaaggaggtag

SEQ ID NO: 72119 - DNA, 513 bp, Glycine max
  Peptide Sequence Number=SeqID_163804
atggctgtctacgctagcataataccaggagaccctattgatccttctcctggttctcctgacaaacttaaaaaatgtattctctcccaggaaaatttggattattggcacaatattcacgatacttgtatcctttacgaggggcaaatggggacccttgctacaattgaaagacctgaaattttcacttgtgtgatgggcgatgtcgcagagaaagttgaaacaacaatagacgaagcacaacgagtagtagacattatagaggacgtggctgagggggtagataaggtggcagaagaggctgtgaagcatcttcccgatggaaaatttcgtgatgctgttgaatttgttgaaaaagtagctgaagatatagataagcgtgcagaacgtgcagaagatgcattagaaaaggtggagaacatggaaaaggagtttgagtccttcattgaatcaaccactcatcatcaggaaaattccgtcacaacgaccgcagaagcaaaggaacagaagtag

SEQ ID NO: 72120 - DNA, 213 bp, Glycine max
  Peptide Sequence Number=SeqID_163805
atggcaggggtttgtgagatgcaatgtgatggcgatggtgttgtaatatggtttcaaagtggcgacgtgaagataggatttcaagggtttgatgagcgaaagcaagagaaagttcgaagggaaaatagtgtagttgtagtagtggtggtggcacgatgtaatagcgtgaggggtaggtggaagtggtgtcgtgataggattttgagattttga

SEQ ID NO: 72121 - DNA, 477 bp, Glycine max
  Peptide Sequence Number=SeqID_163806
atgtccagcgttaaggagttagttgaatctaagtgtctgagttctgttccctccaactacatttgccttgaaaatcccgaagattctatattgaattatgaaacagataatattccaaccattgatttttcccaactcacctcttctaatcccagtgtacgctccaaggcaatcaaacaactaggagatgcttgccgcgattggggtttctttatgctaatcaatcacggtgtgtcggagatactaagggatgaggtgattaggacaagccagggcttttttgatctgactgagaaagaaaaaatggagcacgcaggaaggaacctatttgatccaataagatatgggacaagcttcaatgtcacggtggacaagacccttttctggagagattatctcaaatgtcatgttcaccctcactttaatgctccttccaagcctcctggttttagaaagagaaagagaaaagtaccataa

SEQ ID NO: 72122 - DNA, 396 bp, Glycine max
  Peptide Sequence Number=SeqID_163807
atgtcaacaaaaggccaaaaaagcagacaaatcgagggtggaggcagaaagcatcctgtttgtgtgctgggggtgggtggaacagagtcgccaaaaggtgggtgtgccactgtgcctacgggacactggaaaaaagagtggtacgaaagtggctcacacaccaaacagataaaggtgcatgtgagagacataccaagaggagatgcacgtgtgcggttgcatgcagcagtgactggggactcaaaaactagggaagggttggtggcaatgtttactcctgtttatgggggcacaacagtaaaaggaggcagcagaaccaagaaaatgcgcaattactgtcccgtattatgtcaggctaggcaaggagaacttcgtagactactgataccatattag

SEQ ID NO: 72123 - DNA, 1074 bp, Glycine max
  Peptide Sequence Number=SeqID_163808
atgggcgacttcacggttgcgttaaaccctcccaaaaccttccgcgccgatattctcctatccaccaccaacaaccgcacttccccggcggcgcgtggctttcaaaccgtactcgcgttcaaaccaccgcgcgcttttcgaggaatccgcgcttcggtgatgccaagagagggtcaacaagcgtctctcggagacgcccttgtcaacactccgcgccgaagcgacttcgttgaggccatcagaagaaccgccgcactctccagctgcctctcagaaacgagcctccacgccaccgttcccggcctcgagtccaaaacccgcggcaaagttcgagatatatacgacgctggggattacctcgttttggtgaccactgatcggcagagtgcgtttgatcggattcttgcttccattcctttcaaaggccaggttctcaatcagacgagtttgtggtggtttgaaagaactaagcatatcgtctctaatgcggttgtattggctccagataacaatgttacaatagctaggaaatgttcagttttcccagttgagtttgttgggtttgtcactggaagtactgatacatctctatggacagtctacaataaaggcgttcggaactattgtggaaatgtcattccagatggaatggtaaaaaatcagaagttgcctaaaaatatactcactccaacaaccaaggctgcagatcatgatgttcctatcactccagatgagcaagtggctttggagcatggcctcatattggtagatactaagtatgagtttgggaaggcaaatgatggttcaattatgttgattgatgaggtccatactcctgattcaagtagatattggatagccaattcttacctggagcgctttcaaaatggtcttgagcctgaaaatattgacaaggagtttttgaggctgtggtttataagtcactgcaacccttatgaagatgaggtccttcctgatgctcctgaagatcttgtctgtgaattagcctggcgcatgcttatgcttagcatctctaagctgcctaagctcttccatgccaaaatgtattggtga

SEQ ID NO: 72124 - DNA, 1893 bp, Glycine max
  Peptide Sequence Number=SeqID_163809
atgagagacaagtcagagagccatccttcgacaaactccgaggacgaccaccgatcctcccccttgctggatctggcgtgtgccgaaatcaccgaatcctccaacagcaagacccgaacctgcggcccgtttcctggttcgggcccctccgagcctcaggctccgttcccggaccaggtcctcgagaacgtccttgagaacgtgctccacttcctcccctctcgccgcgaccgcaacgccgcctcattggtttgccgctcctggtaccgtgcggaggccctcacccgatccgagctcttcatcggcaactgctacgcgctctctcccactcgcgccaccgcccgcttcacgcgcgtcatgtccgtcaccgtcaaagggaaaccccgcttcgccgacttcgatctgatgcctcccgattggggggcccacttcggcccgtgggcctctgctttggcccaggcctacccctggctcgagaagctccacctcaagcgcatgttagtcaccgacgccgacctcgccctaatcgcggactccttcgccggtttccgcgaactcgtcctcgtttgctgcgagggcttcggaactcccggcctcgccgccgtcgcctccaagtgcagattgctgagggtgcttgagcttgtggaatctgtggtggaggttgaggacgatgaggaggtggattggatttcgtgttttcccgagactcaaaccaatatggagtctcttgtgtttgattgtgttgaggttcctattaattttgaggctttggagggtttggtggctaggtcgcctcgcttgaagaagcttcgattgaaccaattcgtctccatggctcagctatatcgtctgctgcttcgagctccgcagcttactcatcttggaacgggttctttcagtgctactgaggctggggtggtcggggaccaggagccggattacgcggccgcatttgaggcttgcagatccctggtttgcctgtctggattcagagagatttgggcagattaccttcccgcgatttatccagtctgcgcaaatctgacgtcgttgaatttgagctatgctgacattaacacggatcagctgaagtcggttatttgccactgccataagctgcagatattctgggtacttgattcgatacgtgatgaggggcttcaggcggtggctgcaacttgcaaggacttgcgcgagcttcgggtttttcctatggacgcgagggaggagactgatgggcctgtttctgaggtggggtttgaagcgatttctcagggttgtaggaagttggaatcgattttgtttctctgccagaggatgactaatgcggctgtggtggctatgtcaaagaactgcccggatcttgtggtgtttcgtctatgtataattgggcggtataggccggatcctgtgactcaggaacccatggatgagggttttggtgctattgttatgaattgcaagaagctcactcggctggctgtgtctggcttgctgactgatcgtgcttttgagtacattgggacgtatgggaaattggttaggacgttgtcagttgcctttgctggggacactgatgttggccttaaatatgtgcttaaaggatgccctaatttgcaaaagcttgaaatcagggatagtccttttggggatggagctctgagatccggtttgcatcattattacaacatgagattcctctggatgtcgacttgtaaattgacgctccaagcttgccaagaggttgcacgagtattgcctaacctggtttttgaagtaattaacaacaacagtgaggagaatgcgggtgatgaagttgagacattatacatgtatcggtctcttgatgggccacgggatgatgctccaagatttgttaccatcttgcaatag

SEQ ID NO: 72125 - DNA, 234 bp, Glycine max
  Peptide Sequence Number=SeqID_163810
atgaaccaaagccttattttctcgagctctcgtcatctccgtctcagcaccctcttcgcctccactcttggcatctcgtctcaagtccctacttgtaaaagcattgtgtcttcgaactccaatcttcgcactccggtgttgacgtcttccgccaccatgacatctcgtgtctccgtcagatacatctcgcgccagttgattgagcttaaagaagtagagacatattcctcttga

SEQ ID NO: 72126 - DNA, 339 bp, Glycine max
  Peptide Sequence Number=SeqID_163811
atggaggcacattttactcctctgtcttttgctccgtctataccttcttccttgcataaagttgttgacgatggtgttgggtggtggtatttatgtggagcagtgatgttgtgtggttgggtggaagtgaggcacggtggttctaagtggttgggtggactatggaggggtagttttgtgtgtttgggttttttggaggtgcaggaagaaaaaaggaaggacatgccgtctagacccaccgctagaaagactttcaatacaagggatccccaggccaaggatccattatcgtcatcttacttgtctgagtcacttgtcaagtcaaaccatcaattctga

SEQ ID NO: 72127 - DNA, 897 bp, Glycine max
  Peptide Sequence Number=SeqID_163812
ggtcgtgacgacatacctaacaccgccatagggagaccagatcatggaggtcgtgttcgtgcggcggggtctggggtgacaattagtcaatgctatgggagggcatcacgtggctccacttcgtcatccatctccatctcccaagaacagatggaggtgaaggacgccattactattgagatgtcacaaaagggatcgcaggtcgcagcacctacacacatggatataaatgtgttaggtgcacgcgtaagcactaaggagagcaatgctgaagttgctgtcaaccgatctggggaagaacaagttgcgcatatgacacctactatggggttgtatgtcgaacgtcaagattctaccaagctagtggcgttgggaaaaatatatcaaggagcctctaccatatattgtgtggcgtatgcagatgatgtcgtaagggttagcgttgacaaagtaattgacggtgaagctgaagtcccgtgccccacatccgaaattaagtatgattcagccattagtgcaaagcaagttgttgaagttgttgacagggtcaaagatgttgctgtgcaggaccccttgcgtgagttgattaagtgtttggttgacatttatgacaaccctgttcaatttgagtgggatggtagtaaatttggtattccaaatgcattaaagatgactgatgacggcaaagttcctcaaactacaccccagtggattgaagttaagagtcacgttcaacgaggaggctatgagtgtgggtattatgtgatgcattggatgtggaacataattaccggggagttgaagactgattggagtctggtacatattgatgattttgaaggaattattgatgaaggtgttgccaaagttgttgttggtttgactcttttggtctga

SEQ ID NO: 72128 - DNA, 492 bp, Glycine max
  Peptide Sequence Number=SeqID_163813
atgtcgagtggtggaaaccttagttgcgtgttggtagctgtggatggaagcgaggaaagcatgaacgcgctgcgttgggcactgaacaacctcaagctccgatcccctacactcgattccaccggtgctccctccttcatcatcttccacgtccaatccccgccctccatcgccactggcctccatcccggtgccatccccttcggtggtgatatcgaagttcctgctttcactgcagccattgaagctcaccagaagcgcatcaccaacgccgtactcgaccacgtcctcggaatctgctccgaattcaacctaaccagtaagggcagaacccatgtccttgttggagatccaaaggagaagatttgtgaagctgtgcaggatttgcatgctgatgtgcttgtgatgggcacatatcacacacaaaaaaataaaggcttgataaacaacctggacaagtattccctttttgagaatgttaacaagtgctag

SEQ ID NO: 72129 - DNA, 351 bp, Glycine max
  Peptide Sequence Number=SeqID_163814
atgactaagccactcaaattggagcagttcttacagcgtagaagcatgttgggcatgattgaagcatcagaagatcttgaagtggagttaggtggccttggcaagatggtttttttcgaggtcgacgacatccaaaaagtcgcaaatggagtgctggaggagctcggtggagggctcatcccagtagttagtgttgcgggagtgcagagaggattccacggagtcggggtagtcgaggtgcggtggcagaggtggcgacacaatcaaccacgttgttttgccgaagctttcttgcgaaggtggaagggtttgtggggtttgagagtgaaggtgtgggaaaaggagaaatga

SEQ ID NO: 72130 - DNA, 738 bp, Glycine max
  Peptide Sequence Number=SeqID_163815
atgttctcaaagcttcagccacaacaccagcaacagcatcaaccttttcaattctctcgtgaatgtcaaacgtccgaggacgatgacagccgaagcagcggtggccctaacaccgccgtcgcccaaaaatcagttttaggcggcggaggatgcagcgatggggccacaattgaagtgcccgccatgagcccgttcattctagaaatcccgggcggaagcgacgtcgtcgaagccctagcccggttcagccgcagaaaaaacactggcctgtgcgtgttaaccggttcgggaaccgtcgccaacgtcactctccgtcaaccttctttctctcccgccggcgccaccgtcgccaccgtcactttccacggccgcttcgatatcctctccatgtccgccaccttcctccaccacgcctccccggcggcgatcccgaacgccttcgccgtgtccctttccggaccgcaggggcagatcgtcggcggattcgtcgccggcaggctcctcgcggccggcacggtgttcgtgattgccgcgtcgttcaacaatccgtcgtatcaccggctttcgtcggaggaggaggcgcagaacaactctggcggcggcgcaggagacgcgcagtctccgccggtttccggtggcggcttggagagcggacacgttccggctgagtcgtttatgtacagctgtcaccttccttcggatgtgatttgggctccaacccctagaccacctttctga

SEQ ID NO: 72131 - DNA, 1126 bp, Glycine max
  Peptide Sequence Number=SeqID_163816
ggatttcaaagagatcttatgccctgatgataaaaatggaggaaatgaggcaaatatcaacctcattgcttggtttagaatggtactagagcaatgcagtccagacgtaaaaagaaaagggttgaaaaactcttatcattttgaagaagcttggcttcaaaatgatggatgtgctaaagtggtggataaatatggcataagggtggatcgatggaagcctagggcaacttggcttgattatggagacaaaaactcaaaattcttctatcatatggctcgacaaaggaggaagaggaatacaattgacaggatcaagaatgatcagggagtatgcttcgaggaagaggaaaatatagatttatcttcagttttggataaggctttcacaaccaaggaggtcaagtgtgctctagaccaaatgcacccatcaaatgcacctgagattgatggtactctatctagcattattttaccaacgtttctgacaagtgatgggattgatgactttgagaggttgatgggagttaagacaatgggtagcttctcaaaatacacgagacttccaacaattgttaggagatccaagaaacaaacatttcaatttatcccagattgtgtttggaagaagctcaagagttggatggagaaggtcttatccagagcaagatgtgaagttttgattaaggctttcaatttagctcttctagtcaagcaatggtggcgtttggttcacgatgttgactttcttttttcagggacttttaaatacttccctcgctgccagccagtgaatgcaaaaatgtcctcctaccaaagtgccacttggtcgggtattaaggcttcaaagtggattattgaccaaggaacgttttggagaatcggggatggcataaatgtgaaggaacataatgtggaaggcttgcaagcactacctcacagtcaagccctggtagattgtgtagaagcaatgaagatttggtttgcttcgaggtgggggaggaacatttgggtgtttgaaggtaagtggatatctattgatcaagtgttggctcgggatgatagtgtcaccatgagcaacccccaaaaatcagacccctcaagaacaactcatcaccttaggatttaa

SEQ ID NO: 72132 - DNA, 222 bp, Glycine max
  Peptide Sequence Number=SeqID_163817
atgaagataaaaatttcaagaggtgttgtgtcccaaggcaatggatttgcatcaaagtttgttatggcagataaaaagatggataacaagattcctatggtaacaaagaaagaaggattcctccataaaaaccatgttgatgatgtggaatcgaaaagacaacttctgaagcagcaaatgctctttaatcagcaaagagatattcaagtagggagcaactaa

SEQ ID NO: 72133 - DNA, 534 bp, Glycine max
  Peptide Sequence Number=SeqID_163818
atggaagtagaaaaaggaaaacaaagaggattcatatcgttgcaaacctcaacgagcctttctcggaacggtcacgtcgatcatctcatctgttatcttgaacggcagaggtttcaccggcatgaagctccagtgatggttgtgatcggaggcgaacgacaatgtcatataattagcggaacgaatcttagaaacgccatcatccacaacgtcaatgtcttgttcgtttctgacactctcttcagtgctttgcgagtgagagcctctcctcctcttgatcctgttcgccgaatccttatccctatctcaattccttcctctcttactcgcaccttctctcaactccacaacaccttcctctgtcacggaacaaaaatcgtagggtggcagaaggagaagagagaggtgttgcttgaatgggttgcgcgcgacacaaaggttgttgctaactgcttttcaggaaggttatcacatgttgtgagggattttggaatcatttcaatatgggtaagtgttaactctggagtatgttga

SEQ ID NO: 72134 - DNA, 93 bp, Glycine max
  Peptide Sequence Number=SeqID_163819
atgttgcaaagggcagcaagcaatgcatattcatggtggtgggccagccacatcaggacaaaacagtcaaaatggctggatcaagcctccaag

SEQ ID NO: 72135 - DNA, 810 bp, Glycine max
  Peptide Sequence Number=SeqID_163820
atgaaaaagacaagtaatgttttcttcagtgaggatgaagctgctgttctattgcaaaggtacaacgcacaaacaattttgacgttgcttcaggaattggccaattatccagactcgaagttcgactgggatgatttggtggccaaaacctcaactggaatttccaatgccagagagtatcagatgctgtggcgtcatctagcgtatggtcactcctttgatgaaaattcggacctcgataatcaacctctggatgatgatagtgacttagaatgtgaacgagaagcattgcctcgcccaaacaaggaaattgcagcagaagcttcagcatgtgtgcagctgaatgagtccacccctacaagctcagtgattcaggctccattgacaataaatgttccagtctttcgttcatctagaattgctaatatggaaagttcacagtcatctagttcggggatgcaagagacaaacattgtttttccagttaccgttaagagacaagcactgccaaatgtaccctcaacgagagctgtggaaaccagaggatcaggtagtggctacacatccatgaaaaagaaaagagaaccatggtctgaggaagaggacttgcaactaagagctgctgttcggaggtggggtgaaggtaattgggcaaccatggctaaaagtgatgactttcctattcagagaagtaccacgcagttgtccaagcaccattggtctggcttgacctttggcatctgtaggcatattgatcaatttgacttggattgtgttgttgagaggggcagctttagcttgtttatgtag

SEQ ID NO: 72136 - DNA, 300 bp, Glycine max
  Peptide Sequence Number=SeqID_163821
atgatttgttgtgcagatgaggctgctttgagtgccaaatgtgacgttgaaaaggaagctccgcagtttgcagagctagagtggcttacagatgtgggtattttcggtgaacaatttgctcaggaagccttggctgcagctgaagtacctcaacttctagttactcataacaatagtagtgttgcttcaaacagaacctccaaatcctacatttcccacaaaaagcctaggattgaagtcctaaatgaccaagatgatgatgatgagtttagtatttttattgtgcctgatcttggctga

SEQ ID NO: 72137 - DNA, 1884 bp, Glycine max
  Peptide Sequence Number=SeqID_163822
atggtgaaattgcttcttcattctctcttgtttggttgcaatgtttctggcaccaaaaacctaagaccaataacttcaaataacccctctagaaaattgggctcacttggtggtatgttaaaatacacatctgttgaaacttattcagtccttcaagcaagctgccttcaacactggtttaaaaactggcaagcacttaggagaaacaaattgacagctagcacttttgctgctgctattgggttttggcatcggcaaagggtccagctgtggttagagaagattggtgctattgaacctttctctggaaaccttgccacctgttggagcaatatcaaagaggaggatgcacttgaaagatacaaactgataactggaaataccgtgcgttttcctgaatttcaggtctatgatgcacacccagaagacagctggctagctgcttcacctgatggcgttattgacagtatggtgcatgagttgccttcttgtggagtactggagataaagtgtccatattttgatggggacataagtaaagcttttccttggtttcgaattccaattctctatattcctcaaactcagggtttaatggagattctaggaagggattggatggatttttatgtttggactcctaatgttagtagtctattcaggatataccgcgatgccgagtattgggatttaatgaaaatagcactatctgatttctggtggaagcatgtctatccagcgagagagttatttaaggagttgattgttagatgtgattatttgaagttggagattggagactggagtgagacaggcttaaaagttcatgcatttgtgacagatttgtggtgggtattatccatagtgacttgtggctgtaattgctctttggattctcaggttatggaggattcagagcaaaggaagaaaaggctgaaacaaatgcgtgtgcaagctgaccaagctgaagtttctggtggcagggaaggttctgtggtgcccggttttctctcaaatcccctgattgaagctccttcaactatgccatcacgggatacatcatatgctgctccaaggtttgactattatactgatccaatgagtgccttctcatctaaaaggaacaatgccagtacccaggctgcaccggataatttccctccttcaaaatttggtggtcctcctatggcacaatattcatcaccacatccagcatatagaaacccagtttggagtggacctggtggtcctgctcactataactttccgttacatccatcaagtggtggtacttatccaagtcctagatttgaaccatcgggtggtccattatataacactgcccagggcatagctcaccagcccagttacagtcctaatcctccttatccaggatacgtgaacagtcctaggcccagttacagtcctaatccctctccaggatacagtaactgccctatgcccagttacagtcccaatccttctccaggatacaggaacagtcctagccctggtcaagggcgaggcaggggtttctggcgcaacacgggaagccctgtttcaggatggggtagtggacaaggaccgaattttcatggtcatcggtccaacgaaaacacagttcatggtccagaccgattttacaagaggtccatggttgaagatccatgggagcatttagaacctattatatggaaggcaaatgatggatatttaaacacttcacgtgtacctctgaattcacaaccctggatttcaaaagcatcaagtacaaaaggggagggatcatctgctgcttctgtcaagtccagttccgaaccaagccttgctgagtacttggcttctgcattcaatgaagctgccaatgatgcagaaaatgtatga

SEQ ID NO: 72138 - DNA, 123 bp, Glycine max
  Peptide Sequence Number=SeqID_163823
atgacgatcgattttgacccctggagggaccgtggaggcagcaagaaaagaaagggttgccatgctagttcatggaatgctgcaaagggatggggaatccaaaaagtgtcgagtcagtgctaa

SEQ ID NO: 72139 - DNA, 309 bp, Glycine max
  Peptide Sequence Number=SeqID_163824
atgtcggggacgggacagggcggggaaaacccgatccccgtcggggacggggatgggatcaatttagctgatgatgaagatgaagaagatgatgattatcttgtgtctaattcatacgttgaagagtctttagatgaagatgatagtgtagaaggaattcagaatccattttggaatgatgctttacattataataatatcaactggagttatcctgataaggaggacgtttgcggtttggagatgctatcgagttttaatgttggacaagaattatacgttggtatggattttgatagtaaagatgcg

SEQ ID NO: 72140 - DNA, 366 bp, Glycine max
  Peptide Sequence Number=SeqID_163825
atggagtctgctttgtccacagtagtggaacgggtgatgaattttgtgttggaccaaagtgttcggcacgtggcttacattgtacgttacgggcaaaacgttgatgaactataccataatgttaaggatcttggacttgaaaaagagaggatagaccatcaacgtgacgaagcggaaaaaaatctacacagaactgaaggcacggttaaagaatggtttcagaaagtggatgagtttgagactacggtggagaagtttaggaatgacgaggctcactgttatggaggcagtaacactaagcaagttccaccagtagccttgtctgccatttgcttgtgtgttttcaatcctgttaggatatgttag

SEQ ID NO: 72141 - DNA, 513 bp, Glycine max
  Peptide Sequence Number=SeqID_163826
atggcagaacatgccattgttgaagactgcggagttcaacgtgacgaagtagttgtcgctgttgggcatgaccttagctatgtacttcctaaccaagttggggtacagtttgatagcctcggagatggagcaaaagatgaccccgacctttttaagggtttctttaaaggtggtggcgatggagatgctgtggaagacgcagcttacggcaaaattggttctcgttttggttcttgggcgtggtgtagtagcacaaatctgggaagtcgatggggggaaggtgttgttggaccaaatggggggtttcatggcgaggaagtggtccaaggctttgaggcaaaactcgagcatccagtgaggttcatctttgagtttcgagatgatgaggtggattgtgtctctataaaggcctttggggatcaagaaagagtcgatgttgatggtgaagccaaacttcttgtcgtagtcacggtgattgcgatggaggctttcgccgatgtcatcatcgcttga

SEQ ID NO: 72142 - DNA, 135 bp, Glycine max
  Peptide Sequence Number=SeqID_163827
atgagtgcgatggagacgtcctcaatgccgacaacagaagcagccaacggcaatgacgcagaggaaaccaaggaagaggaagcaagaagaagaaggctcgacgtgaatgaagtggagacaatggcgtatggatga

SEQ ID NO: 72143 - DNA, 5694 bp, Glycine max
  Peptide Sequence Number=SeqID_163828
ggtcctattgaatatgtatctattggtgagattaaactcagcttacgcctttccttgcttgagcatggtgtgggttttagtacttgggatccaaagttgcaactaatagtatgcaacttagaagttgttactaggccttcaaacaaaagttccgagaagaagaagaaaactcgaaaatctagtggccgatcttccggcaagggaaagtggaagactataagcaacattgcacgatatttgtcagtttgtatgacaaatcttgttttgaagacacctaaagctactgttgagattgggaagttgaatgtggatatatctaaagttggtggatccgagtcagatttgttagttagggtacacatattacccattgttgttagtgagcctcaagttagttgtaatcagttgtctgatttaagtggtggagaatgcagtgcttctagccaggcctctattgctacaataaaaaaggctcctgcactttttatttgtgaaaaattctgtgtctcatgtgaatttggccatgatagggaagtgggtatacttataaagagtgtggacatttccattggggaagtcacagtgaatttgaatgaggggttgcttgtgaagaaaaagagttcagtggaatcttcttctggctctgagaaaagtgtagggtcaaatgttgattctatgagcgcaaaagagcctcccaagaagcgggaaaaaattataggctatatttctaagtttcctcaaaaggtcagcttcaatctgccaaagctaaatgtgagttttgtgcatcgtgaacgtggtctctctgttgaaaataacatcatgggcatccaattcaaaagcatcaaatcacgaccctcaaaagatgctggggagagtacacgtcttcattttcaacttgaatttagtgaaattcatcttcttagagaagctggttcttccatcctggagatattgagggtgaatttggtcacttttgtgtatgtcccagtacagggttgcttacaatcaacacatctatctgcaaacaacatttcgaatatggggactacagtgcatacagaacttggtgaattaaacctcaacttggctaatgaaaatgaagaatgcttgaaagaaagaatttttggtgctgagtcaaagtctggctacattttgcacattactaaagttagtttggattggggcaaaaaggacttgaaatcctctgaagaaggtgctcctaagtgtgtgctaggtttatctgttaatatgaccagcatgggagtttatctaactttcaagcgagtagaatcattcatatcaactgcaatatcctttcaagttctattcaaaagcctttccgcttcaaagaaaaaaacaacgcaaacccgggctcgatcatcaaaaagttcagggaagggaactcaaatgttgaaattcaatgttgaacagtgttcagtatatgtactgggggagactggaatagaaaatgcagttgttcctgatcccaagcgagtcaattttggttcacaaggtggtagagttataataaatgtgtcagcagatggtaccccgcgcactgcaaacataatctccaccgtttccgatgactaccggaagctaaagtactgtatttctcttgaaatctttcattttaagttgagtgtgaacaaggagaaaagatccaaacaggtagaacttggaagggctagatctatctatcaggaatatatggatgaaaataggccagtatcaaaagtggcattgtttaatatgcaaactattaaatttgtacaacgtttaggcggccttaaagagaatgctgcctgttctcttttcagtgctacagaaattacaatgaggtgggagcctgatgtgcatctatcactaattgaactggttctccagctaaaattagtggtacacaatacgaagcttcaggagcatggtaatgatgaacatgtcgaagacatgtctaatgtaaaagatactaataggaaaaatgaagctactgtggaatcagggcattcagaaaagaagaaagaatctgtttttgctgttgatgtagaaatgttaaatatatctgctgggctgggagatggagttgatgctatggttcaggtgcagtcaattttctctgagaatgctcgtataggagtgctccttgaaggactcatgttttattttaatggggccagaatcatcaagagtagccggatgcaaatttcacgaattcctagtaaatctgctgctagtgcatctgatgcaaaggggcctgtagccacaatatgggattgggtaattcaaggtctggatattcacatttgtttgccattcagattgcaattgcgtgctattgatgatgctctagaggatatgttgcgtgcattgaaacttattgttgctgcaaagaccaatatgatttttcctgtgaagaaagacagttctaaagcgaaaaagcctagttcagtaaaatttggatgcgtaaagcttttcgtacgcaagttaacttttgatattgaagaggaaccaattcagggatggcttgatgaacactaccatttgttgaagaaggaagctggtgaattagctgtccggttaaactttttagatgaatttatatccaaggcaaagcaagatccaaaacctactgatgacaccaataattctcctcaagaaaaaaaggtttattttaatgatgttgaggttgatgtaaacaatccttcgactattgaatcaatgcgagaagaaatttataaaaaatcattccgatcatattaccaggcatgccaaaacctagtgttatctgaagggtcaggtgcttgtattgatgatgactttcaagctggtttcaaacctagtacttcaaggacttctcttctttcaatatctgcattagacttagatgtaagcttgacaaaaattgatggtggagatgatgggatgattgaagttctgaggaagcttgatcctattcgagattacacatatcctctttttgctggaagttctggtaaatgtgaaggtcgtcttgtgatggctcagcaggcaactagctttcagcctcaaatgcttcaagatgtctatgttggggcatggagaaagaaaggcgaagtgtcatttggggtgagttatgaaccagtttttgctgatattagttatgctttcactgtgttgctacggagggctaatctaagtgttataaaccccggcccacttattgtgccaccaaaaaaggagaagagtttgccatggtgggatgacatgagaaattacattcatggaagaatttccttattattttctgaaacaagatggcatattttggcaagtacagatccttatgaaaagcttgataaacttatacttctgactagatctatggaaattcaccagtcagatggtcgcattcttctttccgcgaaagatttcaacatttttttgagcagtttggagagtatggcaaaaaagcgtggttccaaaattccgccgggtgtttctagtgctttttttgaagtcccactttttacacttgaagttgcaatggactgggattgtgactctggcaaaccattgaatcattatttattttcacttccagatgaaggaaaacctcgtgagttcgtatttgatcccttcagatccactgctctttcacttcgatggaacctatcttttagatcccttcctccttcatcagaaaaacaatgtccaccctctgttgcaagagatagtatagaaggatatgctactgtatctcagcctcctcacacttctcagaatgtttcaccggcttccccaacaataaaacttggtgctcatgatctagcatggattacaaaattctggaacttgatgtaccttcccccacataaactgcggatgttttcacgctggcctcgttttggtgttccaagaattatcagatcaggcaatcttgcactagataaagtaatgaccgagtttatgattcgtatagattccacaccgatttgtataaagaacatgcctttacatgatgatgatccagccagaggactgaccttcatgatgacaaagctgaagattgaattatgttttggcaggggtaagcaaaagtttacttttgaaagctaccgtggccttcttgatcttgtttaccaaggtattgaccttcatatgcccaaagttttcctaagtaaagaagactgctgtagtgtttctaagttaattagcatggcaacaaaaagctcacaatctgcatccaaggataacgttccctctgaaaaaggttgcatgacgcagaaaaatcctgatgatggatttattttatcctgtgattacttcagtataagaaaacagtccgcaaaggccgatcctgatactttgggagcctggcgtgaagagggaaaaataaatcctgagaagaccacgtgtgtacagtttgagcgtggtaaacagagcgaaactaatgagcatacgcaatcagacccaagcgacgacgatgatggctacaatgtggtgatagctgacagttgccagcgtgtgtttgtctatggtatgaagcttctatggaatattgaaaacagaaatgctgtttgtttctgggttgctgctctttccaaagccgctgcacctgccaagccttctccttctcggcagtatgcacagagaaaattacatgaggacaacaaaaaggatgatgcagccgaaactaatcaagatgatgatgcatgtcaaacccatcaagatgatggagccaaaatccagcaagatgatgaagctgaatcccatcgagatgatggagctgaaacctgtcaagatgaaggagctgagacacataaagatgaagtttcaacatcccttaacactaacagcatctcggattctccctcttctcaggctgccaagaatcctgaattaccttcatccccaccacatttggataatgcggacaacttgccatctactaaaaatgagaatgctgacgacactgaggaggggattcgacacttcatggttaatattattgaacctcagtttaatcttcactcagaggacgcaaatgacataactcaactccacaaaactggcttgttagaggagaacagtccaagccttataagcactagttatgccatatcttcactcagcctttctggtcagccctccatagctatccctttccaagaccctacaaccaattctagcaggccacaattaaggcgggtcagggtgacaacaattaagggtaggtttctgcttgctgctgtaagtggccgcattttagcccagtcatttcactcagtccttcatgttggttacgagatgattgagcaagctcttagtactacagatgtaaatggtagtgaataccagcctgaaattgcatggaaaagatgggagttatctgttatgttggagcatgtgcaggcccatgttgcaccaacagatgttgatccaggggctggagtgcagtggctaccaaaaattctcagaggctctccaaaagtaatgcgtacaggtgctcttcttgagagagtttttatgccttgtgatatgtactttcagttcacaaggcacaaaggaggcactccagaaatgaaggtgaaacccttgaaggagctcacattcaattctcataatataacagcaacaatgacatctcgccagtttcaggtcatgctggacgtgttgtgcaatcttctccttgcacgggttccaaagtatggataa

SEQ ID NO: 72144 - DNA, 11196 bp, Glycine max
  Peptide Sequence Number=SeqID_163829
atgacaaccctaagatcaagttggccttcgaggctgcgccaacttctgtccagcgggggcgccattggtccttcagtcaaggtggactccgagcccaatgctgaagtacaaacatacgctcttactcataaagcaagtatagtagcttctggtatttgtatggttttctgtgcatgcactgttttcagtggcaaattccttgtgccatcatttaaattgtggctgctccgtttgcatgcaccctttttgcctcctaagatcaaagccttcattgagaagatcatccagtgtccattacaagatattgccataccactttctggctttcggtgggagtacaataaggggaattttcatcactggagaccgctgttgcttcattttgatacatacttcaagacttatttgtcgtgtagaaatgatctgacgttgttagataatctagaagatgacagccctttaccaaaacatgcaattctgcaaatattgcgagtgatgcaaaaaattttagagaactgtccaaacaagagttcctttgatggcttagagcatttcaagcttttacttgcatcaacagatcctgagattcttgttgctacattggaaactctttctgcacttgtaaaaattaatccctctaagcttcatggaagtccaaagatgatttgctgtggttcggtgaacagctatcttttgtccttagcacaaggctggggaagcaaggaggagggcctaggattgtactcttgtgttatggcaaatgagaaagcccaagatgaagcactgtgcttgtttccttctgaagagattggtcatgaccaatcaaattgccgcataggcactaccctttattttgaattgcatggtcccaatgcccaaagcaaggaacatagtgcagatgcagtttcccctagctcaacagttatacacatgccagatttgcatctgcgcaaagaagatgatttgtcattgatgaagcagtgcactgaagaatttagcattccttctgagctcaggttttccttgctcactagaatcagatatgctcgtgcctttcgttctcctagaatatgcaggctttacagccggatttgcctactttctttcattgttctggtgcagtctggtgatgctcaggaagaacttgtctccttttttgctaatgaaccagaatatacaaatgaattaattagaattgtacgatcagaggaagttatatctggatctatcaggacacttgcaatgcttgctctaggagctcaattagcagcatatacatcatcgcatcatcgggcacggatcagtggatctagtttaacttttgctggtgggaaccgcatgatactcctaaatgtgctccagagggctattttgtcattgaagatttctaatgatccatcatcccttgcctttgttgaagcacttcttcagttctatctgctccatgtggtctcaacctcaacttctggtaataatattagaggttctggcatggtgccaacattcttgccgttgctggaggattttgatcctacacatattcatctagtctgttttgctgtgaaaactcttcagaagcttatggattatagtagctcagctgtatcattgtttaaagaattggggggcattgaacttttggctcagaggttacagaaagaggtacacagagtcattggtttggttggaggaactgataacatgatgcttactggtgaaagcttgggacatagtactgatcaattgtactcccagaagagactcataaaggtctcccttaaggcgcttggttctgcaacatacgcacctgcaaactctaccagatctcaacattctcaagacagttcattacctataactctaagcttgatttttaagaatgtagataagtttggaggtgacatttattattcagctgttactgttatgagtgaaataatccacaaagatcctacctttttttctgctctgcatgaaataggtcttcctgatgcgtttttattgtcagttggatctggaatacttccatcatcaaaggctttgacatgcattccaaatggtcttggggccatttgtcttaatgccaaagggttagaggccgttagagaatcttcatcgctacggttccttgttgacattttcactagcaagaagtatgtcttagccatgaatgaggctattgttcctttggcaaatgctgtggaggaacttctacgccatgtatctacattgagaagcactggtgttgatattatcattgaaatcatccataagatcacatcttttggggatggaaatggtgcaggattttctggaaaagctgagggcaccgccatggaaacagattctgaaaacaaagaaaaagaaggccattgttgcattgtaggcacatcatattcggctgtagaagggataagtgatgagcagtttattcagctatgtgtctttcatttgatggtattagttcataggactatggaaaatgccgagacatgccggttgtttgtggaaaaatcaggaattgaagctttattgaatttgttattacgacccactattgcacaatcctcagatggcatgtctattgctttacatagcacaatggtatttaaagggtttgctcaacatcattcaattcctctggcacatgccttctgttcttctcttagagagcacttaaagaaaactttagtggggtttggtgcagcatcagaacctttgttgctggatccaaggatgacaactgatggtggcatcttttcttcacttttcctggttgagttccttctatttcttgtggcatcgaaagacaatcgttgggtgactgccttgcttacagaatttggaaatgagagtaaggatgttcttgaagacattggatgcgttcaccgtgaagttctgtggcaaatttctctacttgaaaatagaaaacctgagattgaggaagatggtgcttgttcttctgattcacaacaggctgaaggggatgtaagtgaaactgaagagcaaaggttcaattctttcaggcagtatcttgacccattattgagaaggagaacatcaggatggagcattgaatcccagttttttaaccttataaacctgtatcgagatttgggccgttccactggttctcaaaatagattagttggtccgaggtcaagttctagtaatcaggtacagcattctgggtcagatgataattgggggactgctaataagaaggaatctgacaagcagagagcatattatacatcttgttgtgacatggtcagatcactttcatttcacattacccatttgttccaagagttaggaaaagtaatgttgctaccttcacgtcggcgtgatgatgttgtgaatgtaagtcctgcttcaaaatcagtggcttctacatttgcatccattgcttttgatcacatgaattatggtggccgttgtgtaaatctttcgggaacagaagaatccatatcaacaaaatgtcgatattttgggaaagtgattgattttatggataatgttctaatggagaggccagattcatgcaatcctattatgctgaattgcttgtatggacgtggagttattgaaattgtattaactacctttgaagctaccagtcagctgctctttacagttaatcgggcccctgcctcgcccatggatactgatgatgcaaatgcaaagcaagacgacaaggaagatacagataattcatggatttatggttctttagctagttatgggaaattgatggaccatctagtgacctcctcttttatattatcatcattcacaaagcatttgcttgcacagccccttactaatggtgatacacctttcccaagggatgctgagacttttgtgaaggtccttcaatccagagtgttgaagactgtacttcctgtttggactcatcccaagtttgttgactgtagttatgaatttatttctacagttatttctatcattaggcatgtctatacaggtgttgaagtaaaaaatgtgaatggcagtgctggtgctcgcattactgggccgcctcctaatgaaacaactatttcaaccattgtagaaatggggttttccaggtctagagcagaagaagctttgaggcaagttgggtcaaatagtgtggagttggcaatggagtggttgttctctcatccagaggaggcacaagaagatgatgaacttgcccgtgcacttgccatgtcccttggaaactctgaatcagattcaaaggatgcagttgctaatgacaatgccctgcagcttgaggaagagatggtccaacttcctcctgttgatgagttgttatctacttgtacaaaacttttgtcgaaggaaccacttgcttttccagtccgtgacttgcttgtgatgatatgctctcaggatgatggtcaacatagatctaatgtggtctcatttattgtggaacggatcaaagaatgtggtttggttcctagcaatggaaattatgccatgctggctgctctttttcatgttctagctttaattcttaatgaggatgctgtggctagggaagctgcttctacaagtggtttaatcaaaattgcctcagatctactctaccagtgggattctagtcttgatatcaaggagaaacatcaggtaccaaaatgggtgactgctgctttccttgcattagacagattgttgcaagtggatcaaaaattgaattctgaaatcgcagagcagttgaagaaggaagctgtgaatagccagcagacatcaattaccattgatgaagacaggcaaaacaagatgcagtctgcattgggactctctatgaagtatgcagatatacatgaacagaagagacttgttgaggttgcttgtagttgtatgaagaatcaacttccatccgacacaatgcatgctgttctgctactatgttccaatcttacaaggaatcattctgtagctcttacttttttggattctggtggtttaagtctacttctttctttgccaaccagcagtctcttccctgggtttgacaatgttgctgctagtattgttcgtcatgttcttgaagatcctcaaacgctccatcaagcaatggaatctgagataaaacatagtcttgtagttgcatctaaccggcatccaaatggaagggtcaatcctcataatttccttttaaatttagcttctgtgatttctcgggatccagtaatttttatgcaagctgctcaatctgtgtgccaagttgaaatggtaggtgagaggccatacattgtcttgctgaaagatagggataaagacaaagctaaggataaagaaaaggataaggataaaacattggagaaagataaagtacagaacattgatgggaaggttgttttgggaaatactaacacggcacctactggcaatggccatggcaaaattcaagattcaaataccaagagtgccaaaggtcacagaaaacctacccaaagttttattaatgcaatagaacttcttcttgaatctgtatgcacttttgttcctcccttgaagggtgacattgcctcaaatgttcttcctggcaccccagcatcaaccgatatggacattgatgcctccatggttaagggaaaaggaaaagcagttgccactgattctgagggcaatgaaactggtagtcaggatgcttctgcatcacttgcaaagattgtcttcattctaaagcttctgacagagatactattgatgtattcatcatctgttcatgttttacttagacgagatgctgaaatgagcagcattagaggttcttatcaaaagagtcctgcaggtttaagcatgggtgggatattctctcatattcttcataattttcttccatattctcgaaactccaaaaaggacaagaaagctgatggtgattggaggcagaaactagcaaccagggccaaccagtttatggtgggtgcttgtgttcgatctacagaggcaaggaagagggtttttggtgagatttgttgtatcatcaatgaatttgttgattcatgtcatggcattaagcgtccaggaaaagaaattcaggtttttgttgatctactaaatgatgttttggctgctcgtacacccgctggttcatccatttcagctgaggcctctaccacttttattgatgctggtttggttaaatcattcacatgtactctacaagttttggaccttgaccatgctgattcatctgaagttgctacgggtattattaaagctcttgagttggtaaccaaggagcatgtccaattagttgattctagtgcagggaagggtgataattcagcaaagccttctgttctaagtcaacccggaagaacaaataatattggtgacatgtctcagtccatggagacatcacaagccaatcctgattcccttcaagttgaccgtgttgggtcttatgcagtttgctcctatggtgggtctgaagctgttactgatgatatggaacatgatcaagatcttgatgggagctttgctcctgctaatgaggatgattacatgcatgaaaattctgaggatgcaagagatcttgaaaatggaatggaaaatgtgggtctacaatttgaaatccaatctcatggccaagaaaatcttgatgaggatgacgatgaggacgatgatatgtctgaagatgaaggtgaggatgtagatgaagatgaggatgatgatgaggaacacaatgatttggaagaagtccatcatttgccacatcctgacacagatcaagatgagcatgagattgatgatgaagattttgatgatgaagtgatggaggaagaggatgaggatgacgaggaagatgaagatggtgttatactgcaactcgaggaggggattaatggaattaatgtttttgatcatattgaggtttttggcagagataatagttttgcaaatgaagcttttcaagtgatgccggttgaggtttttggatccagacgtcaggggaggacaacatctatttatagtcttttgggaagaactggtgataccgctgtgccttctcgtcacccactcttgcttgaaccttcttcattccccccacctacagggcaatcaggccagtttctcagaattgtttatagttcattggagaacaactcattgggtttggataatatatttcgatcgctgaggagtggacgccatggacagcgtttgcacttgtggactgataataaccaacaaagtggtgggacaaacactgttgttgtaccccaaggccttgaggatttgcttgtcactcaattaaggcgaccaatccctgaaaagtcatccaatcagaacattgcagaagcaggttctcatggtaaagttggaacgacccaggcacaagatgcagggggtgcaaggccagaagtccctgttgaaagtaatgctgttctggaagttagtactataactccctcggttgataacagtaacaatgcgggtgtcagaccagctgggactggaccttcacatacaaatgtttcaaacacacactcacaggaagttgagatgcaatttgaacatgctgatggagctgtgagggatgttgaagctgtcagccaggagagtagtggtagtggtgcaacttttggtgaaagccttcggagcttggatgttgagattggaagtgctgatggccatgatgatggtggtgaaaggcaggtttctgctgatagggtggcaggtgattcgcaggcagcacgcacaagaagagcaaatacgcctttgagtcacatttctcctgtggttggaagagatgcgttccttcacagtgtaactgaagtttcagaaaattcaagccgtgatgcagatcaagatggtgcagcagcagagcagcaggtgaacagtgatgcaggatcaggagctattgatcctgcttttctggatgctcttcctgaggagctgcgtgccgaactcctttcagctcagcagggtcaagtggctcagccatcaaatgctgagtctcaaaacactggggatattgatccagagttccttgcagctcttccagctgatattcgagcagaaattctagctcagcagcaagcacagaggctgcatcaatctcaggagctggaaggccaacctgtggaaatggatacagtctcaataattgcaacttttccatcagatttacgagaagaggcaagtttttcagttcattgctgttatataaaagttctgttgacgtcaccagatactatccttgccaatcttacacctgctcttgttgctgaggcaaatatgttgcgggagaggtttgcacaccgttacagtcgtaccctctttggtatgtatcctagaagtcgtagaggggagacttcaagacgtgaaggtattggttctggtctggatggagcagggggaaccatttcttctcgccgttccaatggagttaaggttgttgaagctgatggagcaccactagttgacacagaagctttgcatgctatgattcggttgttacgcgtagtgcagccactctataaaggccaactccagaggcttctattaaatctttgtgcccatagtgaaacaagaacctctctggtgaaaattctgatggacttgctaatgcttgatgtaaaaaggcctgtcagttattttagtaaagttgagccaccatatagattatatggttgtcagagcaatgtaatgtattcacgtcctcaatcttttgatggagttcccccattgctgtctcgtagaatacttgaaactctcacttatcttgctcgcaatcatctgtatgtggcaaaaattttgcttcagtgttggctaccaaatcctgcaataaaagaaccagatgatgcacggggcaaagccgtgatggttgttgaagatgaagtaaatataggtgaaagtaatgatgggtacatcgccattgcaatgctattgggtctcttgaaccaaccactttatttgaggagcatagcccaccttgagcagctgctaaatttactggatgttatcattgacagtgctggaaacaagtcatctgacaaatccttgatatctactaacccatcatcagctccacaaatttctgccgtggaagccaatgcgaatgcagattctaatattttatcttctgtggatgatgcatctaaagttgatggttcctccaaaccaacgccctctggcataaatgttgaatgtgagtcacatggagtgttgagtaatctttcaaatgcagaactccggctcctgtgctcactgcttgcacaagaaggtttgtcagataatgcatataatcttgttgccgaggtaatgaagaaattggtggccattgctccaacacattgtgagctttttgtcactgagctggcagaagcagttcaaaagttgacttcatctgcaatgaatgagttacgtgtctttagtgaagcaatgaaagctctgcttagtacctcttctactgatggagctgcaattctgagagttttgcaagccttgagttcccttgtcaccttactgacggagaaagagaatgacagaggtactcctgctctatctgaggtttgggaaatcaattcagcattagagcccttgtggcatgagcttagctgttgcataagcaagatagaatcctactcagagtctgcatctgagatttcgacatcttctagtacctttgtgtctaaaccatctggtgtaatgcctccacttcctgctggctctcaaaatatcttaccatacattgaatctttctttgtggtttgtgagaaattgcatcctgctcagccaggtgatagtcatgactcaagtatccctgttatttctgatgttgagtatgccaccacatctgcaactccccagaaagcatctggaactgctgtgaaagtagatgagaaacatatgccttttgtccggttctcagagaagcataggaagctactaaatgcattcttaaggcaaaaccctggtttgcttgagaaatctttctcactcatgctaaaggttccaagatttattgattttgataacaagcgtgcccacttccgatcaaaaattaagcatcagcatgaccatcaccatagcccattgagaatatcagtaagaagggcatatgttctagaagattcttacaaccagcttcgcttgagatcaactcaagatttgaagggaaggttgactgttcacttccaaggggaggagggtattgatgcaggtgggcttacaagggaatggtatcaattattgtccagagttatttttgataaaggagcactgctttttactacagtgggcaatgaatcaacatttcagcctaaccctaactctgtttatcaaacagagcatttatcttatttcaaatttgttggtagagtggttggcaaagcattatttgatggtcaactcttggatgttcattttactcggtcattctacaagcacattcttggagtcaaaaatgacatcagtgatgttctggatcttacttttagcattgatgcagatgaggaaaaattgatcttatatgaacgaacagaggtgactgattatgagttgattcccgggggacggaatatcaaagttactgaggagaacaaacatcaatatgttgatttggttgccgagcatcggctgacaactgccattcgacctcaaataaattctttcttggaagggttcaatgaaatgattcccagggagttgatatcgatattcaatgacaaagagctggaattgttgatcagtggacttcctgatattgacttggatgacttgagagcaaatacagaatattctggatatagtgctgcatcgccagttatccaatggttttgggaggttgttcaaggtttgagcaaagaagacaaagctcgactgttgcaatttgtgacaggcacatccaaggtgcctttggaaggctttagcgctcttcaaggaatttcaggctcccagaagtttcagatacacaaagcatatggaagtcctgatcacttgccttctgctcatacttgcttcaatcaattagatttgccggagtatccatctaaacaccatttagaagagaggttactgctggcaattcacgaagcaatcgtatatttgcaatgggaaatgccattggcagtttttcaatcaacagttttgcactgtaatgatgccttgtttatttcagtaactcaggttagtggtgttgcggaatcagctaagatcgtatattaa

SEQ ID NO: 72145 - DNA, 288 bp, Glycine max
  Peptide Sequence Number=SeqID_163830
atgggtgaccgacttgaagctttggaaactcaggttgaaaacgtgacgacgctgcaggagcttgctttgcaaatgcaacaacatgcgcagcaaatgcaacagcagagtgtgatcatgacagaattaagcaaacagatggggaagaagacagcgaggcaggaggactctacgggtgattcatcacatagtgagtctcgtcttgtagggaagaaggtgaagcttccactgtttgaaggagaggacccagtaacgtgcattacacgagctgagatctactgtgatgtttaa

SEQ ID NO: 72146 - DNA, 396 bp, Glycine max
  Peptide Sequence Number=SeqID_163831
atgcaggttgtgaaatttggtgacattatttttgagccaccaagagatggcccaacattatgggaaatagacattcctgatcgctctgctgctggattctatgttcctgatcctaatcccaaatacattaacaagctctttgtcaaccagacaagtttaggcaatatgtgggtgtcagtgactacacaagattggttctttgcacatgtcaccgggaagcaagaagatggcagttaccaaggaactacttggcaaattaagttcaacctcgatgacgtggagacaagtaacatctacagattaaggttggcacttgcaagtgcaaatatctctgaattacaggtttggaacctcacaaaacttttctgtgtaatctcacattacatggatgtttag

SEQ ID NO: 72147 - DNA, 219 bp, Glycine max
  Peptide Sequence Number=SeqID_163832
atgaaaatacgcaccgaaaccgcggcaattcgttccatgaaagcggaatccacgaagccgcgagagaagcgaagcgagcaaggttggcgcgtgaatgcggttcgggaaacgaatttcgacgagagaatcagagaaactgagaatcggaatccatggatggatcggagaaagaaagagaacgaagcattgaaggttgaatgtgcgacctgcatcggataa

SEQ ID NO: 72148 - DNA, 123 bp, Glycine max
  Peptide Sequence Number=SeqID_163833
atgggactcatattccgattacagtttctcctgatgagagacctagatatcgtaatagaaaaggagattctcgagtattacgagatgcattacgtcgtcaaaacaaacttgaaattccaactg

SEQ ID NO: 72149 - DNA, 213 bp, Glycine max
  Peptide Sequence Number=SeqID_163834
atgtccattggatttaatggtgaaatatgtgcaatttcaggtgaaaaagagtgggctaagcgcgcattcaccgctaagcgcaatttcagcgcgcttagcgcaatagaagaatttggcagggcatcaatatcaaggtcgcgcactaagcgcgagatcagtgcgctaagcgcagcagttgtcttcagccaggctcagtgcacgaactggcgctaa

SEQ ID NO: 72150 - DNA, 1047 bp, Glycine max
  Peptide Sequence Number=SeqID_163835
atgatgttaactgtcaacaagtaccaaccgtttccatgtgaactcagcacgaatcaaaactttctaaattccaattttgtccccaccaaaccaaatcttacgcttcctctgctcttttcgcttctctacttctccttccactttctccctctcttcctcgcaattgattcttcttctggttctggtatggatgctgctgcaagtcaaagtctctatccattgcaccgttgcaaaactgttcacctggttaggcatgcgcaaggagttcataatgtagcaggagagaaaaaccatgatgcatacaattcttatgagttttttgatgcacacctaacctctctcggctgggaacagactttctgtagagattggtataggtattctgccctggttaataatctgcgaaagcacgtgaaggcaagtggactttccaaaaatattgaacttgttgtcatttcccccttattaaggaccatgcaaacagcagttggagtctttggtggtgaagcatacactgatgggattggtgagccacctctgatgacggaaaatgtcggacacagtgatcatcctgcagtttctagtatgaactgccctccattcatagctgtggagctttgccgagagcaaataggagttcatccttgtgataagagaagaaccattagcgagtaccggaatatgtttccagcaattgatttttcacttattgaaagtgacgaggacattttatgggaatctgatgtcagagagaagacagatgaagtttctgctaggggcctgaagtttttggaatggttgtggacacgtgaagagaaggagatagcagttgttacccacagcagttttctgtttaatacgctccgtgcttttggaaatgattgccacccagatataaagagtgaaatatgcacacactttgctaattgtgagctgcgttcaatcgtcatcattgatagaggtatgattggatcaagtgaatcaactaccaactatcctggcaagattcctcgtggccccgatgttcccagtgaagctgctgactaa

SEQ ID NO: 72151 - DNA, 1050 bp, Glycine max
  Peptide Sequence Number=SeqID_163836
atggagcttcaagaccatgatttcttggaggaattaatgtctctaagaagagaaacatgggataccaatccatgttcacaagaaaaccagcttttctctaatggctggagttttgattgttttgaggatcaaaactatcatcaagcttttcctccaaactctttctcttgccaacaagttcctcaaagttacaataacaaaggctacaactacaatgaaatttatagttccttactacatgaattctctgcaccccaagttatagattcatcatcctataacacccttgatacctctccttttctggctcaagaagattatccattgtccatgatggaagaagaagatccgggctttcttggggaagagcttcattgtttggaccttcaaaccacatgcaaaatggagccaagccattccactgaaatgcctattttcaacacaacttcatcatttgtggagagaaagaatagagcaaagaagcttcaggggcagccttcaaagaacctaatggcagagaggagaagaagaaagaggttaaatgacaggctctccatgctaagatcaattgtgcctaagataagtaagtccattgggttgaagtacttgaatgtaaaaccacatagaactactatgatggacagaacagctatacttggagacactatcggttatatgaaggagctcttggaaaagattaataatttgaagcaagaaatagaagtggattcaaacatggctggcattttcaaggatgtgaagccaaacgaaatcatagtgagaaattctccaaagtttgatgtggagaggagaaatgtcaatacaagggtggagatctgctgtgcagggaagccaggcttgttgctggctaccgtaaacaccttggaaacattaggcgtcgagatccaacaatgcgtcattagctgtttcaatgatttcacagtgcaagcttcttgctcagaggaattgctgcagaagacaattctgagttctgaagatataaagcaagcactatttagaagcgcaggatatggtggacgatatttgtga

SEQ ID NO: 72152 - DNA, 357 bp, Glycine max
  Peptide Sequence Number=SeqID_163837
atgggagcccacagttcttttgggctaggaatgcccatatccttgccaaagatcacacaagaagcttttggaaagggcttgattgtggttgtggaccagctgttatgttcggccatattattacttgtgagtagagctaagcatgcaacaaggtgcaaggtgtggaagagccatggaggttatggtgatgccgacgtggtggagcgcgaggagaggagaggagtgactgtggagtgtagtctgtgtgattgtgactacaagtgcgagagagaaagagattgtgagcgcgagggtgtgaagtatggaggaggcgtagaggttgtggcggcgctggcgtggtggagaacgaggttgtga

SEQ ID NO: 72153 - DNA, 1005 bp, Glycine max
  Peptide Sequence Number=SeqID_163838
atgtccaagccactgctaggcatagcggaagaggaaggtcaaagcaatgtcactttgttggtttcttcctcagccaccatggaaagtgtgtgcctgaatagctcaaaactgaaagagcgcaactacatggggttatctgattgttcatctgtggacagctccgcgccgtccttctcagatgagactaagagcaatctgaacctcaaggctactgagctcagactggggcttccggggtcgcaatctcccgaacgagattcagatctttgcttgagaagttcgattcagtttgatgaaaagccactgtttcctttgcatcctgcaactgatgaacaccattcctcatcaaagcctgctgttttgggaaacaaaagagggttctcagatgtcatgagtggattcgccgaggagaaattgcttgttagttccgaggtcaacacaatattgccaccaaggccttcttctaatgtggggttgaaaccaagctctatgcttgagaacgtcggggctcagcagcaagccaaagaactcgcaacggtgaaggttggtcacgagaggtctcatgctgtcaacgaaagcagaccaaatcttaatgattctactaataacaatagcagtgcaccagctaccaaggcacaggttgttggttggcctcctataaggtcatttaggaagaattcattggtcactacttcaaagaatgttgaagaagtagatggaaaagtggggcctggtgcactgtttgtaaagccattttgccaggatccagttactgcttatgttgatgtgatgtcaggttcttgtggatctcatggaaatctgggaggggaggtgctgaatgaaaccaagctgaaggatctgcttcatggatcagaatatgttcttacttacgaggataaagatggagactggatgctagtgggtgatgttccctgggagatgtttactgagacgtgcaagaggctaaggattatgaagagctctgaagccattggtctaggttag

SEQ ID NO: 72154 - DNA, 567 bp, Glycine max
  Peptide Sequence Number=SeqID_163839
atgggttactttgaaattgtttgtagggatatgctaggtgcacccagcaatattgctggtgcacccagcaatttattgaaaggtcaattttgcccttcatttaaaaacataaaaaactttttccctctttcggaagcattctgtcttctctcttccgcgaaaaaccttttctcctctcttctctcttccgcgaaagcaagcttccttggtggtcttcttctccgcgaggcttctccgccttcatcttctccgcaaggcttctctcttccatttgcattcgagatgaactttagggtagaggacgccggaaaaaatagcggaagcttggtgacggtgagccttccggaagatttccggaagaagggttcttccgaaggtaatgaaacgactttcggaagaacaggtcttccggaaagctctcggaacacctcttccagaatgtttccggaagatgtacttcttccggaaacattccggaagaaggttcttccggatgacctttccgtggttccggaagcactttccggaagatccttcttccggaatgtttccggaaaaattgactaa

SEQ ID NO: 72155 - DNA, 525 bp, Glycine max
  Peptide Sequence Number=SeqID_163840
atgtcgtttgaaaagatcctagccggtatcggccaaacaaaccctagctggcgttgtttagaattgtcctcctccttcacaactctttggattacgcactcctctccaaaaccagagatgaaagaggaagatcgagcaagcaagttcaacactgtcgtcgcattgagcatacaacaatccattcaaattctcatctccattgcactcttgaaatcctcgcccaagaacaacaacccactcacacccatcaaacttgttcgccgccaaaacaacgtcgtgcattgttggttacattcttgtacaaacaagatttcactgcgcaactcctttgacacaagtatccgtgtgcgaggtacctctagtggtgcacaagatcatggtagtgatggtggtggtgccaattatgataatgtgatagtgttggtggccgtaacaataatgatagcgatgttagtagtggtgatgacaattctagtgctagattggggggttaaacaaagcaatcagacaaaatcaataaaatag

SEQ ID NO: 72156 - DNA, 303 bp, Glycine max
  Peptide Sequence Number=SeqID_163841
atgaatgataagaaggttgttgtggttggtgtctcgctaagcgagacttatgcgcttagcgagaatcatccgctaagcgaggcacccatcccgcttagcgagtcgggagaatctatagaagaatctgccaagcatctgcgcgctcaacgtgtcatcagctcactcagcgagtcggagaggcttaagatactgatatccaagagcgtagagagaaaaacagaggtgcaaaacagagcaaggaagccaaaaacctcagctttgaagaggattctaggtttaggagtaatttctaggttcctagag

SEQ ID NO: 72157 - DNA, 171 bp, Glycine max
  Peptide Sequence Number=SeqID_163842
atgtcaaagtcaggatgccaaagccaggattcatcaagggctaacccagaggcaattggctctccaattaccctttatcctgtagcacaagaacaaaatcttcctcaggaagttattgtcatgagtacaacatacagagaaaaagggtacataagtaactgtgaacagtaa

SEQ ID NO: 72158 - DNA, 333 bp, Glycine max
  Peptide Sequence Number=SeqID_163843
atgcgttcgaatttcacaacgatccaacggttaacgagtctggatcatcgttctactgagatagttgacattgttgcttacatttttgcacttgtgcctactatgcaaccgcaggaattggacactgaaatagtcgtagcaaccacaactggaacagccacaaatgcaaccgctgtcgctgctaatgtagttgttgatgagaggcagatgaatgcactctttcttggtgtgctcttgtactttgaccggtacacacggttgttggctcccaacttgaacatgcttcaggatcagaggatttccattgcttccaatagaagaagcagggtatag

SEQ ID NO: 72159 - DNA, 1863 bp, Glycine max
  Peptide Sequence Number=SeqID_163844
atgaatatcaatgaattgtttgaatcagttgatatactcaatatatctgaacatcatgcaaattttaatgtttgccttcatactcctccccatattgtatccgatggcatatggggaggacatatcacagaagccccacctttaagatcatctttctcgttattcctacttcaagtcattgtaatctatactgtaacacgagctttacattttcctataaagaagttaggtttaccatcaatcatttcacaaatgatggtcgggctaattataggaccatcattgaacatattggaggaagacaagattatgttgtttccttatggaagtcaagatacacttgctacgatagcatcacttggtcatgtgctatttgtctttgaaaatggtgtaaaaatggattttagcattaccaccagaataggaaaaaaagaatgggtcattgcccttgtaggattgttattacctctgctaattggttatacacaactagaaatcatttctacacttttaacccaagtgattgcttccgtcctcaatgaccttcaaatcctaaactctgaacttggaaggctggcattatcttctgcattggtgggtgacatactaagtaatattcttataatttcaactgtggtctttgatgtaaatcaacaagtagatgggattgggataccgctaaaggatgctatgtctcttgccattcttctaaactgcaaaggtgttgtggaagtagcaatgtatagctctgcattagacaaaaatgatcttgaacctgatatttacacagtggttataacaacaatcatgatcacaaatagtattgtgcatttgatggtgaaacgtttgtatgatccttcaaggaaatatgttggataccaaaaaaggaacatttttaatttaaaaccagactcgaatcttcggatactagtttgcattcataaacaatatcacacaatccctatcataagggctcttgatctatgtacccctacaccagaataccctaccaccgtggatgttttgcatctaattgaactagtaggtcgttcttcccctatttttgtttctcacaagatgaaaaaaggtgttctctctcacacacgaaactcctactcagagaatgtcatcctttctttcaaaatctatgaagatgaaaaaaagggtgcaacaacaataaacccctatacagccatatctccacctacgttgatgcatgaagatgtgtgtttccttgcattagataaagttgcatcaattatcattcttccttttcatcgaaaatggtccattaatggtaaaattgagcatgaggataagacaataaggtcattaaattgtaaggtcatggaaaaggctccatgctcagttggaatattagtgagtcgttttgttcatcaaagagattcaccacttcgattagccatgatatttttgggtggaaatgatgatagagaggctttgtgcttagccaaccgagcagccaaagactctagtgttaaccttgtggtatatcacattacaaccaataacaaggatgaaatccaagacgtggacactatgcttgatcatgcgatgttgaaagacgctaagaaagaatgctctaatttgaaaactgttattcataaggaaataatagtagaggatggagcccaaatatcttctattcttcgtcaaatgatagatgaacatgatttttttatagtagggagacgtcatggcattgtctgtcctcaaacaaaaggacttcaaggatggagtgagttttcagagttaggtctcataggtgattttcttgcttctacagatctagaatgcaaatcttctgttttggtagtgcaacaacaacaattgttccattaa

SEQ ID NO: 72160 - DNA, 1659 bp, Glycine max
  Peptide Sequence Number=SeqID_163845
atggagtcaaaacattacttaatgcaattgctcaacgctgccaaaaccattgatcatctaaaacaaacccatgctctttttctcaaactcctcaggcaacaaccaccccatcattaccattacttcatgggtcgtttgttacaccaggttctccgttgcactggtgagaaaaccaatctttgctatgcccaccaactgtttgatacaatgccaaactgccccagtagcttcctttggacctcccttattcgtgcactcctatcccatcaggctcatcttcaccattgcatttccacttattctagaatgcatcaaaatggcgttttaccatctgggttcaccttttcttcgatacttagcgcgtgtgggcgagttcccgccttgtttgaaggaaaacaagtgcatgccagggtgatgcagtcagggtttcatggaaacaagattgtgcaaactgcactccttgacatgtatgcaaaatccggctgtataagtgatgcgcgcgctgtgtttgatgggatggatgacagggatgttgttgcgtggacagcgatggtttgcgggtatgccaaagtaggaatgatggttgatgcacaatggctctttgataaaatgggagaacggaattcttttacttggactgctatggttgctggatatgcaaattgtgaagacatgaaaactgccaagaaattgtatgatgtcatgaatgacaagaatgaggtcacttgggttgcaatgatagcaggttatggtaagttaggtaatgtgagagaagccagaagagtatttgatggcatacctgtgccacaaggtgcatcagcttgtgcagcaatgcttgcttgctatgcacaacatggatacgcaaaagaagctattgacatgtatgagaaaatgagagaagcaaagatcaaaatcactgaggtggcaatggtgggtgctatttcagcttgtgcacaacttagggacattagaatgtcaaacacactaacaggccatcttgaggagggttgctgtgataggacacatattgtttcaactgcattgatccatatgcactcaaaatgtggaaatataaacttagcattgagcgaattcactacaatgagatacagggatgtgtatacttacagtgcaatgattgcagcctttgctgagcatgggaaatcacaagatgctatagaccttttcttaaagatgcaaaaggaaggattaaagccaaaccaagtcacattcattggtgtcctcaatgcatgtggctcttctggttatatcgaagaaggttgtaggttttttcagattatgactggggtatttggtattgagcccttacccgagcactatacttgcatagttgatctccttgggaaggctgggcaactagaaagagcatatgatctaataaagcagaatgcatccagtgctgatgctacaacttggggttctttattggcaacttgcaggctttatggtaatgtggaacttggtgagattgcagccagacatctctttgagattgaccctgaggattctggaaattatgtgcttctagctaacacttacgcgtcaaaggataaatgggagcatgcacaagaggttaagaagttgattagtgaaaagggaatgaagaaaaaaccttcagggtatagttcaattcagtga

SEQ ID NO: 72161 - DNA, 258 bp, Glycine max
  Peptide Sequence Number=SeqID_163846
atgtgtattgttgctccctcgtctgggatattgcctgctagtgttgaggttgatataaatgatgggtatcatccaagtcttcagagcattgacctagatttagaggaaggctcgggtgatagtgaagatgcaagtgttggtgcaacatatgcttttgagggaattcatttgaatgattcacaagaaattgtcagccaaggaattggtagccaaaagagtaggaaaagagaaaaagaattaatcacactgaaaagttaa

SEQ ID NO: 72162 - DNA, 365 bp, Glycine max
  Peptide Sequence Number=SeqID_163847
atgccacaaccaaatgaagataaagttcttattaatgatcctatatgtgacatgattaatgatacatttgggcatcatcctgataataatgatatggaggaagacaaagatgtgtgtctagaagcaagccaaacaatgtcagatgatattatagaacttttggaggatgagggtccattggtgggaatcatggaagggggaaggggaagaggagagaaagggtatgtgaggggaggggaagggaggggaaaggtgaatcatagtgtgggtgggtttgtgaacaatgtgtgcaatggagattggaaaagtgaagaagcaaaggagacgtggagtgaggggagggggttgggaattctagattgtgg

SEQ ID NO: 72163 - DNA, 174 bp, Glycine max
  Peptide Sequence Number=SeqID_163848
atgtcagtgaaaaacctcgtcgggtgcctaggagtacatgacaagacaaaccacacactacacaagcttaaaggagcactcaaattaggtgtatttacccccaaggcctacactccgaagagtccgtcagggcctctcccttctaattcaagtccaacccaaaaaatattttag

SEQ ID NO: 72164 - DNA, 1206 bp, Glycine max
  Peptide Sequence Number=SeqID_163849
gatgctgcactggacaatgctccgccagtacctgttgattttttggtatctcagaaaactcgtgttatagttataactggccctaatactggtggtaaaaccatatgtttgaagaccgtaggattggctgctatgatggcaaaatcaggatgtaggctcacaaaggccttgaactctgactttgagtctaatgttggtctctatgttcttgcttctgaatctgcgcaaattccttggtttgattctgtttttgctgacattggtgatgagcagtccttatcacaatctttgtctacgttctctggccacttgaagcagataagtgtaaggaataatggaacaaacccccttgaaggagcagcactaggaatggcattattggaatcttttgcacaagacagttgtttgttgactatggctacaactcatcatggtgaattgaaaacactaaaatacagtgatgaggcctttgaaaatgcatgtatggagtttgatgaagtgaatttgaagccaacatacaaggttctttggggtgtaccaggccgctcaaatgcaataaatatagccgagaggttgggactaccatctgttgttgtagatactgctcgtatgttatatggttctgctagtgcagagatagatgaggttataactgatatggaaaggttaaaacaagaataccaagaactattggatgaagcacgtcattatctgaggcactccagaggactttacaatagtctattgaacaccagaaggaagatcatagaatatagtactaatctaagatttaagaagatgagagatgtgtccgaggctgcagcgatggcaagatccatccttcacaagaaagtgagggaattggatgcatcagctaagcaaccttcacagaataataaaaccattagcagctctaatttatcagcaaccaacaaaagccaaactgttgcagagaacaaagaacccactattgctgataaaagtgcatcttctgttaaagtttttaatcgatcaagatcagttgtcattcaccttattgatgttgcagataaatctgggcctcccaaggttggtgatatggtacatgtctcttccctcgggaaacaggtgactgttttaaaagtggattcatccaaaggagaaattgtagttcaagctggaaacatgaagttgaagctgaaactaactgacattcaaagatcatag

SEQ ID NO: 72165 - DNA, 762 bp, Glycine max
  Peptide Sequence Number=SeqID_163850
gatcagctatggtctcttaatcaaacttttgaggaaagtcttaaacttctcgaggaaaccaatgctgccgttgaaatgaacaagcatggcactctcagattgcacttggggcaccttgatgctatgctggtcaaaaccgccattcaacatgcccggagaagtataccagtgagtggttatgaggcacgggccattgtggctcttctgcagtgtgctgagatcgtgcagggtgatctcaaggctgtaattaaggaagacaaagattggcataatcgtttcatgcctcttacagaagtggcacggcaacaagttcaagtgattgagagaaaggtaattcctgtttattttactatatttcatactgttggttcaggagatactggctgcatcagagatgtacaacagttaatagagagcataatcaggaatgaaaagagtgaaacatcaacccttgaagtgaataacattgatggcaggtggtgtgtaagagtagattctggacagaagaccagttttaagggtctattgttgtccagtggatccggagttggaagtactatagagccactttctgctgttcctttaaatgatgagttgcagcgagcaagaagtttggtggtaaaggctgaagcagatgtgcttttggcattaaccaaaaagatgcagctggaccttgatgatattgagaagacattgaacagtttggttgaactagatgtggagtttgcttactggttttcctttcaatggtcatcttcttga

SEQ ID NO: 72166 - DNA, 231 bp, Glycine max
  Peptide Sequence Number=SeqID_163851
atgttgtcctatgttctcatggaaaaagaagaggttgtctaccatcccaaagatcttgcaatgattttaggttctgaacagatatttgcaatctcactcaccttcaaacagcttttagataattcaaattctcctcctgctaaccaataccatactaacaagaatcaagggatcagaccacttgttgaggctttgaggatgagctttggtgcaacggttgtggccatgtga

SEQ ID NO: 72167 - DNA, 738 bp, Glycine max
  Peptide Sequence Number=SeqID_163852
atggagaaactgaggttgcaaacatgggcaggtaaagctaagtgtgtaggggcaattttgtgtgttggtggagcattagttaatagtctttacaaagggaaggagttttatcttggtcaccatagtcatcacgctcaaactgctactgcagcacacaaaaccaacatgcttcgtggcactttgtttttgatttgcagttgcttctctttaacggcctgctattttcaattgaaaaaggtgaagttgcttagaatatttccactgaggttttggggaacaatgatagcatgcattctcgcagcaattcaagcagcaataataggtgccttcttagattccagtaaagcttcgtggagattagagtgggatctacaactaatcactatagtatattcgggagcactcgctacggctgcttcattttgctttttatcttgggcaattaaaatcaaaggacctagttatcctccaatgttcaatcccttggctcttatttttgtggccatatcagaagctattgtacttggacaaccaataggagtcgaaacgttggtgggcatggttttgatcataatgggattgtacttctttttgtggggcaaaaacaatgacacacagagattgcctcaaccaaatggactaacaagcatgcctgatacatctatagtcgcaccaagttcttctcctaccgacactagtgtgcttcttcaaattgacaagacttgtaataaaaactga

SEQ ID NO: 72168 - DNA, 132 bp, Glycine max
  Peptide Sequence Number=SeqID_163853
atggggtggtgtggtacaatggttggtttggtgcatcatgaagaattgacattggatggttgtggtggtttttgggtggaggtgggatacagtggttatggaggtttgggagagatgctagggttggcttga

SEQ ID NO: 72169 - DNA, 432 bp, Glycine max
  Peptide Sequence Number=SeqID_163854
atggagatctataatctcttgaagatgttaaaactcccatggccaagacactatgaacaaggggaacaagggccttacccttgcatatgcaaagaggctgtttccggattcgaacccatgaccaacaagtcaccaaggcacaactttaccgctgcaccagggctcgccctcaaaaacttcgtaccccattgtccagaggctcttcgctatgcgaaggaaaaatgttcaactagaaagcctctacttccaattccacgtggcaaaaggagagactttgcttctgagccgcttctagaaccttccattgtccaagaagtttcattcgacgacgacaatgaagaagaagaattccttgacgaatttgaatacatctcggttgaagttctcaaatgcacagatgaagacgacgatgacagcgacgacgacgaatag

SEQ ID NO: 72170 - DNA, 123 bp, Glycine max
  Peptide Sequence Number=SeqID_163855
atggtggcgtctctggtgctctctagagctcctcctctggttgctctgttagggttcttgtgcgtcagaaaagaaaaaggggcagaagtgttttgtaaaagctgctctaggaagcaagcttaa

SEQ ID NO: 72171 - DNA, 399 bp, Glycine max
  Peptide Sequence Number=SeqID_163856
atgaataacggatctgggcagtctgctttctcaggaaagtcagctactagtgttgatgagttatgcaagatcatttggactgtggaagcagatttagaagatggtcacctactgtacataactggtgatcctgctgtattaggctgctggaaaccaaacatggctgtactaatgtctcctacagaggatgcaaacacatggaaagctgaatttcagaactcccgatctaggggggctctgcttctgcacaaaaagggttatttagcacttttgactgggctcttgaagctatcagacttttccagcaactctcagaattccggtgacttttccggtgactgtcagaattctgacaacttttccgacaattgtcagaaattccggcaactattccggtga

SEQ ID NO: 72172 - DNA, 1059 bp, Glycine max
  Peptide Sequence Number=SeqID_163857
atgaagcggaagagtggaatgactgacagtgaaggggagtcacaagcacaaaagtggagtaacagcccaggatacactaatgttagtaatgtaacgaataatagtcccttcaaaactcctgtgtctgcaaaagggggaagggcacagaaggcaaaggcttccaaagaaggcagatcatgtcctccgacacccatgtcaaatgctggttccccttctcctcttactcctgctagcagctgtcgctatgacagttccttagtactagagcaaaattcttacatcaaaccttataggggaattgaatcttctacgtctggtgaggtggatggtgatatctctgtgcttaaggcagaagttgagaaactttctttggaggagcagggattagatgatcaaataagggaaatgcaagaaaggctgaggaatttgagtgaaaatgaaaacaaccagaagtgccttttcgtgactgaagaagatattaagggcctgccttgcttccagaatgaaactttaatagcaattaaagctccgcatggaaccaccctggaagtccctgatcctgaggaagctgtagactatccgcagagaagatatagaatcattcttagaagcacaatgggccccattgatgtctaccttatcagtcaatttgaagagaaatttgaagaggttaatggtgctgagctccccatgatcccacttgcttccagttctggttccaatgagcaactaatgacggaaatggttcctgctgaatgcagcggaaaagaacttgaacctcaaactcagctctcttctcatgcattctctgatctaaatgcttcacaggagtttgctggtggcatgatgaagattgtcccttcagatgttgatattattggcttctatcagatgctgactaccatactttattccttaactcccaacaaaacagctactgttgattggaatggtatagacatgcttcatcctgattttggaatcatttcgaggcctcaaagtccatcatctgggcttgctgaagtgccatcaacaggagcaaactctattcagaagtga

SEQ ID NO: 72173 - DNA, 1362 bp, Glycine max
  Peptide Sequence Number=SeqID_163858
ggtcagaagtatgggtttgtacaatttgttggggtggaaaaccctaagatcttagagatcaagctggacaagatttatatcagcaatgtcaaacttcatgtgaatctaccgaggttcaggcgaagagagggaatgcaactaagccaagagcaaccagaggggggagacaaaggtagagggtcgaagggtctttgtagaacactagtcaatataaaggggacaggaagtcctttgatgggaaccaaagacttccacacaactgatgggctagagttgtgggaagggtcagatatgttggtggagacaacaaatgaggcatggctaagcaagagtcttgtaaggaggctccatgaaccagagaaaatctttgacttacaagatatgtttattctagatgctttaagctcgatcaaggcccaatatattggtgataaccgtgttctacttattggccacgatagtgatatcttactactcgatatgtcggataataggttggtttgggttaggtacaaaaggttactgttgaacacttggaatgaagtaggttttgggcgtgttgtggtgccaattggtaccctcattaggatcaacgatagagtgtggtcagtaaggatagtggaggagcttggtgacaaaagggacaagtgttgttgtttccatgagaaggagaatgagggggacgaggaggagtttatcgtagccgcattaggcagagttgttagcaaaaggatgagaagcatgagtagttggggagtccacagggatatttggggtgtcaaaaggatatttcttttaaggatgttcagcaaggttttagaaaccgtaagtctgctaacaggtgtaggcctgatggaggagtgtagcacatttggactacaagctcaattaggccttagtaacttaagcccaattcttccaacccaaagaaagggatttgtggatgtatctgagacccaatatatgaaccctctattggatgaccctactaacatcactgggtctctaatggtaagggagcctatggctgatgatggggaccatgtcctaaaggtgattgatgtagccattcggccacctattgcgccacctaagtgcaaggaaaacgaaggtgggacaacagaaggattatgggaggtggaggggtgttcaaaggagcctatgagggaactaccagagccttacaagatcatatggacacactctaaatttgactcaggacctcgttcaagtagtgagtgtcaaggatctcaatggataaaagacgatcaacaagaggctaaggataagttggaagtagataaatttactaagttggaaatgtgggacaacaacaactacatggataagcacgaaaggtag

SEQ ID NO: 72174 - DNA, 1251 bp, Glycine max
  Peptide Sequence Number=SeqID_163859
atggttaattggcgaaaaaggaataatatgataagaggtgtacatgctgatggagtttggaaagaggaacctttggaggtaaaagaggaagtgtggaatgatgataatgatatgcttcttgggagttttgggaaagaggaaattgtggaggctatttgggattgtaggagctcaaaaagtctcaatcccgatggtatcaatgtgtcttttattgcacttattccaaaggttggggaccctcaaggagtcatcgatgaaagacaaagtgcatttttgggtgggagaaacctcttgcatagtgcattgatagccaatgaagttgtggaagatgctaggaaaaatagaaagaaatacttttactctttaggcccgcctagagaatttaagcctcaaaagggcttaagaaaaggtgacccccttgcacattttctcttcaatattgtggcggaagaccttagtgttttgataagggaagcttccttgaagagtctttccaagggatatttggtgggaaaattaggtgttgagacaacttgtgctcctaaaaatcatggtggtttgggggtgaaggatattgctatgttcaatgaggcacttctaacaaaatggaagtggaacctttttcatgatagggggtctttatggctagtatgtggtgggaggagtgatgggtggtttgacaatatattggaatggagaatagagagtggagaattagtgagagatatgggtagttggagtcttgaggggtggagattggagtttaagtggagaaaagagtggtttgattgggagttgagtgtggtggaagagtttctcaatgtattgacaaatgtcaatattgctaatcaaggggaagatcattggctagaagattcatcttcaatgtactcgatcaaatccgtatatatggctttgtatgacttgagagttggttctaatgagattgacattttcaaaagtctttggcaaattaaaatccctcataaggtagccttccttctttggagggttttttatgatgggattccaactaaaagtagaagagtatcaactcagctctacctaagtcggctcgcgagcatttctgacaatgtgctcatggtttacagggtaattggtggcaaacgggttggagtgcaattgtgtgggccatttggcagaaaagaaatgcaatgctttttgaatgaagaaactttgaggttgaacaactttggtagagaattatgtttgcgatgtggtcttggatga

SEQ ID NO: 72175 - DNA, 2097 bp, Glycine max
  Peptide Sequence Number=SeqID_163860
atgcgaaaaaagtgcaagggcagttttggtattttaaaaaaatgctgggtgcacctagcaatactcagagtcaaactccgacaccctgtcttcgctgtcggtcgatgttctgaggaagaatcccaggatcctggaattggagaggttgaggtagtttctgccgcctgcggaggggtacacggagagctggtcctggaggatgaagctaccgtggtggacggcaatcaggcacttcaggaccacggcggcgttgttggtctcctgaaggcggtccatcaggacctccacagcgaccaaggcggtcgtgagccgtcgccagaggagaggagcgtggctgagtgcttcagcgtggggggcgtggaggaatcatggcccgtgacgccggcaggccctcgacggcggacttggaggccggcgggtagtaaagttagtttgtatagggttccatttgggcgtcaaatctgcatgacagaggagagaagcagtttgagaggtacattgcatttacaatacatggattgtctctacatgaatcctcaggaatccattgaagcacgtgtgaaacaccttctttctcttatgactttgaatgaaaagattggtcaaatgacacaaattgaacgctcagttgctaccccttctgccatcaaacacttctccattgggagtgtgttcagtgctccacacaatggacgttttgagaaggtactgtcatctgattcggctgatatggtggatgggtttcagaagttggcacttgagtctcggttagccataccaatcatttatggggttgatgctattcatggtaataatagtgtctatggtgctactatatttcctcacaatgttggcctaggagctaccaggaacaatgttgttgcctgtgccaagcattttgttggagatggaggtacagagaaaggtgtaaatgagggtaataccatactatcatatgaagatttggagaggatccacatggccccttacgtggactgcatagctaagggagtttctaccatcatggtctcatattccagctggaatggaaacaaactccatggtcaccattttctgcttaatgaaattttgaaagaaaagctaggcttcaagggatttgtgatttctgactgggagggaattgatgaattatgccaaccttatgggtcagattatcgtcattgcatctccactgccattaatgctggaattgacatggtgatggttccttttagatatgaaatatttgttgaagagttgatgtctctagttcaatcaggggaaataccaatagcaagaattgatgatgccgttgagcgcattttgagagtgaagtttgctgctgaactttttgagtttcctttaactgacagatctttgctagatgtagttggtggcaagctacatagagatctggcacatgaagcggttcgaaagtccttggttctgttgaaaaatgggaaggatcctagtaaaccctttcttccattgaacaggaatgctaagagaatccttgttgctggaactcatgctgatgatattgggtatcaatgtggaggatggacaggtaccaagtatggatctagtggccggatcacaatcggcacaactatcttggatgctgttaaggaagctgtgggaaatgaaacagaagttatttatgagcagtgtccatcaacagacatcatagaatgtagcgaagtttcctttgccgtagttgtggtcggagaaggtccctacgccgagtgtgggggtgacaattcagagcttgtaatcccatttaatggagctggaatcatagacttggttgctgataaaatcccaacacttgtgattcttatatctggaagacctttgctcttagaacagtgcctattggaaaagatagatgctcttgttgctgcatggttgccaggtactgaagcacagggaatcacagatgtcatatttggagatcatgacttcaaaggtcaactaccaatgacttggttcagaagagttgaacagcttgatcaaccagttggagttagttcatgtgagcccttattccctcttggctatggactaacatatgataaggagaatttgcatgactaa

SEQ ID NO: 72176 - DNA, 1638 bp, Glycine max
  Peptide Sequence Number=SeqID_163861
atggctgagatgaacaagaaagaagagctgatcttcttttccatacctgggagtggccacttaccttcatctctcgaattagcacaactcctaatcaagcaccacaaccatctttcaatcacaatcctctgcatgaagctcccttatgctccttattcagatgcatacatcagatcagttacagcctcacaacctcaaatccaagccattgatctccctcaggtagaaccacctccacaggaactattgagatcaccaccacactacatcttgaccttcttgcagaccctcaaaccccatgtcaaagccatagtgaaaaacatttcatcatctcattcaaacaccgttgtagggttggtcatagatgtcttctgtgcacccttgattgatgttgcaaatgacttaggtatcccttcttatttgtacatgccttcaaatgttgggtttttgaatctcatgttttcccttcagaaacgtgaagttggtgatgcattcaatgattctgatcctcagtggttggtaccgggtctccctgatccagttccttctagtgttttgcctgatgctttttttaacaaacaaggtggatatgctacttattataaacttgctcagaggttcaaggactccaaagggatcattgttaactctttttcagagttggagcagtatgctattgatgcattatgtgatggtcaaattcaaacaccccctatctatgctgttggtccattgattaatctgaagggtcaacctaaccaaaatttggatcaagcccaacatgataggatattaaaatggctggatgagcagccagattcttcggttgtttttctatgttttgggagtaggggaagctttgagccatctcaaacaagagagatagcactagcacttcagcatagtggagttaggttcttgtggagtatgctttctccaccaaccaaagacaatgaagagagaatcttaccagaagggttcttagagtggacggaaggtaggggaatgttatgtgagtgggcaccccaagtggagattctcgctcacaaagcccttgtggggtttgtgtctcattgtggatggaactctattttggaaagcatgtggtttggggtaccaatattgacatggcctatttatgcagaacaacaactgaatgcttataggatggtgagggaatttggattggcagtggagctgaaagtggactatagaaggggtagtgatcttgtaatggaagaggagatagagaaagggctgaaacaattgatggatagagataatgcagtgcacaagaaggtgaaacagatgaaagagatggctaggaaagctattcttaatggtgggtcttctttcatttctgttggagaactaattgatgttatgacagatgtagttaagcaattgtgttattctttctatcctgttctattttattgtctggactatagaaggggtagtgatcttgtaatggcagaggagatagagaaagggctgaaacaactgatggatgtagctaatatggtgcacaagaaggtgaaaaagatgaaagaggtagctaggaaagttgtccttaatggagggtcttctttcgtttctgttggagaactcattgatgttatgactgatagcaagtga

SEQ ID NO: 72177 - DNA, 1349 bp, Glycine max
  Peptide Sequence Number=SeqID_163862
ggcataccactttgacttgcccgcatcgtgtctctactgagcatggagttgttccagcacctcgcaggaaagcgtgtaaacctttggaatatgtgtttgaacgccagctacgaccatccctaccttcaatcaagcccaaatatgtgatcccagaccaagtgaattgtgctgtcatcagatatcacagcagacggataacatgcttggagttccaccccacaaagaataacatcctgttatctggagataagaaagggcaacttggagtatgggattttggtaaagtatacgagaaggtagtctatgggaacatacattcttgtttagtgaacaatatgaggtttaatcctacaaatgattgtatggtctattctgcatcctcagatggaaccattagttgtactgacttggagacaggaatatcatcttctccattgaacctgaatcctgatggatggcagggtccaaacacttggaaaatgctcaatggcttggatattaattctgagaaaggtctcgttcttgttgctgatagctttggttttcttcacatggttgacattcgctccaacaacaggagtggtgatgcaattttgatccacaaaaaaggaaaagttgttggtatccattgcaatccaattcaaccagacatctttctgacttgtggaaatgatcattttgctcgtatttgggacctgcgtcaaatagaagctggatcatccctttatgacctcaagcatacacgtgttgttaactctgcatatttctctccaatatccggaaccaaaattctcactacatcgcaggacaaccgtcttcgtgtatgggattctatctttggtaatgtggactctcccagccgagaaattgtacatagtcatgatttcaatcggcatttgacaccctttaaagctgaatgggatccaaaggatccatcagagtcccttgctgttgttggtcgttatataagtgaaaattacaatggagctgccctccatcccattgattttatagatacaagtacagggcaactggtagccgaagtgatggacccaaacatcacaaccatcagtcctgtgaataagctgcatccccgtgatgatatcctggcaactgggagttctagatctctgttcatttggaagcccaaggagaagtcagagcttgttgaggagaaggatgaacagaaaattgtggtttgtggaaaagctgagaagaaacgtggaaagaaaaatggcaatattagcgatgaatctgatgatgaaggattcatgtccaagtccaagaagtctaagtctaaaaagacagagtggaaattgtctcgctgcactactaaggataatcgctga

SEQ ID NO: 72178 - DNA, 540 bp, Glycine max
  Peptide Sequence Number=SeqID_163863
atggaaaagagaaggcagaaatggaaaattttttctctatcttgtgttcatgttcctaacgttcacctacttcaccttttacggccttatggcagttggcctttcatcttcccaacatttagcagcggttatttcttcagcattttactccctgtggaatcttctttcaggttttctcatcccaaaagcgtcactggtaaactgttttctttgtcttttctctctgggattcaaatgacactccttgcaatgtctctgagtattcccgggtggtggatttgtttctattatatttgcccgattccatggacgttacgtggtatcatcatgcctcagcttggtgatgtggaaaccaaaattctaggacctggatttgagggcaccatgaaagaatacttagctgttagtcttggatatgaagctgaaatcaacggattttcagctgtgggcctttcagtgattgtgcttcttggatttattcttctgttctttggttcttttgctgtatcagtcaaactcttgaatttccaaaagagatga

SEQ ID NO: 72179 - DNA, 255 bp, Glycine max
  Peptide Sequence Number=SeqID_163864
atggacgaagatttggagaataacacggaggtttgtgacggtaacaatgcaatgacaccaatggtgagaaagaagtcagaactagttgtggtcgcaaataataactctcgtttacaaatgcttaggaatttcatgaccaatttgcaagaggtcttcttcggcactaagcttgtggtgctttttccggcagtccctttggctgttgttgcaaatttttatagctttggaaggactacttttattaacaattattaa

SEQ ID NO: 72180 - DNA, 546 bp, Glycine max
  Peptide Sequence Number=SeqID_163865
atgttaactaatgatgttaacatcggtttttctcagaaaaccgatgttcattactttcctcgcgctctatttttcttcttcttcctcgcgctccgattttcttcttcttcctcgcttcttcttcttcgtgacctcacggtacacgcttttgtaactgcacgttacccaggtggtcactgcaaggaggttcgtgcttgcaagttgcaaggtgatcaaggtggtgactttcagtccgttggtgttcacaaggtgctcgcaaggtgcttcgtgctcccaaggtgcctattttataattttggttatatttggtttatgagtccgatttcagcattcaacactaacaccaacactgcagtttcagtcaggaatgtccgtttgaggcccataatatgtcaaaacgctcgaaatcgaaggaggaatcccatggacattaaatcagaagatttagttgcaaggcgtagggagtacctctgccttggtggtttgctttcttctgggctgtccattcatcaattgcactcttcaagtttgagagagagtatttaa

SEQ ID NO: 72181 - DNA, 1023 bp, Glycine max
  Peptide Sequence Number=SeqID_163866
atgaagaagatattaacatcatcatcatcatcatcatcttattcatccaccctcagtttggactcttctttgtgcaactccaaaagtgccactactgcagggtgtctcacagcaatcttgcgaaggattctctgctctggaggccttccaacacacccatcagaccaaatcggagaacttgactcaatgccaaagatgagtgacaaagttcaagaattcaagactaaacacaacaccgaatctatagccaccgccactactactactattactcctgggatactagaaaggttaatgggtttggaatcaatggtagtagagagagatacaaatacagccaatgaatcaacatcaagttcttcacttccacgtagcaaatcaatgaactctgtggactacttgggggaatgcaagagaatggagggtcttcataagcgtgctaagtcttcatcattccgtgaggttccaactttcctcttgcatgaaagtgagaacttcttggtgctcagctttgaaagtggatgtgatggtggagaattcaggtccaaagagagaaaaaaagaaaagggttcaaaagagagaagtgagttgaagaaaaacaagagagaaaaggtgcatgatgacatgttttctgtcaatgttggaaatgatggtgaatttgcccaaactacgacactgttcatggcttgttctgaaaaggagtacgttggttcagaaatggtgggattctcattctcacaccccgtgaagcgcaaggaagttaccaatggtgagaaattgaagaggagaaaaaagggaacaacgtgttatgcagaaaagaaggtggacactgaatgcagttcagaagattcaagcccagtttctatctttgattttgagcgtggagctcctgaaacagagatggatacaagttggagaagaaaattgtcaccagagcttgaaaatgagcagcttgatgatctgcattgtgatagtaatttgatgattaaagagaggaaggtgaattgggatcaaataggttag

SEQ ID NO: 72182 - DNA, 1224 bp, Glycine max
  Peptide Sequence Number=SeqID_163867
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattggatatttgttatgtggctggactttgtcacatacttgcatcaccatggtcaccaccagaaactgccttggtaccgcggcaaggaatggagttatttaagaggtggcctcaccactgtggatcgtgactatggttggatcaataacattcaccatgacattggcacccatgttatccaccatcttttcccccaaattcctcattatcacctcgttgaagcgctcactatactatactgggagcttggtggtgaaaggggttcccaaccctcctttctaggtgtacatgctttgatacttctgacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 72183 - DNA, 3348 bp, Glycine max
  Peptide Sequence Number=SeqID_163868
atgtctctgaatcattctccaatggatgttgatggtgagaattctcatgtgagcaataagcgtagaaaagggtcgaggaaaagaaagcttctcgtcaaccagagagttgaggatcctttgatgttctgttgtcaatttttggttttgttgaagagtgtggaagagggttttcagggctcatggcacccggggacggtagtccgttgcgggaggcagaaacgtcatgtcaaatatgacaacattttagatgatgatggatcaaagtatcttgtggatgtggtgtatgtttcagctgttttggatggtcttggttcttcagattgtagcaatgaacgcggattcattagaccactgcctcctccgcttgcgtttggggagagggaccttccatttggtctctgtgttgatgtgaattatgaagaagcatggtgggaaggagttatatttgatcattgcaatggaacgaaggagaggagcattctcttcccggatttgggtgatgaaatcaaggttggaattcatcaattgaggctaactcaggattgggatgaagccaccgagaattgggagctccgagggaagtgggtgttccttgagatggttgaggagtttgataaggaatccgtcattgctgtttcgctaaagcaaatatggtatgatgtgagggcaacaaaggagtttgatgacaacttaaagcactggacttgtaatgtgaaggaattgtggagagacctcgtaaaagaggtgattggtgactactatcttcttacactagaacaagttttcccagccttaaaccttccggaggagttcttgaaagaaacaccagagtcagttgacaggattcaggttgagccaaacttgttggatggcaatacaaaatgcggtggcatcattccccttcaagaggaatatgataaagatcctttggtggacttggaatccgagaaggaaattattttgcaggtagaaccagcatctccagttcaagagatcatgcctgaggctggtgaagtaatgccaggtgctagcaggtgtgcaaagaagagaaaacgtagacgcacagcatccatatgttggaaacggctggaactgagaaacgctgaattctgtcctgatgttattaatgaatatatacgtggatgtgggagcaagaccgttagggaacttttgaagactaaagtacggaaacatcttgcatatcttggatggaaaattgagtgggctgaagataaatattttcctgggcgaggacgttacaggtacaagtcacctgatgatgcacaggaccagaaggtttacacttcaattattcaagttttaacacaactccaaatggagtccaacatgaacaatgtgcagccacaaattgatcataataggatgcattctacaaatgactctaatctttcacatctgctttcagatttacccccaaatgaccaggatgtagatgtttgtcatccaaaacagaaaccttctaatgctaaagttgtagttgagccagaattttgtcctgaagctgttgttaaatattacttgaatgcatcaaagagacatcattgggttgataaagtcaaatggagactgaaagctaagaagcatttgttagcagaaggatggacctttgagtacccaaccaagaagcgaaagacaactttgtacatgtctccaggaaatcagtggttgggcttccttcgaggtgcatgcagaatacatattaaagaaaagatttctgaatggactaattctggcatgatacctttgaatgtcccagccgtgaatgagagcaagaacggtgaaggtgatgttgatagtgaggatctattacaaattttgtcccaattgcttaaaaaagagcctgccttgctaactgcttccccagaatgtagatcaactgagaatagaaaccatagatgcacccgtaattcaaaagcttccatgccaaagagccgcaggaaaggatcaccaacacgtgtgctatggtcaagcaaaagggtgcaaaaggtgtctgccccttctccgtcacacaaaagacatcaaaatgtcttgtcttggttgatcgataacagtgtggtgatgtcaagatgtaaggtctattactgggcaggaggcaggaactctaaagtgtctgaggggaggataacttatgatggaatcaagtgtagctgttgctcaaaaatatatggtcttggtggctttgttaatcatgctggtggaagtagtgactgcaggccttctgctagtatctttttgaaggacgatggcggtgaacttgttttatgtgaccaatgtccatcagcatttcatagcacgtgtcttgatttggaggatatccctgatggtgactggttttgtccatcttgttgttgcgggatttgtggacaaaccaaaatagaagggactgaggatggtgatttacttgcttgcattcaatgtgaacataaatatcatgttggatgcttgaaagatagagaaaaatatgagtcaagaatatatatgaaaaattggttgtgtggaaaagagtgtgaacagatatatgaaggcctccaaagtctattaggaaagccacttatagtgggcacggacaatctaacttggacattggtgaagtttatcaactctgagagttgcgatgttggtagtactaagaatgacttattggcagagacatacagcaaactcagtgttgcactttcggtgatgcacgagtgttttgagccattaaagaacccttttactagtaaagacatcatagatgatgttatattcaacactaggtcagaccttaatagattgaatttcgaaggtttctacactgtacttctggagcaaaatgaagaactaattagtgtagcaacaattagggtctttggacagaaagtagcagaggtaccgcttataggtaccagaatacaatatcgtcgacttggaatgtgtcgaattctaatggatgagcttgagaagaggctcacacaaattggagtggagaggctagtcttgcctgctgttcctgatatgctagaaacatggaccaactcttttggttttgcaaagatgacaaattttgagaggtcacagttcttggactgtgctttcctagagtttcaggaaaccgtcatgtgccagaagctgttaacaaggagtccatcccccaaattgggtttaacaagaggtttgcacttgacacattttagatgcaaccaaaaccacatgatgtttgtcaaatgtaaaattgagtttgataagtccagttcagcatttgaagtggaccaagctgaagagcttgacaaaagtaggaaggatctacaagtggtggagtgtgttccaaccttgcctacttcctaa

SEQ ID NO: 72184 - DNA, 204 bp, Glycine max
  Peptide Sequence Number=SeqID_163869
atggaatcaaatagaaagagcttaaacaagctcagaagaagaaaaagaaaggggaagagaagaagaacaacaccaccaccacgtgtgaagggtgaaattgaaggcctcaagcaatttgattccaccaagtggctccatgaaacgccgtcgtttccctttgattcagtgtactgtaaccgtccactggctggtaccggacactga

SEQ ID NO: 72185 - DNA, 595 bp, Glycine max
  Peptide Sequence Number=SeqID_163870
atggcaagaataaatgatttgggcaagaaagatgagctacaaccactctttgaggaggaattgtctataagaatccaacttcaagagatgttctgggagatgattaggaggaatgaatccttactgagacataagtctagatctaattggttgttggatagggatggccctgggaaagttaaagagttagtgatatcattcttcacatctagattcagtgaggatgagattagaagaccttacttagatggagcggaattttctaaaatttcacaagtagactatgggtggtcaatctttcatgaaaacggtagtttgtggagagacacattggagtcaaagtatgagggggaatcttttggaggtggaaattggagtgaaggcatagatgggattatgggacagaaagatgaagtgttcttccaaatttgggaaattgatattccaccaaaatctaaacatctaatctggagagtaatgcttgataggatgccttctagagaaaatcttaggaaaaggaatgtgaacttagatgattacttatgtcctttttgcactcagcgtgaggaaacaattagtcatgtaattctatctt

SEQ ID NO: 72186 - DNA, 300 bp, Glycine max
  Peptide Sequence Number=SeqID_163871
atgtcggggcaccgctcgaagtcggagaagcacgacgtcgacggcggcggcgatgagaagcagctccggtgggacccctacgaggtcctcggcgtcctccacgaattaggaaatcaaaatcgcgtaccgcaaaatggcgctcaagcacttaacaatgatgatgttgataacattttaaggcattcttcttactactactttagcatgagaactccaagtccatcttcagtccctaaggaagctaggttaactcaacagggttcccatgcacaacgtagctgggaaggattgcttgtgtag

SEQ ID NO: 72187 - DNA, 5241 bp, Glycine max
  Peptide Sequence Number=SeqID_163872
atggctgcgaacgcccctatcaccatgaaagagaccttaacgctgggaagcgttggaatcaaccagcaattcattacatttactcatgtgacaatggaatcggataagtacatttgtgtcagggaaactggacctcagaacagtgttgtcatcattgacatgagcatgccaatgcagcctttgagacggcccataactgccgattcggctttgatgaaccccaattctagaattcttgctctcaaaggccaaatggccaatttcggtcaattggacctgatccacaagtggcaacgttcaatcatgactttatgtggttatggcagccaccacgtccaagatgttgtggctgcattgcatgatgcgtggataactccaaatacactgggaattgtcactcagacgtctgtatatcattggtcagttgagggcgatggtgaaccaatgaagatgtttgatcgaacagctaatctggctaataaccaaataattaattatcgttgtgatcctaatgaaaagtggttggttttgattggaattgctcctggttcagcagagcactacttaggtcatatctctagtgatgtcggactaaacaccccctttcacaccttgcacaatgcaagttctggaggctgcaatgaagactacccaaagaggccgcaattaaggcagagaccacaactagtaaaaggaaacatgcaactcttctctgtggatcagcaacgtagtcaggctcttgaagcacatgctgcctcgtttgctacatttagagtggctgggaatgataaggaatctactcttatttgttttgcatcaaagagtttgaatgctggacaggttacatcaaagatgcatgtcattgaacttggtgcccagccaggcaaaccatcatttactaagaaacaagcagatctgttcttccctccagactttgctgatgactttcctgtgtcaatgcagatttcaaataaatatggattgatttatgtcatcacaaagcttgggctgttatttgtctatgatctggagacttcaactgcagtttatagaaaccgaatcagttccgatcctatatttttgaccacagaagcactttcagtagggggattttatgccatcaatagacgtggccaggtgttgcttgctactataaatgaggcagccattgtaccttttgttagtggccagctaaataatttggaacttgctgttaatctggctaaaagaggaaacctccctggtgcagaagaattggttgtcaagcggtttcaagaattattttctcagaccaagtataaggaggctgcggagctcgctgcagaatctccacgaggaattcttcgaactcctgacactgttgctaaatttcagagtgtacctgtgcaagctgggcagacgccaccactgttgcagtactttggtactctgttaaccaggggaaaactcaattcttatgagtcattggaactgtcacggcttgtggtaaatcaaaacaaaaagaatcttttggaaaattggctagcagaggacaaacttgaatgcagtgaggagcttggtgaccttgtgaagacagtggataatgacctcgcattgaaaatatttatcaaagccagagccacaccgaaagttgttgcagcatttgctgagaggagggaatttgacaagattctgatatactcaaagcaggttggatacacgcctgattacatgttccttctgcaaacaatattacgggcagatgcccagggtgctgtaaattttgctctgatgatgtctcaaatggaggggggttgccctgttgactacaacacaataactgatctctttcttcagaggaatttaatccgcgaggcaactgcctttttattggatgtgctgaagtcaaacctaccagaacatggatatcttcaaacaaaggtactggaaattaatcttgtgacctttccaaatgttgctgatgctatattggccaatggcatgtttagtcattatgaccgtccacggattgctcagctttgtgaaaaggctggccttttcattcgggctcttcagcattattccgaattgcctgacatcaaacgtgtcattgtgaatacacatgccatcgaaccacaggctctagttgagttctttggaactctttcaaaagaatgggcgctagagtgcatgaaagatcttttactggtcaaccttaggggcaaccttcaaataattgtgcagactgccaaggaatattgtgaacagctcggtgtagatgcatgcattaaactctttgagcaattcaagtcctatgaaggactatactttttcttgggtgcatatttgagctctagcgaggatcctgatattcacttcaagtatatcgaagcagctgctaaaactggacaaattaaggaggtggagcgtgttactcgggaatcaaacttttatgatgctgagaagacgaagaactttctaatggagaccaagcttccagatgcacggccattaataaacgtgtgtgatcgttttggttttgttccagatctcacccattatctctacaccagcaacatgctgcgttatattgagggatatgttcaaaaggtgaatccaggaaatgctcctctagttgtaggacagttgttagatgatgaatgccctgaggatttcattaaaggtcttattctttcagttcgttctcttcttccagttgagcctttagttgaagaatgtgagaagagaaatcgtctccgcttgcttactcagtttttggagcatcttgtaagtgagggaagccaggatgtgcatgtgcataatgctctgggtaaaattatcattgacagtaataacaatcctgagcattttcttacaaccaacccatattatgattctcgtgttgttggtaaatattgtgagaagcgggatcctacacttgctgttgttgcttaccgaagggggcaatgtgatgatgagcttgttaatgtttccaataaaaattccttgttcaaactccaagccagatatgttgtggaacgtatgaatgctgacctctgggagaaagttcttaatcccgagaatgagtttagaagacagttgattgatcaagtggtgtccactgctttgcctgaaagccagagtcctgatcaagtttccgctgcagtgaaagcttttatgactgctgatcttccccatgagttgattgagcttcttgaaaagattgtgctacaaaattctgctttcagcggaaactttaatctacaaaatttgttgatcctcactgcaatcaaggcagatccctcaagagtcatggattacattaataggctggacaactttgatggccctgctgttggggaggtggcagtagaagcaaacctatatgaagaagcttttgccattttcaaaaaatttaatttgaatgttcaagctgttaatgtcctactagataaccttcggaccattgatcgagctgtggagtttgcattccgggttgaagaagatgctgtctggagccaagtggctaaggcacaactaagagaaggcttagtaagtgatgcaattgagtcattcatccgtgcagatgattccactcacttcttagaggttataaaagcttctgaagatgcagaagtataccatgacctagtaaggtaccttcttatggttaggcagaataccaaagagcccaaggtggacagtgagctcatatatgcatatgcaaagattgacaggcttggagaaattgaagagtttatattgatgccaaatgttgctaatttaccaaatgttggagaccgtttgtatgatgaggctctctatgaggctgcaaaaattatatttgcttttatttcaaactgggctaagttagcagtgacattggtgaagcttaaacaattccaaggtgctgttgatgctgctaggaaagcaaacagttcaaaaacatggaaggaagtttgttttgcttgtgttgatgctgaggaattccgattggctcagatttgtggtctcaatgtcatcattcaggtggatgatttggaagaggttagtgagttttaccagaacagaggatgctttaatgaactgatatctctaatggagagtggacttggactggagcgtgcccatatgggtatctttactgagttgggagttctttatgcaagatatcgtcctgagaagttaatggagcacattaagttattctcaactcggcttaacattcccaagcttattcgagcctgtgatgagcagcagcattggatggaacttacatacttatacatccaatatgatgagtttgataatgctgcaaccactgtaatgaatcactctcctgaagcatgggaccacatgcaattcaaagatattatagttaaggttgcaagtgtggagctctactataaggctgttcacttctacttgcaagaacatcctgatattttaaatgatcttcttaatgtacttgccctacgtgtggaccacacccgtgttgtggatataatgcggaaggctggccacattcgattggttaagccgtacttgattgcagttcaaagcaataatgtgtctgctgttaatgaagctttgaatgaaatttatgttgaggaggaggactatgatagacttcatgaatcaatagatctgcatgacaacttcgatcagataggtcttgcacagaagattgagaagcatgagcttcttgagatgaggcgtgtcgctgcttatatttacaagaaagctggaagatggaagcagtccattgctttgtcaaaaaaagacaatctttacaaggactgtatggaaacttgctctcaatctggtgaccgtgaactctcagaggatttgcttgtttactttattgagcaggggaagaaggaatgttttgcatcttgcctcttcgtctgttatgatataatacggccagatgttgctcttgagctagcttggatgaacaatatgattgattttgctttcccatacctcttacagtatactggtaaagttgatgagcttatcaaggacaaaattgaagcacagaaagaggagaaagctaaagagaaggaagagaaggatgttattgctcagcagaatatgtatgcccagttactaccacttgctttgcctgcaccaccaatgccaggtatgggtggaggaggctatgctccactgacaacaccccctatgggtggtatggggatgcctccgatgccaccttttggaatgcctccaatgggcggcagcagcggctcctactga

SEQ ID NO: 72188 - DNA, 1161 bp, Glycine max
  Peptide Sequence Number=SeqID_163873
atgctacaggaagagaatgagtctgagatcatcacatctcttaagaaaaaacttgaagtccacatggcaaggaatgagttactactgaaggaaaatcaggaactcagagaagaagtagttcggttaaagtcacagataatttcacttaaagcacacaacatggagaggaaatccgttctatggaagaagatacagaaatccatagatgacaacaacaattcagaagcacatcaacaacataaagcaccaccagttcaggtaatcacaggtgaaaagagttcacagtatgagaatgtgcatacaaatccaaatttcaaagacacaacacctaaaaaagacaaaccagcagcaatagtaacaccagctccgccaccaaggccttctcccaccctccttcttcctttacataaaaaagagaaaggacttaaagtgcagcaagcaatagcaccaccaccacctccaacaccaccaaaattatcatcggttgggttaaaaactctgcgccgtgtgcctgaagtaatcgaattgtatcgttccctaacacaaaaggatgctaacatggaaaacagaatacattccaatggaattcccacagtagcattcaccagaaacatgattgaggaaattgaaaaccgctcaacttatctctcagctgaggttgagtctacctcttttgcagatgtttctgaggtggaagcatttgtcaaatggctagatggggaactatcttcattggtggatgaaaggtcagtgctaaaacattttcctcaatggccagaacaaaaagtagatgcactcagagaagcagcttgtaactacagagatctgaagaaccttgaatctgaagtttcatcctatgaggacaatcccaaagagttggagagaagtgtaagtgctaaagagaggatgagggagagtactagcaagagatacaagaatttccatatcccttgggaatggatgctggacataggcattattggtcagatgaagctaagttcattgaggctggcaaaggaattcatgaaacggatgacaaaggaattagtgtcaaatgaacttttgcaggaagataacctttttgtacaaggagttaagtttgcattcagagtgcaccaggtggctttgatcttgagaccatacaagcatttcaagaattga

SEQ ID NO: 72189 - DNA, 1368 bp, Glycine max
  Peptide Sequence Number=SeqID_163874
atggccacgattgacatggttgagaggttgagaacagatatgggaggggtggtgttggttgagggagcggaggattcttgggctttgtgcgaaaggattgaggattcaaatattaatgatactttagttgatatgtggaaagtgaaacttcctcctaagggtaagaaccctaaagctggcttcgagggcagcaacctccagcaaaaaaaagaagaagacacagaggctttaccactcttctcttggtcccttctcctctctgcaccattgatgctggtgcttcctgtgtttccggcattctatcatgcttccctatcactccctaccccatcaaaaacaccttgtcctcaagtaagtcaggaggagcttcaggaaatccagcaatatggaagcgcgaaacacccttgttgttccgacagaggtggcggaattggtgttggggaagaagatgcgaagtggtggcgttcgcgccctgcaattccacgcagcgtccgtgatggaggaacatcacacgtaatgggttttgggccgattccgggtgtgggttttgggtcaggtccttcagatacgggtgtggctagcttcgggtcaggttgtgctgtattaagacccaatggcacaacccgtgctcatggcgcgtggctaactcctccgggggaaccaaaggggctgacggtggagctaccagcggtggagttcgcagccgcggtggaggcagacgaaggtccgacagcttctgctcctcgatcttcgaaggtgaccggcaagccgataattctattagccaagtcttcgaactccttcaggaacaaaggtggcgtggtgaggaactggtgtgggtttgggcgtggtggaggaaggcacaggagcatggcaatgaaaaagcgtgttcatgttgaaggtcataccgcacatggtattgtcaagacgagcatgggcctcgtcgagggtaagaaccctaaagctgacttcgagggcagcaacctccagcagaaagaagaagaagacacagaggaatctaataacggtttctgttttcatatgattgcctatgagggagcaaccactacaagcaggatttggggctttaccactcttctcttggttccttctcctctctgcaccattaatgctggtgcttcctgtgtttccggcattctatcatgcttccctatcattggggcaatgaatcacgataaagggagaatgggggatcagcaaggaaaatgcaggtatgctaggaaacaaaaatatggtattgccggatttcagccacgtacaaaaggagtaacaggggatatcggaatggctggagaatatcataatggctacaatgtgattgattggcacaaaggcaccatgtgctga

SEQ ID NO: 72190 - DNA, 306 bp, Glycine max
  Peptide Sequence Number=SeqID_163875
atggcctcatcaaactttttatttcccgaatggaactctataaataggcctcctatattcaatggcgtggaggctatagatttaaatatctgggaagccatagaaattggtccttacatccctactacggtagcaggaaatgcaactgtagaaaaacctagggaacaattggatgaggaggaaaagaagttagtacaatataatttaaaagccaaaaatataattacatctgcactaggaatggatgaatacttagggtgtcaaattgcaaaagtgcaaaagatatgtgggataccttacaagtaa

SEQ ID NO: 72191 - DNA, 1458 bp, Glycine max
  Peptide Sequence Number=SeqID_163876
atggcgcggtttcgttgcgtgttctgcagcttactgcactatatgcttcctagaaagagagcgagcgaaggaggagtggttgtagaaggagacactgaccccaccaacagttccaatagcggtgcggcgtcgttttcgaagaaggctcggatcggaagccttgctgcctgctcgggtgccggtgctgcggaatcggcggtgaacgtcagcggccagggattcggtagcggcagtggtgacgacagcgtcgggaactcggtcggaggaatggcgttggggaattcgcaaccggcggagatcgatgaggatctgcacagtcggcagctcgctgtgtatggccgggagaccatgcggaggctctttgcgtccagcatcctcgtttcggggatgcagggtcttggagttgagattggtaatttggtccttagatatgctgatcatactagcagtggttttctgacccctctcttaattaaagaaaattgtttagttgtgactgttgtgttgtttgacggtattggtgttaggaagattgataatttagtccctggtctcctttccaagaatctcattcttgctggggtgaaatctgtaaccttgcatgatgaaggaaatgtggagttatgggatttgtccaggcagaggcttctgttggctgttgttttcactgaagttagtcttgagaaagccattgagttcaatgattactgccacagtcatcagcctcctatcgcctttattaaaagtgaagttaggggcctttttggttctctgttttgtgattttgggcctgagttcactgttgttgatgtcgatggagaggatccccatactggtataattgcatccatcagcaatgacaaccctgctctagtttcctgtgttgatgatgagaggctcgagtttcaggatggagatctggttgtattctctgaagttcatggtatggaagagttaaatgatggaaagccaagaaagataaaaaatgctagagcatattcattcactcttgaagaagacaccacaaattatggtagatatgaaaaaggtggcattgtcacacaggtcaaacaaccaaaggttttgaactttaaaccactcagggaagcactcagtgatcctggtgattttctgctgagtgatttttcgaagtttgatcgcccacctctactgcatttagcattccaggctttggataagtttgtttctgagatagatcgcttccctgttgctggttcagaggatgatgcacagaaacttatatctattgccagtaatattaatggtagcttaggtgatggaagattggaagatgtgaatccaaaacttctacagcaatttgcctttggtgctagggcagtattgaatcctatggcagccatgtttggtggaattgtaggacaagaggttgtaaaagcatgctctgggaaatttcatccactttttcaatgcaactga

SEQ ID NO: 72192 - DNA, 126 bp, Glycine max
  Peptide Sequence Number=SeqID_163877
atggtgttctggatggagcggagccacggcgtcgtttttgggaacgctgagtttcgtgaagtgaccggggtccatagagagtggtacaccagctatactgcttgtgcacccagcaataaaacttaa

SEQ ID NO: 72193 - DNA, 96 bp, Glycine max
  Peptide Sequence Number=SeqID_163878
atggcaatgaagggagtacttgaattgcaaaagaagggggatgataagaacaaagtgtcaatgaggtcgaaacttaaaaattgggttgaaaaataa

SEQ ID NO: 72194 - DNA, 1095 bp, Glycine max
  Peptide Sequence Number=SeqID_163879
atggcttatacaatctacttcatcattttgatgcacttttgcacctttgttgttgtcacaacaagcattagcaatgacctgatgagaaccaagttcttatccattctagtcttcggcgattcaacggtagacacaggcaataacaactacatcaacactttagccaagggaaatcatttgccttatggtaaggatttccctggtcacatgcctactggtagattttctaatggaaaactggttcctgacttcattgcctctatgttgaacctcaaagacactgtccctcctttccttgatccaaatctgtcagatgaagaacttctaacaggtgttagcttcgcgtctgggggatcaggttttgatgatttgaccacggctttaactggagccatagcgttgtcaaagcaaattgaatacttcaaagtttatgtagcaaggctcaagcgcattgcaggggaaaatgaaactaaacgaatacttagagatgctttggttattattagtgcaggaactaatgactttctcttcaatttttatgacattcccactagaaaattggagttcaacattgatggataccaagattatgtgcaaagtaggcttcaaatcttcattaaggaactatacgaccttggatgtagaaaatttgctgtcagtgggcttccttccattggttgcatacccattcaaataacaacaaagtctgtaagtttaaaggatcggaaatgtgaagaggatgagaattcagatgcgaagctctacaatcgaaaattagcacggcaattgcttaagatacaagcaatgcttcctggaagcagggttgtttatacaaatgtgtatgacccattgaataacctcatcaatcaaccagaaaaatatggtttcaaggaaacgagtaaagggtgttgtggaaccggcttatttgaagtagctccattgtgtaatgaattcacaccaatatgtgaagacccttcaaaatatgtattctgggacagtgttcatccaacggaaataacctaccagtatattgccaaatacctagaaatggaagtcctgcccaagttccaatttcatacggattatgttttttaa

SEQ ID NO: 72195 - DNA, 189 bp, Glycine max
  Peptide Sequence Number=SeqID_163880
cttgggttgtgggtgtgggtgtttgacgcagtgcttgtggttgtgtgggtgtgggtgtttgacgcggtgcttgtggttgtgtgggtgtgggtgtttgacgcggtgcttgtggaggagggtgttgctgagtggtggctggtggtggctagtggttcacggagggggagggtggtgttgagcggtggctag

SEQ ID NO: 72196 - DNA, 888 bp, Glycine max
  Peptide Sequence Number=SeqID_163881
atgtcaaaccacacccaacccaaactcgaacctacatcgttggagcttgatcttgcgcctttgtccatgggttcgcctagcactagcaatggtcatatgggtaatataagggtgagtggggcgacattgatggtagtttgggtcttggctatgcggagttctaggggtgcgcggggtgaagagaattgggagatagaggagaaggaggaggtgatggagaattcgcgcatgcgagcagagaaccgaccaaggagggaggaggaggtggggaaggaggaagggaggatggtgccggtggagtcgtggaaggagggggaggttaggaagtcagtggactgtgacgaggagggtggtggaggaggaggaggaggtgttgtcattgccattgccggtgtagttcacgagtttggacgttggcgatccctagacttgatccgcatagtgcacttgaacgggtacgtggaagaaatcacgcgtccaatcacggctggggaggttctgaaggcaaatccaaaccatgtcttgagcaaacctagctcccaaggcgtggttcgccggattctgatcctcgcaccggagaccgagctcaagagaggaggcatatacttcttgatcccggcggcatcgttaccggcggagaaaaagaaaagacacatgaaacatgtgaaacacgtgagtggtaaccacggtggtgatgatagtagtaataagaatgccgttatcaagaaggtgtcttccaagaagagcaaccatgatttgtcatcatcacaacaacgtgataatgggggctttgtagtttctaaggagaagaaatgctcagggcgggatcgccggagtggtcgcggcggattgtggcagcctcggttggagagcatctcagaagactag

SEQ ID NO: 72197 - DNA, 1845 bp, Glycine max
  Peptide Sequence Number=SeqID_163882
atggaacaaccaccggacaccaccaccaatctcttcgaccacctctcgaaggagctcctctacaccatcctggaccacctcaacgacgatcctttcgccagaaagtccctctcccaatcctgtaagtccttccacgcgctcgaagccacgcaccgcaccagcctcaagccgcgtcgcctcgagttcctcctcccgaaaaccctccaccgctaccgttccatctcgcacctcgacctcacgctctgtccctgcgtcgacgacgccactctcaaatcactctccctcgcttggcactcctcccttcgatccattgacctctccaagtcgaggctgttctcgcacgtggggctgtcggctctggccgtgaactgcacgtgcctcgttgagattgacttgtctaataggcctgacctcactgacttggccgccaaggcaatcgcggaggctgtgaacttggagaggctgtgcttggggaggtgtaagggaatcacggacttggggattgggtgtgtggctgttaggtgtagtaggttgaggcacgttgggttgaggtggtgcattcgggtaactgattttggggtgggattgattgctatcaaatgcaaggagattcggagtttggatctttcttatttgccgatcacagaaaaatgtcttcatcatatccttcaattagaacatctagaagatttggttcttgaacactgccttggcattgaggatcatggccttgcaaccctccaagcaagctgcaagtcaatgaagatgcttaacttgtcaaaatgtcagaacattggtcatattggcatagcttctcttacaagtggtgctcacaatttagaaaagcttatcttatcctccagcctgagtgttactactgatctagcaaaatgtctgcaaagttttcctagattgcgatcagttaaacttgatagctgtctgggtacaaagtcaggattaaaagccatcggtaatttgggcgcctcactcaaagaactgaacttaagtaaatgtgttggagtcactgatgagaatctccccttccttgtgcaaacacacaaagatctagagaagttagacataacatgctgtcacacgataacacatgcatccatatccagcctaacaaattcatgtttaaggattacttcccttagaatggagtcatgtagcttagtcagcagagaagggcttcagtcaatctcaagatgtaccaaactttcttgtctgaagttgggcatatgtttgatgataactgatgatggacttaagcatattgcaagcagttgttcaaagctcaaacatcttgatctctataggagctcaagaataactgatgagggaattgttgcagctgcccttggctgtccttcacttgaggttgttaacattgcttataacaacaacatcacagatacttcattagagtctttttcaaaatgccagaaactagaactcttgaaatccgagggtgccctcgtatttcaccaaagggtctctcaaatattgcttccaagtataaagctgtcatattgctcagtaacagatgtggggctcattgcacttgctagcataagctgcttgcagcatgtatccatttttcatgtggagggtttaacttcaaatggcctagcagctttccttttggcttgtcaaaatttgactaaagtgaagttacatgcatgctttgagtcattgatacctcaacaaattctaaattacatggaagctcgtggctgcacgcttgtgtggagggataaaacttttgaagcttccgggtatgtacttttggacatttcagacctttattttaagctagtcatgcaggaactgaatcatctgtga

SEQ ID NO: 72198 - DNA, 825 bp, Glycine max
  Peptide Sequence Number=SeqID_163883
atggagcataccagatatcatacacaactatggccaacccatgccactctcaaacctcgttgtttcactaccaatccacccatccaaaactcacttcgtccatcgcttgatgccaatcatgatccattctggcttccaatgagtgtgacacctttcttgcattccattcttgatccaattttgacaaatccatggaaccaattttctaattggttcaaaaatggtgatcctacaccatttgaaacagcacatgggatgatgttttgggattatgccggcgctgattcgaaacttaataacttgttcaatgatgccatggctagtgatgctcgattagtcactagtttggtgattgagaaatgtaaaggggtgttcatgggattggggtcattggttgatgttgggggaggcacagggaccatggcaaaagccattgctaaatcattccctcagttggattgcattgtgtttgatctaccacatgttgtttctggcttgcaaggaagtgagaaccttaaatttgttggaggggacatgtttgaggcaattcctccagctgatgccattttgttgaagaaatgcaaagaggcaataacgaggaaaggcaaagaagggaaggtgatcatcatagacatggtggtggagaatgagaagagagatgatgaacctattggaacacagctcttctttgatatgctgatgatggtgttggttactggaaaagagagaagcaagaaagagtgggttaagttgaattcctctgccgattataacaactacaagataacgccagtcttgggcttaaggtctcttattgagatatag

SEQ ID NO: 72199 - DNA, 1521 bp, Glycine max
  Peptide Sequence Number=SeqID_163884
atggctcaagtccgtaatgtcttcccttttggaattggcgtgggagaaaaacatagtgctttgttgtggtggggaaaaggctgggaagtttggaccaaaaagggttggcgcaagaaacatggagaagagtgttttgggagcactatgaaaaatggccacccggacaaaattgggtatctacaacaaggaatgctaagttccttgaagaacttgagcttgaagaatgataggttactagaaacacaattggactcgattatgtttagggacacaaagttacatgcaaatatgccacattttaagaaaggatatgggtgggcaagcggagctggaagaacagtggggaatggtgtaggaggttctcatcttaagcaagttcctagtgttctatgttttaaatatgcagaggcgagaaggaacaagaacaacttgcatgagaaagcaagagatgcttgggtggttgagattgtggaagaagggatggagtggctataccaaagcttagtcagaagtttgaaggatgttgtaatatttgataagcttcaagatgttttctttatggagaaaaatagagagttgaaacttaggtatttgggtgacaaattagtgttaatctttgggatgggtgaaaaaacttcacaagaaaggatagaaaagggagatgaaggattctttgaggagttgggggagcttggcatggtggtgaaaatggataaggatactgagaagtatggtaagttggagtatgtgcgtgttctagtgaaaagtagtgctcataagatcctggatgtgtacaagagagtccaaattagtgcgttggttcaccaagagagagttatggaggaaacatcttcaatggtgttgcaatgtaagtgttggttatggaacaagggagcttcctcgaatggtgattccatgagtaaaagtaatattagagtggaggttatgtcatcaaatttggagtgctctgtcattgacgagggggatggtttcatcattaacccaatgtggcaacctcataaaggcagccaccagcgaggagaaccaaatgtggacatggtcgaagggccattacaagcaatggtgatggagaggccattagaaatgatggtggagaaccagatgtggtcatggtctacgaagtcaacagaagtgaattcagtacacacatctacgacaactagagttggagatggatcggaaccaaagtctaatgaggggaatggtctagttgagaaaaagtgcacaaaaggaactaatgaggttgcatccttggacgagacccacgacaacaacatgtcaagaggccttgttgatgttagtcaagcttcttctagtgttcttgaaaccccaagagcgagacaaaattatttatccaatgaaatcacaagggttgtaaaagataggagggcacttcaggagggtggggatttcaaatggattgagaatccttcagtgaattcagttggaggacttgtgtgcatctggaatggggatgtgtttgttttgagaagatcatag

SEQ ID NO: 72200 - DNA, 2994 bp, Glycine max
  Peptide Sequence Number=SeqID_163885
atgaacccttccacactcaccccttcccacacccaccgtcctctcctcctaccctctcccttccacaccagacggcgtcgttttaaagtctccctccctcgctgttcctcctcctccgccgcctcctccccccctcctccgccacctccgccgccgcagcgaccgcccaaggacctcaagggaatcgatgtcctcgtcgacaagctctcgccgccggccaggctcgccacctccgccgtcatcgtcgccggcgccgcggcggctggatacggcctcggctcccgcttcggcggaagccgctacgctgcgctcggtggagctgtcgccctcggcgcggccggcggtgctgcggcgtacgctctgaacgcggctgctccgcaagtcgccgccgtgaatttgcacaactacgtcgccgcgttcgacgacccttcgaagctgaagaaggaagagattgaggccattgcgtccaagtatggtgtgagcaagcaagatgaggcattcaaaactgagatttgtcatatatattccgagtttgtatcttctgtgcttcctcctggtggtgaggaacttaaaggtgatgaggttgataggattgtcagcttcaaaaattctttgggaattgatgacccggatgctgctgctatgcacatggagattgggaggaaatttttcaggcaaaggttggaagttggggatcgtgatgctgatgttgagcaacgtcgggcatttcaaaagttgatatatgtgtcaaatcttgtatttggagatgcatcgtctttccttctaccttggaagcgtgtattcaaggtcaccgattcccagattgaagtagctgtacgtgacaatgcgcagcgattgtttgcttccaagctgaaatcagttggcagagatattgatgcagaaaaacttgttgcactaagaaaagaacaacaattatgtcgcctttctgatgagcttgctgagaacttgtttagagatcacacaaggaaattggttgaggaaaatatttcagaggcaaatagaatacttaaatctcgcaccaaagcagttttcagtcctggagctacgcaggcaattgcagagctggataaggtattggcatttaataatttactcatctcatttaagaatcatccagatgtggatcgctttgctcgtggtgttggtccaatttctttagtgggtggagagtatgatggtgacagaaaaatagaggacttgaaactcctttacagggcatatgtttcagatgctttgtctggtgggcgcatggaagatgataagcttgctgcactaaatcagttacgaaatatattcggactgggtaaacgtgaagccgaggccatttcacttgatgttacgtcgaaggtatatcgcaaacgacttgcacaggctgctgcagatggtgagttagaaatggctgatagcaaagcagccttccttcaaaatctatgtgatgaacttcattttgatccacaaaaggccagtgaacttcatgaagaaatttatcggcaaaagcttcagagatgtgtagctgatggggagctcaatgaggaggatgttgctgctttgttgaggatgcgtgtaatgctctgcataccgcaacagattgttgaagcagctcattcagatatctgtggcagtttgtttgaaaaggttgtcaaggaggcaattgcatcaggggttgatggatatgatgctgaaatccagaaatcagtaagaaaagcagcacatggcctgcgacttactagggaggttgctatgtctattgcaagcaaggcggtaaggaagatttttattaattacataaaacgtgcacgggcagctggaaatcgtaccgagtctgcgaaagaactgaagaagatgatagccttcaacaccttagttgtaactaatttggtggaggacattaaaggggagtcaactgatatttcctctgaagaacctgtgaaagaggacattacacaaactgacgatgaagaatgggaatcacttcagacactcaagaaaataagaccaaataaagaacttacggaaaagttgggaaaacctggtcagacagaaattactctgaaagatgatcttcctgaaagggataggactgatctttacaagacatacttactttattgtctaactggtgaagtgacaagggttccatttggtgctcagatcactactaagaaggatgattctgagtatcttcttctaaatcagcttggtgggatcctgggattgagtagtcaagaaatagtggaagtgcacaggggtctagctgagcaggcttttaggcaacaggctgaggtaattttagccgatggacagttgacaaaggccagggtggagcagcttaataacctccagaaacaagtaggcttacctcaagaatatgctcagaaaataatcaagagtataaccactacaaaaatggcagctgccattgaaactgctgtaactcaagggaggctcaatatgaagcagataagggaacttaaggaagctgatgttgatttagacagtatggtatctgagaacttgagagagaccctcttcaaaaaaactgttgatgacattttctcatccggtactggagagtttgacactgaggaagtatatgaaaaaatcccgtcagatctcaacattaacaaagagaaggcacgaggtgttgttcatgagcttgcaaagggtagactatccaactctctgattcaggctgtctctctactaagacagagaaatcagcagggagtggtttcttcactcaatgacttgctggcatgtgacaaagcagtaccctcacagccagtttcatgggaagtgccagaggagctttctgatctatacaccatatacttgaagagtaatccaactcctgagaatttgtctcgtttgcaatatctgttgggtataaatgattccacagctgctgctcttagggagattggagatagattactcaatactactgcggaggaagagaagtttgtattctag

SEQ ID NO: 72201 - DNA, 549 bp, Glycine max
  Peptide Sequence Number=SeqID_163886
atggcacaattcactgtactggaaaagtttacagatatatttattggatggctgccaatgtatggattgatgaagctggtgctctttgtctacttgtggtatcccaaaactaaagggacaggatatgtttacgagactgtgttggggccttacgtatcaaggctgataagtcatgaacatgacattgacatgaaattattggagttgaaggctacaggatgggataatgtcatatattactggcaatactgcgccaaattttggcaaagtgcttttgtcaaggctcttcagcacttggcttctcaatcaagtggattttctgccaaccccaatacagagaataaggacgcgcaaggtcaaagtgtcccacaagcgcctccaaaccagacccaatcgtccttcatgaagcaaagcagcaccctaagcaaaagcaagaagtggcctccaagcccccccagtgaaaaccaaaactctcaaaccgaatatatggatgaagaagaggaagagccatgggaacccaaatccgtcacaatcaacggccaacactag

SEQ ID NO: 72202 - DNA, 669 bp, Glycine max
  Peptide Sequence Number=SeqID_163887
atgattaacaatgtggctggtgttatcttgtatcatattttgaacttaaatgtgagaattccaagtgaagggaatgcttctgatgtccatgatgatgttaaaactttttcaaagtgcttgaatgaagtggaaagagttatatgttatgatcctgagtcaaatggatctgagagtatcaatgtaacctatttaggtgctcattgggaaggtttcatgtctagtttcaatattaatagctcaaacagtgaaatttgttccaaaaggagtggaatctttgcttttgttttctgtgaggatcaaagcctattgttagcttcaatatttctcttgcttattctgactgaaagtaaagatcttgattgtctcctatcttcaatgagtgggctaagcgagaaggaggatgagatgttgcagactgatgatacatcaatatctaagtctgtggatgaaagtatcttcattagatttatgcctgagattttaaatgccctgctgaatgttttagccttccagcaacccctttctataatgatgctatggaatgcggggtggtgcttgcaaaagctactcaacttccatagagagggacttaatggtgataatcttctcttattcactttcagtatttttctaccatcttattgtcaagtctcagattatctaagctag

SEQ ID NO: 72203 - DNA, 754 bp, Glycine max
  Peptide Sequence Number=SeqID_163888
atggcacgcaaatcgaggcaggattttagcgtttcaaaggtcaggtttttctcactgtttgtggctgagtatgagtcacaattaaaagggaaaccaaagcagaaaaattcagaagctctccctctctctcacgcagccttcttcttatcttcttcctccaccattgtttcccaacaaagctccaacctttggccatcatttctgctccaaatcgcgaaaggagggcattttcggggtcgtgaagtgcgtgtctatgagtgggacttcgaaatttcagagttttctgcctttgctctgttttgcttggctgtgatagctgtgctgtttgaatgttgttttgcttggatgttgtggaagcttgggaggattgatggggacccggtgttgagagaaacgaggatatgggctacgtgggaggtgaaacttcctgcttttattgttgaccacagagtggtacctggagatatgtcgcgggggtcaggagaccttggggatgttaggcgagctcctggcagtcaacagataaaaggaacaaagaccacaaagcaaggaggcttgtggtggctggtcagctgtgaaactagattgatatgtgagatatggtctctggtaatcgattaccaagggcttgaaaacgaggtcaggaagctagggaagcctctggtaatcgattaccaaggggcctctggtaatcgattaccagcctgtgtaatcgattacacagaggaatgggtcactggtaatcgattaccag

SEQ ID NO: 72204 - DNA, 162 bp, Glycine max
  Peptide Sequence Number=SeqID_163889
atgtcacgccaaaatgagtttgttggttactcattcataggaaaaaatcccaaaaagtttggcattcccaccggatgtaccatggatgaactgaaggatttgatcaagcaagttgtgcctactgggattccccttatggtgttgattgagtctaactactga

SEQ ID NO: 72205 - DNA, 45 bp, Glycine max
  Peptide Sequence Number=SeqID_163890
atgggtaaaattctcaagaatcttgttgtgagtttagttttaaac

SEQ ID NO: 72206 - DNA, 240 bp, Glycine max
  Peptide Sequence Number=SeqID_163891
atgaaggcagaaagattttttggaagcaaaaggagaaggggagagatggaggaaggaaggaaaagccagagtgagaagagaagcttttgggctaatggtggttactctaattcctacaccttcatgtgctcgttagctgtcaaagctcaaaacccaaggttaaaggctaacatgattattggtcaattcgacttcttcatctattggaacacatggatgttgggtgataaaattggctaa

SEQ ID NO: 72207 - DNA, 117 bp, Glycine max
  Peptide Sequence Number=SeqID_163892
atggatactagcactcttactgtggtaaatttggctaaaagtgagaatgtgttgatgaaatatattgttgttagggttgcttataaatccatgtggcttttcatggagggcctttga

SEQ ID NO: 72208 - DNA, 87 bp, Glycine max
  Peptide Sequence Number=SeqID_163893
atggaggacatactgacccagctgaagaaggaaatggccgctcctcataaccggaagcttgtccaacctccagaagggactgtttga

SEQ ID NO: 72209 - DNA, 339 bp, Glycine max
  Peptide Sequence Number=SeqID_163894
atgagtggcagaaatggaagcggtctaaaacttgacttgaatctgaacctaccgccaccaacgattgttaaccaaggacttgagtcttcggctcgatcagcaatagtgtcactaacatcatcatcatactcatgtttgtccactgagctcaaccaagatgacaacaacaacaacaacaacaatcacggatactccaacatctctgaagccatttccattgtgctagtagggtgccctcattgccttatgtatgtgatgatcaatgagggtgacctcaagtgccccaaatgcaaaagcagcactttgattcattttcttaatgaaaacaatatcccataa

SEQ ID NO: 72210 - DNA, 315 bp, Glycine max
  Peptide Sequence Number=SeqID_163895
atggatagggtagcttgcaaaggaattgttgatggttcctttacgatgaagtctgtgtatgttaagcttgtgcgggccaaaggcctcaagcatatttgggttgattctgactctaaggaggccttagatctgattgaagaccttagccatgatttgaaagctaggaggcaaggagagactttagtgatccaagtagctcttgcattggatcatgctgttgccaagcatctgctagtcacaacagaaaaatcagtcattttggatgattcagacaaccatgctctagaatataaggagaagaaagtgttgctctag

SEQ ID NO: 72211 - DNA, 533 bp, Glycine max
  Peptide Sequence Number=SeqID_163896
atggggcgtgttcgcacgaagacggtgaagaaatcctcgcggcaagtgatagagaggtactactcccgcatgacgctggacttccacacgaacaagaaggttctggaagaggtggccatcattccctccaagaggctccgcaacaagatcgcggggttctccacccatctcatgaagcggatccagaagggtcccgtgcgtggaatctccctgaagctgcaggaggaggaacgcgagcgtcgcatggacttcgtccccgatgtctccgccatcaggaccgaccagatcgaggtcgacaaggagacgctcgacatgctcgccgccctcgggatgtccgaggttcctggcatcgttcaggtggatcctgttgccgtccaggcgcccctcggcttcggccgtggcggccctggaaggaggatttgttgtgttgtgtccaaggatttaaatatcgctcgtggtttcggtttggtcacgttggttgatgttgaggacaaatgggattccaattacggtcgtggacagttaaccttgat

SEQ ID NO: 72212 - DNA, 288 bp, Glycine max
  Peptide Sequence Number=SeqID_163897
atgagggtgaaactgaataggtcactggaagatgaagagttttgtgatggacttgtccaagctttatatgatgcaaccagggtttttgaactggcaattaaagaacataaatcgttctcacgaatgtcctggttatcaacagcctggcttggggtagaccaaaatgcatgggtgaaggcactgtcttgtcaggctgctgtgtactccttattgcaagctgcaagtgaaatttcatctcaaagtgatggtagagaccgaaatgtcaatgtatttgttcaaaagaggtag

SEQ ID NO: 72213 - DNA, 1023 bp, Glycine max
  Peptide Sequence Number=SeqID_163898
gcaacgacaagagacggtgttgttgaggatcctcttacggctgtagaggaatttaacgaagagcagcaacaaccacctattgaagaaggtgttactgatgttgagggttttctaggcggacccaatgacatatcaattttgagagattttaaaaatcatgaacttcctgagcttaagctatcttcccatggaaggaagatgactaagttcggcaggcttgctctagagattgaaggccttgtgactgccagcggactaaaggtgactatcaccttggatgacatggcgtcgttgctgtatttgtcgatcataggggtgttccatagcttcgagcagcttcatgtcgatgatgctgtcgatatgttggtggaattattggaggtcagcactgcagaggcaagagctgagacaattcaatgtcatggctcttatgttcgattatcctggctgcaagacgtgtatcagacgaaaatcgacgcatgtcactggatcgtagcagtgcgagcatatttgttgcatatgcttggatgcactctctttgctaacaagagtaccacacacgtgcacgtggtattcttgaatgcactgcgtgacttgatgcagagtgggacttacgcttggggcgctgctgcacttgtgcatatgtatgataatttaaatgagtgttggatctatgagcttttcccgtctgttggttccgccatagctgccgaggattatgacgagcggatatcgggtgcatgtcgatggacctctggcaaggcattacctgtgtcgatgtatcataggcatttgaacaaactggcccttgatgttgaccccttgacagtcattcatgaactggagagggttgtacgacagtttgggtacattcaaaccatttcaccatattctgctgcggcttcggcttctgttgaagaaatagatgctagatggatgtaccaggggatcctcctagaatttcgtcgattcagcaatatgacacatttgttgaacctgatgtgccttagcaaccggtggtga

SEQ ID NO: 72214 - DNA, 573 bp, Glycine max
  Peptide Sequence Number=SeqID_163899
atgtcaaccaccattgatgtcccagaatcaagcaatgttgctaaagaaaaagtagttttagctgcaccctcaaggtctggagggtggaagaaaggggtagcaataatggactttattctaaggttaggtgccatagcagctgctcttggtgctgctgccacaatgggaaccagtgatcaaacactccctttctttactcagttctttcagtttgaagcaagttatgatagcttcactacttttcagttttttgttattacaatggcacttgtggctggctatcttgtgctgtcactacctttctctatagtagccatcatacgcccccatgcagttggaccaaggcttttcctcatcatcttagacacagtgtttctgactttggccactgctagtggtgcttcagctgctgccatcgtttacttggcacacaacgggaaccaagactcgaactggcttgccatatgcaaccaatttggagatttttgcgcgcaaaccagtggagcagtggtgtcatcggtctttggagaaatgcttctagatggtgctgacctggctcttgatgcttactag

SEQ ID NO: 72215 - DNA, 804 bp, Glycine max
  Peptide Sequence Number=SeqID_163900
atggatgttaagacaactttcttgaatggtgatttactggaagagatatatatgactcaacctgagggacatggcaagaaaacccgtacccgtggatacccgctcgaatccggcccgactttgacgggtaatacccgagttgaccgggtatgggttcggattcgggtttttcccgatgtccaagggtcgggtacagcaaaaaaaagcacgacccaaggtccactgaaaagacactccgttgggccaaaaagcgaacccgatgaagaaggcatgactatgtatgttatgcaaaaccctaaacacactaagactctgacaatcacaaagaagatagatagaaaagaaaatcttgagaagctgtgccatctctccaaagggtcctttgccattgaaatatctccaaaaccttggcttaattgctttcaattttgtgagctctgtttcaagttggaagaagaaaacgagtccggctgcagcgtcggagtcagaggcagaggcagaggcgtttgcgtcggctctggcgagcaagaaggatgcgactttgttggagttcactcccccaagtgcaggctctgcaattccttgctcaaatttgtcttcaaagtcgaaaccagaaactctaattggctcaacattgttatggctgatgctgagaaccccaattggctacccgaggataatggccatttagcaacacagaagaaatatagacagaaaaaagatggacaaaaagcaactaggaaaaaaaaacataacctaatgaagtttgggaaaaagccaactcttcccgattacaccaattaa

SEQ ID NO: 72216 - DNA, 960 bp, Glycine max
  Peptide Sequence Number=SeqID_163901
atgaccactttttctttcttctctcattttctttcctccactattcctccttctccctcaccctcctccaagaactctattttctatgccctcttcaaaggaaacaccaagcaattcactttttccaaagccacgaacctcttgcagttgcagccacgcataactgttttctcttctttaaaggatgcaggctccagtgacaacacaccaagcaacttttgcattattgaggggccagagacgattgaggattttgtgcagatgcagctgcaggaaattcaagacaacataaagagcaggcgcaataagatctttcttctcatggaagaggtaaggagattacgtgtgcagcagcgcacaagaaggggtcaaaaagttgtcaatgaagagggagaggagaaaccagatgagatgccggatattccgtcatcaattccttttctttcgcatgtgacgcccaagactttgaagaagctctatctgactagcatgtcattcatatctgcaataattgtatttggtgggcttattgcgccgacgctggagctaaaattaggtttgggtggtacctcatatgaagatttcataagaagcatgcatttgcctttgcaactaagtcaggtcgacccaattgtggcatccttttcaggtggggctgttggtgtgatttcagtactgatgctaattgaggctaataatgttgagcaacaagagaaaaaaaggtgcaagtattgtcatggaactgggtacttggcctgtgctcggtgttctgcaagtggcgtgtgcttgaacattgatcctatttcagtatgtagtgcttctgccagacctctgcatgctcctacaaccagaaggtgtccaaattgctctggtgcaggaaaggttatgtgtccatcttgcctttgcactgggatgatgatggcaagtgaacatgacctgcgtattgatccatttgactaa

SEQ ID NO: 72217 - DNA, 1362 bp, Glycine max
  Peptide Sequence Number=SeqID_163902
atggcgtggacggaagatagtgatgggaataatgggagggaaaagttggttggggaaaatgggtttttgaaagtgtctgagccttcttctgatggttctgttggggatgggggttcggtgagtaagagatgtgaagggaaggacgatgtttcgtatgccaacatcctgcgttcaaggaacaagtttgtggatgctcttgcgctgtatgagcgcgtgctggagagtgatggcgggaatgttgaggctcttattgggaaagggatatgtttgcagatgcagaatatgggtaggcttgcttttgagagttttgccgaggctatcaggttggaccctcagaatgcttgtgctctcacacattgcggtattctgtacaaagacgaaggtcgcctcgtggaggcagccgagtcatatcaaaaggctttacaagtggatccttcttacaaagcagctgctgagtgcctagccattgttttaacggatattggtaccaacataaagcttgcaggaaacactcaggaaggaattcaaaaatattttgaagctctcaaaatagatccacactatgctccagcatattataaccttggtgtggtctattctgaaatgatgcaatatgacatggccctcactttctatgaaaaggctgcatctgagaggcctatgtatgctgaagcatactgtaatatgggtgtaatatataaaaatcgtggtgatttggaagcagctattacttgttatgagaggtgtttagctgtttcacctaactttgagattgcaaagaataatatggctatagctttgacagatttgggaacaaaggttaaattgcataagttgacaacttcaaatcaccgtgtcttacttatggagatcattgttttgaaagctttgtattataattggcattatgctgatgctatgtataatcttggggttgcttatggtgagatgcttaagtttgatatggctattgtgttctatgaacttgccttccacttcaatccgcattgtgcggaagcttgtaacaatctaggtgttatatataaagatcgtgacaaccttgacaaagcagtggaatgttaccagcttgctttgggaatcaaacctaacttttcacagtcattaaacaaccttggcgttgtatacactgtccagggtaaaatggatgctgcggcgagtatgattgagaaagctataatcgcaaatccaacatatgcagaagcatacaataacctaggagttctttacagggatgctggtgatatcgctctagcaattaatgcttatgagcaatgtcttaagattgatcctgattctcgaaatgctggccagctgaaagttttcattgctggtgctatgtaa

SEQ ID NO: 72218 - DNA, 588 bp, Glycine max
  Peptide Sequence Number=SeqID_163903
atgccattttgtggttgctccataggagttgttgatggttgcatctatgcattagaaggattttcaagatcttcaacaattaaatatgtttggcagtatgatcccattaaaaactcttgggctgaggctagtccaatgtcagttggcagagcctattgcaagacaggggttactaggggtcgtggtggactaatccctctgcaatctgcagaagtatatgaccctcatacatgcatgtggtccctgttacctagcatgcattttgcaagagctcaagtgttgccaactgttgttttggctgacttactgaagcctattgctggcttcatacaaaggaaggtgatacttggaaagttgcagcaggagatgttcctattcatgatttcaccgaattggaatctacttatctcttcactagattacttgaaaaacttcatgatgacatgcaaaatgaacatgttgagtcagctttctctcaatgaatattgtcatcaccagataactcattcagtgaagatgctgaatcttctgcagaaacacagggagaattttggaaggttgttgcttctcccccagcctggtttttaa

SEQ ID NO: 72219 - DNA, 1140 bp, Glycine max
  Peptide Sequence Number=SeqID_163904
atggacacaattaaaggagaactaaaacaagcaataaagttggagttattacaaattgcatcacaacagtcacccccacttcaagcacatgatatacaactattagcagcaagggtaagcaccaaggggagttgtgcagcaccggagacaaatgcaataggtaaaacaacctctgatatgcatggtgatagcatcgagctgcatgtaattgccgataagtctaccaaattattggcattgggcaaacaattcgacaattttggcaccatccacaatgtggcttatgctgatgatgtggttcaggatccagagaagctcgtgagctcacctttgaaggctgctgaggaggacaacgcattggtgccagttgatccatttggagagttggtgaagaacttgtttgaaatttaccaaaagtcgattgagttgccatgggatggcactaaatttgggatccataatgtcaaagatggctttttcgtcacacacgctgatgtcactgagataattttaggtgacaagtgtttgaacatctccattctacaattgtggcttatgtttatgcatgattgggctgcaaacatagattatggagcactatatggtttcgctgaacctcaatgtatccacaatgcaaagactagacgtgaagattgtgaaaattacattggaagatggataaaggaatcacaaaaacaactttacatagcatcatatttaaatgaggcccattggcaacttcttgttctgtgcccagctgagaatacagtggtttggttttgttctttgcaaaagaagcctgatgctgccatcaaggctgtagtcaacagtgcaatgaaactagtaaccaaaagtgcagagggaaagccaccccaacctgtgcctcagtggattaaagcaaagagtcatgttcaaacgggaaattacgagtgtggatactatgtaatgcactggatatggtgcatcgtaagtgccggattgaaggatgaatggattcgcgtcattcgttcatcctgcttgcatatgtttatggctcaacgtgtttgttgtccacacctgtcatttggtgtcctggtttcagcatctggaatgcatttgtgtcctggtttcaacagctggaatgcgtttcagaacctgtga

SEQ ID NO: 72220 - DNA, 255 bp, Glycine max
  Peptide Sequence Number=SeqID_163905
atggatgaaggtggtgacgttcgcaacaacattcacagccacggcgtttgcagtagtgacatttgcgacggtggcaaggtagggtgtgaggaccggaggaagtggaagaaagtgacaaatgtgttaagagaactagaggacgggtgcaacattaggattgggaagttagggcaaatgatggatgtcatagatgtggggaacacactgattggacctatgaactgcgagtatttagctgtagttcacaatttctga

SEQ ID NO: 72221 - DNA, 798 bp, Glycine max
  Peptide Sequence Number=SeqID_163906
atggcagaatcatcgaagaaacaaaatggatcctcctctaccaccaccgttgcaggccaccgccaccacagaccatccagtgacccaccaacaccaattcctcttcctctttcatctcccaagctagcagttggtgtctcgctaaacgaggcttgtgcgcttagcgagaatcacacgctaagcgaggcactcagcccgcttaatgagttgggagaatctagagaagaatttgagaagcatctgcgcgttcagcgcgtcatcagctcgctcagtgagacatttgtctcttcccacgttaagtatctctgttgggaaattctggcgaaacttgatgctaagttcaatgagacatctgagaatgagattgacttggcccatcttgttcggtatcgaatgcataagacattacgggccaatgcacctctcccatatccccatcttgttaccttatttctccagcatttcaaagttcccttagatgatgaaccttttgtcaaagttaaacgttcttttactattggtgttggtgttgttacatattttggttatcgaaaagacatggatggtcagtgggtgcacaagcaagacctgccacctcccattcccgatgagcgtacaccgtctccaccaccgcaacgggatgcctcttcttctcacctgactgaagttctcaccgagctctgcgatcttcaagagtttgttggtgatcgctttgatgcgatggattcttgtatcatatggcttgaagatgatattagtttcatccggcgttgctttgatccaccgacagattcttag

SEQ ID NO: 72222 - DNA, 576 bp, Glycine max
  Peptide Sequence Number=SeqID_163907
atgactcacacgaagaaaattggtcaaataacgtttgaggcaacaaaggaaattgcaaacaagattgattccttaaaggagcaggcctcacaggggagttttgtcacccatggacgtcatgatatattgactgttgccattggacgaccagaacaccctagtcgtatctgtgctgctggagccggtgtcacgatcaaacaatactttggactaactccaaagatctcccgcacgtcttcgtccaaggctcccgaagacttagagcagctggcacaaaagatcagggaccaactggaggagtcgatcacaaaaaaaccaaagatgcaatcacaaggactcgcactgcctcctgagcctgaggttggtccttctgctgtttgtgccggcacaaaggaaagttgtgttgatccttcgaggcatgacccaggcacgggtgagtcagagaaatatgggttgtatgtcgatgaaaatcctgcccacctggttgcccttggaagactttatgaggggtcgaccaccgtttacaacatccctttgggcaatgatcaagtcgaggtcaatgttgaggaagtttga

SEQ ID NO: 72223 - DNA, 537 bp, Glycine max
  Peptide Sequence Number=SeqID_163908
ggtgaagttgcggagacattacagtatatggtgtcaccacaagggaggaacacatggatagttgatgatctcgtgtcttatgtggagaagataacgattttatccgaagagaaagagagaatcgctgagcctgtggcacatggtccagcaacagagcgtcgatttacaccacaagagtttcacatgcttcagtcaagtgttgaaattcggggttttggcagacgatgggaggctgttgaagcggaagaattttcccaacaaatggagaagcatggccatggaatgtattacacgccaccaacattttctcaatatccttcacagatgtatcaatatccttttgaaggtcatcacactgatatgtctgcaagcgaacattcgctcggtgctccacaatggaatgtacccggagcaatacctgatatgggtgacttagtaggtattgatttgcgtcatgaattttctgctgaggctgagcaagtagaagcggggagacatcgcggcagaagaaatcctgatcgtcaagcgcaaagatag

SEQ ID NO: 72224 - DNA, 549 bp, Glycine max
  Peptide Sequence Number=SeqID_163909
atgctcgaaagttttcaacaacaaaatcaaatgtcagttttggaattgtacgtaaaaaaggatgtggttggtggttctatgtttcattctgcaaattctcttacatcatgcggaaataatttatctaataatgaggcgcaaccgccaacaaatgtgagcaacttacatggtgatgaagatgatgatgatgatgattatcttatgtctaactcatacgttgaagagtctttagacaaagatgatagtgttgacggtatatctgatactgacgatgaagtcgccgacatgattcaaccagtaagaattgttcacccagcagaaggtgtacaaggaattgaaaatccattttggaatgatgctttgcattataacaatatcaactggagtcatcctgatgaggaagacatttgtggcatgatcagagaagatccatcaataaaagtttctttgattcaagagaggattaatagtgaatttgcctacaaggtgtcgtacaaaaaagcttggttggcgaagcaaaaagccattgcacttgaatatggcgattga

SEQ ID NO: 72225 - DNA, 1122 bp, Glycine max
  Peptide Sequence Number=SeqID_163910
atggcgtcactcctacaccttcccatcactagcgcgctgcatacgttcgagccgcttgttacttcagacgccattagtctactgacggagcttcttgaggtcagtcatgaagaggctacatttgagacccgacaggctggtgggcatcatgtccggttggggtggcttcgagacttttatcagagccagtgcaggaccagacgatgggttgtagcagcccgcacgtatctgctccacttggtgggttgtactattttcgccaataagagttcaacccatgtacatgtcgtgcacttggaggctttcagggacctggcccagacagggggattcacctggggggcggctgcattagtccacatgtacaaccatctgaatgacgcttcgcaggcctctacacggcagctgggcggttatattacacttctccagggctggatatacgagcactttcctatagtgcatacatccgtcattcattatgcttatgatgaggggagcccacgggcctgcaggtggcttacgggtaaggctcatattacggggatcaagggagccccatatcggagacgtttggatgccttgagtgtgactgacatgtgctggatgccctatggtgagcaccggcgagttagggcctgtgacttgatatcgtcgtacaccgggcagctcagatggggtcagattgtggtgtggcggcagactacatggagtggttttttcggatattgcacccattcgtcacgcggaccgaggagactgctgcgccgagacatccgcctccccttcatcataaggagttcgtcaagccaccccatccccgaggtttcagtcgcgaccgatctccctacgcattcagtggttgactgcgaaggatgtcaggtgatggctgaggatttaggagcgattgctgaggatttggagcgggtcatcaacctcaggatggtcactgaaggcactgacttatatgacatcatgactcgttgtctgaggagagctagaggtgacgccgcagatggaagttgtcgcaacctacccttcggcgggagggcgacgcgtgactcgctggatgcgtgttccacgaaaggaatacgcgcggagtcgccaccaacgtttatttga

SEQ ID NO: 72226 - DNA, 504 bp, Glycine max
  Peptide Sequence Number=SeqID_163911
atgtcgaagatctttatcagagaaggacgacaacagatgtctcctatgcacaagcgatcaatcgaaaggtataactctatatgtatcaagtatgtgggaggcaaccaagtttgtctgactggtcaggaatctgaggatactgaagccctaatctttggtggagggttctttgttaaacctaaacctttacaacagaaggcaatgttaggaagctttggatcaatgggtggggatgatgaggagtcgatttctgcatttataggaaatggtgatgaagacgactggtcactatgcgaggatgagtttgagatgacaaggaggtggtatcgaagacttgggatagtatcccgaagacgaagcacagagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 72227 - DNA, 630 bp, Glycine max
  Peptide Sequence Number=SeqID_163912
atgcttgtagcagagaaatgcaactctctattcaacaacaacaacaatactagtagtaatcagccgcagcttccgttcaagctctctaccacggcttctctggatctctccaaccctctaaccaaactcaccattttcaacaacagcctcagcctcatgaacggagttttggagcttcggctcaggctaacggtggcggttcgggtcagccgaagcagagggttagagccaggaggggacaagccacggacccacacagcatcgccgaaagggtacgtttctctttctcagttcttacggagggagagaatcgcagagcgaatgaaggccctgcaagaactcgttacgaatgccaacaagtgtagtacagcaataccctcgtacatcattcccattatatctttccgtaatgtaaaactggaaaccgctaagactgacaaggcctccatgctggatgagatcattgattatgtgaggttcctacagctccaagtcaagggaaccccttcatcaaacttagcaaatcacgtggattttgctaaagtgcttcaaccaatccaatcacaaatttcggagtttcccatccctctatctcatttcttttggttaagaggaagcaaaacaatctaa

SEQ ID NO: 72228 - DNA, 645 bp, Glycine max
  Peptide Sequence Number=SeqID_163913
atgttgtatttcaacggaagagtatatgaagacaatgatggtgtaatatttgaaggcagtaaaaatgccattcagattaaacgcggaattagtttcaatggtttgaaaaaaaaattggagataagatttttagtttcaggaaaatatgttgcgttgcaaatttgtgatgacgaagatgttgaaactatgatcgaaagttttcaacaacaacagcaaatgtcagttctagaattgtacgtagaaaaagatgttgctggtggttcgatgtttcatgctgcaaattctgttacgtcatgtggacgtaatgtatctcatcatgagtcggaactgccaagaaatataagcaatttacatgatgatgaagatgatgatgatgatgattatcttgcatctaactcatacgttgaagagtctttcgatgaagatgatagtgatgatggaatatctgatacagacgatgaagtcactgacatcgttgaaccagtttcaattgttcacccaaccgaaggcatgatcagagaagatccatcaataaaaatttctttgattcaagaaaggataaatagtgaattttcctataaggtttcatacagaaaagcatggatggccaaacaaaaggcgattgcaattgaatatggcgattag

SEQ ID NO: 72229 - DNA, 309 bp, Glycine max
  Peptide Sequence Number=SeqID_163914
atgcttacagatcacttgatccgtaaagctcccagcgatttccgacagcgttttccgccatcgccgacaacattggagcaaaaaaaagtcaagttcacgggcctgacctcgacggtggacgcaagaagaagtagcagcaaaaagaagctggaagaagaagacgcaggaagcttcctcgcaccaccaccgcacctcctcaacgaagaagaagaagagccacaaagaagacgtaggaagaagaaggcgcaggaagaagaagcaggaagaagaagccggaagaagaagaaatgtgatgaagcaggaagatga

SEQ ID NO: 72230 - DNA, 180 bp, Glycine max
  Peptide Sequence Number=SeqID_163915
atgggacacgagtgtttgatggataagaggctttcagctgaagaaatggcggttggtggggtgccacattgggatctccttgtaaagcaagctcatagagagagagaatcaagggattgtgtgtggagttttgacaaatttctttgcagccttggaatggatgacgtgggtaccgcttag

SEQ ID NO: 72231 - DNA, 867 bp, Glycine max
  Peptide Sequence Number=SeqID_163916
gtctttgagattgatgatgtgaaagcatggaaatctgttctgatatctgtcacttcttatgcactgggtctcttcatgatttccaaagccccctggtatcttcttcctctggcttgggtatggacagggactgcaataactgggttctttgttataggacatgattgtgctcacagatcattttcgtctaacaaattggtagaagacattgttggaactctggcctttatgcctctgatttatccatatgagccttggcgatttaagcatgacaggcatcatgcaaaaacaaacatgttacgtgaagatactgcttggcaccctgtttggaaggacgagtttgaatctactccacttttgaggaaagcaataatatacggatatggtccatttcgatgttggatgtctatagctcactggttgatgtggcactttgatttgaagaagttcagaccaagtgaagtaccaaggatgagtacgtttaccatggtacatcatactgcaccgcatataccattcaaatactcagaagagtggaatgctgcgcaagcacagcttaatggaactgttcattgtgattatcctaaatggatcgagatcctatgtcacgatattaatgtccatattccacaccacatatccccgaggataccaagctataatttaagagcagcccataagtctctccaagaaaactggggacagtatctgaatgaggctagttggaattggagattgatgaagacaatcatgacagtgtgtcatgtgtacgacaaggagcaaaattatgttgccttcgacgaacttgcccctgaagattctcgtccaattacatttttgaaggaaaccatgcctgattatgcttaa

SEQ ID NO: 72232 - DNA, 525 bp, Glycine max
  Peptide Sequence Number=SeqID_163917
atgctctatagtggtggtgtcagtggaatggtggtgggatggaatagtgatagcaatggtggtgacgatgatgatagtagtgatgaaatgcaacagtggtggaacggtgatggtggtagtgacaataatagtggtggtgacaacgacaatggtgagaggtggaatagtgataacgatgacaatgaaaatgacaacaatagtgatagtggtggtggtggtgaatgcaataaaggcgaggtgcgatggcgagagaatgatagaggcaatagtggttgtgacgatgatagtggtagtggagacaacaataatgataggatgccaagggtggtggtttttactgcaggagaaacaaaaagatgcgatcacccagagaattatatggggttcggccctttcgcccacctatggctaatgacaagagatgatgacattcacagtgtggtccaaatccaatggagtttttttcctcttggtattttgcagccttacatggagactgtttctctaataatctttttgccatga

SEQ ID NO: 72233 - DNA, 153 bp, Glycine max
  Peptide Sequence Number=SeqID_163918
atggggttcgttcaattcaacgcctctgggttgaattggatggatgaacagagaagcagagcaaaggggaaggaaggatggaagggtgtgtgtgataggatcagagaacagaggttaagcaaagcgaaaatgatgagattgtgggaaaactag

SEQ ID NO: 72234 - DNA, 1416 bp, Glycine max
  Peptide Sequence Number=SeqID_163919
atgggtccagagttgcattttggtttgtgtatcaatgtacaagcatatgaacagtttagattatgcaatctggagacagttgaatctcctgaaaaggaaactattgaaagaggagcagtgcagccactccaaactcagacagaaaatcggcttcaggtgtctgtgtgttcaattccattgtctgatctatcaccaacttctgttacacaatctttatcaattgtttctagtccaaccgtacaaaaacagaaaatatctactccaaaggtcaataacacacatgtgccagaagtagataggaaaaatccttctggtcgcaaaacgttatctgctgtttctgttgcaaggacatcagcatctgacggatacaactggcggaagtatggtcagaagcaagtgaagagtcctacaggttctcgaagctattacaggtgtactcattcagactgttgtgctaagaagattgaatgctgtgatgattcaggtcatgtgatagagattgtttataaaagtgagcacagtcatgatcctccgcggaagactaattccattagggaaaataagtttctgtcttccagtgaacctattgtagaaaacagtgtaccggagcagcctgtcagagttctgaaggatgctgatccatccatttcttcaaaagaatctctacaagaagcaccctgcagcaatgataagaaacgacaaaatacatctaatatcagtggtaatgataaagttattttgaaagaggaacatgctataatacttaatgttctttcctttaatttgataatcagaatgaagaaaggtgacttaacagaaatggattctccagtaaaacctggaaaaaagcccaagttcgttgtacatgcagcaggggatgtggggatatctggtgatggttaccgatggcgcaagtatgggcagaaaatggtgaaaggaaatccacatcccagggaggatgagatttcttatcttctaaagcaaagatgtgtaggtggtggtgtcgtccttttgcttccttgctatgctgagaagagctctactttgtctgggcaaaatggcaagaacagatgcacttctgctggatgtcctgtcagaaagcacattgagaccgcagtagataactcagatgccgtcatcataacatacaagggtgtacatgaccatgacatgccagtccccaagaaacgacatgggccaccaagtgctcctcttgtggctgctgcagcacctgcctccatgaacagtttgcaggtgaagaaacctgactccccacaaaacaagaaaatttctactcaatggtcagtggacaccgaaggagaactgaccggggaagcgctagagcttggaggtgagaaagcaatggagtcagctcgaacacttctgagcataggttttgaaattaagccttgctaa

SEQ ID NO: 72235 - DNA, 402 bp, Glycine max
  Peptide Sequence Number=SeqID_163920
atggagcacattgttcaaatgaagggaagattgaagttaaatgttaccacaaccagtaatggggcactggagtctataatccagatattttcagtaccagaagcattaaaggataggaagctagaactcttaccaatcatggttagggaacaagagctagatgtcttgctgagagagtccataaaggcccctagacattccaatgacgacggtggaagtacacttggccaggggcttcaaactagcacctatcctggggaggttatcttttcaatagcactagctataagtggcctcatcctttttgcccttctgattggcaacatgcagtttgttcagaacatgctggagtttccatgggcttgtaattgttcgtgtcaaatagactggatacttgaatag

SEQ ID NO: 72236 - DNA, 204 bp, Glycine max
  Peptide Sequence Number=SeqID_163921
atggtggttcgtgctttgaattcaggtttagagtggggttgtgactggggttgttgtaattttggaggtggtggtgatgaccttgttggtgatgatgatgaagaagaagacggtcagacaataatcacacatgacatgcctgcatggtcgattaacaatcacttgtgtaaaggttatggcttaagtgttgtcgacaaaaagtaa

SEQ ID NO: 72237 - DNA, 1059 bp, Glycine max
  Peptide Sequence Number=SeqID_163922
atggctaacctttccattgtggttcaaggacaaggagaggctgaaagcttaagagaactctgttttgttgtagccaatgttaatgctaagcatagtggtggtattgggaaagagaatgagagttcccatgttggggcttttgatgtaagtaggcttcagaagcttaaaggaaaaaaggggaatgggaagaagaaagatgcccttgttgttgctgctgctgccatggaagagccgaagaaggttgataagcgatcacgtggaaaggccaatttggagaagtcagacttggaaccggctctgaaagctctgaaggacaggctcatgaccaagaatgtgacagcaatggaagaagcacttgttcctattttaacccctaggcgttctattgacatattgagggatgtgtatgctgccaaggagcaaaggaaaccgtatgttgttgtgtttgttggagttggaaaatctactaatctagctaaggttgcttactggcttctgcaacacaacattagtgtcatgatggctgcttgtgatacatttcgatcgggagctgttgagcagctgcggacccatgcacgtagacttcagattcctatatttgagaagggttatgaaaaagatcctgccattgtagcaaaagaagcaattcaggaagcttcgcgcaatggttcagatgtggttctagttgatacagctggctgtatgcaggataatgaaccattgatgagagcactgtcaaagctcgtctacctcaacaatcctaaccttatcttatttgttggagaagcactggttggtaatgatgcagttgatcagcttgcgaaattcaaccaggcttgttattcaacccagaaattagccgacctctcaacatctcccacacccagattgatagatgggatcttgctcaccaagtttgacactattgatgataaggtatctgcactttcaatggtttacgtatctggagctccagtaatgtttgtgggctgcggacagtcctatactgacctcaagaaactcaacgccaagtcgattgcgaagactctccttaaatga

SEQ ID NO: 72238 - DNA, 771 bp, Glycine max
  Peptide Sequence Number=SeqID_163923
atgaaaggggttgtccccatggaacctccttatgaggtgtaccaggatcagagggccaggttgagacaccagagtctcttgcaggactatgaagacctgcacaaggaaacagaagccatgagaaggaaattgcaggctacgaagcagaaaaagtttatgctggaagatgaagttagatttttgaggcaacgttacaattacttgctaaaacaccctattctaaagcctcaaccaaagcaacaagttgtaaagccacaaaagctcaaaatccaagctcccatcatctcaaagggaaagaattacaacaagaaggagcctaacctgcgaccccaccaccctgcatctcatttgaactcaaatggaaggatttccaatgtggctgatgtcccactgaaaaaaactggccacttgtttgatctaaacctgaatgctaggagttctagtaaaaaagatgcttccattaacatttctggtccaccagtgcttaacttgaatcacaaagaaaggattaacagcagcaaggaagccacgaagaagagtgtaactccatttttcgacttgaaccagatttcgagagaagaggaggaattgcagggaaacagtgagcccatgggaatcgaagaaccaaagagaagttcacaaagagttgcgactgacgagcagcatggcgatatcaagctctcggctgcttgtagaagtgttggggatggatctaatagggcagggaagaggaagatttcatggcaagaccaggtggcattgagggtttga

SEQ ID NO: 72239 - DNA, 558 bp, Glycine max
  Peptide Sequence Number=SeqID_163924
atgtgggcaaaggctaagccagatgttgatccttatggtgcaaaacgcaaagcagggaaacctcctacaattgatgacaatcatcattctggatttagtgtggagaagaaacctaagcgggagtggagttgtggattatgtcaaattactaccacaaatgagaaagggttgaataatcatcttgagggaaagaagcacaaggcaaaagcatcactgagaactaaaaagatagggttggatgcaagactagatggtcaaaaacttcaacgtggcataacctccacaaacataggcatactggaacctagaaaggaggatcaagttgtgcaaaacagtcaaggtttaggtggtctggataatgaaaatgaaatagctactagcaaagaaacaggtgaaacaaatgcattgacaaaaaggaagaagtttaaattttactgtgcattttgtaaagttcaaactgcctcagaaattatcatgcaaagccataaaaatggaaaaaggcatctggctatgatcaagaaatttagccaaaacaatgttgttgcaaatttttattga

SEQ ID NO: 72240 - DNA, 1014 bp, Glycine max
  Peptide Sequence Number=SeqID_163925
atgaaaactgaaacagagccaaatgaaaccgagtcagattggagcgagttgactcgcgagtgcctcatcaacatcctctctcgactcagcgtcgaggatcgatggcgcggcaccatgctcgtttgcaagtcatggttcagcgtcttcaaggaaccctctcttcacttcgtcttcaacctcgaccctcaattcgactcgcccaccgaatcaactcgctggtggacccccgagttcgaggccaagatcgataacatgcttcgatctgtcgtcgaatgggcccaatcctctctcacccatatacgcattcgccactgttctgatcgttctctcgccctcgtcgcccaaaggttccaactttctcccaaattccaatacccttttgtttttccttcgctaatcgatggtggccccaattgggtctcaaaactttggtcctttaattgcccaaaccttgaggtgttgtttatcagaagctgtcctcgtgttaccgatgattctatctctaggatagctttgagttgtccgaagcttagggaattggatatcagctattgttatgagataacccatgaatcgttggtgctgattggaagaaattgtcccaaccttaaggttctcaaaagaaatctcatgaattggcttgatccttcccaacaccgagggattgttcctgacgattatctaaatgcttgtccgcaagatggagacgatgaggctgctgcaattgctaattccatgcctggtctagagcagcttgagattaggttctccaagttaacagctaagggcctcaattccatatgtcagggatgtcccaaccttgagttcttggatttgtctgggtgtgctaacttgactagtcgagacattgcaaatgcatcttctagtttggtgcacttgaaagaaattaaaaagcctaatttctatatccccaggtctgtcttccacactgaaaggtatggtcattggagtttgtatgatgagagatttcaaacggatattttccaaatctga

SEQ ID NO: 72241 - DNA, 402 bp, Glycine max
  Peptide Sequence Number=SeqID_163926
atggaatgtggctctattgctgaatcaggtaataaagttgtcgctgttggaatcaactgtaccccaccaagatttatacatggtctaattgttttgcttaagagggtgactacaaaaccaattgttatatatccaaacagtggggaaacttacgatgctgacctaaaggagtgggtgcagactgaagtgcagaaattgctaaagcaattagctgatgagaggttttctgaggcttcaaatcatagttccaatgtcaatcttgttgataaatcaagaaaagtaaaggtcttgcggaggttaattaatgttcaaaaagccaagtcacgtgaatcaaaagaagaccccttggagttacgttatcctgtgacaaaagatactcttgtgactgagagcatggaatag

SEQ ID NO: 72242 - DNA, 2583 bp, Glycine max
  Peptide Sequence Number=SeqID_163927
atggccaaatttagttacaatatgtggcatgctgtgatcaaagcaggaaatggaaaattggatgaagccaaagaggatagaatggatgactggaagttgcaacaaggcaatttggggcatgaacctgatgaagatccagatgcagccatgttagatgaagcaaggcaaccgctgtcaaggaaggtaccaatagcatccagcaaagtgaatccatataggatggtgatcgtggcacgacttgttatccttgcattcttcctcagatatagacttatgaatcctgtacatgatgcactggggctgtggctaacttctattatatgtgaaatctggtttgctttttcatggatccttgatcagtttcccaagtggtttcccattgaccgagagacataccttgatcgtctttcaatcaggtatgagcgtgaaggtgaacccaacatgcttgctcctgtggatgtctttgttagtactgtggatcccatgaaggaacctcctttggttacagcaaacactgttctttcaatcttggccatggattacccagttgataagatatcctgttacatttctgatgatggagcttcaatgtgtacatttgaagccctgtcagaaactgcagagtttgctaggaagtgggtgccattctgcaagaaattttctatagaacctagagcaccagagatgtacttcagtgagaaagttgattacctcaaggacaaggtgcagcccacctttgttaaggatcgtcgagctatgaagagagaatatgaagagtttaaggttaggatcaatgcacttgtggcaaaagctcagaaggttcctcaaggaggatggattatgcaggatgggacaccatggcctggaaataatactaaggatcatcctggtatgattcaagtctttcttggtcacagtggaggtcatgatactgaaggaaacgagcttcctcgtcttgtttatgtttcccgagagaaaaggcctggattccaacaccacaagaaagctggtgctatgaatgctttgattcgggtttccgctgtgctcacaaatgctcctttcatgctgaacttggattgtgatcattatgtcaataacagcaaggctgctcgagaggccatgtgctttttaatggacccccaaactgggaagaaggtctgctatgtccaatttcctcaaagatttgatggcattgataggcatgatcgttatgctaatagaaacacggttttctttgatattaacatgaagggcctagatggtattcagggtcctgcatatgttggcacagggtgcgtatttaggaggcaagctttatatggctacaatcctcccaagggtcccaagcgtccaaaaatggtaagctgtgactgctgcccatgttttggaaagcgcaagaaggttaagtatgaagggaatgatgcaaatggagaggcagcaagcctcagaggaatggatgatgacaaagaagtgctgatgtcccagatgaattttgaaaagaaatttggacagtcatctatttttgtgacttcaaccttgatggaagagggtggtgtgcctccttccgcaagtccagcaagccaacttaaagaagccattcatgtaatcagctgtggatatgaagataaaactgaatggggaatagagctaggttggatttacgggtctattacagaggatattctaacaggttttaagatgcattgccgtggttggaggtccatttattgcatgccaaagagagcagcattcaagggtactgctcccatcaacttgtcagataggcttaaccaggtgcttcgttgggcactaggctccatagagatcttcttcagtcgtcattgccctttatggtatggttataaggaagggaagttgaagtggcttgagagatttgcctacgcaaacacaactgtctaccccttcacctccatacctctagttgcctactgtgttcttcctgctgtttgtttactcactgataaattcatcatgccgccgataagcacttttgctggtttgtacttcgttgctctattctcttcaatcattgcaactggtcttcttgagttgaaatggagtggagtgagcattgaggaatggtggagaaatgagcaattctgggtcattggtggtgtgtcagcacatctctttgctgtcatacaaggtcttctgaaggttttggctggaattgacaccaacttcactgttacatccaaggcagcagatgatgaagaatttggagaattatacacctttaagtggactactctcctgattcctccaaccaccatcttaataatcaacattgttggggttgttgctggaatctcagatgccataaacaacgggtaccaatcttggggacctctatttggaaaactattcttttcattttgggtgattgtccatctatatccattccttaaaggtttgatgggtcgccaaaaccgcacacccaccatagttgttatatggtcagttctattggcttccattttctccttgctttgggtaagaattgacccgtttgtattaaaaactaagggacctgataccaagctatgtggaatcaactgttga

SEQ ID NO: 72243 - DNA, 354 bp, Glycine max
  Peptide Sequence Number=SeqID_163928
atgggtgtagagggaaatggaggaggcgtcgggggagaaggagaagcctttgatgaggacgttgaagaggaagatgtcgggtttgggaacggagaagaagagggcacgtgcgtggcgcgtggcgccgacgtcgaagagcttctgggcgagcttagtgacggtggcgaggccgtgctggtaaccgttgcggatgagctgcgcgtgggtttcggcaaggtgagggaaggtgcacgctttgttgatgcggctaatgccccctcgaatcattgcatgcacctcaacaccttagttaggtattcacttcagagacttattgtttgttacctttggactttggtgttgaaaatgatatga

SEQ ID NO: 72244 - DNA, 3465 bp, Glycine max
  Peptide Sequence Number=SeqID_163929
atgaattcctgtgtgactggaagtttagtccatcagggccagttgcttgttcatattgctgagaatggacactcctttgagttggattgcaatgagaacacactagttgagtcagttatgcggtctattgaatctgttactgggattaatttcagtgatcagcttgttctttgtttggatatgaagcttgagtcgcagcggcagttgtctgcatacaagcttccatctgatgacagggaagtgttcatattcaataaaacaaggcttcagaacaactcgcctgttccaccgccggagcaagttgatattcccagtcatttggagcctccactgccagcctcctcccatgatcctcacccccttgatgatgcttcggatcctgctttgaaggctttaccttcttacgagcggcaattcaggtaccattatcatcagggtcatgtgatttatactggtaccatgatgaaatatgagcattgtgagaggcttttgagggaacagatggtccaagaaagagcggtggaggttgcaaggggtaatttggatcagtactatcgaatgattaaccaaaactatgtggacttcatgaaacgttatatgcaacaacacaggatgcattctgatctattggtgaattttgggaaggatgttgagaaactaagatctatcaaacttcaccctgctttacaaactgctaatcgcaaatgcttactggatttggtcaaggaagaaaacttgaggaagtcagtggagaattgcacctgctcccacaggcagtttgagaataaagtgacacaatttaagcagacttttggggaagtgaagcggcgggctgaggaactgttgtccagcagggctttcttgcccatcaagaatttagaacaagtaattaaagaacaccagagatatataaatgaacaaaagagtatcatgcaatctctgagcaaggatgttaacactgtaaagaaactggtagatgattgtctatcctcccaattgtcctcctcactccgtcctcatgatgcagtttccgccttgggtcctatgtatgatgttcatgacaaaaatcacttgcctaaaatgcagacttgtgatcgtgctatttcaaagctagtcgagttttgcaaggaaaacaagaatgaaatgaatctttttgttcacaattacatgcaaaacataacttatgtttcttatctcatcaaagatcagaagctacagttccctgtttttaaagaggcaatggctcgtcaggatggcttatttgtggatctaaagttgttccatggtattggtcctgcatacagagcttgccttgcagaaatagtgagacgaaaggcttctatgaagctgtacatgggcatggctgggcaaatggctgaaaggcttgctataaaacgggaggctgagctcaggagacgggaggagtttttgagagttcatagttcatgcattcctaaagaagtattagcatctatgggattgtttgacactcctaatcaatgcgatgtcaatatagctccatttgatggtggtttgcttaatattgacatatcagatgtggatcattatgctcctgaatatctaacaggagtaacttccaagctggagaagcaaggaagcgttaaaagttcatctgctttgagtagtgatagctctcacttggctgaggctgtagatattactggtgactcaattgagagatatgattctgaggacttgcttgatggcagtgagttgattgaaattgctggaacctgcaagatggaagttgagaatgcaaaactgaaagctgaacttgctggtagaatagctttgatatgttctctctgtcctgagttggagtatgagtcactggatgatgaaagggtgaataatatattgaagaatgccacagagaaaactgaagaagccttgcatttgaaagatgaatatattaaacatgttcaatccatgcttaagatgaagcagatgcaatgtgtgtcatacgagaaacgtattcaagagttggagcagaaattgtctgatcagtatgtgcaggggcagaagatgtccagtgtaaatgatacggctgactttcctcttgtggctgggaagacagataattacaaatcagaatctatcagtggtgaagccaacatgccttgcatatctacttctgagcccatggatgaggtttcatgcatctcaagttccttggatgcaaaacttggtttgttcacagaacatactggtaaagcgttagatggggtggatgaaaacatgctggattcctctggagttcagaacccgcagttggattcatctatgatggagccgcatcgcgaagaagcacagagtgctgataaagataaaaaaggcaagataatagtacaattgggcatgtcactgacaaacagttctactggtgagaacatgcctgtgtcacatgatcttgtaccttgtgactcagcagtttgtcaagacttggaatccaaagtaaacgatgaaaaagtgttggagctacaaagtgcacttgcagataagtcaaatcaattgaatgaaactgaaaccaagcttaaaactgttatggaggaggttgctgtgatcagaagggagttagaagcaagtcaaaaactacttgatgaatctcagatgaattgtgctcacctggaaaattgtttgcatgaggcaagagaggaagctcagacacaaaaaagttctgctgacaggagggcctctgagtatagtttactgcgtgcatcggttattaaaacgcacagcttttttgaaagactcaagacctgtgtttattctcctggtggtgtggctggttttgcagattccctgcgtaatttggcgcaatctttggccaattctgctaatgacagagatgatgacgatattgctgaattccgaaaatgcattcatgtattggctgatagagttggtttcatatctaagcaccgggaagagctgcatgagaagaacacaagaacagaagctgctaacgaacagctgcggaaagaattggaggagaaaatcgaccaggtcaaaacttattacaataagcatcaacttgaaaagcaggcaaataaagagaagatttgttttggttgcctggaagttcacgatatagctgcctttgtgctcactccagctggtcactacgaggcaattactaggaactgctctaactactacttatctgatgaatctgtagccctgtttgcagaccgtcttcctaccagacctaactacattgttggacaaattgtgcatattgaacgccaaattgtgaagatgccgacgcctcggcctgagcacggtggggctgataaatttacccctgacaaggggactgactggttgaccttgaattcaggctcaactccaaacccttacggtctccctgttggctgtgaatatttcctagtgacagtagccatgttacctgataccaccattcattcatcctctccttcctga

SEQ ID NO: 72245 - DNA, 465 bp, Glycine max
  Peptide Sequence Number=SeqID_163930
atggaagaagcttcttcgagcgaatattccattttcaaaaaaagaaaaaccactgcattccatattccgtgcgatcggagaagaggaacagactctgaagggttaacattctttgcaggagttctactagagaagcatatagttgttgtctgttctaatttggatgacatagagaagttggtatctaagttagaagacaaggtttgtgctcccgaggaaggttcttgcatggatgctataatccttcacctacatggttgtttgccgcctgaattgcaggcaagtagttttgattggatacaattttcagatatagatgctctcataatactcacaagtgcagtgccacagataaagcatgggtttgatccaaccaaaggaccaagatcagagttctattttgatggtttgactaagttatactttatacatattatcttgaaaacagctaaaggatttagctga

SEQ ID NO: 72246 - DNA, 324 bp, Glycine max
  Peptide Sequence Number=SeqID_163931
atgatcaaagcttatctccccttaaaccagccaagtagtgttctgagcattctagtaacaggagacttccttccaggcctttccccgaatgcaagctggggtctttctttgaatcacaacttctgcgacaagacgaagtatttcagaaaagcatggagattccatataaagaagcctggagattcaagaaccttctgcaatgttcagttaaagaagtatggagactcaagaaccttctgcaagtcaaaatcacctcttctctctggcagtggagggaaagctaatcctgggtatgatgtctcaaagccttccagcaactgttaa

SEQ ID NO: 72247 - DNA, 219 bp, Glycine max
  Peptide Sequence Number=SeqID_163932
atgagaagtgagtttggtgatacaaaactgagagcaccccatcctacttatagagtctgtccatcacagagctctctcaacttgtcagaacgtgagataggaagttatcagaccaagagggcaagaagcaaaatcaagcatggcattgtgatttgtggaagcaaggaagataaggaatcaagttccaacaccaacaggcatggaatggaagaagaataa

SEQ ID NO: 72248 - DNA, 783 bp, Glycine max
  Peptide Sequence Number=SeqID_163933
atggcttccacttctgcagtttcaatggttatgccggtaacttatgccagccagaagagagtggtgcctagctctgatgcattcttcaagccactcacactacggtcctccaaggtagtggcggcatcaaattccaatggaaggtttcaggtgaggacctccatgaaggagaaagttgtaacagggctcacagcagctgcattgacagcttcaatgatggttcctgatgtggctgaggctgccgtctcaccttctctcaagaacttcttgctcagcatcgcggcaggtggagttgttgttgttgccattattggtgctgtgatcgaactcgatgcgcgcgatttgaaccgtttggagttcccggaaatcgttggtttgccagcggcgagagcggtaagaagcgacggcgaggaattttcccgtgagagacacggcggggctgtagtccacctcttcgtgcggggtgagtctcttgacggtgctagtttcgccatctatgacggtggagcaaacgccgctccagctagtgaaaacggcgtcgttttgttcgtgcgtggaaacgaaaaacggggcgacccagttcgttcagagacaaagacgacgtcgttttgttggttaatgaattgggagttagagttaactgagacgccgtcggcgaggcggtggtctgccttggcgtggggcggaggatggcggttgttgaggtcgacggagaaaacgtcgaaaccgtattggactcttccgacggtgtcattgttgttgagtgaaagtgtgagtgtatga

SEQ ID NO: 72249 - DNA, 957 bp, Glycine max
  Peptide Sequence Number=SeqID_163934
atggccaccgccgaaccactccagaacggctccgccgaaaacccacttccggtggacaatgcccccgccgcgcaaccgcccaccgaaacggaagctgacgccgccgccacggcatctactccgccggagaagaggtggccggggtggcctggggactgcgtgtttcggctcatcgtgccggtgggaaaagtgggaagcatcattggacgcaagggagagctgataaagaagatgtgcgaagaaactcgatcccgcattcgcgttctcgacgctcctctcggcactcccgatcgaattgtacttgtgtccgggaaggaagatccagaggcagctctttccccggcaatggatgctgtagtaaggatattcaaacgtgtctctggattctctgaaactgatgctgagaatcaagaatctgccgctggtcttgcattttcttccatccgtttattggtggcatcgactcaggctatcaatttaattggaaagcaaggctctttaatcaaatctattcaggagaataccagtgcttcagttagagtgttgtcaggagatgaggtgcaattttatgctactgcgaatgagaggattgtggaaattcagggagaagccttgaaggtccttaaagctctggaagcagtagttggccatctgaggaaatttttggttgatcatagcgttcttcccctatttgagaaaacttacaatgcccctacctcacaagaccgtcaagcagagacctggtctgacaagtcattgttgcatacttcttcacgtactagcatatttgccgatattcctctttcaacaaaaagggattctgtcttagctgaccgtgaaagtcaattggacttgtttctcccttcctccactatgtctctctatggtcaggattcttcactttctggcgtccattcttcagctcttggccgtgttggtgctcctattgttactacg

SEQ ID NO: 72250 - DNA, 246 bp, Glycine max
  Peptide Sequence Number=SeqID_163935
atggttgaagggaacaaaacacaacatttcatcacactattattattgttccatgagatttatgtgagtgctaagagaatccctagtattgtcataatctttgttggggaaagagaagtcatggtgaacaacttaaagagtattggtgaccatggtggggtcatggtaggagatgaggttggccttggtgttcttctagggaggactcaaggtaaaggtggaagatatagcaaattgcgggggtga

SEQ ID NO: 72251 - DNA, 831 bp, Glycine max
  Peptide Sequence Number=SeqID_163936
atggcgagtgaaaagttggtgctggcagtgatcagggccgcgaggccaaccttccgcaaccaaaacgacaaaatcgcatttgccgttcactcctccttcctcacctccggctatgtcctcaccgctacaggtccccaggccctctccgacaatgcgttttctgacccatccaatgacgaggtatccgttgatcattggaacgagctgaacgatgagtacgcgttcgtttacgcgaatccagaaaagggttcggagaaagtgcttgtcaagtgcctcgtgatgaacgacaaattgctcgttcatgcttttactcaaggatcttcggagcctttgagccttgagattgatgttggggattatgctggagaggatggagtcagcaattattctcagcagttcaagaatttggataagcttgtgaagaaaatagatggggatatcttgtctaaattagatggttctgctaaagccagctcatcaagtagaaggatcctctttgaaaaattgtctcattgtcttttatacagctcagaaacaagtaacagaactagacaagagatacctgatcctgttgctggatttggtgaacctggtggtcctccaacgcaatttattttcccttcagttcccattggttctggtagtgatcttgttcctgggcctgctgctggagtgtttccttcaaggggtggtcatggcattggtggaagcatgcttgtagaattgttgatgctaagttcaacaatggaagcagggcctaatgacccccgttggtttggtggtgttggtggtattggtggagatcctgcttttcctggaggattgccgtaa

SEQ ID NO: 72252 - DNA, 366 bp, Glycine max
  Peptide Sequence Number=SeqID_163937
atggcgatgaattgcatgctgattgctgctttaggcttgaattcaccaaagtgtcccctgtttatgccacctccagagggaatgatcaatgcaaattttgatgcctcgataaagattggtaaagggatggggttcggccttgtgttccgcaatcataagggtgaggtccttgcatctgcaactcgcttggaagatcagtgctatagcccccagattgcagagtacctagctttcaaatggagtatccagatggcgaaccaacttctgctgcagaatgattgtagagacatgacaacacatatagacactgttgctttggtacatacaaagaagataggaaacattgttgctgattctttagcttag

SEQ ID NO: 72253 - DNA, 2298 bp, Glycine max
  Peptide Sequence Number=SeqID_163938
atgggatgttcacattcaaggttggatgatgaagaggcagttcggctttgtaaagacagaaagaagttcatcagacaagctgttgaacaaagaactcaatttgccacgggacacatagcatacatagaatctcttaaaagggtttcagctgcacttcgcaattacattgaaggcgatgagcctcgcgagttctcattagacacagtcatcaccccacctttcacgcctgtgaagaggaaaactggctcaggattcattcccatatcagcaaaaccctttgctacaacaggagcaattgagtttgggatcggaccaaactctactttgaaagtgaattaccttaggcctggtggtaacccagcaatttcagttgaggaaaggcctcaatccccggaaagggttcaggttgagacgtactatggcattgatggatttttcaacatgcaatcctcaccagtgaatccctcaatttttgcttactctcccaataataggactactatccctcccccttcacctcattcccaatgggatttcttttggaaccctttttcatcattggacagttatggttatccttctggaggtagcattgagcaaactgcaatggatgatgaatacagaggacttaggcaggttagagaagaagagggaataccagacctggaagaagatgaaactgaacatgaagattgtgttggaaagagaaatgtagcagaagaaagaactaggcacgatataaattcttccaaagaagttattgttgaagattttaatgatgatgatgatgaggaggaggaggaggaggaagaggaggaggaagaaacagacattgaagatgaaactgaaactgagcacaatgccaaagattcacaagctcatggtagtgcaagttttgaagtatcaaaagctgaagctgctggtcatattgaatccagacatagggaaatgacaattggtaaacaagaagctgtggaagatacaccaggttttactgtttatgtaaacagaaggccaacaagcatggcagaagtgatcaatgatcttgaaactcaattcacagttgtctgcaatgcagccaatgatgtctcagcattgttagaggccaagaaatctcagtatttattgacatctaatgagctttcagcatctaagttgttgaacccagtagctctgctccgatcagcttcttcacgctcttcttcatctagatttttggtgaattgttcgagcactagcgcagaaggttgtggtgagggcactaaggatctctcagcggaacattgtatgttatccggtagtcaccatgccacattggatagattaaatacatgggagaagaagctctatgaggaagtcaggtctggagaacgtgtccgaattgcatatgaaaagaaatgcaagcaactcaggaaccttgatgtaaaaggagaggacccctcttgtgcagataaaacaagagcagccattagagaactagatacccagataacagtttcaatacactcaattgaagctatttcaaggagaatcgaaactctaagggacaaagagttgcatccccaacttcttgaattggtgcaagggctggaaaggatgtggaaagtgatggcagaatgccatcagacacagaagagaaccttagatgaggctaagattcttctagctggcactccttctaaatcacgtgccagaaagcagtcttccatttcaatgactgatccaaacagactggcccgttcagcctccaatcttgaattcgagttaaggaactggagaaatgcctttgagtcatggatcacttctcagagatcctacattcatgcactaaccggatggcttcttcggtgcatgagatttgagcctgacgtatcaaagttaccatgctctccccgtaggtccagcagcactcaccctttgtttggactatgtgttcagtggtcaaggcgcctagatgcaatacaagaaaaggcagtgcttgatggcttagacttttttgcagctggaatggggtccctctatgcacatcagttaagagaagattctaggagaaactcatttggatcaaaacaaagcaatgggaatatggaaatggtggaagttggtgaggtggaagaggtaatggctccagagaaactggctgaagttgctatcaaggtgctttgtgctggaatgtctgttgctataagctcactggcagagtttgctttggattcttctgaggggtacaatgaagttgttaagcaatgggacaatgggaagtgtcaaaatactacttctagtgagactagaacataa

SEQ ID NO: 72254 - DNA, 135 bp, Glycine max
  Peptide Sequence Number=SeqID_163939
atgcttgaggaatcttatggaactgctagagataccgctatcactgttggactacacacgcgagcccgcttagaggatcctttaagggcgacgagtttttgcatgacgagtattgtgataggattcattgtgtga

SEQ ID NO: 72255 - DNA, 270 bp, Glycine max
  Peptide Sequence Number=SeqID_163940
atgtgggtttccggcagtgtagggggttctgtgggttcgaccaatgacaatgtgggtgtcgacggagcggttctggcagatttcgggcgggaggagaaagagaacaacaatttcaggcaggaggatgacaaagagaagagttggaaaatgccattgtggctgccagtatctatttctaatggagaaagaaagcgtgagttgcaattccaattcatggaaaagttgcggctgctacacgtaggtttcctagtaggggtgaaggaattttga

SEQ ID NO: 72256 - DNA, 600 bp, Glycine max
  Peptide Sequence Number=SeqID_163941
atgagtggtcatgtcgctccacctatttatgaatataatgatgaagtcatcagtgatgaattttttcttgatgagtctgatatcctccatgaactttccatggacgatgaagatcttcctgatgtggatgatgattctgaaaccgaacatgttgaagaggttgatgatgccattgacacattcaaaagtcataatggggaattgtatgcagttgcctgcagtccaacagatgcgacattggtggctacagggggtggtgatgacagaggatttctctggaagattggtgaaaaaggagattgggtttccgagcttcaaggtcataaagattctgtatcaagtttagcttttagctatgatggacagtttcttgcatcagggtgcttccatggaattgttcaagtctgggatgcatatggaaatctgaaaaatgtatttgaaggtcttggagggggcattgagtggctcaggtggcatccaagacaacgcacactcttagctggttccgaggatttcaatgtttggatctggaacgctactgatagaattacccccccctacttgctttgctggtcatcatggcagtgtgacctgtggtga

SEQ ID NO: 72257 - DNA, 3111 bp, Glycine max
  Peptide Sequence Number=SeqID_163942
atgtcaaaaaataacgcttctcaaacaaagtatgatgtttttgttagcttcaggggcgttgacatccgtcgtgggtttctaagccatttgattggcacttttaaaagtaagcaaataaatgcctttgtagatgataagcttgagaggggtgaagaaatatggccatcacttattgaagcaattcaaggatcatccatttcgttgatcatattctcaccagactatgcttcttcgcgttggtgtttagaagaacttgtgacaatacttgaatgcaaagagaagtatggacagattgtaatccccattttttaccatatagaacctacagaggtacgacatcaacggggaagttacgaaaatgcatttgctgagcatgtaaaaaaatataagagcaaggtgcaaatttggagacatgctatgaataaatctgttgacctatcaggaattgagtcatcgaaatttcaggatgatgatgagctacttaaagaaattgtcaaacttgtgctgaaaaggttgggtaaacacctggttaactcaaagggacttgttggaattgacaaaaaaattgcagatatagaatcattgatacgcaaagagtcaaaagatactcgtcttattggaatttggggtatgggcggtatcggaaagacaaccctcccacaagaagtatttaacaaactacagtctgaatatcaaggttcttattttttagccaatgaaagagaacaatcaagcaaagatggaataatttctttgaagaaagaaatttttactgaactattaggacatgttgtgaaaattgacactccaaattcattgcccaatgataccattcgtcgtatgaaggttcttattgttcttgatgatgtgaatgattcagatcacctagaaaaattactgggaactcttgatcattttggagcaggtagtagaatacttataacaactagagatgagcaagtgcttaatgctaacaaagctgatgagatataccgtcttagagaattcaattttgataaagcatttgaacttttcaaattgaatgcctttaaccaaagtgataatcaaagtgagtatgatgagttatcacaaagggtggtcaattatgccaaaggcattccattagttcttaaagttttggctcgtcttcttcgtggaaaaaataaggaagtatgggaaagtgagcttgacaagcttgaaaaaatgcctcttcgagaagtttgtgacataatgaaactgagttatgttgatctggatcgcaaagaacaacagatttttctagatcttgcatgtttctttcttagatcacaaacaaagataacgatagactatctaaattctctgttgaaagatagtgaaagtgacaattcagtggttgttgggttagaaaggctgaaagataaagcacttataactttcttggagaataattttatatctatacatgatagtttacaagaaatggcttgtgagattgttcgtcaagagtctactggagaccctggaagtcgtagtcgcttgtgggatctcgatgacatatatgaagcattgaaaaattacaagggtaatgaggccattagaagcatactacttcacttgccaacaactaagaaggaaaatttaagccctcgcttatttgctaagatgaacagactacgatttctggaagtttctgtagaagataattatgactgcttggatcaacttcatattcttggtaccaacctctgctggcccaagcagcaaaagactcggattgttgatattcttgctaaagggcttaaatttttggcaactgaacttagatttcttagttggaagagttactctggaaaatccttaccagagattttttctactgaaaaacttgtgatattgaaattaccatacagtggaatggaaaaactttggcttggagtgaagaatctagtgaatttgaaagaacttgacctcaggtgctccaagaagttaaaggaactaccagatatatcaaaagccacaaatcttgaagtaatacttctccggggttgttctatgttgactaatgtgcatccatctattttctccctgcccaaacttgaaagattgaacctttctgattgcgagtcccttaacatactaacaagcaattcccatttacgcagcctcagttatctcgaccttgatttttgcaagaatcttaagaaattctcagtagtatcaaagaatatgaaagaactgagattaggatgcacaaaggtgaaagcacttccctcatcatttgggcatcaaagcaagcttaaattgctacatcttaaaggaagtgccattaagaggttaccttcatccttcaataatcttacacaactgctacatctggagctaagcaattgcagcaagcttgaaacaatagaagagcttcccccattcctcgaaactctaaatgcccaatattgcacttgtcttcaaactcttccagagcttcccaaattgcttaaaactttaaatgtcaaagaatgcaaatcgcttcagagtctaccagagctttccccgtcgctagaaattctaaatgcaagagactgcgaatcattgatgactgtattgtttccttcaacggcggttgaacaattaaaggaaaataggaaacaggttatgttctggaattgcttgaacttggatgaacattctctagtggctattgggttgaatgcacaaatcaacatgatgaaattcgcaaaccaccacctatctacaccaaatcgtgagcatgttgaaaattacaatgattcttttcaagttgtttacatgtatccaggaagcagtgttccagggtggttggagtacaagacaagaaattatcatataactattgatctctcttctgctccaccttccccgcagaggagcttcgtcttctgcttcgtccttggtgagttccaacggacagacataattagaacacttgaatttagcatcactatgaatgagggtgaaggtaaagaggacagtgtcagcatgtacatagattatttgggttggtcatcaattgaatcagatcacgtgtgtgtgatgtacgaccaaagatgttctgaattcctctggtgtcagccccataaggaccttggcatataa

SEQ ID NO: 72258 - DNA, 756 bp, Glycine max
  Peptide Sequence Number=SeqID_163943
atggcagctagtgatcacgccattcttcgtgatcgcacatatgcaccaacaaagagaagccttctagaactcaccactcaagatgcaaccttagctcagaacaagctgttgttccgacaaatagaagccctaatagagaccctcaacaagcttccacaacaactacaagcggtagggggatgccatacatgtggaggaatacacgagcctggacaatgcatgatccaagaagacccttccagggaagttaactacatgggtataccaaatcgccacggattccaaggttacaaccaaggaggtccgtctggattcaatcaaggatcaaccggatttaatagtggcccatctggattcaaccaaggaaggaactttacacaaggctcaagatggaggaatcacccagggaatcaatacaacaaggagcaacaagctcgaggagacattgaaccaattcatacagttttcaatgtcaaattaccgcagcacaaacacctcgatcaaaaacttggaaatgcagaaattcaacaagaaagcattctccaagtcaatacccctcctcatcaacttattgtcaaggaagaaagacatggagaacatgagaaagccttaaatgtcattctttccttgatcgctaccacttctcttgcaataatgtggaagctgcttccagaatacacgagttttatggtgtctctagctaagaggcgaaaatgcaaggaagatgtgttctatgtgatcttcatgccaccttga

SEQ ID NO: 72259 - DNA, 2421 bp, Glycine max
  Peptide Sequence Number=SeqID_163944
atggagatggtggttgcgagttgtgcactgtgttcgcgcggtggtggtgtgcttccatcgcgatttgtggtttggtggtgtgggtcgttgttcgatgatagtgatggtgcgtggagagattgcaggaaagaggaagaaggagcttacagaaaggatgttcttattgttcttgatgatgtgagtgattcagaccacttgggaaaattgttgggaactcttgacaattttggatctggtagcagaatacttgtaacaactagagatgaacaagttctgaaggctaagaaagtaaaaaagacataccaccttacagaactcagttttgataaaacactggaacttttcaatttgaatgccttcaaccaaagtgatcgtcaaaaggagtactatgagttatcacttagggtggtcaattatgccaaaggcattccattagttgttaaagttttggctggtcttcttcatggaaaaaacaaggaagaatgggaaagtttgctagacaagcttaaaaaaatccctcctacaaaagtttatgaagtcatgaaactgagttacgatggtctagatcgtaaagagcaacaaatttttctagatctggcatgtttctttcttagatcgaatataatggtgaacacttgcgagctaaaatctttattgaaagatactgaaagtgacaattcagtgttttatgcattagaaagattgaaagataaagctcttataactatttctgaggataattatgtatcgatgcatgatagtttgcaagaaatggcatgggagattattcgacgagagtctagcatagctggaagccacagtcggttgtgggattctgatgacattgctgaagcattgaaaaatggcaagaatactgaagacattagaagcctacagattgacatgcgaaatcttaagaagcagaagttaagtcatgacatatttacgaacatgagcaaattacaatttctgaaaatctctggaaaatataatgatgatttacttaatattcttgctgaagggcttcaatttttggaaactgagctaagatttctctattgggattattaccctctaaaatcgttgccagaaaattttattgccagaagacttgtcatattggaatttccatttggcagaatgaaaaaactttgggatggagtccagaatctggtgaatctaaaaaaagttgacctcacttcctccaataagttagaggagctcccagatttatcaggagccacaaatcttgaagaactgaaacttgggggttgttcaatgttaacaagtgtgcatccatctattttctcgctgcccaaacttgagaaattgttccttattaactgcaagtctcttaccatagtcacaagtgattccaaattatgcagcctcagtcatctctaccttcttttttgcgagaatcttagggaattctcactaatatcagacaatatgaaagaactaagattaggatggacaaatgtgagagcattgccctcatcatttggatatcaaagcaaacttaaatcactagatctaagaagaagtaagattgagaagttaccttcatccatcaacaatcttacgcaactgctacatctagacatacgttattgccgggagcttcaaacaataccagagcttcccatgttccttgaaattctagatgctgaatgttgcacttcacttcagactctgccagagcttccccggttccttaaaacactaaatatcagagaatgcaaatcgcttctgactttaccggtgcttcccttgttccttaaaactcttgacgccagtgaatgcatatcattgaagactgtgttattgtctccttcaacggctgttgaacagttaaaggaaaacagtaaacggattctgttctggaattgcttgaacttgaatatatattctttagcggctattgggcagaatgcacaaaccaatgtgatgaaatttgcaggccaacacctttctaccccaaatcaccatcatgttgaaaattacagtgattataaggataattatggttcttaccaagctgtttacgcataccctgcaagcaatgttccaccatggttggagtataagacaagaaatgattatataattattgatctatcttctgccccaccttcgcctctccttggcttcatttttggcttcgtctttggtgagagcacagacatgaatgaaaggcgtgaagttaacatcactataagtgatgttaagggtaaaggtaaaagggagaccaacagagtcagaatgtacatagattatggcattgggaaaattatatcagatcaggcacaatgggcagtcgatccaggtttaaaagaatttggggtcagcccaataagcaccttgacatataaaagtttcattgacattgaagaaatggaattgcatgacagtgactga

SEQ ID NO: 72260 - DNA, 183 bp, Glycine max
  Peptide Sequence Number=SeqID_163945
atgaagaaacttggtgaagaacccatggacgagctccaagcagtcacactcgctcaagttgatgattctcacgtccaaagtacgggtgtcgtgtcggtgttggacacagacaacggacgcgtgtcggacaccggacacggcaaggggctggagtatccgtgcttcatagttacgcgagactga

SEQ ID NO: 72261 - DNA, 195 bp, Glycine max
  Peptide Sequence Number=SeqID_163946
atggcttgtggtgggctcttggtgggtttcgtagtggcttgcaatctttttcgttgtgctttgtggtgggtttgtgatgagtttcatggtggttcacagtggtatagggtggtcgaggaatatgaagatgtagtgtatttgaaagtggtggaggcttcactgccattgttagctttggtatcactgcagcattga

SEQ ID NO: 72262 - DNA, 1995 bp, Glycine max
  Peptide Sequence Number=SeqID_163947
atgaaaaaaacacttagttgcaaggacataaaatgtattttagctttaatgttaaagatcaaatgcatttggcgagctgtggcacaacggttaagttgtgtcttggtgaccgattggtcatggattcaaatccggaaacagcctctttgcatatgcaaaggtaaggctgtgcacaattaccctcccccataccttcgcttagcaaggagcctctgggcactgggtttatatctttataaattgcttctctttctatctagtacactgctatctacattagaagtttttttggcttgccagtttatgatcccatacatgctaagaatagctaagctggggtgttataaaaaatactttattgactctactactcttgacttccgtttcttgcagtgtcgaggtccatttgctaagagaaggcatccattggtggactcaactgttgtttcagagatcagaagatgccttgacgaaggggttgaattccaaggtgagttgctgaactttaggaaagatggatctccacttatgaacagattgcggctgacacctatatatggagaagatgagataactcatgtcatcggaatccagttctttacagaggcaaacattgatcttggtccccttccgggttctacaattaaagaatctactaaatcatcagatcggtttcattctgtgctttcttcgttgaatcctgttccagtgggggatcgcaatgttactcgtggaatttgtgggatatttcaattaagtgacgaggtattgtctctcaagatacttgctcgtttaactccaagagatattgcatcagttggttctgtttgtaggcatttgtatgagctaacaaaaaatgaagacctttggagaatggtgtgccaaaatgcttggggcagtgagactacacgtgttttagagaccgtgcctggtgcaaggaggcttggatggggtcggctggcaagagaactgaccacccttgaagcagcagcatggaggaaactgactgttggaggtgctgttgaaccttcacgctgtaattttagtgcttgtgcagttggtaatagagtcgtcctatttggtggtgaaggggttaacatgcaacctatgaatgatacctttgtattggatctcaattctagtaatcctgagtggcaacatgtccaggtcagttctcctccccctggtcggtggggccacacactttcttgtgttaatggttctcgtttggttgtatttggagggtgtggaacgcagggcttgctcaatgatgtgtttgttctggacctggatgcaaagcctccaacttggcgtgaaatttctggattggcacctccacttccgagatcatggcatagctcctgtactcttgatggtaccaagttgatagtttctggtggctgtgctgattctggggtactcttgagtgatactttcctccttgatctgtcaatggagaaacctgtctggagagagataccagtggcatggactccaccttcgcgtctgggtcacacactatccgtttatggtggcagaaaaatactgatgtttgggggtctggccaagagtggggccctgcgttttcgctccagtgatgtgttcacgatggatttaagtgaggaggagccatgctggagatgtgtaacagggagtggattgccaggattgccaggtactggaaatcctggaggcatagctcctcctcctagacttgatcatgtggctgtcagccttcccggtgggagaattctgatatttggtgggtctgttgcgggccttcattctgcctcccagctttacatactagatcctactgatgagaagcctacatggagaatccttaatgtacctgggcgccctccaagatttgcttggggacatagtacatgtgttgttggagggacaagagctattgtaatgggtggtcaaactggggaggaatggatgctaagtgaactccatgaactttccttggcaagttctgtcagttag

SEQ ID NO: 72263 - DNA, 109 bp, Glycine max
  Peptide Sequence Number=SeqID_163948
atgctccaaccatatgggatcaacgttggcttaaaggagcactcaaaccaggttacacccaaggcctacactccgaagagtccgtcagggcctctccctcttgattcag

SEQ ID NO: 72264 - DNA, 2118 bp, Glycine max
  Peptide Sequence Number=SeqID_163949
atggttgctatgtcctctttaacaagcatggctcctcaaaaggccgttattgctgaaactggggaacttgttgacgtcaatgatgttaagatcaacactatacttgcagtcaaggctggtgatgctattcctcttgatggaatcgtggtggaaggaaagtgtgaagttgatgaaaaaatgttaacaggagaatcattacctgtgaccaaggagttagattcagtagtatgggctggaactattaatgtgaatggatatataagtgtaaaaactactgttttggcaaaagacacagtggtggctagaatgtcaaaacttgttgaagaagcttctagcagaaaatctcgaacacaaagattcatagatcattttgcgaagtactatattcctgctgtcgtcttgatttctgctagcattgctgtggttccagctgcattaaaagttcctaatattaagccttggtttcatctggcaattgtggttttattgagtgcatgcccttgtgctctcatcctctccacacctgttgcaatcttttgtgctctcacaaaagcagcaataagtggattactattgaaaggtggagattatattgaaacactttctggaattaagacagttgcttttgataaaacgggcacaataacaagaggagagttcactgtgacagatttttctgtttctgtagatgacattagcattgaaactttactgtactgggtttcaagtgttgagagtaaatcaagtcatcctatggcagctgcactagtggaatatggaatgttgaattctgtcaagccaatccctgaaaatgtggagaattttcaaaattttccaggggaaggagtttatggtataattaatgggaaggatatctatataggcaataggagaatcggtgctagagctggctctgaaagagttgattgtcgcacgcaatgtcaaagccctgaaatttctaccccgaatcaatgctgtggaccaactctggttggagtcttcaggttagctgatacatgcagatcaggggcattggaggcaatagaagagctaaagttgttaggtgtgagatcagtcatgctaactggagatagctctcaggctgctatgtatgctcagagtcagttgaaccatgctctagacattgttcatgcagagcttctacctgcagaaaaggcagtgatcattgagaatttcaagaaagatgggctaatagccatgattggagatggcatgaatgatgctcctgcattagccacagctgacatcggtatctcaatgggaatatcaggttcagctcttgcaaatgaaacaggcaatgcaattctcatgtcgaatgacatacggaaaatacctgaagccattcgactagcaagaaaaactactagaaagctaattgagaatgtcattatttcaattggcttcaagagtgtcatacttgcattggcaattgcaggataccctatagtctggcttgctgtgttgactgatgttgggacctgtctacttgttattctcaatagcatgttaattttacaggagaaaactaaatatgaaagaaaatctacaagttccaaatacggaactttctcggaagatatgaccacagctctacttgacaagaaaagtaatagcaatgagaacaaagcagttctctccgctgaaaagtgtggtaaagattgttgtaaaaacgacacttatcgtgaagcaactacaaacaagaatgaatcttctggactttcaaagttgagctcactgaagggaaaccacaatgggaacttggtatctatcgaagtgcacattgtgaaaccttgcaatggttgtggtctaggcaaagtcaaaatgtgtgaggacttctcatgcagaacaaataatagtagctctgattgttgccaagagcaatctaagactgagaaaagtgacactggttctattgttacacaagaagctagcattgccacattagagtctgatggctataagggcaagtctatggatatttcaaagttgtctgggacaagtgtgactcccaagtgttgcaagaacttgtgctgtaatgatagtgttaacaatattagtaaccttagccttagccagcccgaaattgttatcgagtga

SEQ ID NO: 72265 - DNA, 240 bp, Glycine max
  Peptide Sequence Number=SeqID_163950
atggagcaagatgttctagaaaagaaacattatcagaaggaaagaaaaagagaaaatgcacttgagttgagtgagtcagtggttgcgagaagcgagttgaagttgaacacagatctgagggatcgagaatgtagaagggagaggagtcacaaagcggagaatgagaagttgagtattggcagaggagatgcaaaacgacaccattgttcgggaagaagaagcaataggcgaagttgctga

SEQ ID NO: 72266 - DNA, 372 bp, Glycine max
  Peptide Sequence Number=SeqID_163951
atggcagaaagcataggaaactgtttgggaagattacagttgtggaatgaagaggtggagggtggagagaaggagaggatatatagattcaaaaaggtgtggctcaatgacggtgaaggatgtgagaatatcttccaacagtcttggattaaaggtgggaatcctttggtgaatttgagcagaacaagtatgaactattgggagattgggggggatcagaactttgggcaaatctcgaaaatgataaaagacctcagaaagaagctcaatcatttgctgcaaaaagttcaatcagaagaggtcttaaatatggtggcaacagtggagaaggagctggatgatttgcttgtgttggaggaagaaatttggtag

SEQ ID NO: 72267 - DNA, 809 bp, Glycine max
  Peptide Sequence Number=SeqID_163952
tgttaaaagggtcaagaagttagaagctgagcttaacaagcttgaatctgaagctgaactatcgggtctgaaaatcaattttgctaagagtagattcggagctttcgggatttctgatcaatggaagcatgatgcagcaaaagttttgaattccaaatatggtggatggaggaaccttgatataaaagacatcaaaactttcaacactgctttgttaggaaaatgtagatgggagttgttccaacagcccgatgaaccatgggccagggttctattcttgaagtatggtggttggaggtccttggaagaagggaaaacaggtgcagtatgggaatggcagcttacttggaggcgacctttgttcaataatgagattgcaatggcggatgattttatcggaagaatagctcagaaggaaatttctccacacagacctaatatctggtggtggaaacctgacccaggagacaaattttcttcaaaaagcgcatatggactgttgtggggagatctaacgaggataaatcaggaggtggtttttaaggaactttggaatcttaaaattccacctaaagcctcagtgttcgcttggcggctagttaaggatagattaccaacaaagttgaaccttaatcctacctctatggtgggaatcactatcttggattggaatagccactgcacttcctcaacacccaacgaagcactttatgcagcatgggcattagggtgctatggtgctggctttgttccttcaaataataataggaaccagctggcccctaaaatttgtaatttcagtaccactg

SEQ ID NO: 72268 - DNA, 141 bp, Glycine max
  Peptide Sequence Number=SeqID_163953
atggctatggcagttcgaaatacaacaaatcctgaagaactgcagatagcagtcattcatgaaattgcttcacttcaaggcagaagtccttcatgtgatctagttaacaacacaaggattgttgatttatatttatgctga

SEQ ID NO: 72269 - DNA, 1452 bp, Glycine max
  Peptide Sequence Number=SeqID_163954
atggacatggtaaataatgcaaactcagcagcaacatcatcaccatcacaaacgcaggtggttgttcctatggcttctgctcaattttcaagcccttccgttgaattaacaacatcatcaccaccggcacatgtggttcagatggcttctcctcaacctcgacacccttcccgggaatacttagaaaaatgtatacccctttataagctagcattgaggggtgattggaatgcagccagacgcatgatagatgcagacactagtctattaaacgctgctataacaaaggaatggggtacactacttcatgttgtggcaggaacagaccaagttcactttgtggatctgctggttaaattactgaaccctgatgacctagaactgaaaaatttcaacggaaacaccgcgttttgctatgctgctgcatctggaaacctgcagattgcttctctgatgatcaagaaaaatgcaggcctaccgaaaattcggggcggagaaggagccactcctttttacatggctgccttacaaggaaaagatgacatggctaggcatctctatgacctgactactggcattttagaagaagatgagtggactacactgttcttcctttgcataaagaatggattgtatgatatagctttgaaaatgctacaagaacactcaatgctggcattggaaagggatgagaacaacgatacagccttgcatctcttggctcgaatgccaagtggctttactggtcatggtcaatggtatcctccaagccaaatcttgaacaatagcatgaagccaactccattcgttcaacttgttgagtgtctttggaacaagcttcttgaacaagattacgatgaaacagagatgaggactttcataagtgtaccatcacaaataacatttgatgctacacaagttggaaattttcaatttgtagctgcacttatgaggtcttaccctgatttattatgggaagtggatgacaaaaaccgaagcataattcacattgctgttatacatcggcattctagcatctatagtctaatacacgaactaggctccttcaaggatttcatagcaacttttgaagacgatgaaggaaacaacattttgcactatgctgctaagttgacacctcctgataaacttggcttaatttctggagcagctcttcagatgacacatgaattattatggttcaaggaggtgaaagagttaatgctgctattagatgtagagaagaaaaatgctaaaggaaaaactccacgtgaaatatttgctgaggagcacaaagaattattgacaaaggcagagtcatggacaaagagcacatctattagctgcatgcttgtttctacactcataaccgcaggagttttcactgcaacattcatgctacctgctatgcagaggaagaatgtttcaagttgctccctaaaaggttactaa

SEQ ID NO: 72270 - DNA, 888 bp, Glycine max
  Peptide Sequence Number=SeqID_163955
atgcagactattataaaagtcataagtgaaccatctcaggtaatatttattgccacagaagttggaaattttgaggttttggcagagctggttagatcttgcccagaactcatgtgggaagttgataccaaaaatcgaagcatcattcacattgctgctttgcaccgccacatagacatatataatctaatacatgaaacaagctctatcaggaattttgtagtaacattagaggatgaggataaaaacaatttactgcactatgctgcaaaattatcaccaccgagcaaacttaacttgttgcctggacctgttcttcagatgaagttcgagttgatgtggtatgagcaggttgcgggcatacaaatttcgttctcaaatttgtcaatttcagaacgaattagtcatcctaaggaggtgaagaagatcatgcaaccttgtttcatagagatgagaaattccaatggtaaaactcctcgagaattattcactgaagagcatttagagttagtgacaaaagcagagtcttggatgaaaagcatgataaattcctgtataactatttcaacggtcactgctacactagtgttggctacagcattcagcattaagcgtgaggataaccataaacccaccattactcgtgacttcataggaagactttttgaagtcactgctgcggaagatatggtggggactggtgacactatatacctccatagcatacttgtcgacgacatttaccattgccttcttcacaacgtaccaagtacgggtgccaaaatcatttttttgggggcctttaataagcctattaataatggaatatcttctgtttccatatgggtcactcgtcaacataaacccacgctattggttacccagtaa

SEQ ID NO: 72271 - DNA, 583 bp, Glycine max
  Peptide Sequence Number=SeqID_163956
gatcttccgtgagaagaaaatgtatcctgcggaagaagcttttgcaggttcttccacgacaacaaaatgtagcttgcggaagaaggaatccgtgaaagaaccttccacacttcttccgcgggaccccgcggaagaacaccttcttccgctacagttcccagaagccactttcagacgcgcagaagaaggttcttttcgcgggagaaccttcgtcttcaacctccaccaccacaggtcactaatgtcgtctatcctaaggttcctacgaccatttacgccattcaaacagatacgaggaggaaatgagggcgcggaggaagaagggaataagccaatatcggggaagaagaagcacgaatggagattgttgggtgcacgggaaagaaacaagcgtggaagcaaggggaagaagaaagggtattttgggtacttcattgaattgctgggtgcacctagcaacacccttagcatttttttaatgaaattggtcctcatgtcatccgcagatgtgatcattttcccaaggaaccagaattattttgacacaatgtgctacagaaactacatgcctggtttactctaa

SEQ ID NO: 72272 - DNA, 327 bp, Glycine max
  Peptide Sequence Number=SeqID_163957
atgtcaaattactgcagcacagacgcctcgatcaaaaacttggaaatgcaggtaggacaattggccaaaaagatggctgaaagaccctctaaaattcaacaagaaagcattctccaagtcaatacccctcctcatcaacttattgtcaaggaagaaagacatggagaacatgagaaagccttaaatgtcattctttccttgattgccaccacttcttttgcaataatgtggaaggtgcttctagaatacacgattttcatggcgtctctagctaagaggcgaaaatgcaaggaagatgtgttctatgtgaccttcatgccaccttga

SEQ ID NO: 72273 - DNA, 267 bp, Glycine max
  Peptide Sequence Number=SeqID_163958
atggctgttcacttgtttgaatgtgttgcacacattgtgacacatctagaagaggatgaagtcatagcctttgaacttgttgaagaccttgttgctgacgaccttgcagtccttaatgtcatgctaccagaatgtgctaagggaaacgctgagcatgggaccgccatcgtggcgtttatcgcgacgccgacagggactcgctccacgtggcatccgatgacgaggccatccgaagcagaccgccatcagcgaagctcagttacctaa

SEQ ID NO: 72274 - DNA, 1560 bp, Glycine max
  Peptide Sequence Number=SeqID_163959
atgacagttgtcgactctccaactcagcaacaacaaccgcaaatgggcaatgccgcatcagctcgtcataatcgtcctaaccttgagtttatagaggcaacagacgaagaagcaaaggacaaatttctaagcctttgtgtgcctctttacaagtttgctctagaaggcaattggccagcagccaaggtcatcttacaaaaagatgttagactcaagaacgcagcaatagcagttggttgggctacacttctgcatgttgctgtaggtgcaaaccatgctccctttgtgaaggagctgctgcaagaactcgacaaccaagacattaaattgaaagatatcaagggaaacaccgccttctgcttcgctgctgcatcagggaacatggaaattgttcaattgttgaaacaaagagttgaaaacttgcctataatcaggggtggaggtgatcatacccctctctattttgctgtcatgcaaagaaaatgcgacatggtagagtatctgtacgacaagaccaaagatgtattcgacgtaaaggacagggaatcactgttcttcacttctatcaccacccgcaactatcacttggccttgaaaatggcaacagagtgtaaagagctagcttatgcacgtgatcatctgaataatgacacagcgttgcatatcttggctatggctcatgatcaaaaccctttggattcttgttgtcattgttcggagcaacaaactcccatcatgatcaaccccgaagttggtaattttgggttcttgtcagagcttattagtgctcaccctagcttgatatgggaagtggatgacaaaaagcaaagtataattcacacagcggtttcgcatcgccatgccagcatcttcaatgtcgtacatgaaatagggtcaattaaggatattatagtagaaggtttcgtgaaaggaaacaacactttattgcatttggcagcaaaattagccccatcagatcgacttgaattagtttctggagcagcattccaaatgtcccacgagttaatatggtttgaggaggtgaagaagataatgccaccatcattcataatgttgaaaaattctgaagacaaaaccgctcaggaattattcacaagggaacatgaaggattgcgcagaaaagcagaagattggatgaaacgcactgctgagttctgtatacttatttcaactgtcattgctacagcagtgttctctgctgcgattaacataccaggtggcatcgatgatcaaacgaaaaaaccaaattacttggacaaaacatcgttcctggtgtttgcaatatcagatggaattgcattcatctcatctgcaacttcaatattaatcttcttgtcaattctcatctcgcgttatgcggagtatgattttcacaatgccttcttcataacgtacgactctggtttgaaggtggttcctgattcaatttcaatacttgcaagtgggtcttctgggcttaacgagtatggtggtgatcacgcgtttaacgtgagattcacgctaagcgctgggcttcttcgtgggctttctttgcgctaa

SEQ ID NO: 72275 - DNA, 192 bp, Glycine max
  Peptide Sequence Number=SeqID_163960
atgggtgcagatcaacttagtttccatacaaccttcgcgctaagtgcacttatcgcacttagcaagtatgatgcgcacattctcattccaaactttttcatacttcctagtgttaagcgtgctttactcgctgagtctgtgtatcacactgaacgcctaagacgtgctaagcgaacaacttcagatctttaa

SEQ ID NO: 72276 - DNA, 399 bp, Glycine max
  Peptide Sequence Number=SeqID_163961
atggaggaggcacataagggggatgaagacaaagagaaaagaggggaagaagtgaaataccgcggcgtgagaaggaggccatggggtaagttcggagcagagatcagagacccaacgaaacctacaggaagacaatggttaggaacatttgacacggcggaagaagctgctagagcttatgatcgtgcagccattgaattgaggggtgttcttgcaatccttaattttccagatgagtgctattctcaactcccttttgtatcatcaaaccctactagtacggctaatggaagttcttttgctccaacacataaggaagttattgagtttgagtgtttggataacaaggtgttggaagaccttcttgagtccgaagtgaaaagaaggaacgaagactaa

SEQ ID NO: 72277 - DNA, 708 bp, Glycine max
  Peptide Sequence Number=SeqID_163962
atgcgtcaggcttatgcatggtccaagatgacgcatccaatgaagttaactacatgggcagtcataatcatcaaggattccatcaaagaggaccaccaggattctatcagagcgataattttttgcaagaccacgattggagatattatccaacatcctagccagggtcagagtcagcaagagaagccacctatcagtatagaggaaatgctattaagcctcatccaagaaacaagggcaaacactcaagagacaagggcattcatccaagagacaagggcattcatccaggagacgagatcacaccaaaagagcacagatgcagccatcagaaacctggagatacaaataggccaactagctgagtcaactgctgaaaagcccactaaaacctttgcggtaaatgctgagatgaagcacaaagaggattgcaaggtaattttcactgagagagaagaggaagaaaagaaaaatgaggaagatgtgcatgatgaggaaggagaaaagaaggaagaaagagaaagaaatgaggagaaggcacaacaatgggagaagtactcacaagtagaaattcaacaaggaagcattctccaagtcaatacccctccttatcaacttattgtcaaggaagaaagacatggaaaacatgagaaagccttaagtgtcattatttccttgatcgccaccacttctcttgcaataatgtga

SEQ ID NO: 72278 - DNA, 78 bp, Glycine max
  Peptide Sequence Number=SeqID_163963
atggaaatcttccggaagaaacttcttccggaaacattccggatgacgttcttccggaagttgtttggccggtcctaa

SEQ ID NO: 72279 - DNA, 198 bp, Glycine max
  Peptide Sequence Number=SeqID_163964
atgagtatgaagaaatgcataaatgcttcgggtttgggtatcctggttcaagttttgtttgctaatgtagatgacgcaaaagaccttacatggaaaacagatgagagaaattatgatggaatgctttgccatctagctgattcttctcagtggaagaagattaatcgtatgtatccgaaattcgaaaaagaggcatga

SEQ ID NO: 72280 - DNA, 3612 bp, Glycine max
  Peptide Sequence Number=SeqID_163965
atggaggctgggaagaagggtggtgggggttctagtaaccagaagaagttgttgaaggatgttgaaaccatgaacaaagctttgtacttggatagaaactcttcaaggagttcaatacctagtgcaaattctagatctaaattcacagggaaacctcagttgcctgatccaagatccaagtctaaagccagtaatgatcataatggtgagaatgctcagaaggataagaagtccatatggaattggaggccattaagggccctttcgcacattcgaaataagaggttcaattgtagtttttatctgcaagttcatttgattgaggggttgccgccgagttttgatgatgccggccttgctgtttactggaagaggcgggacggggttctcgtgacccagccggccaaggtggttcagtgtgtggctgaatttgaggagaagttgacctacacttgttcggtgtatggaagcaggagcggacctcaccattctgcaaagtatgaagcgaagcattttttgctctatgcttcgcttctcagtgtgccggagatggatttggggaagcaccgggtggatctgacgaggttgcttcctctcactctggaggagcttgaggaggagaagagctcggggaagtggactactagttttcgattaatgggattggccaagggcgctacgatgaatgtcagttttgggtatactgtggttggtgataatgctagtgctaccagagacagccttccgaaagcattgtcctccaggcagaatagtttttctctgactccgacgaagtttgatgttaaacccagacagtttgatggaagcagcacgatgagacgtgccacaagtttgcaatactcacctcaagcttctgacgaggtaaaggatcttcatgaggtgttgccattaactaagtcagcactagctagctcaataacgtcttatatagaattggatgaagaaaagttatgtagccctctggatgataagacagaacttgattcattcacagaaaatcttgggccaatcaagccagatgcctatgcttctgatcttggaaaagaaaggcttgaagagcatgcgactaaggatgaaagtacatgtgacaaacctgaactctatgtatttcaagaaaagctggagacagttaaaccagatggctattttttaccagattttggaaacaaaaaccctgaacagtgtcatgataatgaattttttgttgtcgataagggcatagaactttcatcaaacgaacgtgttaaactagaggaatccatcataaaggctcctgacgatgcttctatggttgatactgtctgtacccttggtatatcaggtatacaaatatcttctgaagatagtgttaaacatgattttctggatgaggcaaatgatagttctaaggatcaaggagtggtagaggaatttgctagcataaaggctcctgaggatgcttctacagttgatacttcctgtacccttggtatatcaggcagacaagtatcttctgaagatagtgttgaacatgattttttggatgaggcaaatggcttggacactaatgagctgctcatgcaagaactagaatctgctttaaatagtgtctcgaatttagagagagtggcactagaatctcctaaaactacagaagcgaaatcggaacataaaatgacaaagtcacatagcttggatgatgttacagcatctgttgccactgaatttttaagcatgttaggcttagaccacagtccaatgggcttgagttctgaaagcgagcccgagtctccaagagagctacttttaagacaatttgagaaggaggctctgaatgggggcttctcttctttgtttgattttgacatgaactatgatagtgaagcagctggtggctatgatgcttctgcttcttctgagcagtggaacttttctgaaggtgtcaagtcatcatccttcttgcaagatctgctggaggagcctccagttgaatctcaggatgttaggagcaaacagagggctcaaatgctagaagacttggaaacagaagccttgatgcgtcaatggggtttgaatgagaatgcttttcatcattctccaccgaaagattttgctggttttggaagtccaattcatttaccacctgaagagcctcccacattgcctcctcttgatgatgggttgggcccttttcttcagacaaaagatgggggttttctacgcactatgagtccctcaattttcaagaattctaaaagttgtgggagcttaatcatgcaggtatccaaccctgttgtggtacccgcagaaatgggttctgggataatggaggttttgcagtgtttggcatcagtgggtattgaaaagctctcaatgcaggcaaaggagttaatgccgctggaagatatcacagggaagacaatgcaacaaatagcatgggaagctatgccttccttagagggtgcagagaggcaatgccatttgcggcatgatccaataacagtgccagacagtgctggtgtgcaaagggacttgaaaggaatgccatctaaacaaaagtctggcaagtttagttcaaggacagtggccaaccaaacaggctcggagtttgtttcagtagaagaccttgctccattggctatggataaaattgaagcactttcaatggagggtttgagaatccaatctgggatgtcggaagaggaagcaccatcaaacattattgctcagtccattggagatatttcagctctccagggcaagggggttgatattagtgggtcccttggcctggatggagctgctggtttgcagctgatggatgtaaaagacggtggtgatggtgttgatgggataatgagcttatcattaactcttgatgaatggatgaagctggattcaggtgagattgatgatatagataatatcagtgagcacacttccaaacttcttgcggcccatcatgccaactcttttgacttcattcgtgggagttcaaagggagagaagagacgaggcaaaagcagatgtggtttgctaggaaacaatttcacagtagcattaatggtgcaactccgtgatcctatgagaaactatgagccggttggaacaccaatgcttgctcttatacaagttgagagagagttcatgcttccaaagcaaagaattttcaacagtgtgtctgagataaggaaaaattattatgaggatgacgagagcaatatagtagcaaaattgaagacgaaggacaccgagaaagaggagaaaagttctgaagaggaagggggcattcctcagttcagaatcactgaagtccatgtggcaggtctgaagcctgagcctcagaaaaagaagctttggggcacttcaagccagcaacagtctggttctcgctggttgctcgccaatggaatggggaagagcaataataagctttcactgatgaagtcaaaggctgcgtctaaatctaatgctccagttaccacaaaggggcaacctggtgacagcttgtggagcatatcatctcgtattgatggtgctcgaggaaaatggaaggagttggctgcactaaatccacatataagaaaccccaatgtcattttaccaaattga

SEQ ID NO: 72281 - DNA, 900 bp, Glycine max
  Peptide Sequence Number=SeqID_163966
tcttcacaagtagaggatgacaagtttgtcgagactccaagtgtggacgaatgttgctcgatgttgggtgtgggtgagggcctcacgccggattggtgggggcacttctcggcctcgcaggagggtgcaaccttccgctacttccagagagcatgtcccagttattgtgatcctttcccttttgcttctagggacgacgttctaaaatacaagtcatctctcacttcagcggcaagtgtcgctacgcttcaacgccaggcttgcgagagtgatgacttctcgttcttgagggcggtgccttgtcgttcgcccttattctttatgtacaagtatctgtttgaggtcctggctactagtgtcgtgactaatggcatgccattaatgttcaataaggatggggagccctacttcctgatctattggcagtctgaccctaccaggttcaagtcgtatgacgaggatccattgacccttgtggaaagggtcagacctatgggtgggactgtgtcattgtctgtgaggagtaaatttaacttgcccctggttaaagatcttgccaacaagtgtaggggtaggtcgcttgacctgctgagtttctcctctgatagttgtgagaaggtcatcttgacctgcgaagctactcctttgatggttatgaggagtaagtacgacttccacctgattaaaggattaccaagcacagagcttggatttgtcgagtcttatgtgcaacataggtgttatgctcttgcattcatggcactcgccgtgagtgacatgtactggagacataatggggagagcgacagtggtggggtgttggagagggtaacgaaggctcaaaatgccacactagaagatacaatggcaatcacatggagtctctatgaagaagcatga

SEQ ID NO: 72282 - DNA, 252 bp, Glycine max
  Peptide Sequence Number=SeqID_163967
atgtcacatgagccaaccatcactaacggagagaggcagaaaagaaaggccaaaagaagtgaaatcttatttctctcatctttcaaggaaatcaaagtaacggagagaagttcctatagagaaaggtacaagtcttcctatggagaaagatcaaggagttgcggaaacaggtcgactgtagatcaaggtgctattgaagatgcagattttgcaatgtcgttgccgcacgcaaatggtggcacaatcaaataa

SEQ ID NO: 72283 - DNA, 2502 bp, Glycine max
  Peptide Sequence Number=SeqID_163968
atgcagagggcatttgagatatacccatactgtgcaatggctctgaattatcttgcaaatcatttcttcttcactggacagcattttttagtagaacaactgactgaaactgcattggctgttaccaaccatggcccaacaaagtctcactcttactacaatttagcacgttcatatcatagcaagggagactatgacaaagctggggtgtattacatggcatccgtcaaggaagtcaacaagccccatgaatttgtgtttccttattatggtttgggacaagtgcagataaagttgggagattttaaaagtgcactctcaaactttgaaaaggtcttggaagtgtacccagataattgtgagacattgaaagcgcttgggcatatatatgttcaacttggtcaaactgacaagggccaggactttattaggaaagctacaaaaattgatccccgtgatgcccaggcgtttcttgagctgggagaattgttaattctttctgacacgggagctgcactggatgcattcaaaactgctcgtactctatttaagaagggaggtcaagaagtaccaattgaattactcaataatattggtgtgcttcagtttgaaaggggggaatttgagcttgctcaacaaacatttaaggaggcactaggtgatggtgtttggctatctttcatcaacgaggaaaagaagtcttccattgatgctgctacttctactcttcaattcaaggacatgaaattatttcatgaccttgaaagcaatggtcaccatgtggaagttccttgggataaagtcactgtactctttaacttggctaggttacttgagcagttaaatgattctggaactgcaagcatattgtatcgccttgtcttgttcaagtatcctgactatattgatgcgtatctgaggctagctgcaattgcaaaagctcggaacaacattctgttaagcattgaactggttaatgatgccttgaaggtgaataacaagtgtcccaatgcattatctatgcttggtgagttggagttgaaaaatgatgattgggtgaaggcaaaagaaactctccgcgcggctagtgatgcaactgaaggcaaggactcatatgcctctctttctctgggaaactggaactactttgcagcagttcgcaatgagaagagaaatccgaagctagaagctactcatttggaaaaggccaaagaactttataccagagttctgattcagcattcttctaatttatatgctgccaatggtgctgcggtagtcttagctgaaaagggccattttgatgtgtcaaaggatatctttacccaggttcaagaagctgccagtggtagtgtttttgtccagatgcctgatgtttggataaatctggcgcatgtttattttgctcaggggaattttactttggctgtgaaaatgtatcaaaattgcttgcggaagttttatcacaacacagactctcaaatacttctatatttagctcgtacacattacgaggctgaacagtggcaagactgtataaaaactctactgagagccatacatttggcgccctcaaactataccttaaggtttgatgcaggggttgcaatgcaaaagttttcagcatcaacactacaaaaggcaaagaggactgcagatgaggtgagagcaactgttgcagagcttcaaaatgctgttcgtgtatttagtcagttgtctgctgcttccaacctacatattcacgggtttgatgagaagaaaattgacactcatgttggatactgcaaccacttactttcagctgcaaaagttcatcttgaagcagctgaacgtgaagagcagcaagtacggcagagacaagaacttgctcgtcaggttgcatttgctgaggaagcccgtcgaaaggctgaagagcaaaggaaatttcagatggaaaggagaaaacaagaggatgaactaaagcgagtgcaacaacaggaggaacattttaggcgtgttaaggagcaatggaagagcagcagtcattcaaaacggagagaaagatcagatgatgaagagggaggagggactggtgagaagaagagaaaaaaaggtggaaagcggagaaagaaggataagcactcaaaatcgcgctatgacacagaggaacccgaaaatgatatgatggatgaacaggaaatggaggatgaagaagctgacataaactacagagaggagccccaaactcagatgaatgatgatgctgaggaaaatgctcagggtcttcttgcagcagctgggcttgaagattccgatgcagatgaggaagcgcctgcaccttcctcaagcatagcccggcgaaggcaagcattatcagaatctgatgatgacgaaccattaatacaaaggcagtcaagtccagcaagagaaaactctgctgatatgcagttgagtgatggagaaatcagggatggggataagacaaatggagatgatggcagtgaagaggagaaacaatattag

SEQ ID NO: 72284 - DNA, 390 bp, Glycine max
  Peptide Sequence Number=SeqID_163969
atgatagcaggtggcggtggcgacgacagtgacggttgtggtgatagttgcaaagacgacaatagtggtgacaatgacactagtgatggttgtgatggtggcaacgagacaataatggtggtggttgcggtggcggcaacgacaatagtaatgatgtttgcgacggtgagtggtgatagcaacaatggtaacattttttatgataacgatagtggtggtggtggtgatgataataatggagatggtgattgcggtggtgacaatgatgactacaatggcagaagtggtggttgtgtggtggtggtggtgacgatgatgatggtggagacaatagtgagagtagtgaaagcaatgatggcggtggttgttatggtgacaatgggggactga

SEQ ID NO: 72285 - DNA, 387 bp, Glycine max
  Peptide Sequence Number=SeqID_163970
ggtgaagggactaaggctttgctcgttagaatcctctcctcatgtcgcgtccagactccagacacagacttgtatatatcatggctttctagtttctatacgaaaaattatactgtaatgttgaaaatagctacatgtatcatacttgcatggcatcatataactgttagcattatgcttctaagtttcttggaaaacatagaagaaggatcctgtgatgctagaaagaatgcttgggcttctgatcttgacaatgccaaaaggagagtctcgactgattttgacggtttagagaggagatcactgatgctgcgaagggaagtaatgttaatagagttggttgcaatggaggctgtttttggatcgaacttcttagagatagactag

SEQ ID NO: 72286 - DNA, 3168 bp, Glycine max
  Peptide Sequence Number=SeqID_163971
atgacgacattgactcttaggggcggtgcaatgaaagtgacttgggctatcatattatactgtcatgtatctttggtttataggtcggctaatggaactgttggagctgtaaaatcagatggtgtctctcaacaatcagggttgggcatacgtgtctctaccccaagaagtgacctagaaaataattctgctgtcaatgataggcgggatcgtcctgttaattcagacaaggaaagggtgaatttcagagctgttaataaggcaactgttcgcgatgaatataactcagcgagccctaattcaagtgcaaaaatgaatacaactattcgggcgccacgaactggttcaggagttgccccaaagttgtcacctggtgtccatagagcatctgttccgaatgattgtgagccctcgcaatgtatgaccaagccccctgccagtgttggcactaacaatcgcaagcgtgtggcatccgcacgatcatcttccccacctgttgtccactggcagaggccacaaaagagctcccgtactgccagaagaaccaattttgtgcccattgtatcaagtaatgatgactcccctgctttagattctgtatctgatgtgactgataatgatcttgggttgggatttgtcagacgtttggctggcaattctcctcagcaaattaaattaaaaggtgattctttaacttcagctaccttatctgaaagtgaagagtcaggggtggctgagattaaaccaaaagagaagggaaggaaaccagaggagatagatcagcaagctggaaaaaatgttcaaaaggtttttaacttggtccttccaacaagaaaaaataagcttgtctctggggaagaacatggtgatggtgttcaaaggcaaggtaggacaggacgcaattttcctgctgcaaggtcaccaacgccagtgacatctgagaagcttggaaatatagggactgtaaagcagcttagaagttcaagactgggacttgagaagagtgaaagggcaggtcgtccaccaaccaggaaactttctgatcgtaaggcatatgcacgccagaaacattcagcaattagtgcatcagcagattttcttgttgggtcagaagatggacatgaagaattattggctgctgtaaagggtgttatcaactctgctcgtgctttttccagccaattctggaggcagatagagcctttctttggtttgataaatgaggaggatattggttactggaaacagaagataaatcttgaatcaagtggattgatgccaagtccagttccttcatatatagatgattgtaaagctgttgctaatgggtttgggttaactggctctgaaagagattttgaacctggtgatcaaatgggtgctgcaattgtagcagaacagttacaactagctaaaggagattctaatggaatttccctctgtcaaaggctaatatctgctttgatttcagaggagtgtagcagtgaaagtgaagatatcatgtttgatgcatgtgatactgaatctgaggcagatggagacttggatcaccattctcaatctaattctcatcttgcttttcattctccttataacggttataggataactaggaagtcaggacatgatgagactgaaagtgatatagttgatatcccatcaactaggttaaattcaagccagaacatgcctaccttgatctgttcagagttgcaatatgccaccttgggtatgaatgaaaagcttctcttggagcttcaaagtattggaatttccccagaatcagtgattaagattagtatgcacttattgttcttacttttgtttttcaagcctgaaatattgcaaacagatgatgaaggaatttgtgaggatatcacttggttagaggagcattgccaaggacagatctccaacaggaaatgcttgctagatcggttattgaaatcggcttcagtgacaaaagaacttcaagaaaagtcttattggaaattcaatatcttgattaacagggattttgaacaaaatgctcttgacaaacttgtgatgatggcttatgagaaatacatggtgctagaatttatcatactcataatagtttgtgatctagatttcctaataagacttgaatgggatgttgaggttgcatggctgagtgaattgacaataactgattggcaggctagccggggtcctagctcatcaggtgggaaaaatgcaagcaacaaaatcgccaagcaagctgcattgggatttgttaaacgaacattggaacgatgccaacaatttgaagatacaggcaagagctgcttcaatgagcctttgtataaggatatgttccttgctgcttcttcccagctaagtattgttcggcaattagatggcatagaggctgaatccacaaaaccttgtgcttccttttctctggaagcaagaactgcttccatgggttcacagcagaacccttcacaatttagtcagaatatgaaaaatcatgatctcgattcatcagatattcttcctgctataaatggttcatctgaacaaactagtgggaaggaagatctgtggtcaaacaaggtgaagaaaagggaattgtccctagatgacgttggcggtagcattggtagttcaagtgctccatcaggtattggaagttctctatcaaatagtacaaaaggaaagaggagcgagagagacagagatggaaaaggacagagcagagaggtgctatccagaaatggaactaccaaagttggtaggccagcaatatctagtgctaagggacaaaggaaactcaaaacaaagcctaagcagaaagcaactaagcattctgtttctgtaaatggcctccttggcaagctatcagagcaacctaaaacagctttgccttccgtttcaaagtctaacgaaatgtctactaacagaactcccaaggagaaagatgagtttggcatgggtgaatttgatgaccatgaacctattgatttgtccaacttgcaactacctggaatggatgtgcttggtgttcctggtgatcttgatgaccaaggtgctgatcttggttcatggttgaatattgaggatgatggattgcaagatcatgatgactttatgggccttgaaattcccatggatgacctttcagacttgaatatgatggtttga

SEQ ID NO: 72287 - DNA, 171 bp, Glycine max
  Peptide Sequence Number=SeqID_163972
atgtgtaaattaccttcttgtcctattcttgcaagttccaccaggaaggaaaagggagacatgaattttaaattcgaaaaaggtttctcctctactggcgaagtcaatgttgccaccaccggcagcaccgctgacgatgtagtgatgaagggaggagtgatgagcttgtag

SEQ ID NO: 72288 - DNA, 510 bp, Glycine max
  Peptide Sequence Number=SeqID_163973
atggctaggggtttagagttagggtttgcatggtattcaaagattttagtgattttaaagatcatcaaatttgggtgcatccagcttcatgcaacgaggtttattgggaaatgttgtgttgctataggtcaaatgggaaaaggtgagggattttggagatgcacgatgagctattttttggaggatttcttcgatatttgtggtcatgaggttttggaccatcaactacgaacatgtgatcttcgagatgaaaatcatgatgaagaggatataaattatgtccccttcgatctaggtttgagggcatctcttcaaaaaaactcagtggtagcggggatcagtagtgaggtggtgtttgaaatttcacatgctaaagaaaggactaggggtgatgaaggggatgtatcacaagtggaagttactcaagtggaggaagtggcagattccctggcaaacttccaactgtcaaatccaaaggaagtagagaaaaccacgtctagggaaaaataa

SEQ ID NO: 72289 - DNA, 306 bp, Glycine max
  Peptide Sequence Number=SeqID_163974
gatttcttctgccccgatgtctccccgcttctacttggtcagcctcaacaaaaaattggtgacgcaaatcaacacctaataagtcacccatatcagtcggtcatgaaaaatgaggatgtgtttccgcaacaccaccgaatgaatgttcgcttgcagaagtatcaatgtgatgaccttcgaagggatactgatacatctgtgaaggatactgagaaaatgttgtttcaacacttgactgaagaatgtgaaactcttgtgctggaaattgacgctctgatgctggaccatgtgacacaggctcagtga

SEQ ID NO: 72290 - DNA, 3501 bp, Glycine max
  Peptide Sequence Number=SeqID_163975
atggatttggaagaggaacaggagtacgacgagcaaatgatggaggaagaagacgacgaggaagagatcacgcaggaagacgcgtgggcagttatatctgcatacttcgaagagaaaggcctcgttcgtcaacaactcgattccttcgacgagttcatccagaacaccatgcaggaaattgtcgatgagtcagcagatattgaaattcgacccgagtcgcagcacaatcccggtcaccaatccgatttcgccgaaaccatttacaagatcagtttcggtcagatttacttgagtaagcctatgatgacggagtctgatggagaaaccgccacgttgttccccaaggctgctaggttaaggaaccttacgtattctgctcctttgtatgttgatgtctccaaaagggtcatcaagaagggacacgacggtgaagaggtcactgaggcccaggatttcaccaaagttttcattggcaaggttcctataatgcttcggtctagttattgcaccttgtaccagaattcggagaaggatttgactgagcttggggagtgtccgtacgaccaaggcgggtatttcattattaatgggagtgagaaggttctgattgctcaggagaagatgagcaccaaccatgtctacgtgttcaagaagaggcagcccaacaagtatgcctatgtggccgaagttcggtccatggcagagtcgcagaacagaccgcccagtactatgtttgtgcgcatgctctctcggactagttccaaagggggttcttcaggacaatatatacgtgccactcttccttacattcgaacggaaattcccatcattattgtgtttcgagcattggggtttgttgctgataaagatattctagagcatatatgttatgacttctcatatactcaaatgatggagctgctacgtccttccctggaagaagcgtttgtaattcaaaatcaacaggttgcacttgactacattgggaaaagaggagcaactgtaggtgtgacaaaggaaaagagaattaagtatgctaaggagatccttcaaaaggagatgctccctcatgttggcgttggagaatattgtgagaccaagaaagcttactattttggatatatcattcaccggctactgctgtgtgcacttgggcggagggctgaggatgatagggatcattatggaaacaagaggctggatctggctggtcctttacttggtggtcttttcagaatgctattcagaaagctaacgagagatgtcaggggatatgtacagaagtgtgttgataatgggaaagatgttaatctgcaatttgctatcaaagcaaaaaccatcacaagtggacttaaatactcacttgctactggtaactgggggcaagcaaatgctgcagggactagagctggagtttcacaggtgctgaatcgtttaacttatgcatccactttatctcacttgcgaagattgaattccccaatagggcgtgaagggaagttggccaaaccaagacagctgcataattcacaatggggaatgatgtgtccagcagaaacacccgaaggacaagcctgtggactggtgaagaatctggcattgatggtctacataacagttggttcagcagcatatcctattctggagtttttggaagaatggggcacagagaattttgaggaaatctctcctgcagtgattcctcaagccacaaaaatttttgtaaatggttgctggatgggtatccatcgtgaccctgatatgttggtgagaacattgaaaaagctaagacgtcgggttgatgtgaacactgaagttggggttgtcagagatatccgtcttaaagaattgcgtatatatacagattatggtcgttgcagtcgtcctttattcattgtggataagcaaaggcttctcataaagaagaaggatattcatgctttacaacagagggaatcccctgaagatggcggatggcatgatctagtgtccaagggttttatagaatatattgacacggaagaagaagagactacaatgatttccatgacaattaatgatcttgtacaagctaggatcaatccagaagatgcatattccgatacttacactcattgtgaaatccacccatcactaattctgggtgtatgtgcttccattataccatttcctgatcacaatcaggataccttggcctatgttttatattatccacaaaagccactggtcactacaagagccatggagcatcttcatttccgtcaactcccagctggaattaatgctattgtatccattgcctgttactctggttataatcaagaagattctgtcatcatgaaccaatcgtcaatagaccgtggattctttcggtctctgtttttccgttcatatagagatgaagagaagaagatgggaaccctagtgaaagaagattttggccgtccagatagagctaacaccatgggaatgagacatggttcttatgataagctggatgatgatggtcttgccccaccaggcacacgagtatctggtgaggatgttatcattggaaagaccaccccaatatctcaggaggaggcacagggacaagctttacgttacacaaggcgtgatcacagcataagcttacgtcacagtgaaactggaattgttgatcaagttttgctgaccacaaatgctgatggattaagatttgtgaaagtaagagtgagatctgttcgtataccacagattggtgacaaattcagtagtagacatggtcagaaggggacagtgggtatgacttatacacaagaagacatgccatggactgtggaaggcattacccctgatattattgtcaatcctcatgctattccttctcgaatgacaattggtcagcttattgagtgtatcatggggaaggtggcagcccacatgggaaaagagggagatgcaactccttttacagatgttactgtggacaatatcagtaaagctctacacaagtgtgggtaccaaatgcgtggttttgagaccatgtacaatggtcatacagggagacgtctcagtgcaatgattttccttggccctacatattaccaaagactgaagcatatggttgatgataagatccattctcgtggaaggggtccagtgcagatcctcacaaggcaacctgctgagggacgctcacgagatggaggtctccgatttggagagatggaacgagattgcatgatagctcatggagctgctcactttttaaaggaaaggttgtttgatcaaagtgatgcttacagggtccatgtatgtgagcgttgtgggttgatagctattgcaaatctcaaaaagaattcttttgagtgcagggggtgcaagaacaaaactgacattgttcaggtttatattccttatgcttgtaagctcctcttccaagagttaatggctatggccatagctccaagaatgcttacaaaggaggtcaaaactacaaaccaaaagaagggagcctga

SEQ ID NO: 72291 - DNA, 726 bp, Glycine max
  Peptide Sequence Number=SeqID_163976
atgaataggtcctctaatgcaaatttttggcttgtgaatttcttcattttgagtgtgggagtaaggtcccaactgaccccggatttttacaaaacaacatgccctgatctttatagaatagttaggagagaggttcaaaaagctctaaaatatgagatgcgaatgggtgcttccttgcttcggcttcacttccatgattgctttgtaaatggttgtgatggttcaattctgctggatggagaccaagatagtgagaaatttgctactcctaacttgaattctgctagagggtttgaagttattgatacaatcaaaagttcagtggagagggcatgcagtggagctgtgtcctgtgctgatatattagccatagcggccagagattctgttctccttagtgggggtcccttttggtatgttcagctaggacggagagatggattaatctcaaacgggacactggcaaatcttgcaattccttctccatttgacacactagataccatcatttcaaagttcaatgacgttggcctcgatctcaaagacgttgttactttatcaggtgcccacactactggacgagcaaggtgcacttttttcagcaatagattgttcaactcctcagggacagaagcaccggacagtacaatagaaaccactatgctcactgaatattgcaaaatttgtgcctacaaaacggtgatgagaacacaaccagtgtgctag

SEQ ID NO: 72292 - DNA, 1305 bp, Glycine max
  Peptide Sequence Number=SeqID_163977
atgggtgatagcagtgttccatctgggtctccaaatgcaaaatcagatcttgttgacagagacttggcggtttccaacaacgcgtcgtcgttggaaaccattgtgcaaagtttccaagattcaatgtctcttggtaagagacacaagttctgggaaactcagcctgtggggcaatacaaggatgttggggactcaagtttgcccgagggcccgattgagcccccgacacctttgtccgaggttaagcaggagccttacaaccttcccagtgcttatgagtggacaacatgtgacatggactctgaggaaatctgtgatgaggtttatgcccttctcaagaataactatgttgaggatgatgagaacatgttcaggttcaactattccaaggaatttctcagttgggcgttgcgtgttccgggctattaccagagttggcacattggcgtgagagccaagacgtcgaagaagttggttgctttcatcagtggcatccccgccaggatcagggttaatgaggaggttgtgaagatggccgagatcaatttcttgtgtgttcataagaagctcaggtcaaagagacttgcacctgttatgatcaaggaggtcaccaggagggttcatttggagaatatttggcaggcggcctatacggctggagttgttcttccaacgccaatcacgacttgtcaatattggcaccgatcgttgaatccgaagaagctaattgatgttgggttttcaaggcttggtgctaggatgacgatgagccgcactataaagctttacaaattgcctgattcaacggttactcctggattcaggaaaatggagcttcgggatgtccctgctgttactcggctgcttaggaactacttgagccagtttgttgttgcacctgattttgatgaaaatgatgttgaacattggcttcttcccaatgagaatgtggtggatagtttcttggtggagagtccagagaatcatgagatcacagacttctgcagcttctatactcttccttcttccatccttggaaatcaaaattactcaattttgaaagctgcttattcttattataatgtttccaccaaaactccgctgacccagttgatgaatgatgtgctgattgtagcaaagcaaaaggattttgatgttttcaatgccttggatgtaatgcacaatgagagtttcctcaaagaactcaagtttggaccaggagatggacagcttcactactacttgtacaattataggattcgtagtgccttgaaaccatctggacttggacttgtgctcttgtag

SEQ ID NO: 72293 - DNA, 1470 bp, Glycine max
  Peptide Sequence Number=SeqID_163978
atggaacctcgtattgggaataagtttcggcttggccgtactaataatcaaaccaatgaagaggttgcaattaagcttgaaaatgtcaagacaaaacatcctcagttgctatatgagtccaagttgtacagagttctccagggaggaactggaattccagatgttagatggtttggagtggagggggattacaatgttctagtaatggatctacttggacctagtcttgaagatctatttaacttctgcagtagaaagctctcactaaagacagttctcatgcttgctgatcaaatgatcaaccgtgttgagtttgttcattctaaatcgtttttacatcgggatatcaaaccagataattttctcatgggcttgcgaaggcgggcaaaccaggtggctgaccctgtttacttgtttactgtattgattttggtctggcgaagaaatatagagatagttcaacccatcaacacattccttacagggtggttgttcttgttacttctcatgttgttacatgttgtcaatgctatattactgttcatcgtcatcttcattaagggagggtgttttcatatgatttcgtcagagcataattatatggaaaataagaatttaactgggactgctagatatgcgagtatgaatacccaccttggcattgagcaaagtcggagagatgatttggagtctcttggttatgtcttgatgtatttcttgagaggaagtctcccttggcaaggacttaaagcaggaacaaagaaacaaaagtatgagagaattagtgaaaaaaaggtttctacctcaattgaggccttgtgtcgaggttatccaacagaatttgcatcatacttccattactgccgctcattaaggtttgatgataggccagattatgcttacctcaaaagaatatttcgtgacctgtttattcgtgaaggattccagtttgattatgtgtttgattggacaatcttgaagtatcagcaatcacagctagctgctcctccagcacgtgccattggtcctaatgttggaactagttcagcattgccaccagctgtgactaatgctgatagacagacaggagaggaagaagggcgacctcctggtctggtttcaggggattccacaaggcgaagaatgacagggcccatcccaaactctgtaaacatttcaaagcagaaaaatccagtcaccacggatgctgcccttaataaggaagccatgttatcgaggcccaatgtcttgggccagtcaagtggatcaagacgagctgctgtttctagtagtcgtgatgcatttgttggttctgatttggatcttcgtactcgtactactgaaactaaccctggaacagcgcccaaaacatcatctgtaagaaatgcttctcatgtcaagagctatgaaactgcagtcaagggcattgagggtttgcaattagaaaatgatgagaaggcacattattaa

SEQ ID NO: 72294 - DNA, 439 bp, Glycine max
  Peptide Sequence Number=SeqID_163979
ggtacatctacttagggattgttatactgagaacaagagaggctacatctcttgtggattagttcaagtggagggtacatccacttggtttttcaaagagaacaagggagggtacatcccttgtggatctttgacttgcaaaggtttttacaaggttgaaagaaatctcaagaactgcaggttgcttggggactggatgccacttgatccaacaagtggtatcagagcagaatctaaaaatctatctactatgtctcttgccacattatttgaaaagttacaggaacatgagatggaattgcaaagactcaatcaaaatgaagaaagcaacaaacgaaaaaagggaatagcactcaaagtctcatcctccatccaagaaggtagcgacaacaaggacttggatgatgaagaagatgattctcaagaaatcaaagactaa

SEQ ID NO: 72295 - DNA, 228 bp, Glycine max
  Peptide Sequence Number=SeqID_163980
atgaaaaactcatccagattgcttcttagcatacagggtcctggttggcatgactcaacacttcatcaaaaagctactctgatctccttaacagaacagaacgtgccacacatgagaagtgcctttgagtcgaagattgtgaggcataggcaccaaaatgaccccacaacagtgcgaaagcttctagaggaggatttatcgcctgccgatgaaggcgagggattatga

SEQ ID NO: 72296 - DNA, 537 bp, Glycine max
  Peptide Sequence Number=SeqID_163981
gctgaagttgcggagacattacagtatatagtgtcaccacatgggaggaacacatggacagttgataatctcgtgccttatgtggagaagataacgattttatccaaagagcaagtgagaatcattgagcccgtgtcacatggtccagcatcagagcgtcaatttccagcacaagagtttcacattcttcagtcaaatgttgaaactcagggtataggcagacgaagggaggctgttgaagcagaagaatattcgcaacaaatggtggaccgtggccatggaatgtattacacgccaccaacattttctcagtatccttcacagatgtatcaatatcctttcgaaggtcatcacattgatacttttgcaagcgaacattcgttcggtggtgttgcggaaacacatcctcatttttcatggccgactatgaccccttcacagcaacatgatgtcccaattgtaacacctaacgccagaagaaatcctgatcgtcaagagaatgattttgcatgtgtgttagccacggcgaaagtttag

SEQ ID NO: 72297 - DNA, 413 bp, Glycine max
  Peptide Sequence Number=SeqID_163982
ttggttccacaattgatgtgcaacagaaaattctaactgagttgcatctttacaagattgatgttgaacactttggttctaagtttgcaattgctcaaaggaaaacacattctcctaagattgatgaagatgatgataatgatgctggaaatgatttggtatttgaagacgatgatgcactaaattgggcaactgtgtatgaggcttcgggggttggagagcgtaggatgaagcaaaaagcagtccaagaaaatgatgaggatctagagtttgaggatattgaacttgaatatgaagaagaagaaatcatagttaattttgaggcatcttatggagaagagggagagggagatgctccaataccttatgataacaatgaagaggattatgttgggattgaaaaagatgattag

SEQ ID NO: 72298 - DNA, 1184 bp, Glycine max
  Peptide Sequence Number=SeqID_163983
atggtggttctggaaagtgaatctaattatgaggtgataagaggtggtagattgaaaacaaagcaaccaaataacagtttttctcaagatgacattgttttcatcaaggaagtgactaatgtgaaagaggacaaagttaggattatttttaagggtattggtccacaaccgttcttgaaaaatatattcaaaatggtgaaggattctaatacaaacccaattgtgtcacggggtgaagctagctcttctgaaagggaagagataaaaataatggttcctgaaggtgaattcaatcatgaggtaataggaggtggtagattgaaagcaaagcaatcaaacaatgttggttctcaagatgacattgttttcatcaaggaagcgactaatgtgaaaggagaggttcagtgtgttgagttaaagcaacatcaaatattggctttcctcacaaaaatggttcaaaggtttgatagtgttgagaaattaatgcaagaggtgaagcaagaagatggacttgataggcccaacatggttaagggacacaaattgtcaagcacgaacaccaccccaaatgttggttatgaacaacaagggttaaagattaatgattatgatgtgtcacatgcatatgatgttctgttagaaggagactttagagcctggttccgccgtccgccaccgtccgccgctgtcgccgccgtcatcttctccggcgagaccaggcttcgtgtctcttccggcgcgtgtagttcacgcgccgccgtgccgtcatcggaatcttgtccgagttgctccagcagcctcgtcggcacctcgtggctgccttccaagtggtggttttctgttttgacaagcttgtgtgttgagctgtggttccttggccaaggataccatgatcatttggaaaagggtattgatactgttccaagtgacagaaaatctgagtgggagaagctggattatcagctatgtgctgtcttgtggcaatcaatcgaggcggatgttttggagatccttagatcgttcaaaacatgttgttctttttggaagaaggccagagaaatctttgccaatgatattcagagtttgtttgatgcaactatgaaggtcacaaccctcaaacaaaccagccacgacatgattgcacacataggaaaagctcgggctgcagtggaagagttgaagag

SEQ ID NO: 72299 - DNA, 756 bp, Glycine max
  Peptide Sequence Number=SeqID_163984
atggcgagtctgcttcgcaacgctaacatttccctcctcaaacgttctctcttccactctgaccttctaacgcgcttttgctttaaaccaggagtattgggcacgtctcaagttttgagcttttcaactcgtaaaaggaggtctaaatcagatggaagtgactcaggtgaagagaacttgtctaagaaagatttggcattacaacaagctattgatcagatcacctctgcatatggaaagggatctatcatgtggcttggtcgttccgtggcaccaaaaaatgtacctgtggtgtctactggttcttttgctctggatatagcacttggggttggaggtcttccaaaggggcgtgttgtggaaatatttggtccagaggcttctgggaaaacaactcttgctttgcatgtgattgcagaagcacaaaagcaaggagatttacactttacaatttacatctacaatttcaacttgtcttttgtaaatatgaccacaacagtaataagttccgtcattaaattctttgtaagacttgaatatagccggagaggattgaatggaaatcctttaagtgtgttctccacacttgggctctattatattagaaaacttagcttactcagtaagctgaagagaggtaagtacaaaagatacaaagctctaaacagagcaggtaaacaacaacaacaacaacaacaacaacaacgccttatcccactaggtggggtcggctacatggatcaacttccgccataa

SEQ ID NO: 72300 - DNA, 366 bp, Glycine max
  Peptide Sequence Number=SeqID_163985
atgaaggcagcaacagcaggtggaatcgtaggcttaagtggcgatttgatgttggaggaaatcgcaagctttagtggagatttgagtgaagctttcccagaacaagaacgtgttcttccactttcagttttctcaaaacttgtatcaatgacatcttttttgtcatgttcatcaaatatacaaagtaagtctggtccaattgatgatgacgttttatggatgcaaaccaagcatgtttcagaacatatttggaatgagaaagacgacagaaaattacacatcaaacgagttgtccccacgtatcaaggtcaagaagaaataccagaggaaattattcctctacttcggcaatttggtttttactga

SEQ ID NO: 72301 - DNA, 918 bp, Glycine max
  Peptide Sequence Number=SeqID_163986
cttgcagatgtctggtcatgtggagtaacgttatatgtgatgctagtgggagcatatccttttgaagatcctaatgaaccaaaggactttcgcaagacaattcagtcttttattttaacttggtttattttaacttacaatttctatcttattctgaaaattttccgaaatgttgatcaccacccagcttttgttgttgtatataacatggatacaactgaaattctatcattttatcagaattcaccagacgagctttatctgttgtttgagcagttctgtgaccacttccatgcaacatcaaggaattcaatgtatatgaatttcatatcttctcattcaaataatatccacgcactggaacagctccggagcattaaagataaggcaagcagctctgcagttttgcagtttgtgaagaatatttttgaatcaagattcattgctgacaaagccattgcagaaattgaggcaaagtgtggccaaaaaattgaagaatgcaaagaagaacaaaggcagcagttgatgcgcattgaagatgaacacacgttgctcatcaaagcattgaggtgtgaacttgaagatgagtgtcagaagctggaagaggagttgcatcttcaaaaatccaaagaagacagacaaagggctttgttgcagttgcagttgaaagtgatgagtgacaagcccaaagaggaccaagaaactctcagtcatagcctctgccagggaataaataccttgaattcaaatgtcaaatcagacactgcattcaaaggcggttattacataataaccgtctttgaatctcgaggagatgtaacattcaaaggcggttattacataataaccgtctttgaatgtcgaccagacgtaacattcaaaggcggttattatgtaataaccgtctttgaatgttga

SEQ ID NO: 72302 - DNA, 456 bp, Glycine max
  Peptide Sequence Number=SeqID_163987
atggaagtggcaatcgcgaccatgcagaacgccagaatcgcaattatcacgatcacgattgagatgcgaaatggtggaaactcaagatttcgatttttgatggagaaaatgcatttggctagacgaataaggtggaacccttcgatgaaccaaagcccctatgagctactactcagtctgaaacacgaaggaatagtagaagaatatcgcgaaaagttcgaattatatgcaggtctcctgagaggaacagaacctgagtacttgaaagggatattcctgaatgggttgaaagaggtggtcagggcagagctgaagttgcatccagtaaactctctccctgaactgatggactatgcgcaacgaatagatgagaaaaattcactaatagaaaaagtccactcaatgttgttaatggcggatggcggttcatggcggaaagtcaaaaatccgccataa

SEQ ID NO: 72303 - DNA, 129 bp, Glycine max
  Peptide Sequence Number=SeqID_163988
atggatatttgttgggagtgcaaactctggggcacaaggcgatttcatgaacagaggttaggagtcatattttatggacgtggcttcatgggtcttggcttttgtggcaatatgaagaacaacaactga

SEQ ID NO: 72304 - DNA, 519 bp, Glycine max
  Peptide Sequence Number=SeqID_163989
atgattgcggagacagagccctttggcagcgacgagaatggtgaagaggaggaagaggaaggggtgattgagatttgtgtccctgaccgtggtagtacacacaatagaaagggagaagcgaatgccaaagagaaggatgctagggggtcggaggagagtgtgtggtgcttgttaacgagaaggtggaaagttgccataggaaggggaggcaacgtggtttctactgttggtggaggcagtatggtttttgctgttggtggtggtttagcagaggaagaagatgggttggttaccttgggaagcaaaggcggcataggtggtgactttgcaaaggcagaagatggagagggttgtctgggtaccatggtattcagtatccagagaatgtcatcaagtttggaagcaatggaagtttgggctgcagtagtggaagtttggattgtagcgaggttggccatggtggtctcaagacgatccacacaggcggtggaaagttcggtgtccaccattgaagagtga

SEQ ID NO: 72305 - DNA, 393 bp, Glycine max
  Peptide Sequence Number=SeqID_163990
atgaaaaaaccaaaggctgagaagcaacctattcaagtgtcactgcctatgaagggatcaaaggcaccatctttggcaaagcaagtggctactaaagcacagaacaacactaatttatttcctaagaaaatgatttgttgttttaagccaaccagagacatgaagctgggtatgatcgaacttcaagtgtgtgcatatgttttctacaaaattattgaccctaggatttttgaaacatttttccccaacattattgtcgaccctgaggtgatggctaagattgcatccaccatactggataccaacatgttgaatctggtcataattgattttgagaattgggatatacttgagcctaaaggcatcccaaattgtgggaataggtttagatag

SEQ ID NO: 72306 - DNA, 441 bp, Glycine max
  Peptide Sequence Number=SeqID_163991
atgagaaagaatttatatatatccataatagggttttgcttcgggcaccagcccaactgctgcgcctccgatgattcacgccaccacgccattcgcgtttccatgacagagatctatcgcctcaagattatggttagtaccagaggtttggatcggactttaggaaaggttataggaagagttctaggaagagaagtcagtgatgatgatgtccatgaacaacttgaagaagcaactgttgatgatgtagttactgatgtcgagggttttccaggcgggtctcacaacacatcaattttgatggactatgtttatcatgtggcaacgaaaatttggaatggagatgaacgttctgagctaaagttatgctcccatgaaaggaaggttgagaaatttggcaggcctgctccagagattgaaggcttagtggctgccacatga

SEQ ID NO: 72307 - DNA, 1575 bp, Glycine max
  Peptide Sequence Number=SeqID_163992
atggagactcctcctccccaacaaggcgtcgtgaagaagaaggagacaaggggccgaaaacccaaaccaaaggacgaacacgggaagggtttgaaggaaggtaggaaaacacaacaacaacaacaacaacaacaacaacatcatcatcagcagcagcaacagcaacaagatcaaccttcggtggacgagaaatacacgcagtggaagtcccttgttcctgtcctctacgactggctcgccaaccacaacctcactgatggtagtgtgccgaatactctggtgattgcgaattgcgaggttgtgaagcctagggttgctgctgctgagcacatttcgcagtttaatgaagaggcgcggtccccatttgtgaagaagtacaagaccatcatacatcctggtgaggtaaacagaattagggaattgccacaaaattccaagatagtggctacacatacagacagccctgatgtccttgtttgggatgttgaaagtcaacctaatcgccatgctgtccttggagctacaaactctcgtcctgatttgatattgaccggacaccaagataatgcggaatttgctcttgctatgtgcccaactgaaccctatgttctttcaggaggaaaggacaaaacagtggtgttgtggagtattgaagaccatataacatctgctgctacagactccaaatctggtgggtcaattatcaaacaaaactctaaatctggagaaggcaatgacaaaactgctgatggccctactgttggaccacgaggtatctattgtgggcatgaggatactgttgaagatgtggctttctgcccatctagtgcacaggagttctgtagtgttggagatgattcttgtctcatcttatgggatgcacgtgttggctctagccctgtggttaaggttgagaaagctcataatgctgatcttcactgtgtggactggaatccccatgatgataatctgattcttactgggtcagcagataattctgttcgcatgtttgatcgccgcaatctcaccactaatggagttgggtcacccatccataaatttgagggtcacaaagctgctgttctttgtgttcagtggtctccagacaaatcatctgtatttggaagttcagctgaagatggtctcttaaacatttgggactatgagaaggttggtaaaaagatagagcgatctggaaaatcaataagttctcctccaggggataaagttgttgacttccattggaatgcatatgatccatggacgattgttagtgtgtctgatgactgtgaaagtactggaggagggggaacgttgcagtttctggttttcgtattggatttgaggatgctcaaggtagagcagatacatgactggcatgggtggggacagtggcaagactgtttccttttcctttctttggcgcagtggggctttggtgatgtggactatgcacttgcagatcaaatatggcgcatgagtgatttgatctacagaccagaagatgaggttttggccgagctggagaaattcaaatctcatgttgtggcgtgtgcttcaaagactgaaaaatga

SEQ ID NO: 72308 - DNA, 1422 bp, Glycine max
  Peptide Sequence Number=SeqID_163993
atgccaggaaccatcatggtttcagtactggaattcatggatcttccattatcttcatcaacattcataagggcttccttggggaaaatagagtaccaagtgaatgacaagggaaacttatccttccccttaactagcctccgcgatgatttgatcttccaaattcttgattctgaggggaatgaaatatcacatacaggtgttcaaataaaattgatattggagaaaggtgttttggaagacaactttccccttggaggtggccatctgcgtttgaagttgcaattcatccttagtgatgaagagcgcgacagaattcgttcattgagacaatctgcattaaagaaaaaacatgatgagcttcttagttccagtagaagaggtgaagaaagcgatagtagaaccgtgattggaaatgctgcattgcccttccgcagaaatgatgaggtctcagaatcaccaaagatacaacatcaacacgaagcagatccccaatcgcgaggtcctgctggttccggagacggcaaagaatctgaaactagaagtgtagttggagctcagcttgagcagaaaaagcagctaaccacaaacattgcagatcaatatagggagtcctcatacacaaaacctgtgtcacaaaatgttactctcactcaattacagcaaaagggtaagaagcctgcttatcagtcatcatctccagatcgatcaccatctgagaaacatcctcagagaggtattggttcggaagaaattgcagttttgtttggctcagaaaaaaaagatgccctgacaagtaatctgacacaacctaaaatagaggaaagtgatcttcagtattctaagaagaggacctcactggggagaattccaagtaatgtgaagaaaatgataagtgcctttgaaggtggattggatcaggataagagacctcagattaaaccacctccaacaaaacaacaagaaagttcaattgaaagaagagattcttccaagactcagcatttggagcaagataagtcaaagaacatagacccagcagacttgcaagaaagggtgaaaagtgcctccctggacatggtgcagttgaaagaattgagcaccttaaatatactgaacagacatattcagatggcagaaataaatccaaataaaagtgtaaggggctattgtggaaagtctagaagattggatttctcaaaaatagaaaatgtggaaaagaatgaagcaaatgatggaactggaactgaggagagcgagtatgaaaagatacaggaaactaaagaatcaaagcccaagacttctgataataatggagatgaaaattctggaggaccatttaatcagaactttgatcctgttaattatatcatatcatgcattaacctccttgtcaaggaatcaaatgcacttcaaaattga

SEQ ID NO: 72309 - DNA, 114 bp, Glycine max
  Peptide Sequence Number=SeqID_163994
aataaggttgggaatcttgggttcaaaacctacactggtgagaatattggctctacagataaggaaagattgcagcagcttctcttagcggatgccatgcttctgcctgtttga

SEQ ID NO: 72310 - DNA, 660 bp, Glycine max
  Peptide Sequence Number=SeqID_163995
atgatgttggtcaaaggttcgtcattgagggagtcatttggaggcgagtctgagattcgtgggtacgatgacatagattttgaagtattgtccaactcccactccttagggttggttttttctagtttgactgatcgttcagcatctacgaggtctagcgacctttcgacttttttgagccaactactggcaaatacggctgaaaaggttgcacccagtgctgaaagagaagtgtctgcctccccaatcatgcttttgaaatacacgtgggttgacggagagcactatgatggatccagagacgtgcctgatcactctccgcatggtctagtcgaatgcgacaccacccacgaagttcatcttggtgtcggcaatgcctgggctcttcttgcattacttcagcaaccgctcgcaggaaatggctcagtggatatcattgatttggctgtcgaagcatccttttttcgccctttttacttccttttacaaaaatttcaaaactggttactcaaagtaacaataaggcttggcatttgttcaggttggcatgtattccccgaggagcggaagacttcttctagacacaccaaatgggttgtcaagtcatcggatttgaccaccatgtcgttcacacagacttccaggtttcgtccaagttga

SEQ ID NO: 72311 - DNA, 360 bp, Glycine max
  Peptide Sequence Number=SeqID_163996
atgtatcatatctgcatgcgggatctcagactcaattatgtccatctgtttgaaaatatttcaaaacaagatgtcggtcgagcttccttgatctataagggtcttcttgatgatggagttgactatttcgatactaatagccattggattatctgtaccggttatgggcaacatgttaggtactcagtgccaagagatcatattgatggaccaaacttgccgaaggtgtctctttcgtttgaaggcagtggccccacccccagtgaagcctatggatatggtttttatgactcacctcggttggttgaaaggtctctcttctctctccctggagtgacttcgactacttcaccttgctga

SEQ ID NO: 72312 - DNA, 373 bp, Glycine max
  Peptide Sequence Number=SeqID_163997
gctgggtgagcgtaggacgaagactgaagccagatcgtggggcacttggaagaacccttcttgtgatggtgggtctaaattcttaagtcttcgaggcactactcgtggtttcttgggagctggagggcacaccaatggatcgtgttttaaggttgttctaaccgtaggaacaacggttcttatgggtgtggtgctgaaagagagacagatatatgaaagagacagggtggaaggtgggggatgttgtgtggggggcatggagatggagcacaaccttgatctgacacaaagtcacatgattagttcagatgctgttcatgtggtggcatccgcaacactccccggcttggtctttgctgatctgcctgactga

SEQ ID NO: 72313 - DNA, 180 bp, Glycine max
  Peptide Sequence Number=SeqID_163998
atgacttttaagggaaacaattttaaaacaaaaaacataaaaatcagtacattgaataatcaaaaagaagttcaatataataagcctaccaagattgaggagctaagcgatcagttgataccagttcctgagccagatatgtattcagcaattagacatgaaatagaagcaggaagctaa

SEQ ID NO: 72314 - DNA, 927 bp, Glycine max
  Peptide Sequence Number=SeqID_163999
atggcattggatatgattgatgttgttcccaggacgaggatggaagaagaaaatatagcaatacaagaagcagcttccgctgggttaaagagcatggagcatctcattcgtctcctttctccttcttcttctcttcacaacaacgttaataatctcaatctcaaccacctcgactgctccgaaatcaccggcttcactgtctccaagttcaaacaagtcatcaaccttctcaaccgcaccggccacgcccgcttccgccgctctccaccccaagcccaagcccaagcccaagcccaagcccaagcccaaactaatcctcaaccacaacctcagatccaacaacaagggttcagtttagatttcgtgaagcccaccattctaaactcaaagcccatcaacaaagacgaaactttgactctttcaacaacctcttcttccttcatgtcctccgtcaccaacgacgccagcgtctccgacggcaagatcggacctttcctccctccctccgccgccaaaccccctctctcctccgcccaccggaaaaagtgccgcgacgccgccgcagcactctccgccaaaccctcctgccactgctccaagaaaaggaaatcacgcgtgaaacgaacgattcgggtgccggcgataagctcaaagatcgcagatatcccaccggacgagtattcgtggagaaaatacggtcaaaaaccgatcaagggctcaccttaccctcggtattattctattccttcttctatcttcatgctgaatcgagggtactacaagtgcagcaccgtgagagggtgtccggcgaggaagcacgtggagcgagcgcaggatgaccccaagatgctaatagtgacttacgagggtgagcaccgtcacgtgctgccgttaacttccgccgccggcgttagtttcggccattga

SEQ ID NO: 72315 - DNA, 1197 bp, Glycine max
  Peptide Sequence Number=SeqID_164000
atgaagttttttttaacatttgacgatgagaaggttaatattgaagcagcaccagcatcccagaatgcctctgaagcagtcattgaccaatcccttgcaacggtttcacatgtaagcaaaaagtctttgatggaaaatggtaaaggacttaaaccatgtaggaaccccctttcacttgaagaggcacatcaatctaaaggtttcatcacattctccttaacaaatggccctgagtatcatatctcacaggcaacacagatagctgatgcagtggtggtagctagaatcttgggagccactcttgtgcttccagacatcaggagtagcaaattgggatatagcatgagccttggagatatttatgatgttcagaaaattattaataggctggatgggttggtgggagtaactaagacactgcctgtaaccaatggaaatccaccaatagtgaaggtacctaacagggtttcacaagactacattgtaaggatagtgaaaccaatatacaaagcaaaggggattgtaaagattgaatcatacttttcctcggttaatccaacaatagcaggaaataagaagaaccttgactcatttgcatgccaagcaatgtttggaattcttcagttgcaagcagagatgcttgaagttgtggactctatgatccaaaaactacaaagttggagccagaactcaaatgggaagttcattgcagtggacttgagaactgagatggtgggaagggagtgtcacaaaaaagatgtctcaggaagaaaactttgttaccagccacatgagataggtgaattcctcaagaagattggattcagtccagagactactgttgtttatgtgactcaaaccaaatggaattctgatcttgatgcactaaaagatatcttcccaaaaacttataccaaggaaactgtgatggcagaagacaagaagggaaagtttctcagatcaaaaagctctgaatttgagaaggtcattgatttctacatatgttccaaaagtgaagtcttcgtgccctctattcctggcctcttctatgctaatgttgctgggatgagaattttatcagggaaaaaccagatacttgttcctgctgaaatagctggtccatcagcttcagcctctgactacatttcttcctatgagtcccaaaagaaccattttgcttatgcatgcttttgttaa

SEQ ID NO: 72316 - DNA, 129 bp, Glycine max
  Peptide Sequence Number=SeqID_164001
atgactttgtcgttgttgaaggcagcgataaattggatgatcaatggcgatgacatgaaattggagtctggacagaaaagtgaaaaaggatttgtaggagaagcacgattgtcaacaagtgtggagtga

SEQ ID NO: 72317 - DNA, 462 bp, Glycine max
  Peptide Sequence Number=SeqID_164002
atgtacattaagtcctggaggaagagtcatgtagacctctttgtcaagatccccatgaagaaaggcgttgtttacgtcgagttgcctgaggtgccagttgtgaagggcagcaagagcaagaatgtcgatgtgagggagaaaggcgggaataagataggacagagtgtaaaggataccgaacattacttgcggtggtatcagcttgagaagggtgatggattgacactaggtgggatgggagagtcaaatttatcggggaaaaagtgggaagtggtcttcatagaagacaatgttacgagatgtagtgatgctatgggaatgaaggtcatatacaagatatcctttggtgtgtggtttgaaaccaatgaagatgcatgggtgggcacgagggtcaagcttttgtctgtgggatttgagggtactcacggagtaggaatgcaattaatcaagtatgctgcatga

SEQ ID NO: 72318 - DNA, 2223 bp, Glycine max
  Peptide Sequence Number=SeqID_164003
atggaagaagacaaaggcgtggcagacaagaaagtgacaaagaatgacgaggttgttctacgaatttcagactctgaagaagccatgcatgcagagaaggatcatagagattctagaagttccctagaagctgaaatcagttccctttctcctcagcacagcacccacataggtaaagggtttacagattcacatggtgaactcacagagcttgagaatctaagaaacaagggtcaagtttcctcagagttggtgacaactacaaagaggttgatgtgtcggtcggaattttcgaagccaaagtccagattggtggagccaccatgtccaaaagacgcaacctttgttgtagaaaaggctcaaatgacaagttccaatttatctgcaaggaattcttccaacaagaatgtttctgaagcaactattgttaccccaagaacccccttgcttgggactccgcgggaagaagatgatgatgatgaagaagtgtacaaggctgcacttattgaaatgaccaagagatcgggtaagaagtatagtgtactgggttttgttgagtggtttgcttttgtttgcataatggggtttttgattgcaagcttgacagatcataagttgcaacattgggaaatttggggtttggaactgtggaaatggtgtgtgttggtgctggttatactatgtggtagattggtcactgagtggtttatcaatgttttggtattcttgattgagaggaacttcttgtttaagaaaaaagttttgtattttgtttatggtgtgaagaatagtgttcagggctttgtatggttaagtttggttcttttgacatgggttctgcttttccaccatgatgtggagacagccagaaagtttactaggattcttaattacattactagggcccttgcttcttgtcttattggagcagctatatggttagccaaaacatttttgataaagctgttagcttcaaattttcaatctacgagattttttgatagggtccaagtatcaatctttcaccaatacattctgaggacactttcaggtcctcccttgatggatatggctgaaacagtaggcaacatgtcgagtagtggtcgactcagttttaaggccatgattaataagaatgaagggaaggaagaacaagtcattgatgtagacaagctcaagaaaatgaaacaagagaaagtttctgcttggactatgaaagggttgattaatgtgataagcagttctgggttgtctaccatttcctatacaccagagagtgcctttgaagatgagagtgaccagaaagacaatgaaattactagcgagtgggaagcaaaggcagctgcttatagaattttcaggaacgtagccaagccaggaaacaagtatatcgagaaagatgacctcttgcgattcatgaaaattgaagaagtggaaaatgttcttccactatttgaaggggcagttgagactggaagaattaagaggaagtctctgaagaactggctggtgaaagtctaccttgaacgccgatcacttgtacattcactaaatgatgccaaaactgctgttgatgacttgaatatgcttgcttctgtaattgtgattattgtgatcactgttgtgtggcttcttattatgggtttcttaaacactcaagttcttgtctttatttcatcccagcttttacttgtggtcttcatgtttggcaacacagccaaggctgtatttgaagctattatatttgtttttgtgatacacccgtttgatattggtgatcgctgtgtcgttgatggtgttcagatggttgtggaagagatgaacatactaactacagtctttctgagatatgataatgaaaagattttctatccaaattcagttctggcaaccaagccaatcagtaacttctacaggagtccagaaatgcaagattcagttgaattttctgttgatgtttctacttctattgaaagtattggagctttaaaggcgaagttaaaagcatatttggagagtaagcctcaacactggtgctccaaccacaacgtattggttaaggatattgagaataactataaggaaaggaacagccgaagatctgaattagtcctggagttaaagaaaattcttgaagatcttaatattaaatatcatcttctgccacaagaagttcatctcagttatgtaaggtcacaagactcagcagcacataccttttga

SEQ ID NO: 72319 - DNA, 491 bp, Glycine max
  Peptide Sequence Number=SeqID_164004
gctgcgcaactgttgggaagggcgatcggtgcgggcctcttcgctattacgccagctggcgaaagggggatgtgctgcaaggcgattaagttgggaacatctgggtggcttgtgctagcagaagagttgccaatgaagaagctctatggagttattcgggttgctgcacctttggctgggattgatgataaacacccaagatggttacatctgcggatccgaccatcttctttacctgttctggatcctgccaagttcaaccccaacaggaaattaaagacaaaagcttttgtcgatggaagatggacattggcgttcagggatgaggagtcttgcaagtctgctttatccatgattcttgaagagattaattttctgagtgacgaggttcacagaagactaaagcctttgcttaaccttgaaaccgcgttggatttatcaggcccagaggaggattcctcttcacattcaacaacacctcccaattcggt

SEQ ID NO: 72320 - DNA, 1215 bp, Glycine max
  Peptide Sequence Number=SeqID_164005
atggattcacaaaactggaaacactctctcctctacatcactttcctcctcgcaattctccacctcacgcagaaccatttctgccacaagctcttcttcgccaaccaaacggtgcgcgtcaagaagaaccccgacctccccctccggttccgttccgacggtaccttcaagatcctccaggtggctgatatgcactacggcactggaactagcgtgacacggtgcagggacgtgttggcctccgagttcgagttttgttccgatcttaacaccactcgttttttaaagcgtatcattctagcagagaatcctgattttcttgcctttactggagataatattttcggatcaagttcacccgatgctgcagagtctctgtttagagcctttggccctgttatggaatcaggacttccttgggcagcagtgttgggaaaccatgaccaagaatcaactatggatcgtgaagagttaatgtctttaatctctcttatggattattcagtctcacaaatcaatccatcggatgatgatctcattaatccttctaaaggtggtgtgatgactaaaattgatggctttgggaattataacctaagagtgtatggtgccccagggtccatgctggcaaacagcactgttttgaatcttttctttcttgatagtggagataggtctgtttatcagggaattcgaacttatggatggatcaaggagtctcaacttaattggcttcgtcgtgtttctcatgaattccagggacaaaagcgggatcctcttcaccctaccgatgctatttccacaatgaaacccccagcacttgcattttttcacatcccaatcccagaaattccacatctgttctacaaagagatcatagggcagtttcaagaggctgtggcttgttcgcgagtgaactcgggggtcttgcaggcctttgtctccatgggagatgtgaaggctgtgttcataggccacgaccacaccaatgacttttgtggaaacttggatggcatatggttttgttatggtggtggcttcggataccatggctatgggaaagcagggtggccaagaagagcaaggattatacttgctgaacttcagaagggaaagaagtcctggatggacgtgcagagaatcatgacttggaaacgccttgatgatgagaagatgagcaagattgatgaacaaatcctatggcagtctagatga

SEQ ID NO: 72321 - DNA, 630 bp, Glycine max
  Peptide Sequence Number=SeqID_164006
atgactatactcgtggatgataaaagacttccgctagaggaggagactaccatgtggaagagactcacacttgagggggagatgtgttgggttacaagtgtgaggtctccttatgtggtggctcgtggtccacaggtgaaaaaggacacattgctaacttgggatgatttgcggcagttccagaatcattcatcacagatggcagccttggattttatggtttcagaagccagtaacacatttgttcctacctatgatgggaacatggcaaaactagtggaaggtcatcgtaggaccatcttattggatcgaaaaaaggtggtagaattggttgatatgcatcagaatggaaccctttcatggattgagtttgcagatgctgtaagacgggttcacgagacgagaattgctcagccaactcggcgaagagttatattagataagccaaaggaggaggactatttctatgccaaccctcatgagtgcctgtgtgaggaaaataactgtgatgacttgctaggtcctcacaactctagtcaggatgtgaaagctgataagcatagggagaactatcttggtcacagtatcaaggctcctgttggaagatggcagaaagacattgcttcatga

SEQ ID NO: 72322 - DNA, 174 bp, Glycine max
  Peptide Sequence Number=SeqID_164007
atgcaagatgatcatataatgatgactgtgtggaagcatttggaacaacaagatgtgagagtatttaagaagggtccacccaaagcaaggaaacttttggtgtctgtgagttgccctacattgctggcaaggacaacaagctttctacccgggaagctcgatgcgcatgcctaa

SEQ ID NO: 72323 - DNA, 393 bp, Glycine max
  Peptide Sequence Number=SeqID_164008
atgattatgccatggtcacatcattgggtccttccaagagaaccccaactccactcccatgccagttggatgagccatccacatgcatcgtccatcattcctactcaaattatggtggtgggtgatgcaatcctatcccccatggcatcctctccaagcttcttatccaaggcacattcttggtggcgaagctccttcttccatggcttattccctagtggatgccaccttctttcacctcttctcctttatctttcgctacatctccatggtggaaaatcaccattgaaggacttcattgaatctcaaagatccagcctccatagaggctccacaagcaagcttccatcaagtggtattagagcacaagagcttcaagtagatgctccttaa

SEQ ID NO: 72324 - DNA, 747 bp, Glycine max
  Peptide Sequence Number=SeqID_164009
atgactgactccaacaaattccacccagctcttgttgtctccaacattaagaaccatatctccatcacctcggagatggaaaacgttcaatacgcgatgtgggcgaaattgttcaagattcatgcacgttctcacaaggtcttccaccacatcgtcccacccgagaaaggcaaggaaagggtttctaaaactgatgaagaaaaggcgtggaataggttgcatgatatattccaagacaataagaattcttgggttgtaactcttgagcaagaattctcccgtaccaacatggaggatttcccaaatgcctctgtgtattgtcaacgactcaagaaattgtccgatcaactcaagaacgtaggcgcacgagtgtcgaataaccgtcttgttcttcaaatggtggccgacctcattgaggcttacaatggggttgcaaccggtaggggtgccgccatggtggctcgcaacactgataactctcaccccctctcaaaaaattcccatcaaaatcaaaatactcatggtgtcacggccgcaatagtggttggcagcagcaatcagagcacaaacagtggcctaccaaacaacgatagtggccatggatgccttgggttcttcaacctagcctatacccctcatccaacggcccagtccccacctcacattgggtcagacccaattttcagaaagcccaacagtgctagacatgcatccttgggccaaaaccaccacaagcctacacgatga

SEQ ID NO: 72325 - DNA, 279 bp, Glycine max
  Peptide Sequence Number=SeqID_164010
atggattgtgaggcagccaccattgccgatccgacttcctcaagtacccgaaacaagttgaatgacgaggcagctcttcgacagacattctccatttcaagagtgatggagaaatggttccttatattggaaatcgcaagagacgaatggaaagaactcttattgttcgtcatggcggtgagaagaagaagaaataagagatggagggaaggtaagaatgattgggacatgattcttgatgttggagacagcaagagcagtgtgaaagatagagtttga

SEQ ID NO: 72326 - DNA, 2250 bp, Glycine max
  Peptide Sequence Number=SeqID_164011
atgaatcttcattgtgcttctcttgctgcaacgatatcttccgtttgctccatcaatgaagccacacacaagtctcgcacgcttcagaagcgagtcaactcggacgcgccaatcaaactcagcaccgagtttctctcccatgactcgctggaacccaccaccaaaccatgcttctgtggaagaagacacttcattgaagctgcaacactgggaactaccctatttccaatacaaccctccagagccaccaacccaccacgtgaatacacggctttgcttaaaaagtttcatccaccaagacctgattggtacgaggagttctatgcttcggttatgaattcagctactaaggattatgaagctgaggttgcaatgtacaagtctcaaatcttcggtaacttgaaggggaagggtctaagaatattggagattggcatcggaaccggtcccaacctcagttattatgccagtggctctggtgttgaggtcgttggtattgatccaaacccgaagatggaaaaatatgctcggtcctcggctgcgtcggctggattgcctacttcaaattttgagtttatacaagctgttggcgaggctataccattaagtgatgcttctgttgatgcagttgttggaacacttgtcttgtgttctgttaaagatgttgatatgacactgaaagctcttgttgctagtgaaattaagactccattagagatgagggttgaaggtggaaaattaggtttattgtgttattctgggaaaatagctaaaacggggtcgctttgttgtgtggcttcaaggccacatgaatcaaatgctggtagtagggactggtccatgggtccaaatgagccctactggcgaacgaattcaagctattcgccacctccgacgaggtgggatttcagatttcagtccgaagggctgccatatgatgtgaatgatggtgttcaactctatgggtcatctacatcatcaattgataaagaaagtagaggctgggtcagaggcaaccacctgtatgatcttcactattctgcttcagatgatactgggattttccttagcagtccatctgacctttctcagggtcctcagtggacgccacctgcaatacaagaaatcagtattgacaattatgaaacttcgactaggaaagattctcatccttctgttgaccgggtatcttttactcccaataaggagggaacatccgtgaatcccaacagtgggggttcaacgtcttctcagtcggaaagtagtgaatctgagtctactgcaaaatcacgtttatcctctcagaggaatttctctaatcttcgttcattcatgtctaagcccattcatcctatgtcctttaatgacctaacaactactagggatgcctttgatcctgcagttacagattttacagagtttgatacttccactccactcagagatggccaccgttggagtagtgccagcagtagtcaggagtttgctgacattactgagtcatttgaattagaaactcctggtcgctcacattttctgtcagatggatttagatgtggtttgtgtgaaagatttctcacacagagatcaccttggagctcccgtcgtattgtgagaagtggagacatgcctacaattggggttcttccgtgttgtcatgcttttcatgctgagtgcttggagcaaacaacgccaaagacacagaaaagcgatcctccttgccctgtttgtgtcaaattggaggaggaaaattcccctgatcaaaggggccacttgagattgaggactggttttccaaggcttaaatcatctcgtgacgatggaccctcaagaccttggggctgtgtacaggtaggtgattgtgttgaaggggctctgcatgcaccgccacgcaacacgatgctcctgcttaatcgaaatcgcattaagaagaacctttctttgaaaggtaacatcggcaaggaatttccaggtaagatgaggaaaaatgggacattttcttcacatctgtttagtggaagctcagctgatggggaagcagtgggttcctctaaggcaactgcaggcccaagtgtgtggaggttcttcttctacttgcactatggacgtcttagtggcagccacctcccctcttccggcaccggcaccggcaccgacattgcttcgccctcctccgggatcaatgcaaaggctggtcaatttgggaccgaagcagctcaaatacttgatttctttactcttattatataa

SEQ ID NO: 72327 - DNA, 831 bp, Glycine max
  Peptide Sequence Number=SeqID_164012
atgtacaaaagggttactcaattacgatctgattccactcagcagaagaatacgcagcgtggttttcctggactttttagccgaaaaaacagtgttatatattatgaaaagaaattagaggacattgaggagaatgtgagattgaagcagttagaggcttcattggcaggagaagtatgtgtaatcgtacaggggcttaccaacctcaatcaattggaaattttatttcccttcttgacaagtattctaaccataaaatttttcagtcaaatagttacgggataccttcccagtcttattcttcagttgtttctgaaattggtgcctcctgccatggagttcctatcctccattcaaggatacatttcacatagtgatatagaaatgagtgcatctagaaaagtgctgtggttcacagtatggaatgtttttttcgcaactgtattttctggctcaattctatctatgttcaataccctccttgatcccaagaacattcctgggaagctggctgttgcagttccagcacaggcatcattttttattacctatgttgtcacgcaaggatggacaagcgtgtcatcagaactcttccgtgtaattcctttcattttcagttggataacgaggcctttcaccagtcaagatgatgaatttgaagttccatctactccataccacaaggatattccaagggtccttttctttggacttcttggtattacatatttcttcctagctccattaattttgccgttcctcttggcctacttttgtcttgcttacatcatttttcgaaaccaggtcagcatttctttggatgttatttga

SEQ ID NO: 72328 - DNA, 228 bp, Glycine max
  Peptide Sequence Number=SeqID_164013
atggctcctgaagttttgaaataccggagatatgataagaaggttgatgtgttctcctttgcaatgagtgagctagttctaaacttcaaattcatgattcttgaaatccttctttggttcagatgcttgaaggtgaacccccgttttcaatttaagaaccttatgatggagccaaatatgtggcagaaggacaaaggccttcttttagggcaaagggttatatcctga

SEQ ID NO: 72329 - DNA, 1188 bp, Glycine max
  Peptide Sequence Number=SeqID_164014
atggaggttagatcagagggtatacaagtgaggtgtgataaacttcagagttctgtgattcctaggacacgtttgagggtttggttcattcgtgtgtgctcaagcattgtggtgtggacgtgtctagttcagttaatgacagtgagtgaactatggcattcacatttaatttcgggaattactaatggtatatatcacatagcccaagttcagcttccaatacaaggggacaatggggttgctcaatcgcctcctgttgttcttcctccaagtgcggtgtttcagatttgtgatatggtaacagttgctcggtttttgaatctcacattggttgttccagagcttgataagacatcattctgggcagaccctagcaattttgaggacatttttgatgtgaagcatttcattgattctttaagagatgaagttcggatagtgaaaagagtgcccaaaaagttcagtagcaaacatggattctctaccttggagatgcctcctgttagctggtcaaatgaaaaatattacttggagcaggcacttaaattcactcctcaaattgagaatttggggcacaaattgattcagatgcttcatgagaagggatcttttgtggcattgcatctgagatatgagatggacatgttggctttctcaggttgtacttgcggttgcactgataaagaagctgaagagctcaagcagctgagatatgctttcccttggtggagagaaaaggagatagtttctgatgagaggagatcacagggtctatgtcctttgacaccagaggaggcagccttagttctgcgagccttaggttttggtagggagacacagatctatattgcagctggtgagatttatggtggtgaacgtagacttgcacaattaagagcttcatttccacaaattgtgatatttatgttgggttacaagtgtgaggtgaagtcccacatcgggtctccttatgtggtggctcgtgattcacaggtgtacccctcgaatctccctaacaattggtatcagagccgatggttcgaccaagtttcggctcagacgagtatacaagtaccgcagatggccagaatgactagcggtacaatgtgccccgtaggtggagcgggatggttaccatgtggaagagactcacacttgaggggagatgtgttgggttacaagtgtgag

SEQ ID NO: 72330 - DNA, 201 bp, Glycine max
  Peptide Sequence Number=SeqID_164015
atgaagaaaggtctcaacattgtttcacttagaagtgatcatggagactctcttgacaaatttgatggaaaggctgatgaggctatttttcttggttactcattgcacgataattcttcaaaagaagatgtaggttttcagcaaaaggattctgctcttgaagatgatatcaaatctaaagaacttcaacaaagcaaatag

SEQ ID NO: 72331 - DNA, 372 bp, Glycine max
  Peptide Sequence Number=SeqID_164016
atggctcttatgtcaactatcgctgctgcagacgtgtatcagctaaagatcgagacatggatcatagcagcgcgagcgtatttgttgcatcttcttggatgcacactctttgctaacaagagtgtcacacacgtgcacgtgatattcttggatacactgcgtgacttgacacagagtgggggttacttttggggcgttgttgcacttgtgcaaatatggggccccttgacagtcattaaccgaccggagagggttgtaggacaatttggctacatccaaactattccgccacatcctgttgcgtcattgttctttgttgacaaaattcatgatagatggatgcagtttggtgagtacattacacctgtatga

SEQ ID NO: 72332 - DNA, 342 bp, Glycine max
  Peptide Sequence Number=SeqID_164017
atggacaaatggctttattcatctgaagccttgaaggttaaaaagatagagttggagattgaatcacaatttatgaatgaagctcatttagaattgaataataccattgagcattcaatccagaaagacaaaaaagaaaaagagatcctttataaaaaagtcctagaactagaaccggaaaagaaagttgctactgctgcaagaaatttcaaggaagctgcacgaatagctactaaagcaaattcattgtgtgttgaaaaagagagcattcaaatagatatggatatgactacattaaatcttgagctactaagagagaaacttggacttgtcaaccactga

SEQ ID NO: 72333 - DNA, 429 bp, Glycine max
  Peptide Sequence Number=SeqID_164018
atgatcgcgccactgtggtggatggtcatcggcaccaagttctggttcgccggttcggtgctggccaaggcccgcgccgacaacctcgaccgcgaggccggcaaggcctgggtcggtggccgggtcgatgccgcacgcgcggccgggatgtccgattgtccgctggttccaccaactctcccccacgtcggatcgctggtgaggcccagccatgacccacctgccctatgtgatcggcgcgtacgccgtgttcgtgctggtgctcggcgcctatgccatcggttcgtggctgcgcctgcgcatggcacgccggttggcgctggcacgccagcagcggcagcagacccgcgccgtcaaacaggaagctgcagcgccgctgtcgacggagctggaacgatgactcctgtacaacgccgccgcctggcctga

SEQ ID NO: 72334 - DNA, 392 bp, Glycine max
  Peptide Sequence Number=SeqID_164019
atggatgggcacattgatgtggccctagtcaaagaattttacttgaacctgtacgaccttgaagacaaatcaccaaaacaggttcgagttaaagggaagttgataaagttctatgcgacatcgctaaatgcctttctagagacaccaccacttatccagccaggggaccagtacccctcatattccatcttctgtaggatgcgcactgatcctcaggagcttgcctccaagctttgtattccagggcacgaatttgttcttaatgctgaaggagcgccctgggagctcttgaggatggacttgaccaccctggcccagacttggagtgtattatcatactctaacctcgccaccacctctcacacgttcgaccttaatatggacagggcgag

SEQ ID NO: 72335 - DNA, 606 bp, Glycine max
  Peptide Sequence Number=SeqID_164020
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcattgttgctaaggtgaacccgaagtccccatcgggcctcagccaaatgaatcatccaacctcagctatggtaggcaaagatttgggaagtacgggcggcccccattatgcacaaagtcaaaacaagcatgccttcccgccatatggcctgcctcccaactatacaccgcccaatgtggcgtacactcccaataagaatacacatgaaattccccatcacaatctagccgacttcgagccttggctcgaatatgccactgaagggcaagcagttggtggtataccccttgaaaacacttcggaaggccctcaatatcacccccagctacacctcttgcattccacgacaagtaaaaaccctcatgctatggcagaaatgggaaagttggatcatctagaggaaaggcttagggccattgaaggaagtgaagattatgcctttgctaacctagaagagttttcctag

SEQ ID NO: 72336 - DNA, 540 bp, Glycine max
  Peptide Sequence Number=SeqID_164021
atgcagatcaatcacatagtcgattctatatccagaacttactcctctatatacagtatctttacagttgagtctgatcattcctacatgactgattttcgaaactactttaattcaacttgcattggtgacattgatataccaaacaacttcattgatatcaactgcaaacatgcaaagatgcacatgcaaatgcatgtacctcagacaatttcaggctattctgacttgggtgatcaggccatggaatgtagacattgcaatgcaaaaatgtggtatgatgaaagaatttcaaaagatagaaatacaacaagtccaaaattcaccttatgttgtggagatgggaaagttgagcttccattattacaaagtccaccgaaatatcttgaacgacttttgtttgatggtaaagcaagtgatagtaaaaattatcagtgtaacatacggacatacaacatgatgtttgcctttacgtctgctggtattaagctagacaaatcaattaatgaaagtagaggacctcctacaattagaatttag

SEQ ID NO: 72337 - DNA, 820 bp, Glycine max
  Peptide Sequence Number=SeqID_164022
atgtcctcaaacggtttcgtacggaaccgcaatctcgcttttcgtcgccagccactgtgggatcggaagtcccttggaacgcaggaaatccggattgaaaagcttcgactgataacgattgccgtagtcgcacagtatcgtcacgattgtatgccccggaccgagctcgcgggcaaggcggattgcgccggcaatgttgatgccggaggagccgccaaggcaaagcccttccttcgtcaccagatcgaacagcaccggcagcgcttccgcatccgaaatcctataggagaagtcaggcgtaaaaccttccagattggcggtgatgcgcccctgtccgatgccttcggtgatggacgagccttcggatttcagcacgccgtgcttgtaaaattcatagagagccgcaccctcgggatcggcaaggccgatcttgatgtcggggttgaagtcgcgcaggccatcggccacgcccgcaagcgttccgccggaaccgaccgagcaaatgaagccgtccaccttgccatccgtctggtcccagatttcgggggcagtcgtttcgatatgggcctgacggttggcgatattgtcgaactggttggcccagatcgcgccgttttcatcggttgcggcaagctgttttgccagccggaccgaaaccttcacgtaattgttcgggttggaatatggggcggacggaacctcgaccagcttggcgccgagaagcttcagcgcgtccttttaaacctggctctgcgtatcgggaatgacgatgaccgtcttgtagcccagagcattggcgaccagcgaaagaccgatgccg

SEQ ID NO: 72338 - DNA, 195 bp, Glycine max
  Peptide Sequence Number=SeqID_164023
atgactgggtggattgtcatcatcaaaaagggggagattgtggaagcaatgacttccaagattattttgatgatgccaaagaatcaagagttaagcaagttccaaagaatcaggagtcaaaaacttcaagaatcaagtttcaaagaatcaagattcaagaataatcaagtttcaagaatcaaaattcaagaataa

SEQ ID NO: 72339 - DNA, 120 bp, Glycine max
  Peptide Sequence Number=SeqID_164024
atgcaaaccgaaattactaaacctcgatccctcgtcaaaccgaatcaatccaagcttcatcctcagatccctcttgttggactaggcccaattgagacagacctcttaggtttagactaa

SEQ ID NO: 72340 - DNA, 165 bp, Glycine max
  Peptide Sequence Number=SeqID_164025
atgaagcaaaataatgtagcattatccacagctgaagcggaatgcatctctgctgataccaaaaatcaaatcgcaaatatcttcacaaaaccactacccaaagatttcttctacaccattagaagagaattaggacttctagatgctagtgacttagacaaatga

SEQ ID NO: 72341 - DNA, 322 bp, Glycine max
  Peptide Sequence Number=SeqID_164026
atgtaccctttcttgttttcagtcaaatccaatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 72342 - DNA, 308 bp, Glycine max
  Peptide Sequence Number=SeqID_164027
atggctccgagaaagatttccacaaagagatctaggaaggacgccgcggccgaagggactagtgccgctcccgagttcgacagccatcgtttcaggagcgctgagcaccagcagcgtttcgaggccatcaagggatggtccttccaccgagagagacgcgtccagctcagggatgatgagtacacagatttccaggaggagatagctcgccggtgttggacgtcgatggtcactcccatggccaagtttgatccggatatagttctcgagttttatgccaatgcttggcccacggaggagggcgtgcg

SEQ ID NO: 72343 - DNA, 126 bp, Glycine max
  Peptide Sequence Number=SeqID_164028
atggcttataggatccatgaagacaagacaatactaagattccctttcaagcaccacctaaagttcaaactcaataacctcaagaagtgttatttagaagatccactagagaaaggaaaaatataa

SEQ ID NO: 72344 - DNA, 1329 bp, Glycine max
  Peptide Sequence Number=SeqID_164029
atgcaggaacgttcgcctggtgtgttcgtggtgagtgccgcgccagcgccggcgaagccgcgcaccccggcccgggccgcatcatcggcgccgtcatccgccacgacgacgtcgctggcccgcgttacggtctcggcctcgaccgcgcgcatgccgcagggcgagaccgccatgcccaataccatcacggtgctgacccgcgaggacatcgcccagcagctggcgctgggttcggatgtgtcgcgggtgctgtcgtcacagatcccggcatttgccccggcgcgcgaaaagatgtccaactacggcgaaaccctgcgtggccgcggcatcctgtacatggtcgacggcgtgccgcagtccacgccgctgcgcgatggctcgcgtgattcgcacaccatcgacccggcgatgatcgaacgcatcgaggtcatccacggcgccaacgcgctgcagggcatcggcggcaccggcggcatcgtcaacatcatcacccgcagtgcgcccagtgagccgggcgcgttcctgctcgacaccaacgtcagctacagcgctgccctgcccagccgccacgacgacaatggccagcgcggctcggccctggtgggcgtgcgcggcgagcagttcgacctggtggctggcctggcctatgagaagcagggcctgtaccacgacggcgagggccgatcgatcggcaccaacgcgcagggcgagctgatggactcgacctcatcgaacgtgttcgccaagctgggctggaacattgccgagggccatcgcctgcaggtcatggccaaccgctacgaactgcgcgggatggacaactacctggccatcaacggtgactatcggaccggtcgcccgaccatttcggtccccggcgatacgccactcgatccgccgatgaaccgctcgcgcgcaggccttcgcggtggatttcgaaggccgctacggtgccagccagtgggacccgtggggcaacaccggcgccaacgccgcctgggaccagacccagaacgaatcggacaagcgcggcttcaagctgacccagagctggacccgcgtcgccgacaccacgctggacgtgaccctgggcctggacggcctgcgcgaccgcacccaccaggtgctgctggccagtggcatgaactgggtgccgcagaccacctaccagagcctgtcaccgctgctgcagctgcactggtggccgaccgatcacctgatgctgtccggcggcctgcgttacgagaagggcgagctggaggtggggtgactacaccaccctgccccgctacggcgctcgcaaggtggctggcggcaagccgaccatga

SEQ ID NO: 72345 - DNA, 768 bp, Glycine max
  Peptide Sequence Number=SeqID_164030
atgggttgtattaattgtaatctcgtgttgtccataagacagttaggtgaccctatgaggggtgtgccatcggaggaaactatcgcgcctttcatcgcgcgagataaagagctagggggaagtagcaatggtgtcataggcggctatcaccaatggttgaagtctagaacgcaagggataacttggctcccaaagctaaagggtcttaatggggaagaggatgacatgcctgaggagagtgaagaggtgcaagctttgaaagctgagctcgaaaagacaagagtggcgaaggtggcaatcactagggtcaggaaagaatgtgatgagctgaaagatgtcaacatgactacggttgaagcgctagagcgggaaacaaaaaaatctcgaaaggaggagtggagcaggaacaagttccgaggggctttatggggcaacagtaacgagctcaaacttagaaaggccgaaagggacaaatcaaggatggaaagcatgatgttagaggataagttaaagagttgccagaggttgaagagaagtttgacagagcagttgagcaaaatggaagagaatatgttgataatcattgatcaatataaagagaaggtgaacctagcggctagtcatgggcagatgttggaagatgaacaggcaaaagtgtcggctttgcaggttgaaagggaagtgagagaagcggtgacagagttattgcataaagtagccatgagatggatggatagatttgatctcactctgaataagagtcaatag

SEQ ID NO: 72346 - DNA, 355 bp, Glycine max
  Peptide Sequence Number=SeqID_164031
gacgtcgaaatgggcacttgcagccaacaaggacagtgtcgatgacactgtatgcgaaaaatacagcattagcaaggagaaatgggcccaattttgtcacagtcgcagagacccttcgtgggaggatatgcagaaacaaaacactgacatggtcattagtttcatccagaagcaaaacactgtccctcaagtgttgtctcgtgggggttatgaatatttagaaaagaagctaatggatgagaagacaaagaaaaaactggaggaagctactaaattaggaagcactgacatggtcattgaaggcatccaatgcttcatttttgttatgaagcaaataaacattcatatatcgtga

SEQ ID NO: 72347 - DNA, 396 bp, Glycine max
  Peptide Sequence Number=SeqID_164032
atgaattttgcagcgaaaagcttgtacgattcaccccaaattccggtgtcatatgctaacttgctcccatatctacttgataatgcaatggtatccataacccctgctaggatttttaagtacaagccattggtcagtttgctcaagcgacctgtgctcctgagttttccaagaccgttcaatcagagattactcgtcttgcacgttggtggggttgccgtaaaacaacatggacaacccttcccttgtgttcaagaatcctctacaacaagagactctcagtctcttaatccctttttagaagtaagaagaagagaagaagaaatctctcttaaaagggatagattgtacaatgaagaccaatcaaaattccttattgaatatgcaagtggttga

SEQ ID NO: 72348 - DNA, 93 bp, Glycine max
  Peptide Sequence Number=SeqID_164033
atgaacggaaaactgccaggaagctacattataaacagaacctcgaagagggttaagcttcgtcctcagagggaaacaacaccagaaatttag

SEQ ID NO: 72349 - DNA, 957 bp, Glycine max
  Peptide Sequence Number=SeqID_164034
atgggtatcactagcgtccctggcgttaaggataaggagttggatatgcaattacgtaaactggccgccgcaatgctggtcatgggagtgaccgctggtctggcgcacgctgaagatgccgccccggccgcaggtcagagcacgctggataaaatcgccaaaaacggggtgatcgtcgtcggccaccgcgagtcgtcagtaccattctcctattacgataaccaacaaaaagtggtgggttactctcaggattactccaacgctatcgttgaagccatcaagaaaaagctgaataaacccgatctgcaggtgaaactgattccggtcacctcgcagaaccgcatcccgttactgcagaacggcacttatgatttcgagtgcggttccaccaccaacaaccttgagcgtcagaagcaggccgccttctccgataccattttcgtcgttggcactcgtctgctggtgaaaaaaggtgggccgattaaagacttcccggatctgaaagacaaagcggtagtcgtcacttccggtaccacctcggaagtgctgctgcataagctgaacgacgagaagaaaatgaacatgcgcatcatcagcgcgaaagatcacggcgactctttccgtacgctggaaagtggccgcgcggtggcctttatgatggatgatgccctgctggccggcgagcgcgcaaaagcgaagaaaccggataactgggaaatcgtcggtacgccgcagtcgaaagaggcctatggatgcatgctgcgtaaagacgacgcatcgttcaaaacactggtagatgacaccgttgcccaggcgcagacctctggcgaagcggcgaaatggttcgatacctggtttaagaacccgattccgccgaaaaatctgaacctgaacttcgaactgtccgacgacatgaaggcgctgttcaaatcacccaatgacaaggctcttaactaa

SEQ ID NO: 72350 - DNA, 1102 bp, Glycine max
  Peptide Sequence Number=SeqID_164035
ggcttcacgccttcactttcagaggactacacatcctagccttccgaggctacacgcgctcaccttcagagggctgcacgccctcgccttcagggggctgcacgcccacaccttcatagggctacacgccctcaacttcagaggactacacatcctcgccttgaggactacatggctacacgccctcgcctttaaaggactacacgtcctcgccattagaggactacacatcctcgcattccgaggactacaagtcctcgccttcagagggctacacgcactcgccttcagggggctgcacgcccacaccttcatagggctacacgcactcaacttcaaaggactacacgtcctcgccttgaggactacatgtcctcaccttcagacgcctgcatgtcctcacactcagagggctacacgccctcgccttcagaggactacacgcactcgccttgaggactacacgtcctcacctttagagggctgcacgccctcgccttcagaggactacaagtcctcgccttcagaggactgcacatcctccccttcagaggactacacgtcctcgccatcagaggactacacggctgcacggcctcaccttcagagggcttcacgccctcgccatcagaagactacacgtcctcgcctttataggactacacgtcctcgccttcataagactacacgtcttccccttcagagcgatacacgcccccgccttcacaggacacacgtcctcacctttagagggctgcacgccctcgcattgagagggctgcaagtcctcgcctttagaggactacatgtcctcgccatcagagggctgcacgcacaaaccttcataggactacacgtcctcgccttgaggaatacacgtcctcaccttcagagggctacacgccctcaccatcagaggactaaacgtcctcgccttcagagggctacacaccctcgccttcagaggactacacggctacacgccctcaccttcagaggactacacgtcctcatccttaaagggttgcacgcccttaccttcagaggacaaaacgtcctcaccttcagagggctacatgccctcaccatcagaggactacac

SEQ ID NO: 72351 - DNA, 145 bp, Glycine max
  Peptide Sequence Number=SeqID_164036
gagatacatggagaaaaatgaagaaacaacaatggaggagaaggtaaagctgaaaattaatggaggctggatctttgagcttcaatgcggtccttcaatggtgattttccaccacggagatgtagcagaagataaaggagaagag

SEQ ID NO: 72352 - DNA, 678 bp, Glycine max
  Peptide Sequence Number=SeqID_164037
atggctgagaagctgacctggcacgatgtgctggctgaagagaaagaaaaaccttacttcgtggaaacgctgaaagcggtagccgaagagcgtgcggcgggcgtgacggtctatccgccgcaaaaggacgtgttcaacgcgttccgtctcaccgaactgggcgatattaaagtggtgatcctcgggcaggatccgtaccacggcccgaatcaggcgcatggcctggcgttttcggtattgccgggcgtggccattccgccgtctctgctgaatatgtacaaagagctggaacaggacattcctggctttcagcgtacgcagcacggctttcttgaaagctgggcgaaacagggtgtgctgctgctgaatacagtgttaaccgtggaagccggcaaagcgcattcgcacgcacgtttcggctgggaaaccttcaccgataacgtgattagcgccatcaacacccatcgcgaaggggtgattttcctgctgtggggatcgcacgcgcagaagaaaggcagcattattgatgcgcagcgtcatcacgtattaaaagcaccgcatccttcgccgctttcggcgcatcgcggcttttttggctgtcagcatttttccaaagccaatgcgctgctgagccaggccggccagacgcccattgactggacgccggtgctgccctga

SEQ ID NO: 72353 - DNA, 143 bp, Glycine max
  Peptide Sequence Number=SeqID_164038
atgagacttttcgcgtctcagctggaagacgctgacatattcggggaaggtgcagatgacgattctcggtcggaagacgctgacatctccggggaagtctcggatggagacgctgacatctcagggaaagtgcagatgacgat

SEQ ID NO: 72354 - DNA, 216 bp, Glycine max
  Peptide Sequence Number=SeqID_164039
atgaaatggaaacttcaacaccccgaccaaaatgaagagaccgacaaaaggaaaagaagcatagcactcaaagcctcctcctcaatacaagaagaagaagaagaaaaatctgatgatgaagaggacttctcactttttgtgaagaagtttcataaagttgtcaaaaatagacgaatggagagacgccataacttcaacaatgggaagagatcttaa

SEQ ID NO: 72355 - DNA, 360 bp, Glycine max
  Peptide Sequence Number=SeqID_164040
atgggtacatcctttgtggtacaagtagagggtacatctacttgggttgttgtaactgagaacaagagagggtacatctcttgtggatcagttcaagtggaggatacatccacttggttgttcaaagagaacaagggagggtacatcccttgtggatctttgcttggaaaggattgtcatcatcaaaaagggggagactgtggaagcaatgtcttccaaggttattttgctgatgccaaagaatcaagagtcaataaaaattcaagattcaagaatcaagcttcaagactcaagattctagaaacaagggaagactcaatcaagataagtactaaaaacgttttccaaaacattgagtag

SEQ ID NO: 72356 - DNA, 828 bp, Glycine max
  Peptide Sequence Number=SeqID_164041
atgcttaggactagaggcttaggtcgtgccttaggtaaggttgttgacagaggtctgggcaaaggagatcgtgatgattctgacggtgctccccagcggcaaaggcctaccgcatcggcacgcaggcaacgggtaccgatcactgttgctgatgatgagccagtggtacctgcagactcgcttgtggacactggtgcaaacaccggtgcagaggctgctgcagatgaggctgagggatttcctggtggacccaccgacacatccatgcttaccgagtatgttgagcatgttgcagccagcgtgtgtatgggagagcaagtgcaaaaattaggtaggcctatccctgccattgaggggctagttgctgggacattactaagtcctttgatcgcgtgttcagtagacaccggcgatcagggacttatatcctcgtttgtagagaggtggcaccgggagacgagtagtttccatcttcctgtgggggaggttatcatcacactggacgacgtggcgtctcttattcatctgcctatcattggcgagttccataccttccaggctctgcacgtcgatgaggcgatgctgatgttggtcgacttactactggtctcagcagaggcagctagggccgagataggacattgtcatggaccgtacgtatgcctatcttggctacaagatatgtatcagtgcagatgtcaagctggatattggacagctgcagctcgtgcatatcttcttcatcttttgggttgcactctttttgctaacaagagtgcaacccatgttcatgttgtgttcttggatgctctgtgcgacctcagttag

SEQ ID NO: 72357 - DNA, 522 bp, Glycine max
  Peptide Sequence Number=SeqID_164042
atggtgcagattaaaataggtatggatgttgcagcttcagagttttacactaaggatgggaagtatgatttgaacttcaagaaacagccaaatgatggagctcatgttcactctgctcagagtcttggtcaactatataaagattttgttaaagaatttcccattgtgtcaattgaggatccgtttgatcaagatgattggggttcatgggcttcattgctcgcttcagttgatattcaacttgtaggagatgatttgttagttacaaatcctaagagaatagttgaggccatcaaaaagaaggcttgcaatggtttgcttcaaaaggttaataagattggtacagtgatcgaatctattcaggctgcacttgacgcaaaggctgcaggttggggtgtcatgataaagactggtggtgctccttgccgaagtgagcaattggcaaagtataatcagcttcttcggattgaagaggaacttggaagtgtgcaatatgctggtgaaacttttagatcaccttag

SEQ ID NO: 72358 - DNA, 153 bp, Glycine max
  Peptide Sequence Number=SeqID_164043
atgtgggatcggcacaggcttaaaggagcactcaaactgggtgtatttaccctcatggcctacactccgaagagtccgtcagggtctctccctcctgattcagttttaactcgtcgccctttaagggtcttagcattaactcgtcgcccttaa

SEQ ID NO: 72359 - DNA, 149 bp, Glycine max
  Peptide Sequence Number=SeqID_164044
atgtgttttcgtgaagaaaatccaagccgaggtgcttccgtaacgtttccaagacgtttctgtaagcgattttgtggaaattcttcatctttcttcatcgttcttcaccgttcttcgttcgttcttcgtcgttcttcggtcttcaaccg

SEQ ID NO: 72360 - DNA, 375 bp, Glycine max
  Peptide Sequence Number=SeqID_164045
atggtgtggaactgtagctatgtagcttatgtggaagggagggatgaggtagacaaaggaacttctaatacacaggcatgttccaagatccatattcctatgcttgactccaatgatccttcctatgttgaatctgatagtgatgttcattttaatgtttctcctcaagcacttgataagctgatgtgttatttccttgcattaaaagtcaatgttcaaccaaacttcaagaatgttgttgttcttagatgctcaaatgacttacatttgatcagtgttgtgatggacatgcttcctgatgctaaggcatgctccaagatccatattcctatgcttgactccaatgatccttcccaagttgaatctataagttga

SEQ ID NO: 72361 - DNA, 360 bp, Glycine max
  Peptide Sequence Number=SeqID_164046
atggaagaagatggagccagtagcagcaactctcttgaggtttttcattccttcatgataaagcctaaagtcaaagaagacaacaagatgccaatatttgcactcaaagcagatggaaggggacctatgactaggagtaggaccaaacagtcagtggataccctccaaaaaatggtagcaggcatacttagcaatgcccaagtggagaaggatgaaggcccaagtggagaaagacgaaggcccaagtggagaaggatgaaggcccaagtagagaaggacgaaaggcccaagtggagaaggatgaaggcccaagtggaaaaggacgaaggtccagaggcagatgcactaccaagatattaa

SEQ ID NO: 72362 - DNA, 801 bp, Glycine max
  Peptide Sequence Number=SeqID_164047
atggctcccaagaaacttccagctaagagtgcaaggaaagaggccactggagaaggttccagtgtggtcccacaggtggagaaggaagttgctaggaggcattggactccacttgtggaatccatggctaagtacgatccagagatagtgatggagttctatgccaatgcttggcccacggaggagggagtcagagacaagcgctcctgggtgaggggccaatggatccccttcgatgaggatgccattaatcagttcctggggcattcattggtcttagaggagggccaacaccgtgagtttagtcagaggaggagccaggcctcgggattcaacgaagaggccatcagccagctactatgtgttccagggcaagactttgccctgagcgtagcatggagacagtttgcagggatcacgtctactagacacctagtggacttggagaagtccaatagggcgctggggtttccagctttgatcatgaacctttgccaattctatggggtgtcgatcactcccaccaagcttatctggcctcccatcagtagggccttcatagagaagaattgcatgcctaggcaggcacaacaacagggttgggcacagaaagagctccagatgcacgtgtacatgcagcatgtgactagccaacaagtggctaatcacagggccacagttgaatggccaggagatgagcctgatcttgagagaggggcaggactcgtaggggccctcggaggtgaggatggagctcaagaggatgatgatatggctgaggtgctagagtacttcatgtga

SEQ ID NO: 72363 - DNA, 211 bp, Glycine max
  Peptide Sequence Number=SeqID_164048
atggaagccacagatttgaatatatgggaagccattgaaattggtcctttcattcctacaatagaagcattgggtagaagactccaagtagattgggctagagatccaagggaaggccctagggttctcatgagccttaggctaagctctagcttctttaggaatcttcttaaggaagcatctcaaggaggtgagcttagttatgagaggg

SEQ ID NO: 72364 - DNA, 346 bp, Glycine max
  Peptide Sequence Number=SeqID_164049
caatggggaggaaggtttgaaggatggttccttcgatgatgctacttttaactgccctcagggccttgcttataatgaaaagaaaaatatactttatgttgcaaacactgaaaacaatgttttaagggaaattgattttgttaatgagaaagttaggactcttgctggaaataggaccaagggctctgattatgttggaggtggaaaaggagactctcagatcaagaagctagatccaaccagcaaaagagttagcaccattgcagggaccggaaaagctggttccaaagatggaacaaccgtaaaagctcaggttggtaaaatattctgtgctattttcaaaagg

SEQ ID NO: 72365 - DNA, 351 bp, Glycine max
  Peptide Sequence Number=SeqID_164050
atgatggaggccatgttaagcatgaagaaaataatggaaagcaatgtggttgtggttgccactacgagtgttgccactgaggtagacccgactcacccaaaggtggagggacttggcagctcaagtagcacctcaatgatggagaaggagatgataacaatgatagtggacacattaccagtgttctactatgagaagttggtgggttacacgccttcaagctttgctgatttagttttaaccagcgaaaggatcgaagtgggtcttagaagagacaaatttaattatcttgctttaatgaatggggagcctggggaaaatggagagaataagaaggagggaggaaattaa

SEQ ID NO: 72366 - DNA, 267 bp, Glycine max
  Peptide Sequence Number=SeqID_164051
atgaggacgaagcttgggagatctgctacaggtgatttaattcccacagatttggagattaatgctacttgcaggagacgaaacgcagagagaattagaaaatttttgcaggacttagaagcagaagcaactccaggagaagaacctcgatcttccgaggcatcttctaggtgtcctattctagggcaatctcatatagatttacttgacgaggttatcatggcagaagagccaaggagagtgaccctagaagattctcaagtctaa

SEQ ID NO: 72367 - DNA, 57 bp, Glycine max
  Peptide Sequence Number=SeqID_164052
atggttggaggtatctgcaaagacactctcaaactcaagttagaggcacaaaggtga

SEQ ID NO: 72368 - DNA, 156 bp, Glycine max
  Peptide Sequence Number=SeqID_164053
atgaagctattgaaggttttatttacacatttctacggcaactttggtgcacagattgttacctggatgaagggggttgaacaaattggtgcatttgtggcttcaaggggtgactttagctttgataatcagcagagatattcaagtagggagtag

SEQ ID NO: 72369 - DNA, 492 bp, Glycine max
  Peptide Sequence Number=SeqID_164054
atggtgacaaaggacgggagtgcgggcaaaaagccaaaggagcatcttccaaaaaggaaaatgcacgggagtcgccaccaacgtttattcgaggaaaacggtgttgcccttgctcctacatatcctcaggcaaaaggtcactttggggcagttgcagctcgccctggcaatctgaaacttagtgctgaagcaatgagctcgcccaagcgagttggtttcttcaccatgaagctatttggtggcccagtctgctatgtaattcagggtgacgaggtgtgggactatggggtttggatttcggatttgatgggagaaatgggtttggattcacatttcgaatctgctcatggagacgtcatcattgcaattgtggagggcagcgcgtgccctttgcgtgcctcggcacctgcgagtaaacctataaggtgcaaggagtttattggtgggatccccctttgggttgcaccactggccgaccctgatcttctgtga

SEQ ID NO: 72370 - DNA, 345 bp, Glycine max
  Peptide Sequence Number=SeqID_164055
atggggcaagtagtccccttatacttatcaaagtccaagaccttaaacttcagaggaatgatgacatcaggcactagtcacaactccgcctccttcaatggccctcagcctttcctctatatgatcaaattttcccctttctaccatagcaaggctcttcccaccataaaaatgcaagggttatggttgtgggtgaaactgagggccctccaaagtgtctggcaggggtacacgaccaactacttgcctatcagtggcatatccgaggtgagggtgactcatgtgccttccccatgggttgagggacctatgccggaccaaattggggttgttggctctcaatga

SEQ ID NO: 72371 - DNA, 405 bp, Glycine max
  Peptide Sequence Number=SeqID_164056
atgatgtacttcgacagtgattttgcttccttttctcttctttctctccaatccttcacctgtggacctcagaacctccctctaagcccttcttcacgcctatttatagcaaaacaaggcatttacggtcatgacagcttgcccaggcgagttgagctcgcccaggtgagttgttacttcatcgtgaagcaaccttgcttgcacaagcgagctagttacttcttcatgaagttatttggtggcccaggcgagcccaaggctagcccgggcgagccagggattagaaaaagcttcgaaatgacccttttgccctcccttttggctatttttcgtattattttccgaaacattgaaaaacctttcggattgcccgagaactggtgtcaaccagctcaattcggctaa

SEQ ID NO: 72372 - DNA, 846 bp, Glycine max
  Peptide Sequence Number=SeqID_164057
atgaaggcttatatgaagggattaccagcagcgttgtaccagacatgtttagatgctttgacgatcactgacgtgtgttggatgccctatggtgaccaccaaggagttagggggtttgacctcatttcttgcttccagggccagcttagatggggtcctattatggtcacagttctaccagaaagggtggatatcgacgacaggtggatgcattactcggaccatctagtagctgcgggtgagatttttgttgtgcctgggcaggcaggtgatgagcccagacatccacctgccccacagcatgaggaatacgtcgagccaggtataccggaggttccagtgggagcagaaggtggactgtcacatgcatctgatccccctagacatgtagtggatggttgtgaaggttgtgaagcgatcgcagaaaggttggagcgtgtgctcaacctaaggatggtcaccgaaggcacagagttacacgagatcatggaagattgcctcaggatctctacgggtaaggagaattttgatggtggtggtggtcacctacaaacacccaaatgctcaattagttacactacacatggcgaacgtgatcaagaaatgaggagttgtattttggaagttgaacagaggtgtttgcatgtccgtgaatgggtgtatgcatttgacgacctaatcagtttatacttgtctagaaagctgagtgctgcagctgtctccatagagttcttcttccttccgccaccgccatcgcgacctccccttcccccttccgccactccccctccccctccctctcccccttcttcctccctcccccgcctcgcccaacgtccactcaag

SEQ ID NO: 72373 - DNA, 795 bp, Glycine max
  Peptide Sequence Number=SeqID_164058
atggcaagtcaagaaaagtgggtcccgtttgcggatatactagctttgctaatctttggggttgtcctctttccgaacgtggacggtttggtggacctagccgcaattgatgctttccttgcatatcaccatagcaaggagagcccagtggtggccatcttggcagacttatttgatacatttgaccgaaggtgtgagaagaacagtgcacagatcgtctgctgcttacccgctctctttattgctcgtgcgtcgaaaaaagaagagtcgatagggaccaacacttggctggggacgaggggttgtattaactataatcccgcacttgccataagacagctaggataccccatgaggggagagccaacggaagacagcctctcgcctttccttgtgagagatttcggcgcgcaaagtctcaaagttgtacaaagagtccacaaggcgtggagaagtccgttgaggaaagataaagaacttaggggcatccgtaatggcatcatcgatggctatcacgaatggctaagagttcatacgcgagggttagattggctctccaagttgaaagttgtcaatgaggagaacttcgaagcttcagaagaggatgaagaaatccaagctctaaaattagagctagggaagacaagactcgccacagaaaaattcaagtcagccgctacaaacatccggaaagagtgcaccgagttacgagaggaaaacgcggccactgcaagagcccttgaacaagaaaccaagagggcccgcaaggaagaacatggtcgagataaattctga

SEQ ID NO: 72374 - DNA, 408 bp, Glycine max
  Peptide Sequence Number=SeqID_164059
atgggtgaagtagaggaggtgcaagaaaaggtgaaggccgacatggaggccatgaaagtgcaaatggccacaatgatggaggccatgatgagcataatggaagcaaatgcggttgtagttgccgctgccagggctattgctaaggtgaacccgatgcccccttctcatatcaaccaaatgaatcatccaacctcagctaggggccctcagtttcgcccacaaccacaacccttgcattttgcggtaggaagagcccctcctgttatggctaaaaaaggaaagttggatcatatagaggaaaggctcaaggacattgcaggaggcgaagattatgcctttgctaacctagaagagttgttcctagtacccgaaggtggtcattcccaagttcaaggtgccggactttga

SEQ ID NO: 72375 - DNA, 255 bp, Glycine max
  Peptide Sequence Number=SeqID_164060
ggaagaacataacgcggaagcggcggctatttgcgctttcatagtcagccccggtgctgtgatctttggcgatcagcgctgcgagtctagctgtaaaggcttcggctttatcaccccggcagacggcagcaaagacgtgttcgtacatttctctgctatccagagcaacgatttcaaaacgctggacgaaggccaacaggttgagttcactatcgaaaatggcatgaagggcccttctgccggcaacgtggtcgc

SEQ ID NO: 72376 - DNA, 213 bp, Glycine max
  Peptide Sequence Number=SeqID_164061
atggcacacagcatgtttgctccgtgccactattttagggaccaacaagggagggagctaaaagggtttttagtgatatttcccaaggtggtcatatctctctcgatggtctctagaggtatcatcccctttgaagaacatattgcagtagtagggactactagcaacgatatgttatcaaagagaaaaactctagatgagggttcactgtaa

SEQ ID NO: 72377 - DNA, 204 bp, Glycine max
  Peptide Sequence Number=SeqID_164062
atgaaagctatgccaagcaagccaacaagaaaaggaaggaagtggtacttgaacccgactaaagacccaagtggagaaggacgaaggcccaagtggagaaaggcccccgagtggagaaggatgaaggcccaagtggagaaggatgaaggcctagaggcagagacattatcaagactattaattgttgctgaagtcccagattaa

SEQ ID NO: 72378 - DNA, 325 bp, Glycine max
  Peptide Sequence Number=SeqID_164063
atgtcactacatgatgttgatgtttgtaacactgttgactacgatattcatcattttcagtccgcagatttggaaaatatgactgacccacctatgtttttcgcatcaggtatgacataccaatttaaggccgtatttcatgttgacaggaatatcattgaggtaccctctgtttatcataaacaatgggctccagattacccgaattatgtggtgttggactacaatggaaagaagcaccatataagagttagaaaatttagtaaccgagtttacattggtgatggtctcaaacacttcaggagggatatgggaatatatgaag

SEQ ID NO: 72379 - DNA, 231 bp, Glycine max
  Peptide Sequence Number=SeqID_164064
atggctcaggaggaggagacttctacaaatcagatcccagagccatccccaacacccatacctaatgatgccataccatctgcactagcatctgagttagaacaacttatctctcaggattcaccagttgctcagccattagaagagaatgagcatgtgattggaagtatgactgaaaatgttagtcagtgtgtcagattgattgtgaaggaatgcattgaccgtatcctg

SEQ ID NO: 72380 - DNA, 393 bp, Glycine max
  Peptide Sequence Number=SeqID_164065
atggcagcccaagaaaatgaagatgaagaatcaaaagatgaagaagacttctcactctttgtgaagaagtttcacaaatttgtcaagaagagaagaatcgagaggcgtcaaaatttcaaccatgaaaaagattccaagaagactctccaattcttagatgctacaagtgcaaccaacttggtcacatcaaagcaaattgcccctcaaacgagcattggcctgagaagaatgagaagaaaagtcatgaagaaagaagatccaagaaggcgtatattgcatgggatgccaatggctcatccaagggttcggagaaggagattaaccttctatccaaggactatgagagcgatgagaacatctctgaagaagactaagcaaaaagcaaaagtctga

SEQ ID NO: 72381 - DNA, 1281 bp, Glycine max
  misc_feature (773)..(773): n is a, c, g, or t
  Peptide Sequence Number=SeqID_164066
atgtctgccaaccatgctgcgtttaacctgatattccgtttcgttgaaaattacgtcagcccgattgccgggcggatctcttcccagcgtcatgttatggctatccgcgatgggttcatctccgcgatgccatttatgattgtgggttcatttttattagtgttcgcttaccctccattttcgccggataccacctggggcttcgcacgcgcctggctgaatatggcgaagcaatttgaaggccagatcctgacgccgtttgatatgacgatgggtattatgtccatctatatttgtgcggccattgcctacaacctgggtaaacactacgtcaaatcacatcagctggatccgtttatgtgcgccatgctgtcgctgatggcgtttctgcttgttgcggcaccgaaaaccaaaggcacgctgcccgtcgacagcctgggtggaacagggatttttacggcgattctggtggccatttactgcgttgagatgatgcgtttccttaaagcgcataatatcggtattcgtcttccggaccaggttccaccgatgatcaaaaactcttttgatctgttgatcccggtgctggtggtggcgattatgtcggtctttaaaccgctggtttccgctgcggattcgctgcctgccattctgctggccgtgctgattggtcatctgctgtggttcgccgggatccacggtgccgctatcgtctccgggatgctgcagatgttctggttgactaaccttggcgcaaaccagaccgcgctgcncgccggtcagcctctgccgcatattttcatggaagcgttctggacgttctttatcgttgtcggtggttccggcgcaaccatggggctggtgttctgctatctgcgcagccgttccgcgcatttgcgctctatcggccgtttaagcgtggtgcccagcctgtttaacattaacgagccggttattttcggtacgcctatcgtgatgaacccggtattctttattccgttcctgctggcgccgatggttaacgcggtgattgcctgggcggccatgaagttggatctgatcggtcgtgttatctccgttgtgccgtggacggcgccggcgccgattggcggcgcatgggcgttgggatgggatttccgcgcggcgattctggtcgttgtcctcgcttgcgtatcggctatcatctacttcccgttctttaaagtgtacgaaaagcaactgctggcgcaggaagctgaagaggcgcagcgcgcggcgcaggagaatgagcagaccgcataa

SEQ ID NO: 72382 - DNA, 258 bp, Glycine max
  Peptide Sequence Number=SeqID_164067
atgatcacgaaccttgttcgtgggagcagaatgacagtggcagggtgcagagataaagggtacatttacttgggttgttatactgagaacaagagagggtacatctccgttggatcagttcaagtggagggtacatccacttggttgttcaaagagaacaagggagggtacatcccttgtggatctttggcttgtaaagaattttacaaggttgaaagaaatctcaagaaccgttggttgcttggggactggatgtag

SEQ ID NO: 72383 - DNA, 69 bp, Glycine max
  Peptide Sequence Number=SeqID_164068
atgagtgatggtttggtggatggctttaaagaacctcgtgctagaagatgctgggacacaacactctga

SEQ ID NO: 72384 - DNA, 618 bp, Glycine max
  Peptide Sequence Number=SeqID_164069
gccccgttcatagacgttctcgcactgttgatctttggaggagtcctttttccgaatgtggatgggttggtggacctggcagggatcgatgcttttctcgcctatcataaccacaaggaaagaccggttgtcactatgctagccgacctatatgacaccttcgaccgaagatgtgagaagagcagtacgaggattgtcaccgttcatgcacagagaaaagaggcgcaaattgggaccaactcttatcaaacaaagaaggagcgtctgtcaactggttccctcgatggaaagaaggaagaaccgaagggttgcatcagttacaatcctgttcttactataagacaacttggctaccctatgagaggggcaccactagaggaagagctcgcacttgtcatttcacgagggttcagtcagaccaatgtggagacacttcggaaggtctgcaaagcatgggaagtggtacaaaagaaggacaaagagctcagaggcagcaacaatgggcccattggtggctacggtaagtggttgaaagcccacgtgcaaggtttggattggctcccaagtctgaggaccgctaaaagggaagaagttgaggcaccggaggaagacaaagag

SEQ ID NO: 72385 - DNA, 183 bp, Glycine max
  Peptide Sequence Number=SeqID_164070
atggattttggagaccagagctgcatacttttgcacaaaattcaagatagtgctctggaggcagcagagaggcagcagctaagcatggaagctagggttcatcactttgagagattagaaagtgactttagcattgggaaatatactgttgccttagaacttgatagaagcatgactaaataa

SEQ ID NO: 72386 - DNA, 336 bp, Glycine max
  Peptide Sequence Number=SeqID_164071
atgagatccagagagggaacatcttccaagttagtgttggccattgttgtttctgattctgatgttgttgtgagtagaaagaagaacagaacagaaccagaatcactatctccaacttcggaccctcccacgcacacgctttcaaaactcaactcgccgtctcttgccctttgtttagctacaaatgttaggtttttcataattgtgaaaccctactgggtcatgatctcggttgagacagtggcaatagcattgatattcagaaggttcggggatcctttcgctatacacgatcggaaccaacgggttgcctatcttgaaagagaagcgcaataa

SEQ ID NO: 72387 - DNA, 1195 bp, Glycine max
  Peptide Sequence Number=SeqID_164072
ccggccgccaccggagccggggcgcgcgtgcagcatgtcaggctgtgcagcgtcagcccagcgtttgacttgcccatggcgcatgatcagcatcagcagcgggctggaacgtagggcggattgccggtttcttaccgccattgagcaacaggtggccgtgatgcgcacttgtgtttgcgccaaggtggccatatgcgccggcacgtcggtccagatatctacccggccagacgccgagcgcctcgccgagcagcgacggcggtatagtcgcacacctctgccgccgcggccgagcgtggtggtgcggccgtttcggctcgctgccgataaagccctgggtgaccaccagcgcttcctgcaggcgcggttgcaactgcgcccgggccagttcgctgagcgcggcgctgtccggcacggcgcggccgaagtgatcgtcggtgcgcatcactttgcgcacgtcgaaccattcggcctgcacgttgcgggcgcgcaggatttcaacgaacagcagggtggacatcagctccccatggctgaccagttcgtcggtcaacgccgtcgaggtggccagcgacgcggcttccgacagcatggcgatgttttccagcaggcggtcgatctcttcgcggatcaccgccggcgccgtgaggcgatcgaggatggcgtactggatgcggcggatctcatcaagccggtagttgcgcttgtcggcctcgcaaccctcggccagggcgaccaacaggttggtgacgcccgccgaggcggacaacaccaccaggcggacctgcgggttggccagcacgacgtcggcgctgcggttcatggcttcaaagtcggcgacgctggtgccgccgaatttggctaccacggtggaattctggggtcaggctacgatacacccagaagcgccccaccttgtcgatcgccctgcgggcgatcccctggtgacaacccaggggattcagcccctgtagtcgataggataatggccggccattatcctacctcggcgtcgctccccctcgggtgccgtcaacggagaaacggctcctctgacactctacctgggcgacgcgcctcttctggcttgcgcaccggcgcgataagcgtacagggcatcgcgggcgtggaaccggcgccaatcggttgcagagaaccgtcttccttttggctgaataacggaataacgccctga

SEQ ID NO: 72388 - DNA, 69 bp, Glycine max
  Peptide Sequence Number=SeqID_164073
atgaacagtagaaaccagtcaaggtacttaggaacggatgcaagtgaggatggagtcacgaccgactga

SEQ ID NO: 72389 - DNA, 532 bp, Glycine max
  Peptide Sequence Number=SeqID_164074
cagcaccaatgtctgtatccgcaaagaatgcatcgactgactttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatgggccgcgtttgtctcattccacgcctgacactcagttccgg

SEQ ID NO: 72390 - DNA, 317 bp, Glycine max
  Peptide Sequence Number=SeqID_164075
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 72391 - DNA, 273 bp, Glycine max
  Peptide Sequence Number=SeqID_164076
atggtgaacaacattttcacaccatctagatacaaagaaatcatcatggtgcagcccaaaccaagtgctggcctaaaggggaaacctcaccaacatgctctcattttcatgccttcttgcattcaacaatcaaaggcttgggtccctaggcctaagtcatattttggcatttaccctaaccccccaaggggatgggggcaatgtggcttgccccatcattttagaacacaacctaggcctaaggccatcccctacaaccccccaattcaatga

SEQ ID NO: 72392 - DNA, 240 bp, Glycine max
  Peptide Sequence Number=SeqID_164077
atgagctatcaagctaggcttagcagggaaggatgcgctaagcgccaacatcattttgttttaaagtcattggaagtgcgcttagcgcatgtagtggcgctaagcctgaatcactcactgctaagcacatgttgcggaaagaattttggtgttgcagaaagtgctaatccccgctgctacgctaagccccaaatgcttactagaagttacaacttcgagttgggcttagcgcgaggctag

SEQ ID NO: 72393 - DNA, 844 bp, Glycine max
  Peptide Sequence Number=SeqID_164078
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaagattctatcttcatgcgaaggatgtccaaatgttcccttgatgggaacaaggggttgtattaattataatcccgttctcgccataagacagcttggctaccccatgagaggagcgccattagacgaaagcatcacgcctttcatcgcacggggtttcagtgaccacaaacgcgagggtactccaaggagttcgcaaggcatgggatgcggcactgtgagagacgatgaggttaaagcttcggaagaaagtgatgaggtacaagccctaaaggcagagcttgaaagagcccgggtagtcgaagagaagttcaagtccatagccatcaaagtctcaaaagagggcagcaatagtgaagctcaagctcccgaagaggtgaaaggaatcattcacggggtcaaaaggcatgatcttgaaggacgagctaaagggaatatgtgggccatcatcgataagtgcaaagagaagctaaatctagcggtgactcacgaacaaaggctagaggatgagtacgccaagatatcaacagaaagggaagcaagggaaagggtaattgattcattgcaccaagaggcaacaatgtggccggaccgatttgctcttactttgagcaggagtcaagaacttcccccattgctagccaaggccaaagcagtggcggacacctactccgcccccgaggagatccacggacttctcagctatt

SEQ ID NO: 72394 - DNA, 384 bp, Glycine max
  Peptide Sequence Number=SeqID_164079
cccgtcccagttaagaagcctacacctttcccttacaaaagtgataaggcggtgccgtggaactatgccgcacaagggcctaacggaaggaagggcgtgtccgtcgtgcatgtaaaggatgatctatcctctgctaaggtcacaaacatatccagtacgagtggcatgactcatagtggccagatcttcgtagcacccgagctaccggtgcagcccaaagacctaaaagggaaagcaaaggcgggcgtggaagagagcgataaggcgagcctgattccgaatgacgaggtcccaattggaaggtttgccaaggaagaggacgacttcagcaaaaacagaatatccgctgaagaaacaaccgagtttctgagaatcatccaatag

SEQ ID NO: 72395 - DNA, 255 bp, Glycine max
  Peptide Sequence Number=SeqID_164080
atgaatgtttacacatatgatataattgtggtccattatcatcaaatccagcaactggcagtagtgcagagtgcaaagtgcagagtgcgaagtgcgacaagtggtgatgatccgcaacttgaagatgcgagttttgaagatctggaatttaagatcagagtgtgtgcttgtactgatatcgtgaaagagcatttccgatttgcagagttaggtagatctcgtgaagttttgggttttgaaaatatggatttatga

SEQ ID NO: 72396 - DNA, 150 bp, Glycine max
  Peptide Sequence Number=SeqID_164081
atgggaaaagaaatactttcacagacagatatgtggttaaagttggatcctctagagcctttgcctgctggaaaacatagagaaactaaaggattagaaacccacccatttattgagaagaaatttagagtgaaggaacaaaaagtctaa

SEQ ID NO: 72397 - DNA, 462 bp, Glycine max
  Peptide Sequence Number=SeqID_164082
atggactacacagagcaaaatttaggagaattctgcaagtttgctgatggaaccggtacattttcagtttctaataagattaatagaataataaagagattgggtagagaccgggcagcaaggtccaaatactacaagtaccctactttatgctaccttttcatgatgaataattggaatccaccaaacctatctcagaaaaatgacgatcgcggattcattcaccgttggatcgtcctaaaatttgagaaccacattagcaacccaattccgagcagtctcaccgttgggaatttcgatatcatgtctgagctaagagaaatacccctcgcattggagaaaaaggaatcgcataaagacagtacaagtgaaggtttcaatctcttctccgtctctctgacgtttgagaattttatcggaacagccagaggaataattggaggaatcccagggaaccgctag

SEQ ID NO: 72398 - DNA, 2145 bp, Glycine max
  Peptide Sequence Number=SeqID_164083
atgacgcttttggccatcaaaatgactagatggctgactcaggtagcggtatggagatttgttggttttgtttcaactattgttggacttgtttgttacggtctcagctcctccttcaactacctatttggagagtggagcttgttgaagatctttctttacagtggttttagtctcttcatctgccttgggaatctgtttgcaaaggtatgtcgaccctcaacctcaacgagtctccgattcaaagctcattcatcattcttggttttgaccatcacatctgtgtattcctattttgctgacaaagctatgaatggaaaaccagatgtatatagcttgatttcatgtgtttcctttgctatcatgtcgttcagcctctcaaggcaaactcagtgtggatttgaagtggatcttttttattttttccttggatgtttaattgtattactcttgaagattaaatttgcattagctgttgttggagtaggattcagctattcccttattattcttcgttcctctttagacaccgcattgcaccataatcttggggcccaagttgatcaactggctagtactactgatacttctgcagtagtgcttttcgttgatcaactgggccgtactgatattgatgtagcagcagtgcaagatatcgttgtcgaagggcaacgggataatgcacaacgtgataatgctagtatgatgcaacaactcatggcttgcattgaagttcttaggcagggcaattcgaatctcaccaacatgcttttggagcatacaaaagaatactttgatgataaatcagaactagctggtgtggaccataactttgtgattgatgcgctaccatctggaaaaatcaacgaccttgaggaaaccataaagctcatggtggacgatggacttgagaaagagtgctgcgatgtgtactgtaattggcggagggaaagcttagagcagtgcataataaatttattacggttacaagggatcaacatcgaggaaaaacttgaacagagggaatttcaatattacattttaagatggattaaagctgtcaatgttgctcataggatactatttcccagtgagcgacgactctgtgattgcatcttctcgaggttctcttctgttgctgctctttgtttcaatgaggtttgtaggggagccctgattcaattgctcaattttgctgaagctgttgcaagtggaagcccttcagagtggcgtttgtccaaaatccttgacatgtttgagacattgcgtgacctgattcctgagtttcaatcgttgtttcctgagtcaatggtaaaggaagtaatgaaagtccatgacaaattaggtgaggcaagcagggtcattttcatgaacatggaaaatgtgattttccatatcccagagaccaaggtaattgccccggcagatggcagggttcacctaatgaccaaacacgtcattcgctacctcgtttttactagtcgggcacaaaagatcttggagcaaattttagaacaataccccaagtttgctaatgaagtggcaaaatctaattcagtttctgatcagattgatcaagtaattaagcgattggagacagaacttgtcacagtgtccaaaaactacgacaagcctgctttgcgttactttttcttgatgaataattggaggtgtgtagagctagaggcaattaagttgagattaaaccttggttgtttccataaagacacaacaaaagtgcaacaaaacctcgaactttatcaaagtagttcttggaatatggtgctaaactttttgaagctagagaacaacgagctagtggagcctaatgcgaacgcagagtcactgaaaggcagcctcaatttgttcaacatgcacttcaaggatatatgtagcactcaatctagatggcttgcctttgataagcagctaagtgaaaaaataataatgtcactccaacacatcttgttgccagcatatgggaacttcattgagaagttgcaagatgttcttggtatacatgcttctgagtatattaaatatggattgtttgatattaaagaccaactcaaccatttgtttcttggaagcatgccaatgaatcagtatctgaaagacaaggaaaaattgttaaagcttgcataa

SEQ ID NO: 72399 - DNA, 294 bp, Glycine max
  Peptide Sequence Number=SeqID_164084
atggtgctagactttttgaaaggtagagaacctcccaatgcacagtctatgaaagaaaacctcaatttgttcaacatgcaatttgaggagatatgtagcattcaatctacatggtatgcctctaataagcagctaagtggacaaataataatatcactacaaaacatgttgccagagtatggaatcttcattgggagaccaactcgatcaacgttttgttacttggaagcgtgcatgccaatgacacagaagatggaagcgaaggagagtcggttaaagcttgtatcaaactaa

SEQ ID NO: 72400 - DNA, 1272 bp, Glycine max
  Peptide Sequence Number=SeqID_164085
atggctgaagaaggaagcagtatggagatatgtggggttcgtttcaactattcttggactactctgttatggtctcagctcctccttcaactctctcttcggagagtggagcttgttgaagatctttctttacactatgcccttattattcttcgttcctctttatataccacgccataccagaatcttggagtccaggatgagcattcagtagtgattgatgtcaattcgctacgtacagataatgctagtatcatgccacaactcatgacttgtatcagggcacttccgcagggcaattcaaatgtcaccaacatgctttctaagcttgtgaaggaataccttgaagataattccaaaccagtagtaattgacagtaactttgtgattgatgcgctaccttggggaaaaatcaatgaccttcgcaaaactataaagctggtaatcggcgttgggtttgcacaggagtgctacgaggtgtactgtaattggcggagggaaagcttaaaggagtgcttaataaatttattaggcttgccagagatcaatgtggagaaaagtagattgttggcatttgaagattacattcttagaagacgtattaaggctatccagacctcgaagcataatggagcgggaacatcttcactttctctgcagattgatcgaataatgaagcatttggagagaaaatgggtggcagagagcaaacatttgggagaaagacggtactttttcatgatgaataattggaggttggtggagctatgtgccgaaaagtcggggttagacgttgattgtttcaaaaaatacacagcaaaaattcaacaaaacctcaaactttatcaaagaagctcttggaatgtggtgctagacttgttgaagctagagaacgatgatcggtttgtggagcctaatgctaacgcagagtctatgaaagacaagctcaaattgttcaacaaccactttaaggatctatgtagcattcaatctagatgggttgcctttgatatgcagctaagggaacaaataatgaagtcgctagaaaacattttgttgccagcatatggaaacttcattgggaggttccaagatattcttggtaaacatgcttatgagtatattagatacggaatgtttgatattcaagaccaaatcaaccatttgtttctcggaaccaagccaatgaatcagtacataaaagagacagagagactcttaaagtttgtatctcaaaccatgtgtagttctaaaaagacttatggggtgtaa

SEQ ID NO: 72401 - DNA, 630 bp, Glycine max
  Peptide Sequence Number=SeqID_164086
atgcctttggagtctgtttccaaagataccacatcataccagaatcttggagtccaggatgagcattcagtagtgattgatgtcaattcgctacgtacagataatgctagtatcatgccacaactcaggacttgtatcagggcacttcagcagggcaattcaaatgtcaccaacatgcttttggagcatgtgaaggaataccttcaagataattctaatctagcagttgatgatgggcgtgtaacatgcgtaaagtctgaagaagttttggagcgaaattctgttgagaatgaaggacacgtgtcagacgatatacatcacatggaagtcaggaaaggcaacggtgatcgtcgtgagttgtactaccattattctgtgaagattggagatgggttagaaaaggagtgctgtgatgtgtactgtaattggcagcgcgaaagcttggaggagtgcttaattaatttatttgaggtgcaagagataaacgtcaagcagaaatgggaagagaaacaattagaagagtacatcattagaagatggattaaagctcttaaggtgataggaatgaggaaatacagcaggagcacaacacagggattttgtttgacagaatccgttagagactgctga

SEQ ID NO: 72402 - DNA, 333 bp, Glycine max
  Peptide Sequence Number=SeqID_164087
atggcttatacaatctacttcatcattttgatgcacttttgcccctttgtcgttgctgttacaacaagtattctagtctttggcgattcaacagtggacactggcaataacaactacatcaacaatttagccaaggaatatcatttgccttatgacactgtccctcctttccttgatccaaatctatcagatgaagaacttctaataggtgttagcttcgcgtctgggggatcaggttttgatgatttcactacggctttaaccggtgccatagcagtagcaaattggatacttcaaagtagggttcgcttaaagctcaagcaaggactttag

SEQ ID NO: 72403 - DNA, 244 bp, Glycine max
  Peptide Sequence Number=SeqID_164088
atgtctggagcgtacgatcaagagggcggctacggaggcgctggatacggtcatggtggtcgaggaggtggaggatttggtggtcgaggcggagatcgtggtggacgaggtggcggccgcggtggcggaagtggtagagacggagactggcgttgccctaacccaagttgtgggaatttgaactttgcgagaagggccgaatgtaacaaatgtggtgctccatctcctgctggtgctaatgacc

SEQ ID NO: 72404 - DNA, 216 bp, Glycine max
  Peptide Sequence Number=SeqID_164089
atgcatgctcggattcaaaaggaagcttgtaaaagaagagcaactcagaagcatgagtcaaaattgaagattaaagaatttcaagttggggatcttgagggaccctttagaatcactgcgacagtgcaaaatggtacataccaacttgaagaacttattggaaaagtcatcccaacgacttggaatgcaacacacttgaagccctacttcaattga

SEQ ID NO: 72405 - DNA, 573 bp, Glycine max
  Peptide Sequence Number=SeqID_164090
atgagtgtgacacctttcttgcatgccatgcttgatccagttttgacaaatccatggaatcaattttctacttggttcaaaaatggtgaccctacaccatttgaaacggcacatgggaagatgttttgggattatgctggcgctgatccgaaacttaatcacttgttcaatgatgccatggcaagtgatgctcgatttgtcactagtttggtgattgagaaatgggacatgtttgaggcaattcctccagctgatgccattttgttaaagtggatattgcatgactggaatgataaggagtgtgtggacatattgaagaaatgcaaagaggccataacgaggaaaggcaaagaagggaaggtgatcatcatagacatggtggtggaggatgagaagagagatgatgaatcagttgaaacacagctcttctttgatatgcagatgatggtgttggtcactggaaaagagagaagcaagaaagaatggactaagttgatttcttctgctggttataacaactacaagataactccagtctttggcttaaggtctctcattgagatctatccatag

SEQ ID NO: 72406 - DNA, 453 bp, Glycine max
  Peptide Sequence Number=SeqID_164091
atgacatactgggcttcatcatcattcaagcatttcaataatcaccacaaggcttttaaccttgtggtcatgggttcgagtcttacggtgataaatctaacgtaccaagttaaaaaggatccaagtccaatacatcgtcaacctcaaagattggtgacttggacttctcctgatggtgatatcatcaagctcaatgttgacggtagcagtcttggcaaccttaacatctctggtttcagaggtatcttgagcaactcgtgtggagaatggctcttgggtttcggtggtaattgtagttttacaacaaatatgcatgcagaacttgtgaatatttacaaaggcttacggagagcatgggaaacagattatcctccttggcataactatgcaaccatccttaacaagattaaagctcttattggtcatcacttatcaatgacaaacttctcttaa

SEQ ID NO: 72407 - DNA, 336 bp, Glycine max
  Peptide Sequence Number=SeqID_164092
atgacacgtcgcctagctcgtcgaggagttcatcgatgtaacattggtgaagagaaaggtctttgcctaattgaatcaaaccgacatcgagcatggatgaaacctgcttctttagttcaactttctgactatgtgggtaacgataaggcttcacgtttactagatttgaattggggaggagatgaatgtgacaaaggttcaatgaataagtcttggaatctggagagaatggctacaatggctggaggggtggtgtcgtcgaaaatgggtgaagaagatgaaggtggggttaggtcgggaacacgggttatgtggaacaaggccgataggaactga

SEQ ID NO: 72408 - DNA, 141 bp, Glycine max
  Peptide Sequence Number=SeqID_164093
atgagaggaggggtgaaagaaagaaagagagtaaatgaaaaccctaggagaggtggttctgtggtgcctcgcgctcagcgccatgtcgcgcctagcgcgcgtcctgcgcttagcgccttgttggacttgagcttcttctga

SEQ ID NO: 72409 - DNA, 369 bp, Glycine max
  Peptide Sequence Number=SeqID_164094
atggctgccaataataacattcatgggaacactgaattgttttgcgtttacagcctcatgcttgatttggtgatctcttctccctggattctgatttatcagattttgcctttcgtttctacttttcattggcctggaacaatcaaagtattatgcatttggggattgttacaatgtcacaggaagaatttgggacagtgtgattgggtggttgactctttgattggtttggagaaactctactgctccttttactgttttcttgataatggtgatgttcatattgcatgttttgaatggttttgcatttacagtctcatgcttgatttggtggtctctactcccttgatttggggacatatggattga

SEQ ID NO: 72410 - DNA, 1311 bp, Glycine max
  Peptide Sequence Number=SeqID_164095
atggaagcagctccatcatcatcaacttgcgcctgcagccaccttgtgaccatgccctaccctgctcgcggctacatcaaccccatgatgaacttctgcaagatgcttctctccaacgacaacaccagattaatcctcgtaaccttcgtcgtcaccgaggaatggctcggtttcatcggctccgacccaaagcccgacattatgagattcgctacaatccccaacgtcgtagcttccgatcacccggggttcctagaagctgtcatggccaaaatggaagcgtcctttgaggagctactcaaccgccttcagccgccgcctaccgccatcgtgtctgatacttttctgtactgggcggtcgttgttggaagccggaggaatattccggtggcgttgttttcgaccatgtccgcgtctattttctttgtgctccaccaccatcaccttttggtcaatttgtcagaaaacggtggcgaacgtgtggattatattcctgaaatttcctcaatgcgggtcgtggattttcctctaaacgatggtagttgccgcagcaagcaattgctgaaaacatgcctgaaaggtttcgcgtgggtttcaaaagcacagtatcttctattcacttccatttatgagctcgaacctcatgccattgatgtcctaaaagcagagttgtcattgcccatatacactattggccctgccataccttattttagccttcaaaacaatcccactttcagcaccacaaatgggactagtgatagctacatggaatggctacaggttctgttctttacatctcacaaaggaagccatttctcggtttcaagggctcaaatggatgagattgcatttgctttgagggaaagtggcattcagttcttgtgggtaggccgtagtgaggcttcaaggttgaaagaaatttgtgggaaccaacactactacaaaagaagcattttaagacgaatgtgcttggttggcatgaagaaaggtgtgacatggtgtgaccaacaattgagagtgttgtctcatccttcaattggaggattttggtctcattgtggatggaattcaaccaaaggtgtgcttgctggggaagatgttaaagtgaatactaccactttggtgaagaaagatgaaatcgcaatgctagtgcagaaatttatggatttggatagtaatcttgcaagggaaatcagggaaagatccgaaactcttcggcagatatgtagtcgtgcaattacaaatggtgggtcagctgttactgatttgaatgcctttgttaaggatttagtgcagacaatacattaa

SEQ ID NO: 72411 - DNA, 849 bp, Glycine max
  Peptide Sequence Number=SeqID_164096
atgaatgttttgtttcactactgcaagccagaaaacggtgacaaacgtgtggattatatccctggaatttccccaatgcgcctcgtcggttttcctctgaacgatggaagttgccacagtacgcaaatatgcctgaaaggtttcgcgtgggtttcaaaagcacagtatcttctattcacttccatttatgagctcgaacctcatgccattgatgtcctaaaagcagagttgtcattgcccatatacactattggccctgccataccttattttagccttcaaaacaatcccactttcagcaccacaaatgggactagtcatagctacatggagtggctacaggttctgttctttacatctcacaaaggaagccatttctcggtttcaagggctcaaatggatgagattgcatttgctttgagggaaagtggcattcggttcttgtgggtaggccgtagtgaggcttcaaggttgaaaggaatttgtgggaacaaagggttagttgtgacatggtgtgaccaacaattgagagtgttgtctcatccttctattggaggattgtggatggaattcaaccaaagaagtaagatgatagtagaggattggaaggttgggtggagggtgaaggaagatgttaaagtgaataatactactttgatgaagaaagatgaaattgttatgctagtgcagaaatttatggatttggattgtgagcttgcaagggaaatcagggaaagatccaaaactcctcggcagatgtgtcgtcgtgcaattacaaatggtgggtcagctgttactgatttgaatgcctttgttggggatttaatgcaggcaacattgataccatga

SEQ ID NO: 72412 - DNA, 1449 bp, Glycine max
  Peptide Sequence Number=SeqID_164097
atgggacctttaataataggtgttaacatacctcaagttccaccaaatttacaacctcaagttcacacccttgtctctatggatgatccaattgaagttccaccaaccaccgccagccacgtggtggcgatgccatacccagggcgaggccacgttaaccccatgatgagcctctgcaagctgctcctatccaaaaactccgacatcctcgtaaccttcgtggtcaccgaggaatggctcggcctcatcggctccgaccccaaacccgacaacatccgattcgccacaatcccaaacgttattccctccgaacacggtcgagccaacgacttcgtcaccttcgtcgaagccgttatgaccaaaatggaagctccctttgaagacttactcaaccggcttttgccgccaacagtgatcatatacgacacttacctcttctgggtggttcgcgttgcaaataagagaagcattcccgtggcgtcgttttggccgatgtcggcgtcgtttttcgctgtgctcaaacactaccatcttctcgagcaaaatggtcactatcctgtaaacgtatcagaagacggtgagaaacgtgtggattatattccggggaactcgtcaattcgtctggcagattttccacttaatgatggaagttggcgcaaccgaagattgttggaattgtccttgaatgctataccatggatgcagaaatcgcaatatctgttatttccttccatatacgagcttgagcctcgagctattgatgctttgaaatccgagttctctatacccatttacactgttggccctgccataccttcttttggtaatagcctcattgatgacattggctacttccaatggcttgacaaccaaccctctggctctgtattgtacatctctcaagggagttttctttcgttttccaatgaacaaattgatgaaattgcggccggtgttcgcgaaagtggcgttcgattcttgtgggtgcagcccggagagagtgataagttgaaagagatgtgtggggataggggacttgttttggcatggtgtgatcaattgagagtgttgcagcatcattctattggggggttttggtctcattgtggctggaattccaccagagaaggagtttttagtggtgttccttttttggcctttccaatattaatggaccaaccactaaacggtaagttgatagtagaggaatggaaggtggggtggagggtgaagaaggaggtgaaaaaggacactttgataacaaaagatgaaattgctaatcttattaagaggtttatgcatttgggtggggatgaagtgagagatatgaggaaaagaagcagagagctgaagcagatatgtcaccgtgcaattgcaagtggtggatcatcagaatccaatatcaatgcttttctcttgcatatattacaggatgccaagcctcattaa

SEQ ID NO: 72413 - DNA, 345 bp, Glycine max
  Peptide Sequence Number=SeqID_164098
atgctggacatcaatgattcggagcttaatgttgcggccgagttgatgaatgacagactccattggttcaatgaacacttcgatgagacgtgcaacattcagttagcatggtcagtctgtgatgaggagttaagagaacaaatagtaaaatccatagaaaacgtcttgttgccagcatatggaaacttctttgaaaagtttcaggaatttcttggaaagcatgtttatgagtacatcaagtatggaatgtttgagattcaagatcgactcaacaatttgtttcttgtaaggaagcagatgagtctgatgccggaagagaaggaaagtctacacaagttagcgtag

SEQ ID NO: 72414 - DNA, 360 bp, Glycine max
  Peptide Sequence Number=SeqID_164099
atgcgggggtaccgtatggttatccgcacctttcatcaaccaggggcaaacgagcccgtcgacgcgcagagactaacatcgtcttccacaccttttgtcatccaaggacaacaagtcaggtggcaggcggagataccttatggtcatccatacctttcgtcaaccaaggcgaatgaattcgacggttttaacttttgtcgtctggagacatttaagcccgacgacgcacgagattcttctttgtcgggcgggcggcgatcaagttcaatggcatggggaaatgtcgtggttgtcccattttatcgctttcaagaaactgaagttttgttcacgcttctgatgtcttttctctctttctga

SEQ ID NO: 72415 - DNA, 474 bp, Glycine max
  Peptide Sequence Number=SeqID_164100
atgaatttcttgacggcacacgataaagggtcggaacaggagttaagtccttacaatcaatataaagaagaaagaactcataatcttgaaagtgtgtttgaagaattcagagcataccatgctagctcaaaagccaatcaaaattcaatgaaaaatcatgaaattcattttggtaagagctactcaatagaaaactttcaagggagaccagagttacaaccttactatcaaaatgaagcagaaaggggtcccaatctggataaattgttgatgcaattcatggaaacaactaaatcaactcaacgagcactccaaagtgtagaaatccaggtaggtgagctagcagaagcactgactcaatttatgtccaaacaagaaaaatactttgtagaagttgaagctcaagagaaaagccctgtaaaagagcatgagtcaagagaaaaagataaggagaaagatgaggaacaagcataa

SEQ ID NO: 72416 - DNA, 424 bp, Glycine max
  Peptide Sequence Number=SeqID_164101
gtcgactctagaggatcccactttttacgtcagtgacaaaaatgccgcaagcattgaattacgcttcgattaccccaccgcaacgctacaagcctcatcgctagacgggcaagggaaagtagtaagcactcaaacgttcatcttgttagccgaatccgcgacgccgccatcgggttcggacacgaagtacttatacctgacgaaaagtggcgagttactgagtaaatggaaaaactgtacgccggatatgagcgtaggctgtagctggggtggacatcaaatatttatcacccacagcgccgacctggtagtgcagcatgcaaccggtggcgcaggtttagcttttctgctgattccattttacaattccgaagcccggttgcagattttcgccaaagtgccaatcggtgctgctgacgagtaa

SEQ ID NO: 72417 - DNA, 393 bp, Glycine max
  Peptide Sequence Number=SeqID_164102
atgcgttcatgggtgaagggtcagtggattccttttgacgcagatgccctcagccagttcctgggagacccgttagtgttggaggaaggccaggagtgcgagttcagtcagaggaggaacagggccgatgggttcgacaaggaggccattgcccagctgttatgcacaccggggcaggattttgcccagaccgctgcagggaggcgggtgcggatcatgcgcactagcatgaccaccttgacccagacgtggatgacattgctgctcagcaatgtcttgcctagcgatcataactccgatctccctctgccgaagtgtcagttggtgtatgccatcctgacatggatgagcgtccatgtggctcaggtatgccacccaccaggcaccctctag

SEQ ID NO: 72418 - DNA, 270 bp, Glycine max
  Peptide Sequence Number=SeqID_164103
atgtctacgagctatctcctcctaaaagtccgtatactcatcctctctgagctagacgcgcctctttctgtggaacgaccatcctttgatggcctcgaagcgctgctggtgctcggcactctggaaatggtggctatcaaactcgggggtggcactagacccttccgctgcggcgcctcttctatacctattcgtggaaagctttttcggagccatttcctgcgaagacaaacgtttggaaagtcaatttacaaggaagtgtcattttaa

SEQ ID NO: 72419 - DNA, 189 bp, Glycine max
  Peptide Sequence Number=SeqID_164104
atgacatccactatttgcagggatcgcacccacaagacacccaatggacccggaaaagtccaacagggccctggggtttcaggctctggttacgggcctctgttagtcctacagggtgcccgtccccccagcaagggatcgcacccacaagacaccctgtggacccggagaagtccaacagggtcctag

SEQ ID NO: 72420 - DNA, 820 bp, Glycine max
  Peptide Sequence Number=SeqID_164105
aggactacatgtcctcgccttcagaggggtacacgccctagccatcagaggactacacgctctcacctttagagaactgcacgtcctcaccttcatagggttgcacgtcctagcctttagagggctgcacgccctcgctttcagaagactacacatccttaccttcataaaactgcacatcctcgccttcagaggactacacgtcctcacctttaggggactatacatcctcatcttcagagagctacacgcccttacctttgtagggctacatgccctcacctttagaggactacacgtccttggcttcaaagggctgcaaggcctcgccttcattggactacaggccctcaccttcagaggactacacgtcctcgccttcagaagactacacgtcctcgccttcagagggctgcacgccctcgccttcagagggctgcatgtcttccccttcagagggctacacaccctcgcctttagaggactacacgtcctcccattcagagggctacacgccctcgcctttagaggactatacattctccacttcagaggactacacgtccttgccatcagaggactacacgtcctcaccttcagagggctgcatgtcctcaccttgagagggctgctcgccctcgcctttagagggctacacaccctcctcgccttcagaggactacatgtcctcaccttcagaggattacacatcctcgccttcagaggactacacgtcctcacctacagaggactatacatcctcgccttcagaggactacacgtcctcaccttcagagaatttaaggtcttctgcccttaa

SEQ ID NO: 72421 - DNA, 391 bp, Glycine max
  Peptide Sequence Number=SeqID_164106
atgaatgttggataccttgaaaatgaggttccagagcttgatggacctggttatatggaggatatctctggtttgttgagtaatgtgctaccatcctcattgaaggatgttaagtgtgtggagagcatattgttttcttccttcaatcctcccccaagatatagaaggaagttgataaggttttctgtgctttttaggcttgttgaagattcattttatttggatgtgacaacgctggagggtaatgtgttttgtataacgggaagtacaaggatgttttatgttaactcgtgcaccacaaagacttttgacccaaggccaagcaaagctacccttgaagcaacaactcttgctactctcttgcaaaagattagccccaggttcaaaaaag

SEQ ID NO: 72422 - DNA, 378 bp, Glycine max
  Peptide Sequence Number=SeqID_164107
atgggaattttcattttgaccggtttccttcggtttttccgacgtttcccacaaataaacgttggtggcgactccgcgcatctttcctccattggaaagcgcacccgtgagccttgcctcgctcgcccgcgaaatggcacgttgcgacagggagaattaaattgtcatcataaaaaaaagggagattgtagaagcaaagattgtgcctttgatgttttgatgatgccatatgatcgtgatgatttgatgtcttatggaaatgcgcttctcaagttgaattcaagacagcaatccgagaatacaagatacaacatcaagaagatgtctagtattttaggaagggaattccaaattgaaatagcaaaaggtttggcctag

SEQ ID NO: 72423 - DNA, 234 bp, Glycine max
  Peptide Sequence Number=SeqID_164108
atgtcagtgaaaaacctcgtcaggcgcctaggagtacatgacaagataaaccacacactagcaaggagactagtcagagtcacgctattttgcgagaatgctccaaccatgtggaatcggcatatgcttaaaggagcactcaaaccgagtgtatttacctccaaggcctacactccgaagagtccatcagggcctctccctcctgattcaggtccaaccgagaaaacattttag

SEQ ID NO: 72424 - DNA, 84 bp, Glycine max
  Peptide Sequence Number=SeqID_164109
atggtgacttatgctcctgggttgatctccaagtctgttcaatcagaaattgctcgttctacatgtttggtgagagtgccgtaa

SEQ ID NO: 72425 - DNA, 459 bp, Glycine max
  Peptide Sequence Number=SeqID_164110
aggaaaatgcaaggatcatgcatgagcaaacatgaaaacaaaagacacgagaacccgaaaaatcatctcttcttacttgcacatttgggggtgcaatgccccatgtgtgtagttaagaaggtgatatggatcttctggcttcccatgacaaaagacgagaccaacatacatcgcgtgtgtgacgacatgatgcagacgacggggacgcacacagtgtgttcgcttcgtgcccgtatcatccccttcgaaaaacatattgcggtagtagggactaccaacaacaatatgttatcaaagaaaaaaactctagatgagggttcactgttatcaagcaagtcgaagacccagcatgaccacatattcacctccactccttatgttcccatggactcggatatagggccctttttcaactcaccgtgtgcacaaatagtgttggtgtttgtgtgcatcaaatga

SEQ ID NO: 72426 - DNA, 354 bp, Glycine max
  Peptide Sequence Number=SeqID_164111
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatccccggcaacggcgccaaaaacttgttcgcggccggcaagtgcaccggatcgcacaagtag

SEQ ID NO: 72427 - DNA, 231 bp, Glycine max
  Peptide Sequence Number=SeqID_164112
atgtttctgttcgtgggagggccgccctcggcagcggaaggaaaggaaaaacttgatctcatcgaagagagattgagggtcgttgaaggattcggcgattatccgttcgtagacatgaccgacctgtgcctggtgtcagacgtcgtcatcccttcgaagttcaaggtacctaacttcgataggtacaaaaggacgacatgttctacgaagtcttacaaaaggcaggcatga

SEQ ID NO: 72428 - DNA, 483 bp, Glycine max
  Peptide Sequence Number=SeqID_164113
atgggtgaagtagaggaggtgaaagagcaaatgaaggccgacatggaggccttgaaagagaaaatggccacaatgatggaggccatgatgaccaaaaaggagataatggaggtcagtgcggcctaccaaacccgtgctagagctagagtaatgggtgaagtagaggaggtgcatgagcagatgaaggccgacatgaaggccatgaaagagaaaatggccacaaggatggaggccatgatgagcatgaagaagataatgcaagccagtacggttgtagttgccactaccagcgctgttgctaaggtgaacccgatgcccccatctgatctcaaccaaatgaatcatccaacctcagatatggtgggcaaagatttgggaagtaggacgaccccaggatgtgcaaattcaaaacgagcacgccttcccgccatatggcttgcctcccaactatacgccacccaatgtgatgtagactccccatga

SEQ ID NO: 72429 - DNA, 93 bp, Glycine max
  Peptide Sequence Number=SeqID_164114
gctggagaggaaaggaagttgcaactaagtgagctagatgagatcctttcagaagcctatgagaattccaaattctacaaggacaccagttga

SEQ ID NO: 72430 - DNA, 820 bp, Glycine max
  Peptide Sequence Number=SeqID_164115
atggggttgtacgtccaaagtcaagattgtacaaagctggtggcgttgggaaaaattcatgatggaccatctaccatacattgcgtagcctatgcaaatgatgtcgtaagggttagcgtcgaaaaagtaattgatggtgaagctgaagttccattagcaacatcagaaattaagtatgtgagagatgccattaacacattcattgcatggccattgcctttgcattcaggcatcactccagacaaagtttccaatgctgccgaattaaacaatgatgttcctaaacatgaccccttgcgtgagttgattaagacccttgttgacatttacgacaagcctgttgagtttgtgtgggatcttactgaatttgggattccaaatcgaaataacatcaggcgacaaatgcttgaacatagtcatacttcaattgtggaccattgtatggattccttgagcctcaatctatacactatgcaaaggacagatgtgggcaatgtgaagaatatatcgaaaaatggcttaaggaatcgcaacgacaactcgcccattggcaaacggttgtgttgtgccctaaagacaatgtcgtggtctggttttgttcatgcatataagaaattaaacacaactgctgatgggaaagtacctaaaactggaccccagtggcttgaactgaagactcgcattcaacgcggaggctatgagtgtgggtattatgtgatgcattggatgtggaacataattggcgtggagttgaagagtgattggagtgtgtggtttggtgatggctcggcactagacccagagtcgatcacaacattac

SEQ ID NO: 72431 - DNA, 459 bp, Glycine max
  Peptide Sequence Number=SeqID_164116
atggcgcctaccaggcaccctttggatccagataagtccaacagggccctggaatttcccgcgctgatcacaggactctgccagtcgttcggagtccccgtggcacctaccaaggtgattcggccgcccatcacccgggcttttattgagaagtactgcacccagagacaggctcaggggaatgctccacaggccgcgggcgcgccaccaccacctcatcaggctggcccggctaggtcatttgacatggatcagtatttacggcatttggttcgccagcaggcggccaaccaccgggcacataccagttcagggcagaggtcgcatggcccgaggattggcccgaggcccaagcaggataggcgcccccgagaagctcccggcgagggagaggaggcccatgaggacgaggagatggccgatttgcttgacttcttgggagggagtggagctacatga

SEQ ID NO: 72432 - DNA, 614 bp, Glycine max
  Peptide Sequence Number=SeqID_164117
atgagcggagagcgagatagtgagtgtgagcgaaacacggggtgggtgagagttagtagtaggagacagaagaaaacgagagttctgagagagggtcctagtttgaaagctgccggtaacacgaacggatatggacggagctacaggagaggaaactggagggataggaaggatataacgtcattctacttcacacgattccccgaggacgtaaccgaggaagacctatggcaccacttcaaaaagtttggtgacgtaagggagatattcatatcaaagaagaagaacagtctcggcaggaagtatggttttgtcagatttcaaggagtagagagcttgcatcaactagaaaggaggctagacaacaccatatttggaggtttgaagatgcatgtcaacataccaaagtttggaagagcacacagcggacaaataccctcatcagtcacacgccgagagagcgcaatgcaaggagaagatgagatggtagctcgaagacaacaaggacaacgagtgaggcaaaggtcgtacgctgaggtcctgcagaggaatataacaacagtgcaaaagagaagaccagtgactgaggtgtgcaacaacaaacccacgtcgag

SEQ ID NO: 72433 - DNA, 123 bp, Glycine max
  Peptide Sequence Number=SeqID_164118
atgtgtctcggcatgggcggcacttgcaaagtaaatgagaagatgggcgttggcagaaagccatgggcgacacaaggccgtggatgtgtctcgcaagtagcatgggcgatatcctccacataa

SEQ ID NO: 72434 - DNA, 147 bp, Glycine max
  Peptide Sequence Number=SeqID_164119
atggtggcggcacggcacagttccgatgacagcacggcggcgcgcgatcctaatcctggtctcgccggagaaaactggccggagatggccgcagcggacggcggcggacgaacccgctctgatgccaacttgaaactgaaggagtga

SEQ ID NO: 72435 - DNA, 1098 bp, Glycine max
  Peptide Sequence Number=SeqID_164120
atggttgacgttgcatgtgttgagtggggtgatgtgactgccaacccatgggatgagtctagggtgccaggaggatcatcaggaggatcagcagctgcagtttctgccagacagtgtgttgtatcgttgggaagtgacactggtggaagtgtgaggcagccagcatctttttgtggtgttgtaggtttgaagccaacttatgggcgtgtctcaagatttggacttatggcgtatgcatcatcacttgatgctattggctgttttggttcatcggttgctgatactgggactctccttcatgcaattgctggccatgatagatttgatgccacctcaagtaagcaggatgtgcctgactttcaatctcattttgtcgctgtgagctccttggaaagtaagcccttgaagggactgagagttggtttgatccgtgaaactattgatgatggtgttgatgctggagtaatttctgcaattcgggcagctgctttgcattttgaggaattaggatgctctgtgaatgaggtttcactgccatccttttcccttgggttgccagcatattatatccttgctgtatctgaatcatcttccaacttgtctcgttatgatggtatcagatatggaaaccaagtttatgctgatgagctagattctctttatggaggttcccgggctcaagggtttggttctgaggttaaaatgagaattttgatgggaacatatgccctttcagctggttactatgatgcatattacaaacgtgcacagcaggtaaggaccataattaggaatagctttaaggaggccctcagtcaaaatgacatcttgatttcccctgcagctccttcagctgcttataaaattggtgaaaagaaaaatgatccattggctatgtatgcaggcgatatcatgactgtaaatgtcaatctagctggactacctgccttggttttgccatgcggatttgttgagggtgggccttcaggccttcctgttggtctgcaaatgattggtgctgcatttaatgaggtatttacttttcctatccactgcaatggagtctttgttggtggagttctctattgttaccagtag

SEQ ID NO: 72436 - DNA, 1422 bp, Glycine max
  Peptide Sequence Number=SeqID_164121
atgtcaaaaacaactacttcttccgaacaaactgcacgaaaccgtttggccaccctcgcagctcacttgcttccctccgacgccacctccgccgccgcgatcctccacccccaccggctctccgcccccaccggagacttgccgccggcgaacctgaagggcacccttaccgtcgtcgacgagaggaccggcaagaagtaccagatcgaagtcaccccagatggcaccgtcagagcctctgacttcaagaagatatcatctgggaaaaatgacaagggactcaaactttatgatcctggctatttgaacactgctcctgtcatctcaaggatttcttacattgatggtgatgctggaatccttagatatagaggatatcctattgaagacttggcagagaaaagcacctttacagaagtgtcatatctcatactgtatggaaatttgccttctgaaagtcagttagcggaatgggaattcgccttatctcagcattcagctgtaccacaaggagttttggatatgatagaatcaatgcctcatgatgcacatcctatgggcatgcttgtcaatgccatgagcgctttgtctgtttttcatcctgatgcaaatcctgctctcaaaggtcttgatatctacaactcaaagcaagtgagagacaagcaaatagcacgggttattggaaagataacaacaattgctgctgcgattaatcttagattggcaggaaggccgcctgtgcttccatccaacaaactttcttacacagagaacttcctatacatgctagattcttttggtgttgatgtatatactgctattgctggggctgttggagctctatatggacctcttcatggtggagccaatgaggctgtcctcaaaatgttgagtgaaattggaactgttgagaacattccagcattcattgagggtgttaaagccaggaaacggaagctcagtggttttggacatcgtgtgtacaaaaattatgatccaagagcaaaggtcttgaggaaactgacagaggaagtgttttccattgttggccgggatcctcttatagagattgctgttgccttggagaagattgcactgtctgatgagtatttcatcaagaggaagctatatccaaatgttgacttctactctggactgatttatagggccatggggtttcaacctgagtttttcactgttttatttgccatccctcgaatggccgggtacttggcacattggcgagagtccttggatgatcctgatacaaagattatgagacctcaacaggtttatgttggggagtggttgaggcattatgcaccaattaatcaaaggactgcatcaagtaacactgacaaacttggtcaattggctgtatcaaacgcctcaaagaggcgtcttgctggatctggggcttaa

SEQ ID NO: 72437 - DNA, 297 bp, Glycine max
  Peptide Sequence Number=SeqID_164122
atgaaccctaaaacaaaacattggctctacaacaccaagaccactgttcctctattcagctatttctctttgctggctttatctgtctccaccacatgcatgggatgctgcatccccccccccccccaccccgaacttgaaagggcacaagaggtcaaggtaaagatcaagacaacgggcatcaaggttcagaaagaatgcaacaaactgagaggcgtcaatgtggccaccgtcgaagcattggaacgggaaacagagggggcccgaaaggaagaatatggtctaaacaagatctga

SEQ ID NO: 72438 - DNA, 3279 bp, Glycine max
  Peptide Sequence Number=SeqID_164123
ggagatgcttacaagcgcaagttgcagaattcagtacatagtttcacaaagcaaggcactgttgggaataaaaaggttaaacttgacgacattgatgcttcttctgctcttgaaaagaaattgggtttaaagacattatcagaagaaaataaggaaaaagtgaaaaactgggactcagttggaaagcaacaaaaggtagtagtgtctcccattggcggtattcttaagaatcacaaacacatttatggaagtacttcaattggtagtaatattcaagatggcactgaggaaacccattgtgatgttcaagtgccaccatcagacaagcatgtgagattttctgctgaggattctgtgcttggtccagaaaagagaagctcatttgatgaaaccgtgttcagtttatcttcagatatgccggcttcttcatttggagaggagaagctcactggaaatgatgaaggcactgtgaacttggaggaaaacagaaatggcaacactgccattaacacagataagagaaaggaggtttgtcctatggttgaaagtaaacaattttctaatactctaggacttgttgctgtacaaaatttgttaaagccgtgtaccagtgaagagaaatcaaagcacttagaagagaagtctgaatcattatccaatgtgacgatttgtgataataataatttagaccggtttgatggaggcaacacaactacagtgcatgtttcttcatatggtgacctttctagatctctttcagaacttcaaggggggcaaagttctggtataagtacacaaccgtgtgaatctgaagcttttagttacactgggaagttcattgatcatttgggaggtccaagttttcagtctacaaatgcacacacaaggacatatttggagccttcaccctcttattctgcttcctgtaacgaagtaaataacagacctgaatttccattgcacacatatggaaacgatgataataatggccaagctttgggtgacaggtcgttgtcaggcacgttttctgctgatatgattgataattcgtttctcttgcctggctgggggagaggaagtataaggaataactgcatggagcagaacttttatggtttgccactcaattctcatggtgacctaatcaactttagttcaagtggaaaaattgggatgaaccagcctgagacatcatgtacattaagaagttctttaagtggcttacctgtgaacaatgttatccatcaaagtagccaggaatgtttaagcattggtaagaggcatgttgttcagaagacacttcaagatagcgtaaatccatttcctcactattcaggaaggttaggtgttagagagttacatggaagggagagaggagatatctaccagcataattctggttggtgttcaaatcactatgtccagccacttgattcagagttgaacctcatgagaaaccctttcattgaacagaatcagaatcagaatcaacttgaaaaggtgccaaatcacgaggaatatggaatggtttcaccaagaggaagctcaggtcttgtttcaccaagttgcagccaaccaacaatgaggttgatgggtaaagatgttccgattggtagaagcagcaaagaaaagcaacaatttgtgggaggagttctttgggctgaagaggaatccagaaggcattattctgtagatgctgctagggacaattctttgttaggaagatgctacatgccagattcagcatctggttctcaattacagagacaaactgagaatgtgtttcaatcagtgaaaattctaagcaaacaggcattacaaagtaccttgttgatgaatggtccaaactctgaatttcttaaccagcgaagtaatcatatatctcaaaatggaagccttggagtcagcagaaatgctagtactaatttgcatactatttcccaagtaactacttcgtgtgcaatatataataggccacctgaagacttgcctgagcagtttatatctcaaggattctgctttcattctcaggtatcatctaatccttgcaatttcaatcagtctactttaagcagtcgtgagctgaatgactggaagatgcaccaccgtgtcgcgaattcagcctttgaatttcccttcttgcacccaattgttgaagaacatgccaaatcatcttggttcaagaggtcctatagcagtttggcaccatggcccttaagctcaacacatgaaaggccacctgggagctcttctagtacaagttttcctcataatacttggagaaatgattctacaatttcatctgtgaaccattcatcagatgttttgtatcctcctacttcagttgctactcactgtcccaggaagaccattcgttacccaacatcaactgctcatcctcatcctcattctcgttctccatacgcttcagtttcccccattatcaaaccaccctctgccatagatagtggttgtagaaacttatttaaagtcactgacagagtgaaatttgatgatatgagtgccagagtgcatcatccatgcaccaattccaggaaaagaccctcaactagttttgttgatcctgcaaaacctaacaagttacctaatatagaagtgaagaaaaacttaactggcatggctgtgcagcaaaacacaagagaagttgaacttgatctccaagtgggtgcaattggtaaatgttgtcagaatgaggctcagaatctaaatccaagaggctttgattcttttaacctggatggtgtggtaatatcaggtcctgtgaaacttagcccaggtgctaagcatattctgaaaccctctcaaaatcaggataactcaacaccggtccattctgccattcctattgctgtgactactgattgtgtcttcctcaaggatgcagatagcaggactgcagatgaaggagacgacatgaatgaggggatcagaacattgcctgatgctcttggatgtgcagctttgctctgtcagatcattcacttcattgaaactttgatgcctcatcaccgaattgaatcagaggttcagcagattaagtcagttgttgatggaatcatgcaaagagttcaaaattataactccctaaatcaacttttttctaaaaaggacaaagcagtgatggagggaccagcagagcgcattgtcatctctgtggtgggaatgagagggttaggaaaaactactcttgccagcagagtatttaacaatgggaaggctggaaaagttgatgagagacttgttgaagaagttatttga

SEQ ID NO: 72439 - DNA, 123 bp, Glycine max
  Peptide Sequence Number=SeqID_164124
atggagcaccatgaattgcttaaagaggtgagcttacgtgttattgatggaataagagggaaaaaagacaaagtaaaagttgcagaatggattaatgtaataagagtgaaaaagacaacgtaa

SEQ ID NO: 72440 - DNA, 777 bp, Glycine max
  Peptide Sequence Number=SeqID_164125
atggctttgcttgcacgtcttcgagttctggttcaacaaatactgcttgatgttgtttcattgttcaacatggtttcttccctctctatatcgaagcaatcaataaaaataactcataatggaattgaggtttttagagatttctaccctgttagtgatgattttgttacattagagtgtgtttggaaatcagacaagtttatattacttgagaggaagcataaaacgaatgatgaaagtcatgttgaggactctggtggaaatgtttctgtccaaacatcagatgttaattataatagtattgagtcttttcttggggatgatcagcttttccatgagagagtagaagcagatgttgttgcaaaagaagatcctaatcatatcgatgatatgaatactgatttgttgactggctcatcacaaattgatgacaaggaaactaggtatagtgatcaagacaccacaaaagccttcatcaacgaatcttcacaagaggctggtttgcctgcatcatcaaggtcttctaccaatgataaacttcaatcttgtccgaagaaggagatgatacatagtgaattggattcagagaatattgatttcacagtgattgatgatgttggtagtgaaagcctaggtcctggcattcgtagagaactttcattttcacgttggtgtgatgatgatggaaggatccatttagatcagcaattaggtaatgaagatgttagtgtagaagacgactctgattttgagttaccgtttcctgaaaagacttga

SEQ ID NO: 72441 - DNA, 708 bp, Glycine max
  Peptide Sequence Number=SeqID_164126
atgtcacaggaagagagggtagaagaaagccagtgttgttcgaacttgacatttaactattctctagctaaagatgtgatatgcatagcccaacaaatgaatgtgctcaacaacaacaacaaattcaagccattttcacaccccattcaactctcaagcatgaattacttctttctcaaagactttttggcattggattctaagaaaccagtttatgaagagttgaaggcaatccaagatcagactgaacttggcaaggcactatggttatctcacaggttaaagatcgagaagattctcatcatcttggatggtgtatgggagaagttggacttggaagctatagggattccattaaatgagaacgacaagagatattgtatcctcctcactacgtgcaaccaagcaatttgcacttcaatgaactgccaaagcatgattgaactgtctatgctaaatgaagatgaagggtggactttgttcaagcaacgtgcacaaatagatgatgattctctagaagacttgagagaggtggcaaagagagtctttgacaaatgtaaaggactgcttgttgccattgtgacagtggcaagaactttaaaggagaagacttgtaccagttgggaattgacatttttaagactagaaacttctgaatcaattgatgttcaagagggcttgacaagtacctataattgcaacgaataa

SEQ ID NO: 72442 - DNA, 99 bp, Glycine max
  Peptide Sequence Number=SeqID_164127
atgtggactatgtcggaccttgcgaagttgatcacgacgctgagcatggcaaagccgagctgcatcgagaagatcagacttttttctcatgctttatag

SEQ ID NO: 72443 - DNA, 177 bp, Glycine max
  Peptide Sequence Number=SeqID_164128
atgaaagctgcaaatttctacacttgtatagttcctaatttagaaggaagaatgaaaaacttatggaacaatacacaaacagaaagagacataaaatatcagcaaaggaaattgcatatattaaatataaaacttgagcaggacaaagctgatgatgaagactgttcagatgaatga

SEQ ID NO: 72444 - DNA, 1186 bp, Glycine max
  Peptide Sequence Number=SeqID_164129
ggtggacccttgggtactacacgccctcgccttcagagggctacacgtcctcgcctttagagggctacacgtcctcaccttcagaggactacacgtcctcgccatcagaggactacatgtcctacccttcagaggactacacatccttgccttcagagggctgcatgacctcgccatcagagggctacaagccctcaccttcagagggctagacgccctcgcctttagaaggctacatgccctcgccttcagaggactacacgccctcaccttcagaggactacacgtcctccccttcaaaggactacacgtcctccccttcaaaggactacacgtcctcaccatcagaggactacacgtcctcaccttcagagggctacacaccctcgcctttagaggacaacacgtcctccccttcagagggctacacgtcgtcaccttcagaggactacacatcctcaccttcagagaactacgcatcctcctaggactacacgtcctcaccattagaggactacacgtcctcgccatcagaggactacacgtcctcgatttcagagtgctacacgccctcgccttcagaggactacacattcttaacttcaaaggactacacaggactacatgtcctcgccttaagagggctacacgccctcacgccctcaccatcagagggcttcacgtcctcgccttcagagagctacacaccctcgctgtgagaggacaacatgcctttgccgtcagaggactacacgtcctccccgttagaggaatacacgtcctcgtcttcaaagggctacacgccctcaccttcagagggctagacgccctcgcctttagacagctacaaaggctagacgccatctcctttagaggactacatgccctcgccctcagaggactacacgccctcccctttagaggactacacgtcctccccttcagaggactacacatcctcaccttcagaggactttacgtcctcgccttcagagggctacacgccctcgcctttagagaactacacgtcctcccgtttagaggactacacgtccttgccttcttagggctacacgccctcacactctcacctttagagggcttcatgctctcgccttcagaggactacacgccctcaccttcagaggactacacgccctcaccttcagaggactacacgtcctag

SEQ ID NO: 72445 - DNA, 548 bp, Glycine max
  Peptide Sequence Number=SeqID_164130
actctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgataattgctttgaaacaattttaaaggaactttgttggagaaataaagaaattcgaagcaagcaagttattccacacactggtggatccaaagctaatcctagaagaagaaatgagttgttgttagaaactgggaagctaccaagtcatggacaattatatattgaaactcataaaaggaaagatggatcatttgtaaatgaagcagcaaagactatagcggaacaaattgaagtaggattgactcaaagcatagttgatgaatctgaagtttctcctcttgatgttgttggtagagtgttagggttagagcactctgggaga

SEQ ID NO: 72446 - DNA, 225 bp, Glycine max
  Peptide Sequence Number=SeqID_164131
atgttgcaagatggtgaatcaggaggggcaacatcttcatcagatgattcatcgaagatgattatcagaggtggagctggagctggtggaggagataatatttcaagctcaggagaaaaaggtggatccactactggaggtagtggttcagctggtatcggctcagtcctggctagtgcgggctcaggaggaacaacctcatgggatctctctaatggaagctaa

SEQ ID NO: 72447 - DNA, 106 bp, Glycine max
  Peptide Sequence Number=SeqID_164132
atgccaacgtcatcacgtaggctcggcggctcctcaccagaattacacttcctacaccctgctgctgtcattttgctcccacgaacaatgttcgtgatcatcacag

SEQ ID NO: 72448 - DNA, 201 bp, Glycine max
  Peptide Sequence Number=SeqID_164133
atggagataaccaaatcacttgtctccaacaacaataataaaaagaacaaatgcacaccttccaggttagtagggcctgatggtgttggactgttggtactgcctcgcaaagttgaacttaaggatgactcaagcttgctagttgcaacctatcaaccactaccagcagcattcacaaagctaaataccttggtcatgtag

SEQ ID NO: 72449 - DNA, 336 bp, Glycine max
  Peptide Sequence Number=SeqID_164134
atgtctcctccacctctagaacctcaatcactcacagactcatctcatgctctcaagatggcttcctcttctcactcagttctctgccacacaactctggctcgcttagcgcgcattagtgaatttcggcttagcgctcgtcttgtcgctcagcggatggactcaagcagtgcgcttagcgggattagcccttgcttagcgaacatgcacaactcatccttcttccagattcttcctcgcgctcaaccaaggaatgttgtgctcagcgaatggctcactaagccaaaagattggcttagcgagcggatgaaatcagcacttcacaaatatggctaa

SEQ ID NO: 72450 - DNA, 2079 bp, Glycine max
  Peptide Sequence Number=SeqID_164135
atgctgtcgcgtttcgctacgttgggccgcataccgcgcggcgtgtgggtattgggtggggtgagtctgctgatggacgtctcctcggaaatgatccacagcctgctgccgctgtttatggcgacgacgctcggcgccagcgtcatcgtcatcgggctgatcgaagggctggcggaggcgacggcattgatcgtcaaggtgttctccggcgtgctgagcgattacctcggcaagcgcaaagggttggcgctgctgggctacgggctgggcgccatcagcaaaccgtttttcgccatcgcgtcgtcgtccggcatggtgatgagcgcgcgcctgctggatcgcgtgggcaaaggcatccgcggggcgccgcgcgatgccctagtggccgacgtgacgccgccggagattcgcggtgcggccttcgggctgcgccagtcgctggataccgtcggtgcctttttagggccgctgctggccgtcggcctgatgctgctgtggcacaacgattttcgcgccatcttttgggtggcggcgatcccggcggcgctggcgattgcgctgctgttttttggcctgaaagagccggccgccgcgataacccataagcgcaccaacccgatcacccgcgccaatctgcggctgctggggcgcggctattggtgggtagtgggtatcggtgccgtcttcacgctggcgcgcttcagcgaagcgttcctggtgctgaaggcgcagcagggcggcacgccgctggcgttgatcccgctggtgatggtcgccatgaatctggtctacgcctgctcggcctatccgttcggtaaactgattgctgaaagccgggctgctggtgctgatcgccgccgatgtggtgttggcgctgagcgatcattggggcggggtgctgtttggcgtggcgctgtggggcgtgcacatgggcatgacgcagggactgttggcggcgatggtggcgcataccgcgccggcgcacctgcgcggcaccgcgttcggcatgttcaatctgatcagcggcgtggcgctgctgctggcgagtctcggggccggaaccctgtgggagctgttcggttccgcctccaccttctacgccggggcgctcatctgcgtggtgacgctggttggcatgcaactggcgccgttcggcgaacggcggggcgcttaacggccgtcgacaagttgcggcatcgcctgcagcagctcgggcacccgctgggattccacagcccggctgaacaaataaccctggccgatatggaaaccggcttcgcacagcgtttgccgctgctgctcggtttccacgccctcggcgatgatatcgatcgacagtttttggccgaggatgccgatgctttccacgatcgccaggatcgccggttcggtattcatccgttgaacgaagtcgcagtccagcttaatgcagtccagcgggtaatccatgatatggctgaaggaggagtggccggtgccgaaatcgtccagcgcgatgcggatgcccatctccttgagcatttgcagcgcgcgcagcacgtacttcgagccgtgcttgttgaacgcgtgttcggtcacttccagttcgatcagagggtggggaatgtggaacttcagcaggcgctgcaggaagcgggcgatatcggcgaagaccttcagctgcatggcctcgctgatcttggtcgccagttcgtagtcgttgaacgcctcgcttaccgttgccggcagctgcacgccgttgatcgggcagtgccagcgcagcagcgcttcaaagccgacgatgctgccgtcggtcaggcagaccttcggctggtagctgggacggatgcagttgtcgcgcacgatctggcgtgcgtagttgagctggctggcgcgggcgcgcgccttgtccatcattttgcggtcgaacatatagacaccgccgcggccgccgtctttcagctcatacagcgcgatggcgccgccaaggctcatgccgcaatgcagcgtcttgccgccgtgggtgatcggcgtctccaactgcagcagaaacttgttggcgatgcggaaaatatcctgctcgttttcgacgtcgcttga

SEQ ID NO: 72451 - DNA, 1569 bp, Glycine max
  Peptide Sequence Number=SeqID_164136
atggagctcggcaccgcgctgtcccgccgtcacgcgcgcgcgctgtggggcagctggctgctggccagtgcaccgctgttcgtgatcttcaacgcgctgggctggtggctggatgccttcggctgggcctggctggcgatgtggtggtgcaaaccgctgttcgaacgtgcgccgttgtatgtgctgtcgcgcggcatcttcggtgaaccagtcggcacgctggccgcgctgcgtgcgcaacgtcactggggcaacagcggcttctggggctacctgggttggcgtcgtttcagcgtgctgcgcagcctgtgcctgccggtgaacctgctggaaggcaacacaccgggccagcgcggcccacgtcgtcgtgcagtggcagccggcgcagcgggcgcggcactggtactgaccgtgacctgcatggcgttcgaagccgtgctggtgtccggcgcgatcggtgcggtgttcatgttcatgccactggagctgatgtccgaatcatggcgcgccgcatgggacatgatcggccaggacacacccgcatgggcacggctgggcttcaacctggcgtgctggctggcctcggtgctgatcggcccgttcttcgtcggtgcgggctttggcctgtacttgaaccggcgcacgcagatggaagcctgggatgtggagatcgccctgcgccgcctgcgcgagcggctgctgccggcggcatcgacgctggccctgctgctgtgcctggcactgccgctggtctccgcaccggtgcatgcgcaggacacagacgccgagcccgaacgcgccatgggcaagcccaacgaccgtggcatcgacgccgaggaaggcgacgaagcaccgaccatcgacccggccaacaccccggcaatgatcttcggcggtacgccggtggataccgccggcttccgtcaggcagtgaaccgcgcctatgaagacccgctgcagcgcccgacccgccaggtcacccgctggaagccgatcgaacaggccgaggaagagaagaaggaagacaagcagctgcggagtgacaccaacagcaacggtgaacgcaaagcgcgcaaggacggcatcgcctggctggcgcggctggccgaatggggcctgtgggggctgctcggcgtcctgctgctggtgctgctgctgaccgcacggctgtggctgccgtggctgcggggcagtggccgacgcaaggccgaggccgcaccgccggtggtggaggaacaggtggagttgccggtggtgctgccgccggacgtggccacccaggccggcctgctctgggaccagggccggccgcggcaggcgctggcccttctgtaccgcgccagcgtgcgcacggtgggcgagcgcagcggtatcgcgcttccacccggtgccaccgaagcgcaatgcctgcgcgcgtcgcggcgcatgcccgaggccagcgaccgtgacctgttcgcgcgcatcgtgcgcatgtggcagtacgccgcctacggtggccgcctgtccagccgcgccgatttcgatgcattggccgatacgctgcgccagcagtaccggtggcaggcatga

SEQ ID NO: 72452 - DNA, 232 bp, Glycine max
  Peptide Sequence Number=SeqID_164137
ggtcttggagttgtcagctctgattacgggcctctgtcagttctatggagtgcatgtcgcccccagcaaggtaatcaggccccttactaatcgagctttcatcaagaagtactgcacccccatgcaggcacagggcgaaacaccacagcagcctggggatggccggaagtgggcaacagacgcaccgccaccacctctagagttcaccttagctcatccacgaaaaggttag

SEQ ID NO: 72453 - DNA, 315 bp, Glycine max
  Peptide Sequence Number=SeqID_164138
atgggtgaagtagagaaggtgcaagagcagatgaaggccgacatggaggccatgaaagagcaaatggcacatatctctcaaaccatgggggagacacatgaaattccccaccacaacctagctgacttcgagccttggctcggatatgccactgaagggcaagcagttggtggtataccccttgaaaacacttcggaaggccctcagtatcacccccagctacacctcttgcattccacaacaagtaaaaaccctcctgctatggctgaaaagggaaaagttggatcatatagaggaaaggctcaaggacattga

SEQ ID NO: 72454 - DNA, 2038 bp, Glycine max
  Peptide Sequence Number=SeqID_164139
cgtgctgattgtcacggtggccgatctgatgtcgagcatgaaaggcaccttcagcggcggcagcgacctgaccgaagagcggctgctgcaggatctcagccatgtcgatctgctggtgatcgatgagatcggtatgcagagcgaatcgcgctacgagaaagtgatcatcaatcagattgtcgatcgccgttcgtcgtcaaagcggccgaccggcatgctctccaacctcgatccggccggcatgaacacgctgcttggcgaacgggtgatggatcgcatgcgcctcggtgagggtgcgatgaaagcagccgggaaaggaccagcggtacttcgactgaacaacctcaaacgggtgatgacgcagctgcgcaccacccgcatcacttcccgccaggatctggcgctggcgctcgacctgagcaaaaacaccgtttccctgattattgatgacctgctggcgcaggggctgattcacgagcttggcccggtcagcgtggctgcggccggcgattcactggcgggtggcgactacttttcgcgcgtggtggccgagcaaacctggcgcaccgaaacggccgatgccgacgggctgctgcacgagctgacggaagtgtgtcagacgctgcgcgcggcgcatccggcgctgctgggcgtggccatcggttttcccggcatcattgattctcagcgcgggcgggtgcacttttctgcgccgctcggctggcaggatgtcgatgtgctgacgccgctgcggcgcggcgttgagctgccgctgcgcatcatgaataacgtcaaagcggccgcgctgctggcggtgcagcagctggagctcaataaagcgcagagccatttctatctgcgcatcgccgacggcgtgggcggcgcgctggtggagcgcggcgaggtgttcagcggcagcagctggaccgccggtgagattggccatctgagcgtgcagcccaacggcgcgcgctgcagctgcgggcgacagggttgtctggagacgctggtgagcctgccggctatccagcagcagctggcccggcgtaagcccggcttacgctggcagtctggcgacagcgagccggagatcgtgtatgagctgatggcgcagaccggccgctatctcggccatgcgctgagccaggtgatgcagctggtcaatccggccagcatcatcattgacggcccgtggaatgcgcaaccggcgtttgtgcaggcggtacagcaggcggcacaggccggcacgctggcgtttacctttgcccataccgcgctgcactttctgccacagcgcatcgatccggccaacggtctggcgctggcggtgattgagcactatgaacgagcggctctctttgcggaccgcgcaatgaaaacgcagcgcatcactctggacgatattgcgactctcgcaggggtcaccaagatgacggtgagccgctatctgcgcacgccggaaaaggtcagggcggaaacggcggctaaaatcgccagcgtcatggccgaaatcggctacgtcgccgaacaggaaaacaccgcggcgtcgcggcacccgccgccgcgcatcggcgtactcatcccctcattcaataatcaaatctttgccgatctgctggccggtatcgaatcggtcaccagcgcccacggctatcagacgctggtggtcaactacgactacaatccgcagcgcgaagaggagcagattgccacggtactggcttttaacgtgcagggattgattctgaccgagtcggtgcacaccgtgcgcgcggaaaagtatcttaacgcggccaccattccggtcgccgaagtgatgggactcagcgagacgcgcgggcgcatcaacgtcggctttgataattaccgtgctggctacgacatgactgcgatgctgctggccagcggtaaacagcgggtgatttattttggctcgatgtccgatcgccgcgatcaacaacgctatgccggctattgcgatgccgtggcggcggccggattgccggccggacgcatcgtgccgaacaaagtctcttcg

SEQ ID NO: 72455 - DNA, 435 bp, Glycine max
  Peptide Sequence Number=SeqID_164140
atgacggtgaaaacctctgacacatgcagctcccggagacggtcacagcttgtctgtaagcggatgccgggagcagacaaagccccgtcagggcgcgtcagcggggtgttggcgggtgtcgggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctctaaactaa

SEQ ID NO: 72456 - DNA, 714 bp, Glycine max
  Peptide Sequence Number=SeqID_164141
atgatgctggtgtcattcatctgttacgcctttaacctgacgctgagcacctgggtgggcggtgtggcgatgcgctatcgcctctattcgcgcctcggcctgcccggcggcaccatcacgcgcatcttttcactgagtattgccaccaactggctgggctacattttgctgggcggcgtagtgtttgtcgccggtatggtgccgattccgcccggctggttcatcggcgaaggcacgctacgggtgattggtgcggtcctgctggcgatggtggcggtttatctgtgggcctgtgctttcgcgaagaagcgccgctggacggtgaagggccagcatctgcagctgccctcgctgcgcatggcgctgtttcagtttgccgtttcctgcgccaactggatggtgatgggcaccattatctggctgctgctggcgcgtgaagtggattatcccatcgtgctgggcgtgctgttgatcagcagtattgccggggtgattattcatattccggcgggcattggcgtgctggaagcggtgttcctcgcgctgctcagcggccagcatgcctcgcacggtgagattatcgccgcgctgctggcttatcgcgtgctctattttattctgccgctgctgctggcactggtgctgtatctgtggctggagagccgcgcgaagcatttacggcagaagaatgagcgcaagatggcggcgcgataa

SEQ ID NO: 72457 - DNA, 551 bp, Glycine max
  Peptide Sequence Number=SeqID_164142
atgggtgaggcctgccgcacgccaggcgccgacgtcgcgcgccatgcggtagccattggtggtcatggcgatctggcggattgccgcgttgtcgcgcacggcggcaatgatatcggtgaagtcgcgccgcatcgagggttcgccgccggtcaggcgcactttttcggtgcccgccgccgcaaaggcacgcgtcacgcgacgaatctcatccagcgagagaaaacttttgttgtgcacgccgttcggccggtagccgtcgggcaggcagtagttgaacgccgtctgcacctcacgtgcggcgttttaaggagcagcatgaatcgtaccctggcagatttggatcgcgtggtggcactcggcggcggccacggccttggccgcgtgatgtcggcgctggcgccgctgggctcacgcctgaccggcatcgtcaccaccaccgacaacggcggatccaccggccgcatacgccgttcagaaggcggcattgcctggggcgacatgcgcaactgcattaatcagctgatcaccgaacccagcgtggcctctgccat

SEQ ID NO: 72458 - DNA, 1137 bp, Glycine max
  Peptide Sequence Number=SeqID_164143
atgatgaacgaactcggctactgctcgggcattgaaaactattcgcgctatctctccgggcgcggaccgggcgagccgccgccgacgctgtttgattacctgccggcggatggcctgctggtggtcgatgaatcccacgtgactattccgcagattggcggcatgtatcgcggtgaccgcgcgcgtaaagagacgctggtggagtatggtttccgcctgccgtcggcgctggacaaccgtccgctgcgctttgaagagtttgaagcgctggcaccgcagaccatttatgtctcggcaacgccaggtaactacgagctggagaaatcgggcggcgacgttatcgatcaggtggtgcggcctaccggtctgctcgatccgattcttgaggtgcgtccggtggcgacccaggtcgacgatctgctgtcggagatccgtaagcgcgtcgaaatcaacgagcgcgtgctggtcaccacgctgaccaagcgcatggccgaagacctcaccgagtatcttgaagagcacggcgagaaggtgcgctatctgcactccgacattgataccgttgagcgtatggagatcattcgcgatctgcgtctcggggagtttgacgtgctggtggggatcaacctgctgcgcgaagggctggatatgccggaagtgtcgctggtggcgattctggacgccgataaagagggcttcctgcgctccgagcgctcgctgattcagaccatcggacgcgcagcgcgtaacgtcaacggcagagcgattctctacgcagacaagatcacgccgtcgatggcgcgggcgatggaagagaccgagcgccgccgcgagaagcagcagcgttataacgaagagcggggcattgtgccgcagggcctgaacaagaaaatcaccgatattcttgagctgggcaaaaacgtggtgaaaacgcgcggcaaaggtaaaacggcttcacgcactgccgccgaagctgaggccagctatctggcgctcacgccacaggccatgcagaagaagatccacgagctggaagggcagatgcagcagcacgcgcagaacctggagttcgaagaggccgcgcgggtgcgcgaccagctgcacgagctgcgtgaactgtttatcgccgcctcttaa

SEQ ID NO: 72459 - DNA, 337 bp, Glycine max
  Peptide Sequence Number=SeqID_164144
ggggtggagtcatctagtagtggcgatgaggttcaagcttttagggattttactaaggtggcaagggatgctactagttataaagagtttgtgtcacataaatggaaggagctaatggtggaagccgaaagggaggtggagaggttagatgtgttgggagaaagcaatatgttggatgatgtcaagaatttggtggttacaagaagtgctgattttgatctgctcgctaagccaatatgccggcttagcgagccatccgctgagcgcaccactcttgaggttgagcgcgaggaagaatctggaagaaggatgagctggacatatgtgctaagtgagg

SEQ ID NO: 72460 - DNA, 591 bp, Glycine max
  Peptide Sequence Number=SeqID_164145
atgtgtcataagttcatttttcaagcacttgataaaagcttaaaagacatcatgcacaatgatagaccttttggaggaaaggtcattgttttttgtggtgatttctctcaaatactaccagttgtaccaagagacataggcgatggcaaacttagagaacctaatgatggttatgttgaaatcagtattcctaatgagtttcttatcaagcactttaatgatcctacccaggcaattgagaaagagaattgtagtgttgatagtgttgataaatctgatgaactactcaatcctgcatttggagttctaacacctgaatttctgaactcattgaaaacatcaagaatacctaatcacaagttaaaaatcaagattggcactcccataatactattacgaaacttggaccaggcagatgggttatgcaatggaactaggcttattgtcacaagacttggtgcacatgtggttgaagcagagattattactggctccaatataggacataggacatacataccaagaatgaacatgtctccttctgattctccatggccattcaaactaattagaagacaattttcattcatg

SEQ ID NO: 72461 - DNA, 327 bp, Glycine max
  Peptide Sequence Number=SeqID_164146
atgtttggaagcaaaggcgagaaccttggcgagccaagacgaataggctctgttcatcgatgtcctggcactcttgatcttcggagtggtcctctttccaaacgtggatggggggtccacaaggcatgggaattggtgcgaaagaaggacaaggaactaagaggaagtggcaacggggccatcggcggctaccataggtggttgaaagccattgcacaaggtttggattggctcccgaggttgagagccactaaagaggtggagtttgaagcctcaaaggaaggcgaagaggtacaagtcctcagaacggagcttgggaaagcctaa

SEQ ID NO: 72462 - DNA, 120 bp, Glycine max
  Peptide Sequence Number=SeqID_164147
atgtacaatcatcatgagaaaggaagagctcctgatcttgaaagtgtattggcagacttcatgacatatcaagctagctctaaagaagtaggaatagtgggggcaagatatgcgggttag

SEQ ID NO: 72463 - DNA, 313 bp, Glycine max
  Peptide Sequence Number=SeqID_164148
atcatttgctattggtgttggtgctgtaacttcatttggttaccgtaaagatcgtgatggtcaatggctgaagaaggacacgctacctcaacaagacgagcgtactccttctcctcctcctcaacgtgatgattccttagcccttatgaatgaagttctttcaaagctacggggcctctacacatatgttggtgaacgattcgattccttggatggtcgctttgaaggcatggatacccgcatcacccagcttgaagaagatgtgacttatcttcgtcggtgctttgatcttccaccgccttctaagtcttag

SEQ ID NO: 72464 - DNA, 573 bp, Glycine max
  Peptide Sequence Number=SeqID_164149
gctggattgcagtggcataatctcagcaagctccgccctcactgtttcacgatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttctgcctttcggtttaccggtgtcattccgctgtatggccgc

SEQ ID NO: 72465 - DNA, 318 bp, Glycine max
  Peptide Sequence Number=SeqID_164150
atgactaaccgcctgagaattcttttgattcttcctttccccttaagcaaaagatttcaaaggactaaccgtctgagatatcttttgtctccccttacaaagattcaaaggactaaccgcctgagaattctttgtcccaacacattggagggtacatcctttgaggttcaagtagaggttcaagtggagggtatatccacttggtttttcaaagagaacaagggaaggtacatcccttgtggatctttggcttgtaaaggattttacaaggttgaaagaaatcttaagaactgcaggttgcttggggactggatgtag

SEQ ID NO: 72466 - DNA, 587 bp, Glycine max
  Peptide Sequence Number=SeqID_164151
atgaactcgctaagcgcacctaccacgctaagcgagttcatcttgtgaggatgaatactcatcctcctgttgaaatccttgtcgctaagcgggtatatctttctcttttaagatacgctaagcgaactatgtttcgccaagtgatggcatcaagaaagagagtgagaactgaggacatcccttcatcatctaacccatctgctttgacagatgccatggaaccagatgcccaacaagcacattctttaattcctatgttgcaaagcttattcaggggccagccaatcatatctatggagcagtttctggaaaaagtggcatggcctgaagctcagctccctctcgaaagagcccataaggttgttcctcccagacctataccagctaagactgagccgacatcagttgaaccacaacctcctgtagtagatccacctgcttctctggaacttgagacattgtctcctccggcaccacctctgataatcatccccgatgactcagttgatgaagctactgctcctcctgattcaccatcttgcaacatagacaatggttctgacttttctgactggatggactgctga

SEQ ID NO: 72467 - DNA, 483 bp, Glycine max
  Peptide Sequence Number=SeqID_164152
atgggtgactcagacaaatgcgggttgtacatcgaagaaaatcattcccgcctggttgccctaggaaaagtttatgagggatccacagccgttcacaacatccctttgttacatggccaagtgaaggatggtgttgaggaggttaaagatgcagatgctcccgttcctgtacccactgatgaggttattttagtgggacagacacttaacaccttccttgcttggccgacacatctcgtcaagtttgtgtctccagcaaaacctgcagataagccgaatcttgaggtatatgatctcctatatctaatgacattggccatcccacagttttttttgaagccgttgcaggttatgtgggatgctaccgtgttcggggtgtttaatgaagacttccccttgtacataaagcatgaagatctgtctgaaatagcacatggtggtcaatgtctcaacatctttgttatacagttgtggattctgtaa

SEQ ID NO: 72468 - DNA, 301 bp, Glycine max
  Peptide Sequence Number=SeqID_164153
atgctaaagttgtcagataacatcataaggttccatagaagagtcattcttggtatgctagaagtggtatctagtccttggaggtatacagtagggaactggttatgtaactcagatctggttagtcctactggtattgaacaggttctaactgaaaaagaccttctggctgactcgtattcagacctagaggcttttatccttgatgagaaggaatttctcctattgaaggctatttctacctttccggagttatcctgtttaatgtcctcaataattggagcgggtcggggatcagacg

SEQ ID NO: 72469 - DNA, 201 bp, Glycine max
  Peptide Sequence Number=SeqID_164154
atggccaactcctatagtgtgacggacggtgtgtacaaggcccgggaacaaattcatcgtcgtatggttgaccggcaactactagcgattctagcttcatgcaagtttttggagttagctcaccctcgtgggatcgcgatcctttgtcccgtccattgtagcacttgtgttgcccagggaagaaagggcatgatgacttga

SEQ ID NO: 72470 - DNA, 243 bp, Glycine max
  Peptide Sequence Number=SeqID_164155
atggatacctcaaagccttacactggggcaatgaggggcatcatgcatgagcctcaaggtggacccttgggtactagtaccctcacttttagaggtctacacgtcctcgccatcagagggctacacgcccttgccttcagagggctacacgttctcacctttagagggttgcacgtcctcgccttcagagggctgcacaccctctcctttagtgggctggacgtcctcaccttcaaagggtga

SEQ ID NO: 72471 - DNA, 129 bp, Glycine max
  Peptide Sequence Number=SeqID_164156
atggggctccgaataaaagtggagaatggagaattggcgaacagcgcgaggcaatcaattctccgggctccagactcgaagggctccagactcgaaggtggaggacacatgaacagcgctaggcaatga

SEQ ID NO: 72472 - DNA, 183 bp, Glycine max
  Peptide Sequence Number=SeqID_164157
atgtcaggacctgagtgttgctcaaacccgccagttttgaacccgaatgcaggagctggccacgttgagaaactcggtggtctcaattcctatctctctggttcccctaattccattgccatttttctcatctctgacatttatggatatgaagcaccaaatttgaggccttgtgccttatga

SEQ ID NO: 72473 - DNA, 339 bp, Glycine max
  Peptide Sequence Number=SeqID_164158
atgaggtccttcaatggtgattttccaccatggagatgcagcggaagacaaaggagaagaggagaggggaggcgccatccactagggaaaaagccatggaagaaggagctttgccaccaagaatgtgccttggataagaagcttggagaggatgcttcaatggaggaaaagaaagagagagagaaagaaagaagggagcatgaaattgaaggaggaaaagggggagagaagttgaactttgagttgtgtctcacaagattcccattcatcaaagttacaacaagtattatacatgcttctatttataaactaggtagcttccttgagaagctttcttga

SEQ ID NO: 72474 - DNA, 345 bp, Glycine max
  Peptide Sequence Number=SeqID_164159
atgatttccgaaagtgatagtgatccaccttcccctcgatccactaagctaatggcttcattagataagcaaatgggaagtgatgatggctttgaagaaggtagaagacatagacataagaggaataaagatggaatggatgatgtgaaggtcaaaattcccaagttcctagagcttcaaagctacaaccacgtggatgaacttatacatagggttgtgaaagtggagcaacaattgaagaggaaacaaacctacaagaagacttcatacacttattcatcttggaaggataaagacacgtccaagaaggagggttcttcttcacaacaattgagtttgatgtaa

SEQ ID NO: 72475 - DNA, 297 bp, Glycine max
  Peptide Sequence Number=SeqID_164160
atggatgaacttatacatagggttgtgaaagtggggcaacaattaaagaggaaaaaaacctacaagaagacttcatacacttattcatattggaaggataaagacacgtccaagaaggagggttcttcttcacaacaattaagtatgatacatgagattgcctttgagatgcatttgatgcaatcctaccttgcaagggcattggatagaagactccaagaagattgggctagagatgcaagagaagaccctagggttctcatgagccttaggatagatttcgggcccatgggctaa

SEQ ID NO: 72476 - DNA, 1329 bp, Glycine max
  Peptide Sequence Number=SeqID_164161
atgaatagtgtctccaagctgttcgagtttgactcaaatgtcttttgccatttcaaggaccgtttctttaagttcctagctactgatgtcgtggctgatgggatgccattgttgttcaatagggactgggagccccgcttccctttctattggcagtttgatcctaccagtgctccttcctctattttggtaaagaagaagagggatgatgttgctgggccattaggtcgcaagaagtcgaaggcccctatgagcctctgtgccctgaggcaggttgtagggctagggctcactgcaggtcgcctcacgattatgcaagatgtgcctccggctccacaaactgtcaaggctcctgctactgctcagactcctgctactgctcagactcctgctactctttctcctgatgtgcaagtcactcaggccgagtctattatggtgccgtcgtccaccattgtggcccctttactaagtgtcggtgtggcgaccactggtgttctggcgatgctgcctctttcttcgtcaactgtggtggccctccctgctactattttagcatctatggcatcgccttctttgtcctcgtgccctcgcgtctccctcgatcatttgtacacttctagtgatgttgacttattgtggggtgccacttataagctggagcagaagaccctggttaactttgtatcagccttcgacaaaaatctcttcaggttggctggggtgctaaatgatactaactttgccaaggtgtttctccaaaggagtttggcaattttggaggagaatggactgcgacaccaagaggctgtgcaaaaggttgcatccttggaggcggatgttgcaaagtggagggctactgctcggactctgtggcgagtggagcaccctaaggtggccaatgccactattggttttgttgaggataggcttgccaagaggattgctaagttggaggcccgaattaaagtgtcggagtccagattggaggagtctgagttgcgggcttctaaggagagggaggccagcaaggagctcgaggaagagctgattctttacaagaaggaggccacagagcaatatgataaaggctttcaaaaaaccgtcaggcaggccgatttctttgcaaatgaccttgtattaggtctctttgatcccttcaaggatgtgaaggagggtgtcttgcttgatgaggaagagattgatgtgaaggagcaagctgctgatgaaggggaccttcctagttggggacaagctttcctactcggggatcctttttggcttccccttggactcatcatacaaggtcgtcgggctgaaaggctcgtg

SEQ ID NO: 72477 - DNA, 441 bp, Glycine max
  Peptide Sequence Number=SeqID_164162
atgatgaaactggtattttatcgagaaaggcttaatggatactatggagtagcagcatatattttagccaacttcctttcttcattcccattcttggttctaattgctctgacatcctgcaccattatgtataacatggtgaaattcaggccaggaatcaatcactttgtgtttttctttctcaacatctacagctgcatctccgtaatagagagcctcatgattgttgtagcttcacttgttccaaatttcctcatgggaataattacaggggctggaataataggaatcatgatgatgacctccggattcttcacgttgctctctgatcttccaaagccagtttggcgctacccatatttatatatcagttatggttcttgccttcttgggcaatacagatggtccttatttggatacatgggcactcaatatagttag

SEQ ID NO: 72478 - DNA, 237 bp, Glycine max
  Peptide Sequence Number=SeqID_164163
atggttggtgtgttgcaatcaaaacaaagccaaggggtcgcaaagaatctaatgatgtggaagaagatgtgctttaccaagaaggatgtagaaggtggtcctgaagaagtggatgagcctgaagaacccaaacaacatgttcaagtacaagaagaaaaagaagaagtattggcagaagacaatcaagagatggaattagaagatgactttgatgtctctagctctaaagaagattag

SEQ ID NO: 72479 - DNA, 222 bp, Glycine max
  Peptide Sequence Number=SeqID_164164
atggatagattttttaatggcttgaatagggacattcaagatgttgtagagcttcaaagctacaacaacatggatgaacttacacatagtgttgtgaaagtgggacaaaaattgaagaggaaacaaacctacaagaagacttcatacacttattcatcctggaaggataaagacacatccaagaaggagggttcttcttcacaacaattgagtttgatgtaa

SEQ ID NO: 72480 - DNA, 210 bp, Glycine max
  Peptide Sequence Number=SeqID_164165
atgactttgagcttagctcatcagtgggctaagcacacatccaccgctaagcgtagcttcagcgttcttagcgcgacaaaagaatctggcagggcatcaatatcaaggccgcgcgctaagcatgagatcagtgcgctaagcacagtagttgtcttcagccaggctcagcgcacgactggtgctatgctgaaatccacttactcacgctag

SEQ ID NO: 72481 - DNA, 267 bp, Glycine max
  Peptide Sequence Number=SeqID_164166
atggttaaagctgtctctagaatatttccattggatttaatgatgaaaaatgtgcaatttcagttgaacttagctcatcaatgggctaagtgcgcatccaccactaagcgcaacttcagcgtgcttagcgcgatagaagaatctggtagggcgtcaatatcaaggccgcgcgctaagcgcgagttcagtgcactaagcgcaacagttgtcttcagccaggctcagcgcacaactggcactaagctcaaatccacttactcgcgctaa

SEQ ID NO: 72482 - DNA, 120 bp, Glycine max
  Peptide Sequence Number=SeqID_164167
atgtataagagaaagcttaatgatggaacccttgtggctataaagcatgtcaagaaggatttacaaaacaaaaacttggctgagttcaagaatgaaataaacaccttgtcgaaaatttga

SEQ ID NO: 72483 - DNA, 1347 bp, Glycine max
  Peptide Sequence Number=SeqID_164168
atggttatctcaacagccacttcaaataacaacaacattcatcagttgcaatctttcaactctcataacaacaattaccaccttcgtgatgcgtccttttcttcgtacttgaacaacaaagaagagatcctggcagaatcaggccatggctatgtcaacaacagaaaggatcctcttggagtaaagaaggaatatgatggagaaattggagtatttgaagctgaaaagtacttcaatggagaagagattgaaagccccccaagagttgctaataatgatgccaacaagcatcggccccaaaaagatgaacaaacaactcttgtaaccagaaagtacaaagttcaaaatggaactccaagtgtaaggtctgaatcaagcttgaatagccaaagtgcacttttgcgaagtgctgtgacgaactcctcaaggaacatgaaaagcaaattgcataggaagagttttctagttggtcttggttgcaaatgctattgttctgacaagaattatgttgatattagtcaccatgcaggtgaaatcagtttcagcaaaaattctagtcacggaaaaacaacttcaagaaatatgttcaatgctgatccaaaggctaatcattcagttaaagttactaggcctcacgcagccgaaatctcgattaacaaagatgtttacttccaaagcccagagaagttaggggtgggattgagcaaagaaaatagtttagcactcttaggtttgaattctagcttaggaaataatccggcgaaaatgcaacttctacaagtagagaagtcaaggaattcattggaagtgtttggctccccaatattgagtagcaggagcaaggcccctacagcactgattaataggctaactaccactcaaaggcaatttctttggggtggtagctttgaagggaagaagatagcttgggtagcttggagacaggtgtgtgcctctagagatttgggagcaaaccttggtgacaaagatatgttaccagcacttgctgccagtgtttgttgccaagcagcagatcttttgactgtttgtgcacatcatagtcccatgatcactatctcaatatttgagtatgagtatctaacaaatcatgcagccttagtagaagaaattgctgataaaaaagtagctgcacctgaggcatggattgaagctctcaaggccagcgaggaggaaatactgatggaaacaaaaataactcaaagagaactcaaagaatcaaaattggagcaagagctggaggtttacaccaaagagaagatgctttcaagaagagttagtagtagtgaggagtttatccaagaacttcatagtttaattgccaagtga

SEQ ID NO: 72484 - DNA, 357 bp, Glycine max
  Peptide Sequence Number=SeqID_164169
atgaggggccatccaatcggcgactcctccttggagggggcacgccatgaaacttctgacagcgagcccacttcctccgagagattcaagtcttttgatgaggatctgttgaccatagtggagagggttgacaaggctattctagatcaattttcagtcttattggatgctcgggcaatcttgtcccttccttcgacgaacaatcctctctctgccttacatgatatcatgggagatttcgcatggaaacccttagttaagccgatcggacctattggtggtgatatgtcttcttttgctgcgaagaatagggtcaacctactgctaaggttgaccctaatgatgatgaagttttga

SEQ ID NO: 72485 - DNA, 396 bp, Glycine max
  Peptide Sequence Number=SeqID_164170
atgaaggtgcttggtgcattagtcagccttatgattcattatgcggggtgcatgagtaggctgaacaccatataccctttgggcctccaagttcgctcactcgacaacaagcgtgtggtttcctacaagatgcagtttcttaagctcaacctcattggatttattctcatgctgctcgatggagattcaactcagtcactcattccctcttcttctcagtctcacatccaatatttggaagataagtatcctgaccctcctctgcttcctcatgatattcaccaaagagccatcaatttccaaaagtacatagggcaaaaagttggcgttgatgaaaaacttccttggacccaaagtgtaattggaaaaggctccgtatggtttttcaagtattag

SEQ ID NO: 72486 - DNA, 399 bp, Glycine max
  Peptide Sequence Number=SeqID_164171
atgggcactagtgaagatgttgcacccaaatcagtacttcttggaaacgatgcctttgtgaggaaacttctattggcaaagccatttagtgaaaggtcctccagagtttcttccactcgttacttcagtgatgagtccagtgcggtaccattcacatgggaagagaaacctggaacacccaaaaaatcaccaaccttagactttgttccaccccttacttctccaccaccagtcacattgagaccccttcatggaccaaaaataccttctccaacgactcaccgaagatcatgcttttttaagagcccatggagaatcctcaagactaagaaagttgggaaggcattcatcaagggaaatgatcagcatgatgatgctctaagagagtttagatcatga

SEQ ID NO: 72487 - DNA, 583 bp, Glycine max
  Peptide Sequence Number=SeqID_164172
ggacaaagggagaaaccaacatcaaccctttaaagattttgctcatggtgacaatgccgaggacctcgacgtcacgcttagccttgacctcggcggcaatggcggagaggcagcggagctcatcctgagtggcgatgaggtcctgcttgagtgccacgtggatgcgggcgagggcgcggatcgcggcgacggaggaggaggaatgcgcaagatgcacctcatcttcttgcaattgtttccgctcatttttgcacctctccctttctcccctagtaatggcccgtggctgaatgagcacatccaagatgcagagaacacccttcacaagccacttctatttgggcagtttggtatttccacaaggagttatggtggaaactcaagaccaagggatcaattattcaacatggtatattcaacaatatactcatcagcaagcagtggtggggttgctgttggtggcttgttttggcaacttatggctcaagtaatggatgcttatcgagatggttacgaggtggtcttagatgagagcccttcaacggctaatttgattgctccagagtctcaaaaactaaactga

SEQ ID NO: 72488 - DNA, 84 bp, Glycine max
  Peptide Sequence Number=SeqID_164173
atgtcattgtggaaggctaaagcggcgagggaggaacctatggtgaggagaggagaggctgaagcaccgtcaaggagaggctga

SEQ ID NO: 72489 - DNA, 729 bp, Glycine max
  Peptide Sequence Number=SeqID_164174
atgaacttaatcattattatcaacggaaaagaacatgctttaaagcgcccttaccgaactcgtgctagagctagagtaatgggtgaagcagagaaggtgcaagagaagatgaaggtcgacatggaggccatgaaagagcaaatggccacaatgattgaggtcatgatgggcatgaagaagataatgaaagccaatgcagttgcagttgccgctaccagcgctgttgctaaggtgaacccgatgcccccatctgatctcaaccaaatgaatcatccaacctcatatatggtgggcaaagatttgggaagtacaggcggcccctattatgtgaaaattcgaaatgagcacgccttcccgccatatggcttgcctcccaactatacaccacccaatgtggcgtacactcccaatgagaatgtcaataactccactcccatactcattgagagccgacaaccccaaactgatcatgcacatgtctctcaaactatgggggagacacatgaaatttcccaccacaatctagcggactttgagccttgcctcagatacgccactgaagggcaagcagttgatggtatacccctgcaaaacactttggagggtcctcagtatcactcacaaccacacccctcacattcgacagcggttaaaaaccctcatgctatggcagaaatgagaaagttggatcatctagaggaaagactcagggccattaaagaaggctga

SEQ ID NO: 72490 - DNA, 249 bp, Glycine max
  Peptide Sequence Number=SeqID_164175
atggagtcatcaactgtcacaacctacccttcggcgagaaggcggtgcggggctcacgggtgcgtcttccaagaaaggaaaatgcgcagagtcgccaccaacatttattcaaggaaaatgtcagaaaaattggaaaggagagaagcgttaaggcgttgcaccattaacgatctcttggagtggtcgacaaaagtggggtttttgcttccacgtatcctcaattacgatgaggaaatcagacctacgtag

SEQ ID NO: 72491 - DNA, 396 bp, Glycine max
  Peptide Sequence Number=SeqID_164176
atgggttctccactagcctccactcctcctcctcctcttcctcctccttcttcaccttctcctcctcctcctcctcctacttcggacgcatcggttgcgccgtctgccgtgaagcggacacgcaaagcctcacgtctacgattgttgtccactagaccacctggtgctgagagaccagtggtgcatgttgatcctgctaccgagaaggccgacgatccccacaggaagaaattaagaacatatttggggattgtggcacgtgataaggtggacatcacctacgagaactggaaggaggcccctactgctcagaaggacctgatttgggaggatattcaggcggaatttgatatcccagaggcttctgacagtaggacgaataggaagttactatag

SEQ ID NO: 72492 - DNA, 276 bp, Glycine max
  Peptide Sequence Number=SeqID_164177
atgcagcagctcctcatgacaagccttgggaaaatagagacatggtgctgtttgagatgggacttgagtcctatgggactaccatggtcgcacgcaagttccaaccaactgcttttgcactatggacaactgctaaaccaggtgcattttgcctggacaaaccttgggatcccgggagtgttaggagggagaaaacaaaccagcaaaaggacgattgagggcacaaaccaacgacccaaaagcaaaaccatcaagcacctggttgattccctctaa

SEQ ID NO: 72493 - DNA, 378 bp, Glycine max
  Peptide Sequence Number=SeqID_164178
atggaggccgaggcagagaacaacgacgtgaagaaggaagaaaacaacaatgataacaacaacaacaatgaaagtaacggcaaaatcgggaattcgagtgagtgtctaagcaagcccaagcgtcaaatgaagatgccgtttcagcttgaaatgctcgagaaagcttatgttgaattactcgtgagagactatgagggtggagttgtcggagaagttggggttgttggattggcatttgtagatgtggttctgtcacaggcggttgaaggacaagaaggagttgccggcaaagaagccgcgaaaggtagtggcgttgccggattctccggtggaggagcccaagttggtttttatgggatatgcaattcaaccgtttaa

SEQ ID NO: 72494 - DNA, 438 bp, Glycine max
  Peptide Sequence Number=SeqID_164179
atgaactctatatggattccttgggatgttggatacaaacctaggttgtctggtggtgttgggacaaaggccgaattgtctaaaaagaaattctgggtgaaaaaagatagagaagatgcaaacaacttactgacagtagggaagaatctgggggtatctatggcagaaaagcacactgcaatggtggagaaacttgtgtttatggagccttgggatataaacagaccagaaagctggaaggtgtgtagagggatgcatgggaggggtggtgatagggatgtggtgttagttagtatttatttgccatatgatttggttggaaaaaggaggttatgggacgagttgaaagtcatcaaggaagactctaatgttactagatggcatgtcatgggagactttaattgtatcaggaagagaggtgataaaagtcttgggtag

SEQ ID NO: 72495 - DNA, 207 bp, Glycine max
  Peptide Sequence Number=SeqID_164180
atggatgtatcagtagggtccaactcagaactttgtgtgcaagttactggaccggagtcatggagcagtttggaccactacagctccaccaagtggacctttgactttaatatctattggacaagacaattacaaggtacgatgcaacttcaaaaggttggagtcacagattgtacagggaaattatcacatcagactcaattttaa

SEQ ID NO: 72496 - DNA, 117 bp, Glycine max
  Peptide Sequence Number=SeqID_164181
atggattggaaaaggaaattggtgcattgcttgaaggaagatttaagtcttggaggtgtattgggagtctccaagagaccccccaaatctctatttgtgtatgatagcttagtgtaa

SEQ ID NO: 72497 - DNA, 387 bp, Glycine max
  Peptide Sequence Number=SeqID_164182
atgaaccattcagtgtttcgatcaggaagacaaaagataccaagaaaggagggcaaaaggagttgcgctaagcgcgaaaagcggactctcgctctcgctaagcgagatctgcagattataaatacgttcttcaacgtgaaaaacatgatttcccccctctcctcctctccaaacgccacccaaaccctaacacctccttctccaccacccacgaccaccagtggccaccacgagccgccgttccttgccgccaaacctccatgccaagaagaatgttgtaatcggagcggaatcctcagaatcctcctcaaggattcgatggagaaaattccctcaatccttcattacatagcttctgatgtgccatcattttcttctattttctaa

SEQ ID NO: 72498 - DNA, 96 bp, Glycine max
  Peptide Sequence Number=SeqID_164183
atgcaagcctggaagagaaatcatgatagcaaagtgaagaagaaagtgaagttttctaatgttgtggaagtgttgggagatacttccgttgggtag

SEQ ID NO: 72499 - DNA, 1832 bp, Glycine max
  Peptide Sequence Number=SeqID_164184
ggctacactccctcagcttcagaggactacatgtcctcgccttcaaagggctacatgcccccaccttcagaggggtacacgccctcaccttcaaaggattacacgtcctcgccatcagagggctgcacgccctcgccatcagaggactacacgtcctcaccttcagagggctacgcgccctcaccttcaaaggactacatgtcctcgccttcagaggactgcacgtcctcttcttcagaggactacatgtcctcgccttgagagggctgcacgccctcgccttttgaggactaaatgtcctccccttcagaggactacacgtcctcaccttcagaggactacacgtcctcaccttcagagggcaacacctcctcaccttagagggctacatgccctccccttgagaagactacacgtcctcacctttagaggactacacgtcctcgccttcagagtgctgcatgccctcaccttcagagggctacacaccctcaccttcaggggactacacgtcctcgccatcagagggcttcacaccctctccatcagaggactacacgtcctcgccatcaaagggctgcacgccctcaccttcagaggactacacgtcctcgactttagagggcaacacgtcctcccatgcagaggactacacgccctcgccttcagagagctacacgtcctcaccttcagaggactacacgtcctcgccttcagtggaccatacgtccttacctttcagagggttgaacgtcctcaccttgagagaggcttcacggcctcaccgtcagaggactacacgtcctcaccttcagatgtctacacgatgtccttttcaaaggactacacgtcctcgccttcggagggctacatgccctcacaccttcaaaggacttcacatcctcgccataagaggactacacgcccagaccatctgaggactacatgtcctcgtcatcaaaggactacacgtcgtcgccttcagaaagccgcataccctcgccttcagaggactacatgtcctcggcttgagagggttgcacgccctcgccttcagaggactacacgtcctccctttcaaaggactacacgtcccctccttcagagggctacacatcctcaccttcagaggactacacctcctcacctaagaaggctagatgccctcaccttcagaggattaaacgtcctcacctttagaggactacacgtcgtcgccttcagaaagccgcacgccctcgcctttagaggactacacgactacatgtcccctccttcagagggctacacgtcctcaacttcagaggactacacctcctcacctcagagggctacatgccctcacaatcagacgactacacctcctcaccttcagaggtctacacgtcctccacttcagaggactacacgtcctcgccttcagcggtctacacgtcctccacttcagaggactacacgtcctcgccttcagagggctacatgccctcaccttcagagggttacacgccctcaccttcaaaggactacgcgtctttgccatcagaggactgcacaccctggccatcagaggactacatgtcctcgccatcaaaggcctacacgtcttcgccttcagaggactacacatcatccccttcagaggactacacgtcctcaccctagagggctgcacactctctccttcagaggactacacgtcctcaccttcagaggactacacctcctcacctcagagggctacatgccttcaccttcagaggactacacatcctcagcttcagaggactacatgtcctcccctttagaatactacacatcctcgccttcagagg

SEQ ID NO: 72500 - DNA, 477 bp, Glycine max
  Peptide Sequence Number=SeqID_164185
ccagatgtagtcccagttgcaatcacagatccaatcacagagacttcactgcctccagagcctgaggttggtccctcagctgctcgtgttagcacaaaggggagttgtgttgatccctcgtcgaccgttctagagacgggtgactcaaacaaatgtgggttgtacatcgaagacaatccttcccgcctggttaccctaggaagagtttatgagggatccacagcggttcacaacatccctttgttgcatggccaagtcaaggtaggtgttgaggaggttaaagatgcagaggctcccgttcctatacccactcacgaggttattttagtgggacagcttttcttgaagcctctccaggttatgtgggatgctaccgtgttcggggtgtttaatcaagacttcccattgtacatcaagcacgaagatctctatgaaattgcacatggtggtcaatgtctcagcatatctgttacatag

SEQ ID NO: 72501 - DNA, 1311 bp, Glycine max
  Peptide Sequence Number=SeqID_164186
atgattgccatcatcaaagctgcgccaacaccgccagaagcgaaaaaagaattgatggcacgcagctggcactcgccagtggttgaagaaatgctcaagcgtgcagcgatggaagcctctcgtccggaaggcttgtctgtggactttggcctcacccctaaaggctacaaactgtctgatgtgcaggcgcaggaaatcctgcagatgcgtttgcaacgcctgactggcctggaacaagacaagatcgttaacgaatacaaggaagtaatggacatcattgccgacttgctggatatcttggccaaaccggaacgcgtcacagccattattgttgaagaattgaatgaaattcagaaacagtttgatgtcgtggttactttgtcgcatacgggttacgtcaaatcacaaccacttgacgagtaccgtgcgcagcgacgtggtggcagaggcaagcaagcggctgcgacgaaagaagatgacttcatcgacaagatgtttgtcgcgaatacacatgactatattctgtgcttcagtagccgtggtcgtgtgtactggttaaaagtttacgaagtaccacaaggtagccgcgtcagccgtggcaagccgattgtgaacttgttcccgttggaagagggcgaaaaaatcaatgccatcctgccggtaaaagagtttgatgaaaaccactatgtatttatggcgacagccaaaggtactgtgaaaaaaactgctctgacagaattcgctaatccgcgtaagtcaggcattatcgcgattaatttggatgagggtgattacctgatcggtgccgaagtcaccaatggccagaacgacattgtgctggtttccaatggcggtaaagcagtctggtttactgaagatgatgtgcgtccgatgggccgtgcaacgcgtggcgtgcgcggcatgaagctggctgccaaacagcaggtattgtccttgctgattgccgaaaacgatcagcagtctgtattggtcgcaacagaaaatggttacggtaaacgcacagtcttgtcagagttccgtcattctggccgcggcacgcaaggtgtgaaagcgatcgcgattagtgagcgtaacggtctggctattgcagccaagctggtcacagctgatgacgaaatcatgctgattacaaccggtggcgtactgatccggacccgcgtgaaggaaattcgtgacatgggccgcgctgcacaaggagtgactctgattaacctgggtgaaggtgagaaactgtccggtctggagaaaatcgtagagaccgatgacgatggtgacgacagcgaagaataa

SEQ ID NO: 72502 - DNA, 312 bp, Glycine max
  Peptide Sequence Number=SeqID_164187
atgccattttatagcaataatgagggaggtggttgctgcccagctcgcccaggcgagctaggtagcttccacttgaagcaacctccctccaaaatattccagatgggcccagggctagggtgcagacgaccatgttggtctttgcgcgctatcggacttgattgtcttcaggatagcaaaagagagccttcatgcatcatcagacttgattgtctctggatgacaaaagaggctgcaaaaaatctccaaatgattagaaacggacgaccatcattgtccccgataccatcggactcgcttgtctctggatga

SEQ ID NO: 72503 - DNA, 111 bp, Glycine max
  Peptide Sequence Number=SeqID_164188
atggtgtacaaaggttggagctttgatggagcttcaatggtgaggaagaagaaaggaatagcaactccctcgcgtttctctgcacccgtcggagccagttttcgaaagtag

SEQ ID NO: 72504 - DNA, 891 bp, Glycine max
  Peptide Sequence Number=SeqID_164189
atgaaggacaccaccagagaaggctccagcactgccacgcaagctgacacggacttcgacacgcaccgattctggagcacagagcatcaacaacattttgagaccatcaagggatggtcattcctcaaagaaaggcgggtccaactgagggatgatgagttccctaactttcaggaggagatagcccgtaggcgctgggcaccacttttgcacccatgggggccagtggattcctttcgacacagatgccctcagtcagttcctggggcaccactgatcttggcagagggccaacagtgtgagtacagccagaggaggagacaagtctctagctttgatgaggaggccattgcccagctattatgcatactggggcaagattttgctcggaccgctgtagggagacgggtgagtgtacatgtggctcagctaatttctgacgtcgtttatcagtttgcaggtgttgcacccacgagacaccctgtggacccggaaaagtccaacaaggccttggggtttcccgctttgatcacgaacctctgccggttctacggagtgcccgtcacccccagcaaggtcatccagccgcccattaatagggccttcaatgagaaatactgcacccccaagcaggcacagggccaagcaccgcagcagctgaaggaggaccaacagccaactatagatgcaccactgccacctcaagaggagaggataaaactccagatgcacaggtatatgtgtcacatgactagccagcaggcggctaatcacaaagggcagaggcagctaaatgagacgctctatcgttacaacctacaccagcaaagtcaggaccccagtcctttcccttggcccactcccaagcagttcgaggccacagtggcctag

SEQ ID NO: 72505 - DNA, 114 bp, Glycine max
  Peptide Sequence Number=SeqID_164190
atggaggttgaggaaccttggttggggttatggctaccattgcattatcatgtagataagggaggtggtgtttggtatcgaatgtgcggcaagcaggctttatggatgatttag

SEQ ID NO: 72506 - DNA, 129 bp, Glycine max
  Peptide Sequence Number=SeqID_164191
atggcattagtgcgtgcctcaatggcattagtgtccggcgatggagaagaagcccacgaggatgaggagatggccgatttgcttgacttcttgggagggagtggagataccgcatacatttttgtttag

SEQ ID NO: 72507 - DNA, 570 bp, Glycine max
  Peptide Sequence Number=SeqID_164192
catgagggcagcagtccaactaaagacactgaagctgttgaagcggtcaacgatgttgttgtagatgaccccttgcgcgagttgattaagagcctagttgacatttatgagaagcctgtagagttagtgtgggatgtaactaaatttggaattccaaatgcagttgcatcattgttcgtaacctgtgctgatgtgaatgaaataatatcaggcgtacagtgtttgaacatagttatactacaattgtggaccatttatatggaccaattcagtcaaagcgacggtctaggatcagtgtatggattccttgagccgcaggctatactgaatgcaaatgatagacgtggacaatgtgaagaatacattgaaaaattgcttaaggaatcgaaccgagatgcctatctaggcgcttatttgaatcatgcatttaagactttggaaaccaagagtgatgggaaatttggtcacaatacaccacggtggattgaagtgaagtggttcagtgatggcacgccgctagacatcaatatcatgacaacattacgaaaaaatgggcagaatattttgtaa

SEQ ID NO: 72508 - DNA, 278 bp, Glycine max
  Peptide Sequence Number=SeqID_164193
cgtctcgatatgtgatgtgcttgaatgggatgtccgagtgaaaagttatgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttggcccaattggtaacctaggcatcagccttttgggagaccaaatggtggctgacttgttggctgttgggg

SEQ ID NO: 72509 - DNA, 494 bp, Glycine max
  Peptide Sequence Number=SeqID_164194
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccaagcccgatgtgaccattacatcagcggattctgatactgaatttgatgaagaagatgacagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 72510 - DNA, 528 bp, Glycine max
  Peptide Sequence Number=SeqID_164195
atgaaggccgacatgggggccatgaaagagcaaatgaccacaatgatggaagccatgatgagtatgagaaaaatgatggagatcaacacaactacaatcgttgttgtaagtaccgccactgaggtggacccgactcacccatctggcctcaatcaagtaaatcgtctagtctcggagttggtaggtcaaggaggcggagcattgggaagtacgggcggcccccattttgtgcaggtccagagcaagcattccttcccatcatatggcttgcctcccaactatataccacccaatgttgcacacgctcccgatgagaatgtcgataactccgctcccatacccattgagagccaacaaccccaacttggtcatgcacaggtccctcaacccatgggggagacacatgaagtaccccgagaccacactctagctgactttgagcctcacctcggatatgccattgagggggcaggcattttgtggcatacccctgccaaacactttcgggggccttcagtattcccataa

SEQ ID NO: 72511 - DNA, 99 bp, Glycine max
  Peptide Sequence Number=SeqID_164196
atggaggtgctcatgattcaagccaagatagaaaaggatgaagaggaatttgttgaaatggaggatttacttctcaaagcaatccatgtagagcaataa

SEQ ID NO: 72512 - DNA, 522 bp, Glycine max
  Peptide Sequence Number=SeqID_164197
atggatgcaagtgatcacacaataatgcatgataggactgatatccctaccaaaagaagtctgctagagctttcatctcaggatgcacttttggcacagaacaagttgttgtccaagcagcttgagacattgaccgaaaccttaagtaagttgccaaaccagtttaatgctaatcaaccttcccattccgatgttttacaggtagaaggttgcagcatttgtggtggagctcacgagtctaggtgttgtattccctttgatgattctgcacaagaagtgaattacatgggagggagtcaacccatacaagggcaatggagagcctaccctgacaatcaattcaacaaagagcatggtggaccatttaataggcctcaacaacaggggcctagcctatatgagagaaccacaaagctggagaagacccttgatcagtttatgcaggtttcaatgtccaaccacaagagaacaaagtcagccatcaaaaaccttgaaatccaggtgcgtcagctggccaaatag

SEQ ID NO: 72513 - DNA, 633 bp, Glycine max
  Peptide Sequence Number=SeqID_164198
atgcagaggaactcgcctgcctcctctagcgatacttctttcttgccacagctatcccttttctccggaagacctttcactggaatatcctcgttcggagtgagggtcgttttgtcattttgttcttccactatctttgtcttcccattaacgtttgcgggttgtgtcggcaggtcagggggtgcaaacacgggactgctgcgggtcatgccgctcagccccgtgatattggttaccttggctgacaacaagctgatgtcggtggcctcttccttcctttcgcttggaggtgcatacctccacggaactgcgtggctgtttcggtatggaaacggaacaggtttaactatcgaggggtattggggtgtttggggagctgcgtctttggtgaaatataccaccaaaggcttaggccttccaaaacttctctcatctgcggactgcatacatatatgctgctcttcactcccctcatcgccaacttccagtcgacctcgatctatcatctattgcaacaggtcctccactgctaaacatgtttccatgttatgtagctcgccgggatgcatcaaacaggaatcctctccgtgcccaccatggggaattacgccccccttttgtagggcctcatag

SEQ ID NO: 72514 - DNA, 518 bp, Glycine max
  Peptide Sequence Number=SeqID_164199
atgttttccaagaaggatgaaatgatgagaatcctgaaactagccaaatacaggctaaaggcccaagtggagaaggacgaaggcccaagtcgagaaggacaaagcccccgagtggagaaggatgaaggcctaagtggagaacatttgtctctggaggactacacgtcctcgcctttagaggactacacatcctcgccttcagaggactacacgtcctccccttcagatgactacccttcctcgacttcagaggactacacgtcatccacttcagaagactacacatgctcacctttagaggactacacgtcctcgcctttagagggctacacaccctcgcctttagaggactgcatatcctcaccttcagaggactacacgtcctcgccttcagaggactacacgtcctccactttcagaggactacacatcctcccctttagaggactacacgtcctctccatcagaggactacatgtcctcccctttagaggactacacgtcctcaccttcagagg

SEQ ID NO: 72515 - DNA, 829 bp, Glycine max
  Peptide Sequence Number=SeqID_164200
gttgcacgaagtttgaatcgttccattttcgacgcgccgctgctgtggcagatgcatggcctgcattcgccgctgctggaccgcttcttcgtgctcatctccaaactgggctacgaatggttcctgatcccggccgacgtgctgatcatcggcgcgctcctgggctaccggcgttggcgcgaggccaccttcgtggcggtcagcttcgtcggctcggcgctgctgaacatgggcagcaagcacttcttccagcgccagcgccccagcctgtgggaatcgatcgcgccggaatcgacgttcagcttccccagcggccacgcgatgggctcgatgaccctggcggtgaccctggtactgctggcctggaacacccgctggcgctggccggtgctgctgctggcgccggcattcagcctgctggtcagcgtgtcccgggtctatctgggggtgcattacccctccgatatcctggccggatggtgtgccgcgctggtttgggtggtagggtgctatctggtcatgttcagtcgccggcacccttggcgacgtcacggcccgccgccagcgaaggccagcgaagcatcatcacagggggattgacgttctgcaagacagggggcaagcacaacgcgcggtactgtgatgcgcaaggcagattgccggggtcgcattccgaacgcgcttgcaggggtatcggcaccccacctagcttgacctgcaatggccgcattcgaagaggtggtgggcgaagccgagaccggcgaggacgcgctgcgcgaggtccgccagatgctgccggacgtagtgctgtgcgacctgcatctgccgg

SEQ ID NO: 72516 - DNA, 879 bp, Glycine max
  Peptide Sequence Number=SeqID_164201
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtgcggctgacgcaacgttagggagtccggagacgtcggcggggccccggaaagagttatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 72517 - DNA, 456 bp, Glycine max
  Peptide Sequence Number=SeqID_164202
atgggtggaacagacgaggtgcaagagcggataaaggccgacttggaggccatgaaagagaaaatggccacaatgatggaggccatgatgagcatgaagaagataatggaggtcaatgcggctgcagttgccgctaccagtgccgttgctcaggtggacctgactcccacatctggcctcaaccaaataaatcgtgccatctcagatatggtagggcagagaggcaaagaattgggaagtacgagcggcccctattttgtgcaagttctaaacaagcattccttcctaccatatggcttggctcccaaccatacatcgccaatgtttcacacactcccaatgaggatgtcgacaactctgcacccattcccattgagagccaacaaccctaagctgatcatgcatatgtctctcaacccatgggggagacacgtgaaataccccgccataatctaa

SEQ ID NO: 72518 - DNA, 900 bp, Glycine max
  Peptide Sequence Number=SeqID_164203
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 72519 - DNA, 504 bp, Glycine max
  Peptide Sequence Number=SeqID_164204
gcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccctttgctaggcagacacagttgtgtccgatggcaagcagagaccaagtttggtcattctgcacccaagatacgcggagataccttacggttatctgcacccctttgctag

SEQ ID NO: 72520 - DNA, 177 bp, Glycine max
  Peptide Sequence Number=SeqID_164205
atggactcgggaaggttccaagttagtgtaccaggggtataccaccaactgcttgcccttccgtggcatatccgaggcaaggctcgaagtcggctagattgtggtggggaatttcatgtgtcccccccacggtttaagagacatgtgcatgatcagattgaggttgttggctcttaa

SEQ ID NO: 72521 - DNA, 246 bp, Glycine max
  Peptide Sequence Number=SeqID_164206
atgacctctccagcaacagatacaatctcggatggaggaatcacccaaatctcagatggtccagcccttaacaacaacaacagcagcttgctccttccttccaaaatgctactggtccaagcaggccatacattcctcctccaatgcaacaacaacaaatgcaacagcagccacaaccaccgcaacaacaacagccacaacaacagaggctacaatcaactgaggccccttcttaaccttccttag

SEQ ID NO: 72522 - DNA, 534 bp, Glycine max
  Peptide Sequence Number=SeqID_164207
ggtggaccttgggtactagttaccctcaccgttgagaggactacacgtcctcgccttgagaggactacacgtcctcaccatcagagggctgaacgccctcacctccagaggactacatgtcctcgccttgagagggctacacgccctcaccttggaggactacacgtcctcaccatcagagggctgaacgccctcacctccagaggactacatgtcctcgccttgagagggctacacgccctcaccttgggactatacgtcctcaccatcagaggactatacgtcctcgccttcaaagggtcatgtaccttcaacttcagaggactacacgtcctcaccgtcaaagggtcatggctacacgccctcaccttgggtactagttaccctcaccgtcagaggactacacgtcctcgccttgagaggactatacgtcctcaccatcaggctgcccctcacctcagaggactatacgtcctcgccttgagagggctgtaccttcaccttgggtactacacgttccctcaccgtcagagg

SEQ ID NO: 72523 - DNA, 150 bp, Glycine max
  Peptide Sequence Number=SeqID_164208
atggataagagcttgaaggatgcaaaaatacccaaaggggagggcaaaatcaatggagtcctttgcttcttgaagatcaatggcagtggaatggagaagaagaaagatgattggagactccacttcaaggagaggatgagtcaagaataa

SEQ ID NO: 72524 - DNA, 501 bp, Glycine max
  Peptide Sequence Number=SeqID_164209
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacggaggaccgaaacatgccactgaaagactctactgagacaagacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 72525 - DNA, 291 bp, Glycine max
  Peptide Sequence Number=SeqID_164210
tctactcaactagtggcattggaaaaagtgtatgacagttcatccaccatacacaatgtcccttatgcagatgatgtggttagggattcaccgaagcatttgccgaaaccagttggatatgctgaaatggacaatgtagtggctaccgttgatccattgggagaattggttaagaacttgtttgatgtttaccaaaagccaattgagttgtcatgggatgggtcaaaatttgggatacctaatgtcaaagatggctttttcatcacacgcgtagatgtaaaactgagataa

SEQ ID NO: 72526 - DNA, 3222 bp, Glycine max
  Peptide Sequence Number=SeqID_164211
atggaggttggggaaatggacagaaaggagacacaagttgaggttccttggagccccggcccacctattaagccagttcctatgaaaccagtgccgatctacatgcctgaggagagaaaccaaatggatcatcttgcaaatggagcagttgcatgtgctgaattttcacttggccaagacaaaattggtgggtcaggtgatgggtcaaatgttgccggttacagtggcaaaacttgtgaacagatagtttcggatgctgtttccagctacagaaaacttgggttctgtgagcaactgttggcggttgaagctgaatcgaggaacatcagtgtgacacaagggaataatgatggattgaagaatccgtttgttcctccactcgtccttgataatgtcctagaccctcaggaaacatacattgcttgctgtagcatgaaatcttcacaggatacctcatatatacttgacaatgccaacaaagaagaaagcagacaaatagcatcaatgcaagtcaatatggaagaaaaggatccaggaagggaagagagaaatgtcactgccaataagcttgacaataatgtagcgccaaacagcaaagaactctgtgaccctgccatggaatttgctgctgtttcttcaccagtgaaggagaatcacaacccagataatggaagcagtcatgatactgatcttaataaaacaccacaacaaaaaccaaggagaagaaagcaccgtcccaaggtcatcaaagaaggcaaacccaaaagaactcggaagccagctaccccaaagcctgttcaatcaaaagaaaagcaacctgtcaagaggaagtatgtgagaaagaatgcactgaacaagacttctactcctccaacagaagagactggggaattgactaaagaaatgtcttgtaaaaggtccttaaatttcgacataggaacaacatatgaaagttctgctgccatagaaaatacaagaacgctattgggaaaagaaaatggtgttcttgtacaagaaacaaatgtaggtcctgcatttgatctaaacacttccatgaagcaggcatcaaacagttacatgtcactaccagaagacacacaagccctaaatacatcttcgggaagaaaaagctcagggacaaagccagaggaaaacccacctccgaagaggaagtatgtgaaaaggaaaggagtgaacaagacttctgctcctccaatagaagttcctggaaatttgactgaagaaacaacgtctgcatctgcccaaacatcatgcacagggtccataaattttgatgaaagagcaagtgaacaaagttatgcagtcaaagagaatccaactgggcatccaggcagtgaaattggtgtagtaatgaaggaaatgaatgtgggccttgcctatgatttaaacacttccatgaagcaggcattaaatgatgacatgacattacctaaggacacacaagccccaagttcatcttcaaaaatcaaactcccggggacaaagagaaaagaaaacttgactggcaagaggaagaatgcgaggaaaaaaggatcgaatccgtctcctattcctccaacagaaatgacagaattgactgaagcaatgatacttgaatctaacatgtcatggagaagatccttaaattttgatatcggaaatgtaggcagagaaaatttagatttggacattgggaaggaaaatatggtgttggaggaaagaaaagtaggtcccacctataaagacacttggttgaaagaggcagtaaatatttgcatgtcattacctgaggaaacccaacacccaagtacgtctatttcaaaatgcacttcccctggggcaaagctgaatgccaactctgtagagaaaaaaaacaaaaaaggccgggcaactgcttggggtggaaacataagtaatagtcaaagttcatcaataaggttacaaatggttggctcaaagagaaaacattctgatacctttaatcgtgcagatgacagcagcatgaatctgattggagtgcaatataatggactgccctcataccaacacctaagtacgtctatttcaaaatgcacttcccctggggcaaagctgaatgccaactctgtagagaagaaaaacaaaaaaatccgggcaactgctcggggtggaaacatcagtaatagtcaaagttcatcaatagggttacaaatggttggttcaaagagaaaacattctggtacctttaatcgtgcagatgacagcagcttgaatctgattggagtgcaatataatggactgccctcataccacactagcctttgccttcagtttccaaaaatacagaagaaaaggagaaccgaaaaggggaatgcaacaaaagaagtccaactgacatgccctcaggaagatgctctaggacatccatatgcatcaagctccagctgctggacttatggttctggatataatacagctagagtcccagccacaagtattgataatactcaaacattcaacgagtttctcttgtctttgaaaaggctggcagaaacatctcaaacctctacttgtgatcgtggttctctaactagaattagaaactgtgatactgaaccaaattatacagcaaaacaagtgggtgtccctggcaaagaaacatttggggatgcaattggtgctttagttgcagagacatgtacaccacccacaaaaaagaggcagaatagaaagaaaagtgttctttccagttcagcacattctaccacaaatgagatgctacaccaccataattttacattggaaaattgccctctgccaatggggaagccatcagacattgttcctgaagtactatggaacaccatgaacaatattgatgcattaacattgcaatttagacagctaaacttaaacgcagaagccagagaccttgcatttcatgaggagaatgcacttgtcccttataaacagaaaaacagccttatccatggagatggggtcatcgttccctttcacattaagaaacagcatctacgaccaaaggtcaaccttgatgatgagactgatagagtgtggaagcttttgctgttagatataaacagtcatggcattgatggaacagatgaagataaggccaagtggtgggaagaagaacgaaatgtgttccgaggacgagccgactcttttattgcacgaatgcatcttgtacaaggtatcatgtttgacattattcacctttga

SEQ ID NO: 72527 - DNA, 222 bp, Glycine max
  Peptide Sequence Number=SeqID_164212
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaagacctgcattcattgtagtttttgtcccaatcataatgggttttagctaa

SEQ ID NO: 72528 - DNA, 510 bp, Glycine max
  Peptide Sequence Number=SeqID_164213
atgactacgagaatgaacgagagggttgacgctttggagggacggatgctaatgctggaggaatcgttccgactgaggatggaggagttccaaaaggtgatgatggaggaatttgctagaatgcgaaacccaccgagttcagaagggatttcatcggtgtcggcggatgagaactctgaattcagaatgacggtcaagaaggtggaacttccttcttttgatggtggtgacccggttggatggatcacaagagctgagacctactttgagatacatggctcttcggaggatgtgaagatccgtttggcaaagatatgtatggaaggagctaccatccattggttcaacttattgacagaaacagaggataatctgacatgggataaattgaagaagatgatggttgatcgttacggaggccgaaggtctcaaaccagaaattcgggtaaaggtcagaaccctaaatcctcaaaaccggcttcaagccatgaaaatggcgcgggatattga

SEQ ID NO: 72529 - DNA, 3108 bp, Glycine max
  Peptide Sequence Number=SeqID_164214
atggagaattcgcgtagaccgttcgatagatcgcgagaaccgggtccgaagaagccccggttgatggaagagctggatcgggcttcgaattcgggtgcccgacagtttcatcagcgacaagtggcttctgggatcaccacgttgtcgtctgcaaggtttagaacaaacgacagagatcttgaaagcagtgattttggtcgccggggcggtgccggtggcggtggcggcggttatcagccgcagccactgccatttcaggagcttgtggctcagtataaggcagctcttgcagaacttactttcaactcgaaaccgataattaccaacttgactatcattgcaggggagaatcaagctgcggagaaggccattgcagccactgtttgtgctaacattctagaggttcctagtgatcaaaagctgccatcactttatctcttagacagtattgttaagaatattgggcgggattatataaaatactttgctgccaggctacctgaggtattcatcaaagcatacagacaggttgatccttctgtccatcaaagtatgaggcatctttttggaacttggaaaggagtctttcctcctcagacccttcaggttattgagaaggaattgggcttcactcctgcagtcaatggctcatcttctgcttctgctacactcaggagtgattcacagtcacaacgtccacctcatagtatccatgtgaatcccaaatacttagaaagacagcgtctacagcagtccagcaggactaaaggagttgttgatgatatcactggagcgatttcaaatacaaatgatgacccagagatgcctggtagaactttgggcgttggacgaccatgggtggatcctagtgttactgttaacatccattcacgtgaaaatgagcaatgcgctcacagaggtgcattcaatgattctgttctggaaaagagcattggtgcatcctatggaagcaatgaatatggttccaatatttcaaggaatttgggcttgggtatccgccgacctggtggtagggtgactgagtcaggacatgacaaaagttggtacagcaaatctggtgtcgttgcagggaccatgtctgggcaaggaaatggtttaggtcttaagtatagttttttgaatactgaagcaccaaagtccatgattttggatgtgcatcatcagcctacacagaacataagtagcacacgtaccagtgtgatctctgcgagctggaaaaattctgaggaagaggagtacacatgggatgagatgaactctggcctgactgttcatggtgcatccactgttagcaacttgagcaaaaatagttggactgctgatgatgagaatttggaagctgaagattgcctcgaaatcagaaatccttttcgggctaatgttgatagagaaatgtccattgaatctcaagccactgaaaagaaacaattaccttcatctcatcatcatccatcactatcatggcaattgcaggagcagcaatctattgatgaattgaatcggaaggcaggtcactcggacagatttgtgtccacacatggtgccataccagccaatgcaaattcttctgctgccaggatggtcaatcagcctttcctgtcaaatgcaacaataggattgccaggaattgcaggccaatttcattctttgggagctgaaaacccttcagggcagtcacctttacaacaaaggtctccgtcaccgccagtaagtgtgcacccttctcatccactgcaaaatttggctgagcaagaccttccccagaatcataaagcatctcaatttctgggaggtctgcagagccaatatattaaagattcttcacccgcccctcctcctagtattcaggttggtaacttacaaagttcacaactgaaaaacttgcagggtccattctcttcaacgacttttcaggcaaggcatcagcaccaactgggctcttctcacaatgaagttactgttaagactgagaagccacccatgtccgaagtgcctttagccagagaaactaaaagtaatctggatacagggaatcttccatctcggttaggggttcggccttcacggtcaggtggcccttcccctgccacattaatttcttcagtgtccaaaattgcatcaccatcttcgttaggtccttccagcgataatgtatctgttcttccaaaaatacctctaagaaaggctggaccacctagggcatctactctaccaccagcttcctctaatgtcagcagtgcctcagcccagacatcaagtgataccaataataccttaaatccaattgcaaaccttttaagctctttagttgcaaaaggtttgatatctgcagaaacagagtcaccagctaaggtgccttcagagttgcttactcgattggaagaacaaagcgatagcattaccaccactagctctttgcctgtggcttcagtgtctggttctgccactgtccctgttccttctaccaaggatgaggtagacgacactgcaagaacgcctatatcattgtctgaatcaaccagcccaggaatcagaaatctcattggcttagagtttaagcctgatgtaattcgagaattccattcatctgtagttagtggattatttgataattttccacatcagtgcagcatatgtggccataagcttagattccaagaacagttcaatagacacttgaagtggcatgccacaagagaaagcgaagaaaatggtttaattagtgcatctagatggtatctgaagtcaaatgattggattcttggcaaggctgagtatccatctgagaatgagtttactgattctgtagatacatatggcaaagaagcagacaaaagtcaagaggatgctatggttctagcagatgaaaaacaatgcttgtgtgtgttgtgtggtgagctatttgaagatttttactgtcaggaaactggtgagtggatgttcaaaggggctgtttacctggccaactctgatagcaaaagtgagatgggaattagagatgtgagtactggaaggggtcctatcattcatgcaagttgcttatcagataactcagtttccagtgtcctcgagacgggacaggattaa

SEQ ID NO: 72530 - DNA, 570 bp, Glycine max
  Peptide Sequence Number=SeqID_164215
atgattatggttgaaactagaggtttggatcaagctttagatagggttataggaagagccttagggagagatcatgtggagcatgcagatgataaggtccatgaacagcctgaagaagcggttgttgatgatgtagttcctgatgccaagggttttctaggcgggtcccacgacacatcagtgttgatggactatgtttatcatctggcaccgactgaacgtcctgagctgaaattatcctcccatggaaagaaagttgagaaatttggcaggcctgctctagagattgaaggcttagtgactggcaaaagattaattcctctaatcacatgtttgttggacactggtgatcaaggacttattttccatctgccaataggagaggtgacaatcaccttggatgatgtggcatcgttgctgaatctgcctattataggcgtgttccatagctttgagcctcttcatgtgggtgatgtcatcttcctcttagtcaaattgcttgaagtgagttctaaagaggcaagagctgagacagtacaatgccatggggcatatgttcgactatcctga

SEQ ID NO: 72531 - DNA, 270 bp, Glycine max
  Peptide Sequence Number=SeqID_164216
atgacagtgtatgcttatgttccttcagtcactatccttaggtttagcaaccttttcagcctttcagctgtaaataagaatcaaacaaggctcatttgcttcaagattaatacaagattgcttcaacaagcaaatccttgcttcaagattaactcaagatcaagccttgccattgaaacaaagtgctttcaagacattcaaggctctggtaatcaattaccaggcaatgtaatcgattaccaaaagacagggttgagaaagagctgttga

SEQ ID NO: 72532 - DNA, 294 bp, Glycine max
  Peptide Sequence Number=SeqID_164217
atggcaggctggcagctaaacaaggatggcgctttgactcaacctatgaccacaaagataacaatggtgatcccaatccgtttgtctttgtccttggctctggcaaggaaaatatttctgctcttaaattttggtcacggtcatgtgagatcgatgaaagtaggaggtattcgtagagttatcatacctccatcacttgggtatcaaaacacatcacaagagcccatcccaccaaatgaatatttgaactcaccacatctctccccttcccgtctcccttcaccactagattaa

SEQ ID NO: 72533 - DNA, 1779 bp, Glycine max
  Peptide Sequence Number=SeqID_164218
atggaagatcatcagcatcagcaccaccatcatcactttggcatgaacgatctaaggcaagtggtgaataacgggccgaggccggcccataccaccttcccctccatgccgccgcaccccacggaggagcttttccccggccaccaccaccgtaatctcactcctttacctactcatcatccccaacaacaacagcacttcgaggttatgatgtttggtcgagacataatgccacctggccttcacgactttgcttccacaccccatgattctgctgttgctaccaccaccatcaccctacccactccaccggttacttgcggctttgatgccgctgagggtgcaggttgcatcggtggagaccccttcactggaagatggcccagacaagagactctcactctccttgagatcagatctcgcttggaccctaaattcaaagaggctaatcacaaaggacccttatgggatgaagtctctaggatcatgtgtgaagaacatggatatcaaaggagtgggaaaaaatgcagagagaagtttgagaatttgtacaaatattacaagaagacaaaagaaggtaaggcaggaaggcatgatgggaagcattacagattctttcgtcaacttgaagccttatatggagaaaatagtaacacagtttcagtcccagaaaccaatgttgttgttggcagcattcattttcaaggcccttctcaaacaaatcaagataataataagtttcaatctcacaacaacaacaacaacaggcattgtgatagcctcagcctcactaactccactaattttgacacatcaacatctgaaggtcatgatggcaatgatcacagtatggagaatgagtccatggagaagaggataaagaggaagagtgggaggagttggaaggtgaagataaaggacttcattgactcacaaatgaggaagctggtggagaagcaaaaggagtggttggataagcttgtgaagacacttgaagagaaggagaaggagagaatgctaagagaggaagaatggaggaagcaagaggcaaacaggttagagagggagcaaaagttctgggccaaagagagagcatggattgaagcaagagatgctgctttgatggaggctttgcataagttaactggaagagaaataatgaaggttgaaactgatcctgagggtactataaatgtaatgactgcagctgaagttcaaaaccagaataacgaagatgagagtgaaattttgaacagcagtaatgttatcagaggtgctgatagctggcaagaatctgagatcacaagacttgaacagctgagagctgagatggagacaaggtttccatatagtgaaatttcagaagaggtttcatgggatgtagtagcaacaaagatggctgattttggctacgaaaggagtgctttgatgtgcaaagagaaatgggaaagtatcaacaaggaagagaagaatagcaagaatcgcaaggaaaacttatctagaaactgcttttacttcaagaacaatcatgaggatcaacaacaatcttctctatacgatcaaggaagtgcctattgtgatgatgatgtcaatgagcaagggaaagagattgagaggcttcaaacaaataatggttcttcttcaccttcaaaatccaatattgttggaaatgttgttccttctgatagttgctttcccttcctgatgggtgctgatcagggtggaaacttgtgggagaactatggcttaaagctcaataaagaaaatcaaaatcattga

SEQ ID NO: 72534 - DNA, 314 bp, Glycine max
  Peptide Sequence Number=SeqID_164219
cttgtgaggaggtgttggagtatgatcacgagcaacctcttgcaactaggtggaggccgttgagggataccaacaaggtggattcgactaaggaggtgttggagcgattgcagttgactggtgttgtttggtctccatatgcatcacaaagagacctcagacctttcaaagaccaaacatactactctggaaacataagagttgggacaaacatatcgctatatctaccagaaagggttttgagaaagttcaggggcaatttcaggataaaccaaaaaggcacccacgtgggtagtgccaatagcaatccctaa

SEQ ID NO: 72535 - DNA, 267 bp, Glycine max
  Peptide Sequence Number=SeqID_164220
atgccgtgtcgcccaacacctaataacacagtccttcaattctggctattaccaattaaaaccggtgatagtctaaacacgctcttccaacccagatatccgtcattcccaacgccaagctggcttacacccgaaacccttcacacgccgcaattcagcaacaactggtttgcactttcttccgcaacttcttctccagccttcaataaatggcttccctcaatcaccttcgaatttcactctcaacacaacttttcatacacatag

SEQ ID NO: 72536 - DNA, 1494 bp, Glycine max
  Peptide Sequence Number=SeqID_164221
atggcggagaagctgcacttacgagagttcctacaggaggatcaagaacccttccttctgaaacactacatttcggagagacgcagccagctcaaaagggtaacaccttccccaaacagcactttacaacaacatctcaaaaagaatccacaaaactcaaacttcccacttaacaaatgcttcctcacttccctccaaaacgccacaaaatccccactcttattgtcaccaaagaagagtactcccctcactctcagaccctccaacgcaaaaaccgcgtcgctcctcctcgaagccgccctcagaatccataccaacaaaaacgcgaaaccgaagcccaaaccaaacagggccttgggcatcttcggctcgctcttcaagaaactaaccaaccggaagagggaaacaatagagggtggtgctgttgctaaggttaataaagacagcgacgacgacgatgttgttgtggtgggatcatgtgaggtcgggttcacgtgttcctgcaacggaaggcccagcagtgctgtctggtcggagagcaacgaggataaatcgttggacttggaatcttccagtagtggcaactcctttgatgactctgttgttgaagagattgagtttctcaacaaagggaaactaataaacgctgatgatcacggcttcttctgtcaaagcccgttccgtttctccctccaacgcagccccgactactccggccgccgcacgccggtcttttcttcgccggcggctgctccatgtcgccgcaaaaccgaggacaaagaaattaatggtgctgatggcgtcaacaaattccattcaggggaagaagaggaagataaggaacagtgtagtccagtatctgttttagacccacccttcgatgatgataatgatgatgggcatgatcatgacaatggagatgatgtttttgatttggactgtagctatgccaatgtacaaagaactaagcagcacctactagacaggctttgtagattcgagaaacttgctgagctagatccggtagaacttgagaagagaatgctggatcatgaagatcgcgagtacgaaacatttactgaagaggatgatgatcatgaagacgtggacagcgaaacagcatgcgaagaaaacattctcagaggagaaatgtttgaaatcctctgctgccgttcaagtgttcaacaagacacacagcaagcccaagcagaagacctcaagaggctggtctatgatctcatcaaggaggaagagacgacacaagttaataataattgttcagacatggtgataagaagggttcttaggaagctagaattgtggaaagaagttgagtccaacactattgatatgatgatagaagaggatttctctagggagcaatgtaggtggaagaaaaatgatgagcacacaaaggagctagctgtggaagttgaacttgccattttttgctttctagtggaggagctttcagaggaactactaatatgttaa

SEQ ID NO: 72537 - DNA, 393 bp, Glycine max
  Peptide Sequence Number=SeqID_164222
atgaccagacgaagggagactgttgaagcggaatcatatttgtaccctcagatggtagagtgtggccatggaatgtattacacaccaccaacattttctcagttttcgacacagatgtatcagtatccattcgaaggtcatcaaagtgatacttctacaagcgaacattcagtaggtggtgttgcgaaaacatatcccaatttttcatggtctactatgaccccttcacagcaacatgatgctccaattcccacacttaatgccccattaggtactcaatggaatgtacccgaattgaagcgggggcacattggggcagaagaaatcctgatagacaagcacggagatgggaatgaccatgcggcacatcctcacggacatcataacgattga

SEQ ID NO: 72538 - DNA, 656 bp, Glycine max
  Peptide Sequence Number=SeqID_164223
tttcggaagaaccttcttccggaaaaacaatttatgttctaccggaagaacctttttccgaaagctttccggaagaaccttcttctggaagctttccggaagaaggttcttctggaagaacaaattgttgttcttccgaaaagtttccagaagaaggttcttccggtagaacaatttattcttccggaagaaggttcttccggatgaacaatttgttctaccgaaagaaccttctttcgaaaactttccggaagaaggttcttccggagaagttatccggaagaacttcttccgtgtgtaatttcagaaagatgaaggtggtcgctgcgtatctgctcgccgtcctcggtggcaacaacaccccctccgccgatgacatcaaggaaatcctcggctccgttggaatagaggcagatgaagataggattgaatcgttcttgtctgaagttaagggtaaggatatagttgagctaattgctgccggtaaggaaaagctggcctcggtgccttctggtggcggtggtgccgttgccgtcgccgctgctcctggtggaggtggcggtggtgctgctccggctgctgaggtaaagaaagaggaaaaggtggaggagaaagaggaatctgatgatgatatgggtttcagtctcttcgattaa

SEQ ID NO: 72539 - DNA, 306 bp, Glycine max
  Peptide Sequence Number=SeqID_164224
atgcacaatcatcaatttagcctcttcaaacgtagaagttgtggtcacaacctcttcaaacaatttcgttttgattttgtggtctatgggttggactttgtggttgcaacatcattcttcgttgtggcatacattgtggtgacgtgcatggcaaaaagcagcaatggcgatttgtgtagtgatggagggcaacctataatggtcgctagtggtgttgtttgcgcatggtggttatgttgggtggaggtggggtgcgatagtgttgatgactatggttgtgcagggaaggaagggggtgttgactga

SEQ ID NO: 72540 - DNA, 294 bp, Glycine max
  Peptide Sequence Number=SeqID_164225
atggcaatggggcgggtcgggtacgggtattgtcttcccaatcccttaccccgacccgatgggtttgagtttattgtctcattctcgtacccgtcggattttaaatggcggggcgggttcgggttcggggtcgggacgggtctaataatctcatatccgtacccgtacccgacttttggttatcgggaaaaacccgaactcgaacccatacccggtcaactcagatattacccatcaaagtcgggacggattcgggcgtgtacccacggatacgggttttcttgccatgtctag

SEQ ID NO: 72541 - DNA, 249 bp, Glycine max
  Peptide Sequence Number=SeqID_164226
atgcggaaaggaccactggaaaaaggaggaactaaggccattgatagcgttgagacactcagaacttgtttggaatttatttttattcttggtttatttggggacaagcaaaatacgaaaaatgagggtacattaagcaaaaatggcaacagaaaggaagaaaaagaaggaattcagaagcaggcccagcccaacagtgacgctaagcgcgcatcaggcgctaagcgagcaactaactgcaggcgctaa

SEQ ID NO: 72542 - DNA, 672 bp, Glycine max
  Peptide Sequence Number=SeqID_164227
atggcatcacacctcttaagtcctgaagacattagcagcgttttttatagaggggaggagaatgctttggtacttgttgtctatggtcaagtttgtagccacaatgtatgcatcactttatctttcttcagcaggggaagaaacatcaactgggacataattgcagagagactgggtttcatgttggtttttggagatttagtgtggattcctttcacttttagcatacaggggtggtggctcttgatgaacagtgtggagtcaacaccagctgccattgtagctaattgctttgtcttcctgattggatacatggtatttcgaggagcaaacaagcaaaaccatgtattcaaaaagaatccaaaggctcgtatttggggtaagcctccaaaagtcattggcggaaagctacttgcttctggttattggtttttaggtagagggaaaggagagaatagagtatcacattctgaaattgatcttcattatgatgttttacaatgtcatacaaagcataaacacttcaccaattccatacttctatccagtttatcttcttattctgttaatctggagagagaagggatgaagctcgttgtgcagagaaatgagaatggcatggtcaaagctcctaggcttatcaaaagtaacagtgtcatgttcccagtttaa

SEQ ID NO: 72543 - DNA, 504 bp, Glycine max
  Peptide Sequence Number=SeqID_164228
atggtctgcaccgatcaggcggaaatgaccggcagattgcttgccgattcattgactttcgaatgtcgcatcatgtattatctgattgtgtgtattcttcttcctcgttcatcaaatcttgctcaggtctccgaggaggacctaatagttatgtgggcattcttaaccggtcgtcagattgactgggcccatctggtcagatccttctatataggtgctggagtggtcacctcttttggttaccgtaaggaattggatggctcttgggtgaagaaagatgtccagccacagcctgccaatgagtgtatcccttcccctccacgacatgactcttctatgcttctgaatgacattctcacagagttacgcagcctccgagcacactttgatgaccgcttggataggatcgacacacactttgaagagatggacatccgcatcgatcagcttgcagatgacatgagctacatctgccgctattttgatctaccagcagatccttag

SEQ ID NO: 72544 - DNA, 79 bp, Glycine max
  Peptide Sequence Number=SeqID_164229
gtcgactctagaggatcccccagaggcccgtgatcaatgccggaaatcccagggccctgttagacttatccgggtctag

SEQ ID NO: 72545 - DNA, 153 bp, Glycine max
  Peptide Sequence Number=SeqID_164230
atgtttcgaggctccaagatgtttggacaggatgagctaaaagcagatgcaaacaatgaaacaatagagtaccatttttcttgccagaacgctcaacatgacaccacaatgtacgcaatgaatcaatacagctcatggcagcaacccttatag

SEQ ID NO: 72546 - DNA, 402 bp, Glycine max
  Peptide Sequence Number=SeqID_164231
atgttgaggaaccttacggattacgtaatcatcccttttttgccttccagaacattacggaactttatggattgcgcactaacacctccttttaatttccggcatgtcacagaacttcacggattgtgctacaacgcttttcttttggcttctggcatgtctcggaacttcacaaattgcctaacgatgggtgccaaatacctcgaagtggtcaaacgagggtcgcatcccaacaagggtggtccccgaacgaaattagggtatgacagagtcggtaaaataggtacgagttcttctactcctattgaaaatgtgttggttgtagaagaggatataaagtatcttttgattttgaaaaatgtgttattaagcatgagcatgacaaagatattgaacatatag

SEQ ID NO: 72547 - DNA, 387 bp, Glycine max
  Peptide Sequence Number=SeqID_164232
atgtcggctttaaaagatcagatggcttctatgatggaagccatgctaaaaattcaaaaatcaatagaagacaatgttatggcggccgctaccaacacaactagggaagcggaaccggtgctacagcctacaatgaactcgggccgggacagaagcgcgacgggtttcaatcggaggtatagtcctcaagcctacccttacggcttgcctccagacttcactccccgtaccgctccagacaatttgagccaagcccctaccttcgaggggcaactccctcctcatgccaactaccctctggaggaagatgacgagggagatgcccatttaggccctctacttcccccaagggaaccggcccccatgagtggccccaaccaaacataa

SEQ ID NO: 72548 - DNA, 132 bp, Glycine max
  Peptide Sequence Number=SeqID_164233
atgtgtgagcatctctgttatatgattgtggattctgcatatgacttagaaaagtatgtgagcggggaatgtctctgtgtatggattcctcaagccacagtccatacagagatatggacaattgcaatttga

SEQ ID NO: 72549 - DNA, 121 bp, Glycine max
  Peptide Sequence Number=SeqID_164234
gaacagaattgtctcaggccacggtcagaagtcaagacaagtcaatggcagaaatcaaccaaggcaaatagaggatagggtcacggccgaccgtcgtctcttcccggcactagacaagtag

SEQ ID NO: 72550 - DNA, 249 bp, Glycine max
  Peptide Sequence Number=SeqID_164235
atggtaatcgattacaggtttctgtgcaaagcaaggaaccattcggtgtttcgattaggaaggcaaaggatatcaagaaagaagggcaaaagggacttttccttggttttcctagaccctagcttgcctgagccaccaaatgacttcaaggttaagaatccagctcgcctgagcaagctcatgacttcaggagtaagccttagctcgcctgggcgagcagcaagtccccaaagtgaccctttccaataa

SEQ ID NO: 72551 - DNA, 186 bp, Glycine max
  Peptide Sequence Number=SeqID_164236
atgtgtgattgctctggtgcacatggcagctctacattgagtgcatacacagaagcagtgagggagctggcatgtgagatattggagctaatagcagaggggttgggggtcccggacacttggatattcagcagcagaaaatgtagtagattcagcatgaaaggaccctttttgaatgtgccctga

SEQ ID NO: 72552 - DNA, 384 bp, Glycine max
  Peptide Sequence Number=SeqID_164237
atggttggtgttgaggagattagagatgtagatgctcctattcttgtacccactaaagagggagctgtgagacccgcgaaacctgcagataggccggatgatgaggtcgatgatccgctatatctaatgacattgaccattccacagctttttctgaagccattgcaggttatgtgggatgctaccttgtttggcctatttaatgaaaactttcccttgtacataaagcatgaagatctgtctaaaattgcacatggtggtcaatgtctcagcatatctgttatacattgtggattcttatgttcactgagacaagtatgcgactggaaccagaaacgattgaaggattccttcgcacaccagaatgggcaaagtactatttga

SEQ ID NO: 72553 - DNA, 384 bp, Glycine max
  Peptide Sequence Number=SeqID_164238
atggccttggcaaatcaaggcgaatgggcttctttttttgacatcttggcacttttgatctttggagttatcctctttccaaatgtgaaagggttagtggacctagcagcgattgacgctttcctcgcctttcatcatggcaaggaaagcccggtcgtcgccattttggccgacatgtatgacacgttcgactggagatgtgaaaagagcagcacaagaattgtttgctgtacactggctctctatgtgtggctggtttcgcacctttttcgccaagaaggtaggcccatttgtccgctacaaggtcaccgttcatgcgccgagaaaggaaaggcaaattgggaccaactcttggctagcatggagggggggggggtccgttaa

SEQ ID NO: 72554 - DNA, 282 bp, Glycine max
  Peptide Sequence Number=SeqID_164239
atggcttgccgctccctggccgaagtcaaaggttctgggccgtgcccaaaaactgttgctgatggatgccaggcctggcctgccacatccatgcccgaacaaggccctgcaagggcttgcctcggtcgcctccgcaggagcggccttgtgccaagtggtttgcagtatttttctgcgttctgctgcccctgggcagaatttttcgggcgcgaaccctatcacaaaaaacggttcagtcgaggggctgccgggcggcttggcagtgccgggggcgggacgtag

SEQ ID NO: 72555 - DNA, 279 bp, Glycine max
  Peptide Sequence Number=SeqID_164240
atggttaatccaactcagtttcaggccaaagaagaaaaggttaaagcaactgatgactcacttagcaaggtagatccgctcagcaagatgcatccacttagcgaggcatccagctcgcttagcggatgggaaaccctagaagaggataagccagagatctgcatgcctagcacgcaaccagcctgctcagtgaggacattgtctcttctcacgctcagtgcgcccattctcgctaagcgaaaattcactaactctcgcttagtgagccatgctcgctaa

SEQ ID NO: 72556 - DNA, 351 bp, Glycine max
  Peptide Sequence Number=SeqID_164241
atgtatcctctcttgttttcagtcacaacaacccaagtagatgtatcctctacttataccgcaaaggatgtaccctccaatgtgttaagacaaagttctcaggcggttagtcctttgaaactttgtgaagggaaaacaaaagatatctcaggcgggagaagagagacacaaaaagaattcaggcggttagtcattggcgaattctttttggcaaagggagaagggaataaaagatatagcacacttctattttcaaggtttggaaaaccagaaaactttagaaagcttttgcaaaggaagaagaagaagaagaagttcaagaaaatgttcaaagagattcaaaggttgtaa

SEQ ID NO: 72557 - DNA, 276 bp, Glycine max
  Peptide Sequence Number=SeqID_164242
atgggcccaaaatctaccttaaggctcatgagaaccctaggatcttctactatatctctagcccaatcttcttggagtctcttagccatggctctggtgatgggtcccttctttaggaggattgcatcacttaaggacaagatcgaggaactcgtacaagtcggatacctagcccagttcataaaaaagtctgatgacaacaaactggaggccaatatagatcgaataaataaggaccatcgcaggagaagagatactaatagaaggagggactga

SEQ ID NO: 72558 - DNA, 348 bp, Glycine max
  Peptide Sequence Number=SeqID_164243
atgggatcgaaccaagcacatgcttttaagaaaagggtttcatcaagtcaaggtcaagtagggaagaaagaaggcgctttacggtgcccttaccaaatgcatgctaaagctagagtgatgagtgaaatagaggaggtacaagaacagatgaaggcctacatgaaggtcatgaaagagcaaataaccacaatgatggaagccatgatgagtatgagaaaaataatggaggtcaacatggctacagtcgttgctgcaagtaccgctagtgaggtgggcccgactcacccatctggcatcaatcaagcaattcatcctgtcgaagcaagcttcatgatgaatcaagattga

SEQ ID NO: 72559 - DNA, 285 bp, Glycine max
  Peptide Sequence Number=SeqID_164244
atggcttcttcacctggctcgcctcctctttctccttctcctcctcctcctcctcctcctcctcctcctcctcctttagacgcatcagcttcgtcgtctaccatgaagcggacacgcaaagccatacgtctaagattcttgtctactagaccacctggtgctgagagaccaatggtcaacattgatcctgctaccaacaaggccgacggtccccaaaggaagaaattaaaaacatatttggggattgtggcacgtgataagttggacgtcacgtacgagaactag

SEQ ID NO: 72560 - DNA, 261 bp, Glycine max
  Peptide Sequence Number=SeqID_164245
atgtcttccctgggaagtaaatggaaacctgtcattgttatgattgcagcccgcattcatgttatttcgcgtaaggttcttaccgaccagctaagagaaatggtagaggatggactgctaatcagagaggaatttaaagaactgccaccccgggttgaatataccctcacggaaaaggggcttgctcttttgcccattttaaatttattggaagattgggaaagaaattatgaaacaaaagaagtgttggctgaggcataa

SEQ ID NO: 72561 - DNA, 352 bp, Glycine max
  Peptide Sequence Number=SeqID_164246
tctgatttgacgatgaaatgggcacctacaaccggcaagggcagtgtcgatgacactgtatgtcaaaagtacgacattagcaaggagaagtggacccaattttgtcagagccatagagacccttcatgggaggcctcacagggttcctttgtcgcccatggacgccaagatgtactgactgttgccattgggcgactagaacaccctcgtcgtatctgtgttgctcgagttgggccactctcctctgtcgagtctgcctcagatgctgacataatatcctctggagaatcaacatcaggagtgggtcctcatcatcctctgggaagtcaagggcatccacagcagttcagag

SEQ ID NO: 72562 - DNA, 453 bp, Glycine max
  Peptide Sequence Number=SeqID_164247
atgccacccaccaggcaccctctagacccggataagtctaacaaggccctggggtttccagcattgatcacgagcctctgccagtcattcggggttcccgtcacacctagtaaggtgatccgaccgccgatcacccgggccttcattgagaagtattgcatgcctaggcaggcgcagggtgatgcaccgcaggccgcaagcgcaccgccaccacctcatcaggctgaccccgctgggtcatttggcatggagcagtatctacagcacttggttcgccagcaggcggccaaccaccgggggcagtttagggctgaggtcacatggcccggagattggcccgaggcccagccaggggaggcacctgcaggagctcccgacgatgcagaggaggcccgcatggatgaggagatgacggacttgctcggtttcttgggagggagcggagccacgtga

SEQ ID NO: 72563 - DNA, 1230 bp, Glycine max
  misc_feature (41)..(41): n is a, c, g, or t
  Peptide Sequence Number=SeqID_164248
ttcaccggcgaggtgtggctcgaacccgggcatcaccccgnacgcagcccgcgcgtcagccggtctcgcacagcggaccccgtcgcggtcgggcggcgccggcctcgtcctcggcgccggcaacgtgacctcgatcccggtgctcgacgtcctctacgagctcctcgcccacaaccgcacagcgctgctgaaggtcaaccccacacaggacgctctggtaccggtgtacaagcgtgccctggcgcccctcatcgagccgggcttcctgcgcatcgtccgcggcggtcctgccgtcggcgcgtatctcacgacacaccccggactcgtgcacgtgcacatcacggggtcggccgcgaccttcgacacgatcgtgtggggtccgtcgaagggcgagggagccgcggccaccaagcgacgccgccgcgagaaccgtccgcggttgaagaagccgatcaccgccgagctcggcggagtctcccccatcatcgtcgtgcccggaaagtggacggacgccgacctgacgtaccaggccgagcacgtcgcgaccatgcgcctgcagaacagcgggcacaactgcatcgccggccaggtggtcatcatgtcctccgactgggagcaggccgatgccttccgagccgcactgcgccgtgcctacgcgaatgccccggagcgtcccacctggtacccgggttccccgtcacggatggagctcgcgagcgatgcctacccggacgcgctcgtcctcggcgaccggctgctcatcgagatcgacgccgacgacgatccggccgcgctggagaccaccgagtacttcgctcccgtgctcgggctcgtcacgctccccggcacgggccagcagttcctcgatgcagcggtggcacacgcgaacgaccgtctgcagggcacgctcggcgcgaacctgctgatcgacccggagaccgagaagtccctgggtgcggggttcgaacgggccatcacggcgctgcactacggctccatcgcgatcaacggctggacggcgttcgggttcatcacgccgacgctcacctggggtgcgttccccggcggcacgatcgctgacgtcggcagcggcatcggtgtcgtgcacaacgcactgctgctcgacggcgtggagcgctcgatcgtgcgtggccccttccgcccgttcccgcgctccctgcccatcgcgaacggcggcggccgcctcacgatcctgccgaagcccccgtg

SEQ ID NO: 72564 - DNA, 525 bp, Glycine max
  Peptide Sequence Number=SeqID_164249
atgaggggagcaccaacggaagaaagcctctctcctttccttgtgagcaatttcggtacgcaaagtttcaagattatacaaagagtccataaggcgtgggaaagcccgttaaggaaagataaagaacttagggccattcgtaatggcatcatcgatggttatcatgaatggctgaaaattcgtacacgagggttagattggctctccaagttaaagattatcaacgaagagaacttcgaagctccagaagaggatgaagaagtccgagctctacaaaccgaactagggaaagcgagacttgccaaagaaagattcaagttggtcgctacagacgtccggaaagagtgtgccggtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 72565 - DNA, 276 bp, Glycine max
  Peptide Sequence Number=SeqID_164250
atgttaggattcacaagcgattctcctcaaatttcagccagcctgcatcaattagactttgcaccttatgcttcaaggtcatacagtgctcaatggaatgtcccggaactcctccacgatatgcacatgttgcgtttgagtcgtatcctcggaaaaatggaggttgaggaaccctggcagtggttatggctaccattgcattatcaagcaggccttgtggctgatttggggatggcttttgtggatgattgggtgagaaggattgttattggctga

SEQ ID NO: 72566 - DNA, 300 bp, Glycine max
  Peptide Sequence Number=SeqID_164251
atggatcctaagaaaataaaggtcattcctgagtggcctacaccaccatgtataagggaaatttggggcttcaatgacttaacaaacttttacaaaaggtttgtcccatatttttctatacttgtagcaccactcattgagttggaaagaatccttgagtttcaagaacctatggatttgaggtcaaatccttttcaagggggagtgaatgatgcaatcctacccccccaagagcattggatagaagactccaagaagattgggccagagatgcaagagaaagccctaaggttctcatga

SEQ ID NO: 72567 - DNA, 579 bp, Glycine max
  Peptide Sequence Number=SeqID_164252
atggcagaaccattgaagaagcgcaagggttcttcgagtagaagccaacgacactccgaggctcaggatactccaattccttcctccatttcctcctcctcattgttctcatcgaaagaaaaacatacacgatatggatttctttatgatgagagtttcgaatgcattcaagcatttcagaactcaaatcccattccttttatgtctttaaaactgcctgtgtattctgaattggtaaaagctttttattctaaccttgaaattcaagagagtaccttgatttctgaggtctttgggataaaaatggtcattgaccaatccctcttctatgatttgacccaattgtctagcaaaggtgtaccatttgaaggtgcactggatgatgattggaaatttgttttttctatttttgatgcttgccgattggtttgcaccaaccaagcggatatgacccgaaggctacttgccggttcattggctcttgaaagccgcatccttctttatctaattgttcatatcctacttcctagatcttcaaaccttgcacaggttgaagaagatctacatagtcattcgtga

SEQ ID NO: 72568 - DNA, 447 bp, Glycine max
  Peptide Sequence Number=SeqID_164253
atgaagctcgacaggttcaggtgcaggtgctgctactggtggaggcacttgaatttggttgccatacctcaagccatctgcccatctgatttgtcagactctgaatggaggttcttgtctcttgctgaaattgcatattctggatggtcatttgcctcactaactcttctaaggaaggttgaggagaagcctcagttgcttgttatctttgttgtgactgctgctgctgttgctgcattggaggaggaacatatggcttgcttggaccaacaacattctcgaaaggagggacaggctgttgttgttgtggaggacttgtccatctcagatttggatgattcctccaacctggattgtatatgttgcttgaaaggtcataattattctactgttgttggttttgctactgaggaggtctattataaatgtttgcagcataagctttag

SEQ ID NO: 72569 - DNA, 2924 bp, Glycine max
  Peptide Sequence Number=SeqID_164254
atgtatcagtggaggaagttcgagttcttcgaggagaagtacggcgcgaagtgcgcggttcccgagaacgacgaagacgacggcgtcgtcgcggcggagaggaagatcgagtgctgctcgagtggtaggggcaaacttgtcaccggcttcgacgacggcgtcgtttgcttcttcgatcggggcctcaagttcaactactctttccagcctcactcttcttccgttctttttcttcagcaactcaagcaacgcaactttctggtaacaattggggaggatgaacagcttactccccagcaatcagctttgtgcctcaaggtttttgacctagacaagatgcaaccagagagttcgagcacaacgagtcctgattgcgttgggatattgcggatattcactaatcagtttcctgaggcaaagattacatcgtttttggttttagaagaagtgccacctatactactcatagctattggcttggacagtggttctatttactgtatcaaaggagacattgcacgggagcgtatcacccgttccaagcttcaggtggaaaacaaccatttggacaaaactctttcggctgtaactggacttggttttaaggtggatggtcaatctctacagttatttgcggtgactccatgttcagttagcttgttttcattgcatgatcaaccgccgagaaggcagacccttgatcagattggatctggtgtgaacagtgttgcaatgagtgatcgctctgagttggtaattggtcgaccagaggcagtatatttttatgaagttgatgggcgtggtccttgttgggcttttgagggagagaagaaattgcttggatggttccgtggataccttttgtgtgttattgcagatcaaagaacaggaaagcatactttcaacatctatgacctgaagaatcgattaatagcccacagtgcattggttaaagaagtttcttatatgctttatgaatggggtaacatcatactcgtaatgaatgataaatcagctttatgtattggagaaaaggatatggaaagtaagttagacatgttattcaagaaaaacctatatactgtagcaattaatcttgtccagactcagcaagcagatgcagcagctacagctgaagtgctaaggaaatatggggatcatctgtatagcaagcaagactatgatgaagcaatggctcagtacatacatactattggtcaccttgaaccttcttatgttatacagaagtttttggatgctcaaaggatctacaacctcacaaattacttagagaagctacatgaaaagggtcttgcttctaaagatcacaccacacttctattaaactgttacactaaattgaaagatgttaaaaagttaaatctatttattaaaagcgatgacagcattggggaacttaaatttgatgtggaaacagcaatcagggtttgccgtgctgccaattaccatgagcatgcaatgtatgttgcaaggaaagcagggaggcatgaatggtacttgaagatcctgcttgaagatcttggtagctatgaagaagccttggaatatatttcaagccttgaatcaagtcaggcagggatgacaataaaggagtatgggaagattctgatagagcacaagccagtggagacaattcagattctcataaggctttgcacggaagatggtaacaaaagagggcgctcaaatggagtgtatatgtctatgttgccatctcctgttgattttcttagcatcttcattcatcatcctcagtcccttatggattttcttgaaaaatataccaataaggtcaaggactcacctgctcaagttgagattcataataccctcttagagttgtatatatccaatgaattaaactttccttcaatgtcgcaagttaatgatggtggaaattaccttaatggagcatcagcaaaaaccatgattttaagtgctcagtctaatggaaacattggtgatcacaaaagttcagagcagggaaaggaccatctcgaaaggcgtgaaaagggtttacgcttgcttaagagtgcatggcctcaagagacagaacatccacaatatgatgttgatttatctattatactatgtgaaatgaatgcattcaaagatgggcttttgtatttgtatgaaaagatgaaactctataaagaagtgattgcttgctatatgcaggcacatgatcatgaggggttaattgcatgctgcaagaggctgggggattctgttaaaggaggggactcatctctttgggcagatgtacttaaatattttggtgagcttggagaagattgttctaaagaagtaaaagaagttctgacttatattgagagggatgatattttgccccctatgattgtgcttcaaactctttcccgaaatccatgcctcacactttctgtgctcaaagattacattgctcgaaagcttgagcgggaatcaaagatgattgaggaggaccgacaagctattgagaaatatcaggaagatacactggcaatgagaaaagagattcaagatcttaggacaaatgctcgaatttttcagcttagcaagtgcactgcgtgcaccttcacccttgatttgcctgccgtgcacttcatgtgcatgcactcattccacctgcgctgccttggcgataatgaaaaagaatgccctgagtgtgctcctgaatataggtccgtcttagaaatgaaaagaaatttagagcaaaattctaaggatcaggacaggttttttcagcaggtgaagagctctaaagatgggttttctgtcattgctgaatattttggaaaagggatcatcagcaaaataagtaatggatccacttctggtcccagatccggaactgcatcatccaccagtggttcttcattgttgcttgttgactggggtccaag

SEQ ID NO: 72570 - DNA, 1407 bp, Glycine max
  Peptide Sequence Number=SeqID_164255
atggagaaaacggttcacatagcagtagttcctggtcctggcttcagccacttagtcccaattcttcaattctcaaagagacttgttcatctccatcaaaactttcatgtcacatgcataattccctcagtagggtctccctcatgtgcctcaaaatccatccttgaaactcttccaccaaatataacctctatttttcttcaaccagtgaaacctgaaaacctaccacaagaggttgctatagaagcccaaattcagttcacagtgaccttctctctgccatctatacatcaaaccctcaagaccttaacttcaaggactcactttgtggccttggtggctgattcttttgcctttgaggcattagattttgctaaagaactcaacatgttgtcatatatttacttccctacatcagcaacaacactctcttggtacttgtatgtgcccaaattggacaaggaaacatcatgtgagtatagagattttcctgagccaattcaaataccaggttgtgtaccaattcacggcagggatctcaataaccaagctcaagatcgatcgagtcaagcttacaaactcttcgtccaacgcgctcagcgactccctttggttgatgggattttcatgaataccttcttggaaatggaaacaagtcctataagaacattgaaagaggagggaagagggtcccctcttgtgtatgatgttggaccaattgtccaaggtggtgatgatgatgctaaagggttggacttggagtgtttaacgtggttggacaaacaacaagtcggttctgttttgtttgtttcttttgggagtggtggaacactctcacaagagcaaataactgagcttgcttgtggtttggacttgagtaatcataagttcttatgggttgtgagagcaccaagtagtttagccagtgatgcatatctcagtgcacaaaatgattttgatccttcgaaattcctgccatgtgggtttttggagagaaccaaagagaaaggtatggttgttccttcatgggcaccccaaattcaagtccttagccacagttcagttggtggattcttgactcactgtggttggaattcaatcctcgagagtgtgctaaagggtgttccattcatcacatggccactgtttgctgagcagagaatgaatacggttttgctatgtgagggtctcaaagttggagtgaggccaagagttggtgaaaatggtttggtggaaagggttgaaattgtgaaggtgataaagtgtctaatggaagaggaagaaggtgagaaaatgcgtgaaagaatgaatgagttaaaagaagctgctattaatgctatcaaagaagatgggtcttctacaaggaccctttctcagttagcactgaagtggaagagtttggcataa

SEQ ID NO: 72571 - DNA, 1032 bp, Glycine max
  Peptide Sequence Number=SeqID_164256
atggaggccggaaacacatacatttcacatgagatgcggagattgtactattactctccaagacgtctctgtattgttagaccacaagaaggtgaaattaaaggtagtttggttaaattaagttggctggctcaccattttgcacaaataaataacgacgacgatgaagaacaagtacgaaggtttgcccgtgcatggatactgagattcattggaggtgtcttgttcgttgacaaaagcagtaacaaagtttcgctaagatgtgcaatgccaccgattataaaactaaatcaatcggaggtatgtgcatcttattacaaatgtgggcatgagaacgatgtccaaccttggctccaaagaggactccttcccaagtggctacgacgtggaaaccaatatatcgacaatgatgatgtgagagtttttcgtcgcaagttggatattatgaaacgtcatgagccgtacccatcaaccgttatatcattgttgcctcccgtttgtttagtcggaagtctcacgtggtacgcggtggctgaagttgcggagacattacaatacatggtgtctcctcaagggaggaatacatggacagttgatgatctcgtgccttatgtggaaaaaattacaattttatccgaagagcaagagagagtcactgagctaggcatagacagacgaagggagactattgaagcggaagaatattcccaacaaatggcggagcgtggccatggaatgtattacacgccacaaacatttgctcagtatccgacacagatgtatcagtatccttttcagggtcatcacactgatacttctgcaagccagcaatcgtttggtggtgttgcggaaacacaagctcatttttcatggcccataatgaccccttcacagcaatatcatggcccaattccaacacctaatgccccattaggaacacaatggaatgtaccgggacaaatacctaatacaggtgacttattcggtgttgaaatgcgatcaatccatcttgctatggctggactcaattga

SEQ ID NO: 72572 - DNA, 252 bp, Glycine max
  Peptide Sequence Number=SeqID_164257
atggagtgggagaaggaagcatggaagagagagagaaagagagagactaaggctatttcttttagaagaataaaagtattattgagcggcgatggtgatgggaaaatgttgtttggtggtggttggagtttggtcacggtggatgaagggtgggaggagatgtgctatttggtggtgatcagaggttggtcatgctggggagttggcgattatggtggtgcggtgacttttaagggagattgtggtgattga

SEQ ID NO: 72573 - DNA, 517 bp, Glycine max
  Peptide Sequence Number=SeqID_164258
atgcccggtggtgtggtggatagtgccgctagccctcgctttgtggtgacgagccctggctcgagggggcgtgttgagagtcccacatcgggggacctttcggatgcctttgaagagaaaatcgtggttctccttggaatcttgtgtgaaatgcacgattttcaagagcaagttgaaccgattgtcgctatgagtgtgcaaatcggagatggcgacgatgatgtggtcttagaggccttgctgcctgagggtatgattattccttctgcttttgagactcttgttgcgctggataagaataagccaagcatacaaacgattgtgaacaagattgatacaattcagaatgagtacaagaccattcaacttgaggttttagcaggaaaccactctcttgtgactacagtagttgagaatggtattcgctttgcaagaaagaaagaccaaatggaagaagttaagcataaaaatatttgtatcccagtaacagttctgaatcaagggaatttggattctg

SEQ ID NO: 72574 - DNA, 360 bp, Glycine max
  Peptide Sequence Number=SeqID_164259
atggatagttgcaagccaactggaacactagtggagtgcaaaatgaagttatcaaagttcgacaaagcagaaaaggtggatgctacaaatttcaagagtttgcctcaagaccaagtagttggcatcttcaccaagcagctcaagcaagaagactctatcaagttaagaagcttacttggaatggtctggttagctatcttgtcccaccaaaaagccacttatgccatattttcacaccactctttggtccacatcgctaaccagggttactacttcattccatggaataaagacaatgcacatcaaaactgtagaggaactgaagaagtacaaaataatattataccagatccaaaatag

SEQ ID NO: 72575 - DNA, 759 bp, Glycine max
  Peptide Sequence Number=SeqID_164260
atggttatgaggactgagtataagttgcacctgattgaaggtcttgtcttgccaaatagtgtggtggaagtttgtcttgttgaacttagaccatggacgatggtcgtcgtagttgctgcaagtgagcggaccaagagggcttaccaaggacgagccttggattttgtgaacttgtgggggttaccaagtgcagagattgggtttgacaagtttacaatgcaagtggttgtgttcttgcatacatggcattcaccgtgggtggcatgtactagagacgatgcttgtgcacacatctcgtgggtggcacgtactggaggcttagtagggtgcttgtgcgcacatattactcgacgtaggtggcatgtattggaggtttgcagtatgctcttgcatatatgtgactcgttgtgggtgacgtatactggagtcatggttggttatgaccctgaagggaccttcccagttggggccaagctttcccacttagggatcttttctggcttcacctcgaactcgccacatgaagcccttagacttgtcaagtctagtacacagggccttgaggatgactctgaagtcttcgtaagtctaagctttgaattgagtgttgatgtcggtgacaatggcttatgggagaccgtacctctagatgagtcgatggcgactagtaaatatttgactactgttggggcctttggaagtggtcctagtatgttcattccctacatggcgaagggccaaggggagcttagactgtga

SEQ ID NO: 72576 - DNA, 234 bp, Glycine max
  Peptide Sequence Number=SeqID_164261
atgactcacatcaggggtgcaaccaagaattacagaaaaataattgatgaggacatggcaaggactaagggcaaggaatctttagaaggacttggaggacctatgacaaggcctagaacaaagaaggccaaggaacctcttcaagaggtgttaaccatgctatttgaatttaggcccaagttacaagtgaagaagcttcggattgtcaattgcaccatgttccaagaagagtag

SEQ ID NO: 72577 - DNA, 723 bp, Glycine max
  Peptide Sequence Number=SeqID_164262
atgtcgatgaagaagctcgggtcgatgaagaacgaagacgagagagtgaaagtgctagagaatgagaacaagaggaaaacaacatattcaaaaatattcatcaagaaatcacaagtgtgctcaagagaagaagccacatcatcatgtgaaacaaactctaattatagatccacgccaccaccactacctcaagttgaagcaagaatgttggaaaaggaagttctcattggaatccactgccagaaacaaaaggatattgtgctcaaaatcatggccttgcttcaaaatctccatctctctcttgctagtagtagtgtattgccatttgggacttctacagtaaaagttacaatcattgcccaggtggcagtgcatgacgttttgatagtggaggttgggttgctgacgtttgggcttatgattgtggaggacagggcggtgcaatcggtttggattatggtttggtgtttggaggagaagaaggtaggggaagggtgggtccagagcatcggagacgaggctgctaacgaagttggtaataattacgactcatgccatcactttatgaaactcgtggtcactgcaaggtccgtttggggtgctcactttacagttcgtttagacagctctctgggtctcacagcaaggtctgggactaggagagttccaatgggtttgcacagtgttgacaatggtgatgttaaacactatgtgtctctttag

SEQ ID NO: 72578 - DNA, 168 bp, Glycine max
  Peptide Sequence Number=SeqID_164263
atgaagcttcagtttgcaaaattttgcaagaaaaggaaaaagaggttctgcacaaggggctaccaaatgtgcaaaacagaaagagagaatcaccctattctgggaggtgatgaatttattggagtggaaaaaatgagagataaaaagaaaagagaaaaagaccgatag

SEQ ID NO: 72579 - DNA, 246 bp, Glycine max
  Peptide Sequence Number=SeqID_164264
atgtcctcatcaggtagaggtgaggatggcgtggaatgtggtgttgagagggtggagaggggttttcacgatgatggagcatgtggggaaggtggggtttgcgccagcgacgaggggtggttctcgcaggagttgccaacgccaaggtgttgccccggtgcgatggaaagtacggtcatggcggatttgaaggtggggatgtgtgaaggggagggtgagaatgtgaatggggttagggtgaacgaa

SEQ ID NO: 72580 - DNA, 624 bp, Glycine max
  Peptide Sequence Number=SeqID_164265
atggagaataacccctccagagctcagaagaaagccaagtcttctaagaggaagcaaggagagtgttctcaagctgctctcaccaagctggatacatgtggttctctcagcaagggtttaactttccatctacttgaagctcacagtctatccaagcttatgcaaatgaaaggaacattttatctagagctggtgaaagtcttctacacgtgtgcccgtgccgatttagaagtttggaaggcagtagccggactggacatgggtggagtccgcaaatttgaagaatctgatgatgggtacaacaagatgcaaacctatagaggaatgcttcttgacctaacaaggaatctgaggaattgcctagtaactgacgatgatctacagattgtgtatggtcttaaatatggtatcaagatgaattgggtactttggattgaagacatcatgttgaaaagccatcggttagtggattatgaatttttgtatgttgtgcttgcctcaatattcattgactatttcaatgtcgatgtatctaatgagatagtagatttcaccaaagcatctagtgagatcaccaaaaggaatctcaagaagaatgggatgatgtttgttgaacatgagtga

SEQ ID NO: 72581 - DNA, 180 bp, Glycine max
  Peptide Sequence Number=SeqID_164266
atgacgactaacagcaatcaatcccatgaagataatgaggaagaagttgagcctgattctctaataacaaccataccaccatactacataccaccatacacgcataatgctgaagaatttaattttgaagattttgaatgcgggcattatacatccttgcaagtaagtagtgggaaataa

SEQ ID NO: 72582 - DNA, 651 bp, Glycine max
  Peptide Sequence Number=SeqID_164267
atgacccttcagcttaatttctatgcagacttttctagtgccatggtcaaaatgggaaaccttagccccttaacagggaaaagtggcttaatcgtactaattgccgcaagacaagaaccaacttcctcacaaagcagcataactattgtaattgtacaactggatccttcactagcatcatcaccctcacaagccaacaatggtccttctccacaaacatcatcatcctcatcagagtcatcaccaaccaacaatgatcctaaaccagcacaagtctcacttcaaccaacattaccatatagacaacaacaatcctcacaaacacaaagcgtaactattgaacttgtacaactagatcctcctccacaaccctcacctcaacaaattccttcaccatcacaaaccaacattaatcctgaacaaggacaaccctcaactcaacaaacaccaacaaacaatagtaatagtactcctccagcatcaccgagcaatggccacgtccaaccactaacatcacaaaacatcatcacaagtgaaaaccaaggacatgctaatagatggaacaggtttgagaggttctgcagaatgtatctgctagacgacggtaactggatggtggacataaagacaagggagcaactaagggagtaa

SEQ ID NO: 72583 - DNA, 1287 bp, Glycine max
  Peptide Sequence Number=SeqID_164268
atggcgaagctgaagacgggcattgattctgcgttctgggacttgaacgtggcgtcccctcagctgcacgacggatgggccaaatccgttccgggcgacccgtttccgttggacggctccgtcgccagcagagtgctccggccacggcagctctccgtcatcggaaacggcttgcctcttcccgtaatcattccctcgctctctcctacttcgcccaaggatttgggttccttctctctccagtccctcctcctcaaactcgccaatcctcgctggtggcttacaatgactggacagtttcgtcccaggaagctgattgctgatgttaaaaatgagatctctaatgctgaagaattcgatctctccacagtcaaggatgttgtgaagcatttcattaacaagtcactttattcttttgggttaacctcacagttcgcttttcctccttcaacatccttgctgcttgctatagaaggccatggtgagaaagaaagattgcgccgcaaaatgatgctgaaaagacaacattccttgcagcttcatgatcatgatcttacgttggaagcagcatggcctcaattatttgttgaccacaaaggaaaatattgggatgtccctgagtctttatctgttgatttgtcatcccttgtgtctgaatctggattgcgatatcactttgggatacataaaaatggtggtaatccccaggcaatgaatgcaaccgatggtaacccgccactgtctctactgccagggttatgtgcgaaggttgctgttagttatgagaagatcaaatacttctggagagataaaggtgctgcagaacaagagaatgaagaggcgcttccatatgatgtgcgtcttaaggaacctcacgcagcagtagcacctttgcttcctggatttggaatggaaggagcttgtctagcgtcgattcaagagaagatcaagagggtagatgctcgtctagatatatcttcagcttcagcatttgcaaagaagattctgaatggttccagtagttcaactgctgatgttagcaaacaaccatcagcctcaccccggctaaatttaatctttcaacagcaggttgcagggccagttgtttttcgagctgattcccggattgcccttgagtctttcgccaggaaaaacggtgtgtcagtagaggattttatttgcagcctgagttactccttgaaggatcttcagtctggaaagatcgttgcttggtattctccaaaaagaaaagagggaatggttgaatttcgcatgtatgagttttag

SEQ ID NO: 72584 - DNA, 108 bp, Glycine max
  Peptide Sequence Number=SeqID_164269
atggaacttatgaccaagggtaggaccaaacagtcagagaatactagacaaggcctaagtggagaaggacgaaggcctagaggcactcccaagaatcttgattgctga

SEQ ID NO: 72585 - DNA, 969 bp, Glycine max
  Peptide Sequence Number=SeqID_164270
atgtttttaacttcagacaaacgagagatcgagctttctcctgatgaagttgttacaactattgatccgcagaaggcagaaattttacagaggtatctccagtggttgattgaagaccaggactgtaatgatacacagttgcatactttgtacgccctctcacttgccaaatcagcaattgaagcctttgaatctgaaaatatttctgagaatcttgatagtggaaatatagagacaagaagtttggctatgttgaagaactcaatctttcagattcctgtcagggaaagattacagatatttttgcaatcctcagacttgtatgatccagaagaagttcttgacttgattgaaggatcagaattatggttagaaaaggctattctgtatagaagactggggcaggagactttggtcctccaaattttggctttgaaactggaagacagtgaagctgctgagcaatattgtgctgagataggaagagctgatgcatatatgcagttgcttgaaatgtatttggatccacaagatgataaggatcccatgtttactgctgctgttcgccttctgcataatcatggagaatcattagatccattgcaagttttagagaaactgtctccagatatgccacttcaacttgcttctgacactttactaagaatgttcagggccagagttcatcatcatcgtcaaggacagattgtgcataatttatctcgtgccgtagacattgatgcaagattgtcaagattggaggagaggtcaaggaatgtacaaattaatgatgagagcctctgtgactcctgtgatgcacgtcttggtacgaagctatttgcaatgtatcctgatgacactgttgtatgttacaagtgttaccgccgtcaaggtgagtcagtgtctgtctcaggtcgcaattttaaggaagacatcctaattaaaccgggttggctcgtgagtcgttga

SEQ ID NO: 72586 - DNA, 1341 bp, Glycine max
  Peptide Sequence Number=SeqID_164271
atggccgctgaaaatcacccgctaaatagtctcgatgccgaagggttagaggcccattggatgccttttaccggcaaccgtaattttaaagcgcagccgcgcatcattactcaagccgcggggacgtattacaccagccatgacggcagaaagattttcgacggcctgtccggattatggtgttgcggattggggcacggccggcaggaaatcaccgacgccgcccagcgccagctggcgacgctggattactcgccggcgtttcagttcggccacccgctgtcgttcgaactggccaacaagatcaaggcactgacgccggcggggctggattacgtattcttcaccggctccggatcggaagcggcggacacctcgctgaaaatggcgcgcgcttactggcgcgccaaaggccaggcgggcaaaacctgctttatcggccgggaaaagggctatcacggcgttaacttcggcggcatctcggtcggcggcatcgccggcaaccgcaaaacgttcggcgccggcgccgaggcggaccacctgccgcataccctgctggccggcaacgccttttcgcgcggcatgccgcaacagggggcggagctggcggaagagctcaaccgcatcatcgcgctgcgcgacgcctcaacgatcgccgcggtgatcgtcgaacccttctccggctccgccggggtgatcgtgccgccggtcggctacctgcagcgcctgcgcgaaatctgtacccagcatgacatcctgctgatcttcgacgaagtgatcaccgccttcggccgctgcggcgcgatgaccggcgccgaggcgttcggcgtcacgccggacatcatgaacatcgccaaacaggtgaccaacggcgcgcagccgatgggcgcagtggtggtgcggccggagatctaccaaaccttcatgaacggcggcgagccggactaccagctcgaattcccgcacggctacacctactccgcccacccggtcagctgcgcggtcgcgctggcgacgctggacatcctgcagcgcgaacagatggtggagcgcgtacaggcgctggcgccctacttcgagcgcgcggtgcacagcctgcagggagccaaacacgtcgccgacattcgcaacatcggcctggcggccggcattacgctggcggcgcggccgggcgaaccggcgcggcgccccttcgaggcggcgatgcgttgctgggaaagcggattttacgtgcgctacggcggcgacaccctgcagctggcgccgccgttcatcagcagcgaagcgcagatcgatgcgctgatcaacgccgtgggcgacgccctcaacgccaccgaataa

SEQ ID NO: 72587 - DNA, 216 bp, Glycine max
  Peptide Sequence Number=SeqID_164272
atgtatgtaaatgtgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacggttcacctacggaaaccttgttacgacttctccttcctctaa

SEQ ID NO: 72588 - DNA, 324 bp, Glycine max
  Peptide Sequence Number=SeqID_164273
atgcagacacaaagtttcacaaatccacaattccttaaaataagtctaactcacaaaaagttccccagtggagtcgccaactgtcgcaacgtgcccttttgcgggcgagcgaggcgaggctcacgggtgcgctttccaaaggaggaaagatgtgcggagtcgccaccaacgtttatttgtggaaaacgtcggaaaaaccaaaggaaactggtcaaaatgaaaattctaagttcgggagttgtatttacgcttgaggaaggtcgacaaaagcgaggcttttgctcctacgtaccctccatcgaagaggaaatcagacctacgtag

SEQ ID NO: 72589 - DNA, 363 bp, Glycine max
  Peptide Sequence Number=SeqID_164274
atgggaggtggtgcaaaagaaggacaaagaactcaggagcagtggttgaaagcccacgtgcaaggtttggattggctcccgagtttgagaaccgctaaaacggaggaagttgaggcaccggaggaagacgaagaggtgcaggcccttagggcagaactcgagcaagcccaaacagtcaaagaaaggttcaaatcagcagctcttaaaatccgaaaggagaatgccgaactaagagatataaatatagctaccgcaagagcccttgaacaagaaaccaagagggcgcgcaaggcagagcatggccgagataaattccgaggagctttgtggggcagcaacaatgagctcaagcttcgaatgtaa

SEQ ID NO: 72590 - DNA, 582 bp, Glycine max
  Peptide Sequence Number=SeqID_164275
atgaccatgattacgaattcgagctcggtcgccgctgctattggatgtccagagcaccctggagccggtgtcaccatcaagcaatactttggatcaactccacggacgtcccgcagctcttcctccctgcctcctaaagaattgcagcagctgacccagcaaatcagggaccagctagaggagtccatcacagagagagggacgcgcgatcctgagacgggtgactctgataagtgcggcttgtacatagaagcagatcctgcccgcctggttgccatggggagagtttatgagggatccactgttgttcataacactcctttgttgcctggccaagtaaaggtgagtgtagaggaggttacagatgcagatgctccagttcctctacccactgatgaggtttccttagtggggcaggcacttcacaccttccttgattggccgacacatctggtcaagtttttatcacagcagttagctgtgtctccggcaaaaccacctccaaagcctgatccggaggtcgatgatccgctttatctaatgacattgaccatcccagagcatttcttgaggccttatcag

SEQ ID NO: 72591 - DNA, 93 bp, Glycine max
  Peptide Sequence Number=SeqID_164276
atggtacgagtagacgctaggcctgtaattagcatgttgtcaccccgcatccagcttcagacgatcaagaagcactactgggaggccgcctag

SEQ ID NO: 72592 - DNA, 426 bp, Glycine max
  Peptide Sequence Number=SeqID_164277
atgaaggacaagtatattgttcaaagcttgttaaagaacttagaaaaaatcaagaacaagcttgttcgcacatcgttcgcgtgtatgatatccactccacaagcttgtggttacgtgagcatcaactactaccaatacatagatgttgtttacacaaacgaacacatcttaaaagcttactccgcacaatggtggcctcttgggaatgaagcggctattcctccttctaatgacgcatggacacttatccctgacccaactacaattcgtgcgaaaggtcggccaaaatcaacaaggataaggaatgagatggattgggtcgaaccatctgagcaccgacaaaaatgtagtagatgtggagccgaagggcataataggcgtcgctgtccaatgcaatctgagcatgggagttgttcaaatcattga

SEQ ID NO: 72593 - DNA, 159 bp, Glycine max
  Peptide Sequence Number=SeqID_164278
atgtggagtcgccaactgtctcaacctacccttcggcgggagggcgacgcagggctcgtgggtgcgtcttccaagaaaggaaaatgcgcggagttaccaccaatgtttattcgagggaaacgtcagaaaaaccagaaaggtgtggtctacaaactttaa

SEQ ID NO: 72594 - DNA, 604 bp, Glycine max
  Peptide Sequence Number=SeqID_164279
atgaagactgttatctctattccactaataaattgtgattttgctggaggagaacatcaccaagacagttgttacttttattctataaataactttgaccggagacaggaaccggtcatgtacaactatcataagaaaggaagagatcttgatcttgaaaatgtattggcagacttcatgacataccaagctagctctaaaggtgactattattccatgcaacagcggggaactcaatttgaaagggactattcttctgcagattatcaatgggagtcagaatggcaaccttattatcacaatgaagcagaaggattgtctaatctggatgatatgttaatgcaattcaaagatactatagatttaatgcaacaagcctttaaaagaactgaaacccagattggaaagttggtagatgacatgactaaagttgtggtcagaaaagaagaagagtatgcagagattgaagcacatcaagaaagcattcttcaagttaccaaaatccatcatcaattgatcaacgaagaagaaaaggatgaagtctcccgtactccagaatatccctgcatggcaattgttggctatgttgtagggaaagataaag

SEQ ID NO: 72595 - DNA, 396 bp, Glycine max
  Peptide Sequence Number=SeqID_164280
atggggttaagtacctcgaggatgtcaagtgaagcttgcatgccaccaaacaatggtccccggacgaaattaggctataaacaaaccatgttgggattatacactcatttctctcgaaaaatgattgaaaatcacgtgaacatggttgttgaagtattggtaatcaaaatttttattcttgcgaacatagggtcgcaccaagcacatgcttttaagaagaggttttcatcaagtcaaggtcaagtatggaagaaaaaatgtactttacggtgcccctaccgaacgcgtgccaaagctagagtgatgagtgaactagaagaggtacaggaacagacgaaggttgacatggaggccatgaaagagcaaatgaccaaaatgatggaagccatgatgagt

SEQ ID NO: 72596 - DNA, 576 bp, Glycine max
  Peptide Sequence Number=SeqID_164281
atggatgatcaaaaggagacacaggaacagatgaaagtcgacatgttggctttgaaagagcaaatggcttccatgatggaggccatgttaggaatgagacaactcatggagaaaaacgtggccaccactgccgctgttagttcgactgccgaagcagacccaactctcctagctacttcacaccatcctcccccaaacgcagtaggacgagaaaggagcacactggggcacaccaacaaccctcatttgggatacaaccgggtggcttacccttatggattaccacctaattacatgccgccagtcatgaatgatgacgcgagtcatgtctcttcccccatccttgaaagggagcctcctcgacagcctgacgaggtccatgaagatcatcgagagtatgcccaaggggatgtcgattactacccccccgatcctcgtcgaggggtcggcacccaacacattgactcagcacaacctcacagcacaaccaatattcttgtccacagaaggaccacacccgacggcagaagaaagaaggaaactcgatctcctctaggagagattgagagctattga

SEQ ID NO: 72597 - DNA, 574 bp, Glycine max
  Peptide Sequence Number=SeqID_164282
gatagtgtccatgcaagtgtcaatccagcttcatcccatactgaagatcattataaccaaccaaagacaccaccacatagtgtccatgcaactgttaatcgggcttcacacgatgctgaagatcattttaatgtctccggttcatcagagaatgagaattctagatcaatagaagaatctcaaactatttcttcagttggatatctaaactgtgaatcgccacatcatgattcttcaatggacgcaggagaatattttgatcttggtgaccagctcatgcaatatagacattgtaatgcaaaaatgtggtttaatgaaagcatattaaaatgttcaaataccttaagcccacgattcagcctatgttgtggagatgacaaggttaaacttccattgttacagaatccacctaaatttctacagcaagttctatttgagcaaaatacagctcatgcaaaaaattatcaacagaacataagaacttataacatgatgtttgcatttacttctgctggtattaaatttgacaaaacaattagtccttcgagaggccctcctacaatcagaattcaag

SEQ ID NO: 72598 - DNA, 303 bp, Glycine max
  Peptide Sequence Number=SeqID_164283
atgaaaaaatctgattggaaaaccttcaaagataagaaagcaaagaaaacttacatcacttgggaagataatgatatggattcatccggagactcagaaaatgaaatcgtgaatctaagtctcatgaccaaaaactatgaaagcgaagaagatgattttttgaagaaaagttggtacattgatagcggatggtctaaacacataacgggagatgcatcaaagtttactcatatttctcctaagaatagtggacatgtgacaacaacaaagataaaacatcaaatcatgttcaatgctttttaa

SEQ ID NO: 72599 - DNA, 468 bp, Glycine max
  Peptide Sequence Number=SeqID_164284
atggctccaaagaaactctacacgaagaggtctagaagagacaccatacgagaaggatccaatgccgcctcagagtttgatagtcatcgttttcagagtgtcgagcaccagcagcgcttcggggccatcaggggatggtcattccatagggagaggcgtgtccagctcagggaggatgagtatacagacttccaggaggagatagctctcagacgttggacaccgctagtgacttccatggccaagttcgaccctgagatagtcctagagttctatgctaatgcctggcccacggaggagggggttcgagacatgcactcgaaggccaacagtgtgagttcagccagaggaggagcagggccgacggtttcgatgaggaagccatcgcccagttgttgtgcataccggggtaggatttttcccgaaccactgtatggaggcgggtgcggatcatgcacaccagcatga

SEQ ID NO: 72600 - DNA, 228 bp, Glycine max
  Peptide Sequence Number=SeqID_164285
atgggtgttacaattcaagtcaataaggacatggtcagactgagattcatcatcgccaactactactgttggatcatgaacgaagaaaaagacatcaaggtacaaatcaacgaataccacaagttactggaagacctaaagactgaaaacatctattttcctaacgagttcatttttgaacttctgattaagaagctgtcggagtcctggacagactataaacaatag

SEQ ID NO: 72601 - DNA, 219 bp, Glycine max
  Peptide Sequence Number=SeqID_164286
atgggggagaagcttgccacccagctcgcccaggcgagcttagcttgcccaggcgagcaaggttgcttcctccagaagcaacagccttctggaggaaggagctggaaggcccaactttcgaagaagttatggaaactcacggattgcgcaaaaacatctcttttcgacttccgccacattacggaatttcacggatcgtgcaagcctgcttccttttga

SEQ ID NO: 72602 - DNA, 297 bp, Glycine max
  Peptide Sequence Number=SeqID_164287
atggagtcgccaactgtcgcaacctacccttcggcgggagggcgacgcgagactcacgggtgcgtcttccaaggaaggaaaatgcgcggagtcgccaccaacgtttatttgaggaaaatgttagaaaaaccaaaagtgggtctacgaattttaagaacaaaggtttgggagttgtttacatgcgaggaagagcggggctcttgctcttacgtatcctcaattgcgatgaggaactcagacctacgtagttctttcaaagcaagaaagttatgcggagtgttgattttagacttttaa

SEQ ID NO: 72603 - DNA, 775 bp, Glycine max
  Peptide Sequence Number=SeqID_164288
gcgactggtggagcgtaccgggcggggcatcagggtgacggcagccggagaggctctgctggcgcatggggagcgcattcaacaggcggtggatgaagccatccgcgccgtgagcgccttcagccatgatgtgagcggcaccattacgctcggcacgggcgcaaccgcctgcattcatctgctgccgccgctgctggaacagctacgccgcgactatccgcttctgaacgtcggggtgaccacgggcaacaccctggatatcgtcagggccatcgaggagaaccgtctcgatatggggctggtgacgctgccggtgagtagcagagcgctggacgtcctgccggtgatggaggaagagtttgtttttatcgcctcgcgggagcagcaggaggctttcagggcgtttaccccggaggcgttatatgctcacccgctgattgcctttgaatccggcagcggtacccgggcgctgatcgagggctggtttgctgccagtggctcagggatcgcgccggtgatgcagcttggcagtatcgaggcgatcaagcgcatggtgcgcgcagggctgggctacagcattgtgccgcgcatggcggtggagcaggaggccgatcgtgacgggctatgcgtgagtgcaaaactctccggcgagctagcggtcagccgtgtcgacggtcaggctggtttgctgagactggagtttgtcctgatggtgataccaggcgccaatcgaagagtaaacgaagcggccaaagaaaaagaggaagctgattaa

SEQ ID NO: 72604 - DNA, 570 bp, Glycine max
  Peptide Sequence Number=SeqID_164289
atggaattgattgaggatatggttgttagtgaccatgcaatcttgagtgatagagcacacatcccaaccaaaagaagcctactagagctttcatcacaggacgcattgttggcacaaaacaagctgctgcctaagaaacttgaggcattgacagaaacattgagttgtgctatatgtggtggagctcacgaatttggctactgtatttccactaaagatacaacacatgaagtgaactatatagggaaccagccaagatcaaactttaatgcaaaccagggtggaccatctaataggccacaacaacaagggcctagtctctatgataagacaacaaagctagaagagactcttgctcaatttatgcaattatccatgtccaatcaaaagagcaccaagccagccatcatgaatctagaagtccaggctgttatgactagaagcaaaatggtgagcatgaatgaaggagagaagatgataggtgaagaaaaacaacaactggtgactgagccagcaattgacccagtggtggaacctttgagtgggacagaggaagaaagtgggaagtag

SEQ ID NO: 72605 - DNA, 378 bp, Glycine max
  Peptide Sequence Number=SeqID_164290
atgaccatgattacgccaagcttgcatgcaggcctctgcagtcgacgggcctcggcttggccaaagtccatccgtggctccacgccaaaagtgagaggcacctgtcagattgagcgtgcagccagtgaatccccgcattttatgcgttttcatgttgcctgcccgcattgcggggaggagcagtatcttaaatttggcgacaaagagacgccgtttggcctcaaatggacgccggatgacccctccagcgtgttttatctctgcgagcataatgcctgcgtcatccgccagcaggagctggactttactgatgcccgttatatctgcgaggccctaggcctggggccagcgccagcagcgacggaatatcacgaatag

SEQ ID NO: 72606 - DNA, 138 bp, Glycine max
  Peptide Sequence Number=SeqID_164291
atggctgaagagcaacctcgacgagtgaccttggaagattactcaagtacatttgtgccgcaattctttactagcattgcgtggtcgaagcacaaacccgtgcctacctccagtccccaagcgacctgcggtccttga

SEQ ID NO: 72607 - DNA, 240 bp, Glycine max
  Peptide Sequence Number=SeqID_164292
atgcccgtatatccatcatggtactcgaagaccaagaaaaaagaaagcaacgaggtgaggaagaaacacggtaaagagttagagaaccatggtgaggcaagggtcatgcaagaagaggtagaatgcgacggggtcgatggcgggaaacaagtttcacgcaggacgtatattaaactagacatcatcacatatttctttgcaagtttccagttgagtgctgggggagatgagtgtttttaa

SEQ ID NO: 72608 - DNA, 366 bp, Glycine max
  Peptide Sequence Number=SeqID_164293
atgggtgaaaaacatgtacagtttcaccaaacacccaaaaagctcaaatgggtcgtggggaatcggctaaaagatcgaaactttgcactcaatttcaaacatttagacgcagtggggaaatgggagaagagggttgcatctgcatctgcaactgaacggagagaagattataagggcgatagagaagtttcgaggatcgaagtgccatgcggcaaaggtgatatggtttcattcgcccttggatatggtaggaatgaggcatcaagacgagatgaagggggtggtcggaagcaatgccgcacgatggttcgtgttgacatgcaagggaagccattgatggtcatggagaagcaatggttctattag

SEQ ID NO: 72609 - DNA, 414 bp, Glycine max
  Peptide Sequence Number=SeqID_164294
atgtcaactgagagacacgttaactacagatatgatgtgcttcaaacacttcagcaatgtcagcaattacttctttgcaagttggttatccccagcacccatgtcgcctccaccgccgctagctctgccgtttccaacgccacactcctcggctacgccattggaacggcccacgggatggcgtcgcaggcgcgcatggcggcctacaaagtttgctggaccggcgactgcttcgcctcccgctctcccttgcgaccgatcgaactcgtcaggcaacatttgcatgtctggttcgctcaacccgaagagcgtgcacaggatgatactcgcaaacacgacggtgagcggcgagggactggtggcggacagtcacttggtggccgccgttgcggtgggggaatccgcgggggatga

SEQ ID NO: 72610 - DNA, 1233 bp, Glycine max
  Peptide Sequence Number=SeqID_164295
atgtgggagctcagtgtccgaaatagagtcaaagaggatctatttcaagcaaagaaggaagctcatcttgttgtagataaattctttctcggattcattctcacaatccagtgttcaggtgctaccaagatagcatctaattggaaacactccattgtgtgtggcttgcattgctgcaaagttggaatcaatggaaccctgctcaagtgtcaaagacaggaattcaggatagcattaagtatgatcgaggatgctgaggacaatggcctgattacaccagggatgactgtacttgttgagactactggtggaaacactggaattggattgacattcattgcagcacttaaaggttacaggctaatcctagcgatgccggctttaatgagtctcgagaggagaattgtgctccgtgctttgggagctgagctgcatctcactgatcctgctatgggcttcagaagtagtcttcaaaaggctgaggagctactgagggagacatgtgatgcttttatgtctcatcaatttgaaaatcctgcaaacccaaagattcactatgaaaccactggccctgagatatggagagattctggagagaaagttgatgcccttgtagcaggtataggaactggcggtacaataacaggtgcagggaaattcctcaaggagagaaattcaaaaatcaaggttccttttcttgtgaacactttcctgtggatagaagagagtttaaaatgcatgcaattaccttcattgctaatgctatgtgttttcatcaaggtctatggagtggaaccagttgaaagtgcagtcttgagtggaggacagccagattgtaagccagacatgttgcatgaatgtgtaaaaggagggcatctgattcagggaattggtgctggtattgttcctgctgtgctggattctgctaagtgcatatctctcaagactgctcagttaatacaatctgctcaagtgcttttgttcattttagcaaacagcatcacacttccaaggaagggtgtaactgatcacccttctagtcatcaggtttctaaatctaaagatgtgatcttccatgaaattgaatatttctttgttgcacctcagcctcagggaaagtgtaattggttgtctgagttgtctaagtttgggaaattagatttagacttccccctcttgaattgcctttacattctaatgcagctgaaggaacttatagtgtgtttggaatag

SEQ ID NO: 72611 - DNA, 180 bp, Glycine max
  Peptide Sequence Number=SeqID_164296
atgaaacaatataatacatgtttttatcaaaatttgaaaccgtggcacatcagggtggacatgattaagtggggtcccgaacttcacacgtctactttgagagatgtcttttacaggagagggacctacaaaacatgggactctgacgctcaagggttgttgctgggagcttatagataa

SEQ ID NO: 72612 - DNA, 1713 bp, Glycine max
  Peptide Sequence Number=SeqID_164297
atggagcaaccacaactcttgcatgacccaaatttccctctcttcaaaaccccttcttcacccgccgtaaccaccaccgccactcacaaacccctttcaaccacacccatcaccaccacctccaacggtgagcgtcgagaagaccactccgtcgaaaccgccgccaccgttgccgccgacgcggaggcgttcggcgacctcgggctggcggaatgggcggtgaagacgtgccgggagctcgggatgcggaggccgcgccccgtgcagcggcggtgcatcccgcgcgtgctggagggccggcacgtgctgggcatcgacgagacagggagcgggaagacggccgccttcgcgctcccgatcctgcaccgtctcgccgagcatcccttcggcgtgttcgccctcgtggtgacgcccacgcgcgagctcgccttccagctcgccgagcagttccgcgccctcggctccgccgtgcacctccgcatcacggtggttgtcgggggcatggacatgctcaggcagaccaaggagctcgccgcgaggccgcacctcgtcattgccacccccgggaggatccacgccctgctccgcaataaccctgatattccccccgttttctccagaactaagttccttgtcttggatgaagcagatcgtgtcctggatgttggttttcaggaggaattgagatttatctttcagtgcttaccagaaaatcgacaaaacctgttcttttctgcaacaactacaagtaatctgcaaaagttgcgtgaacgttaccaagataagatgtatgtctatgaggcttatgaaggttttaaaacagttgaaacacttaagcaacaggctatattcatccctaaaaaggtgaaggatgtatatttgatgcatattttggctaaaatggaagatatgggaattcggtctgccattgtatttatctcaacatgcagagattgtcatcgtttaagtttaatgctggaagtgcttgatcaagaagcagcagctctgtattcattcaaatcacaagctcagaggcttgaagcacttcaccaatttaaatcaggaaaggtttcaatactgctagcaactgatgttgctagccgcggtttggatattcctacagttgatcttgtcatcaattatgatgttccaaggtttccacgagattatattcatcgtgtaggtcgtacagcaagagcaggtagagggggactggctttgagtcttgtcacccagaatgatgttgatcttattcatgaaatagaagcacttattgagaagcaacttgaaatgattgaatacaaagaaaatgaggtgctttctctcatgaaaaaggttttcagtgctaagaacgtagcagaaatgaagatgatagatgatggctttgaagagaaagctaaagagcggaaaaaacagaagctgaaaatgctagcagataaaggattgttaaataaaagaagtaaaaagagaaaacgaaataaagaatttgcagaggaaggggaagaacaaaaaaatgaggttttcactgttaggaatgtgacggaaatgaagaggatggatgaggatggcattgaggagaaagcagaagaggggggaatacaaaaacttaaaatgcgaacacagaaagatgaagggaaaaaacagaaaaaagagaaagtagaagcattagcagatatagaaactccaaagaaaaggagtaagaagagacagtaa

SEQ ID NO: 72613 - DNA, 255 bp, Glycine max
  Peptide Sequence Number=SeqID_164298
atggacgggagggacagtgaagttgaagagtgtgcgtttgaaattgaagagtgtgttgagttgtgttctggagagagaaagagagagagtgcatttctgagagcatctttctcgggtcgacgcgtggtggatgacgaaagttctgacattcaaagggcattttcagggccacgtggtgagaagatagtggttgctgcagcgtttgtatggacgactgcgacgtttcttggtgtcgacagcagcgcatgcgcgtga

SEQ ID NO: 72614 - DNA, 474 bp, Glycine max
  Peptide Sequence Number=SeqID_164299
atgggaaacctctttggcaaaaataaaaagcgtgacactgaaagtgccaacaataataaaggaagaggtggaagaatctacactgccgtgaccacaagaggcttaccacctcatttcccaacacaattacctcattcacagcctccaccgctattatatccaactctagaacctccgccaccgccaccgccgccgccgccgccaccggcactaccacaatccatgtccaagaaaccaagttttgcgagagttttcgctaaacaaagctcttcagtcatgaacaacaatcaatctgctgccaagaagtatgctttgattcgtgataacttctctacccttgaacagagatcggaaaaactagcatgcaaaagcaattgcaagaaaaagtatggaagtctagccccaagcgtcacgggagcaactcacgtggctatcaattcctgtcaaattaaaattgtcgtactccgtgtttaa

SEQ ID NO: 72615 - DNA, 318 bp, Glycine max
  Peptide Sequence Number=SeqID_164300
atgagctttttcatctcctttctctaccgtgacctctccatcaccggtaactgcatccccctcgccactgctactcacaaacgctcacgtgggaaagcgaggccagagactccgacggcaaggtcttgcacaagatcgacaacattgttgaggttccttacattttcgacggcaccccaggattgtggttattgtcatatcggtttggaaggtggatggatgcgatggaaagatgcggagaaggaattgagccatgcatgtcttgaatgtcatggaaagatgttgactcaagtgtttcttgttggctcagagttgtaa

SEQ ID NO: 72616 - DNA, 303 bp, Glycine max
  Peptide Sequence Number=SeqID_164301
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactggttaggtttggcctcaatggaaaaaacggagcacctaacaacgtatcttcacagaccaagaactacgagatcgcccctttcattctgggggaccaggagattggatctagccataagaagaatagaatgcttggctga

SEQ ID NO: 72617 - DNA, 309 bp, Glycine max
  Peptide Sequence Number=SeqID_164302
atgtggagtcaccaactgtcgcaacctacccttcagcgagagggcgacgcggggctcacgggtgcgtcttccaagaaaggaaaatgcgtggagtcgccaccaacgtttattcaaggaaaacgttggaaaaaccggaaagggtgtggtctacgaactttaagtgtgaaaggttcgggagttgtatttacgcacagggaaggttttaaacgtggttacgacgtgaaagatcgcttggattttattttaacagggactaaacgatattacaactcaaatgatcggtggaaattcattttactacttgattag

SEQ ID NO: 72618 - DNA, 1795 bp, Glycine max
  Peptide Sequence Number=SeqID_164303
atggcgggagcgttttttcaccaccgggatgcgacgcgcagcggtgagttcaccaccgaacgcggcggctgggcaacggcgcgccgtgattcggccggactggcaccggatccgcagcgcttcgccagtgaggcgattgtgcaggtgtatgctgcgccgacctacggctggaaaggtgcggtggccgtgcatccgtggattatctttaagcgcgccggagaaacccgctacaaccgttatgaggtgatcagctggggcagcggcgataaagtgcggcgcaacagcaatctgccggacggctactggtacggtgcgcgtccgcgtttgctggtgtcacatcgcggtgcggctgcgcaggcgatgatcccgcagattgaagcggcgattcaatcctatccgtggcccaacacctatcatgcgtggccgggccccaacagcaacaccttcctcgctcacattggccgtgaagtgccggcgctgaagctcgatttgcccgccaatgccatcggcaaggattttcctgtcgctgctcggcgtgctgggcgtcacgctgggagcggaagagggcgtggaggtgaatctgctgggactgaatctggggctggatttcaccccgttgcgtctgcggctgccgtttatcggcggaacgccgaaatccccgtcttcatgatagagattgacgctgtcggccttcacctcgatctcttttttgatcggatcgtcaacgcgggcgcaccacagcgtatcgcccgcaacgcgcagcacctgcatttttggaccaccgtggccgtgcagcagaaacagcgtggccagaccgaggaagataaagaagccgccggtatcggtgatggcggtgatcagtacgctggagccgaccgccgggtcgcgtttgagtttggtcataatcagcggaatcagcacgcccatcagcgccgccagcagcagattcagcaccatcgccagcatcatcacgccgcccagttgcagattgtcgtacatcagccaggttacgccgcccatgatgccgccccagaacaggccgttaagcagcgccacgccgagttcacgcgcaatcagaaacgaaaagttgccgggttcaacctgatgcagcgccagcgcgcgcacgatcatggtgatggtctgattgccggtattaccgccaatgccggcgacaatcggcatcagcgtggccagcgccaccagctgcgaaatggtgtcctcaaacagaccaatgacgcgcgaggcgataaacgccgtacacaggttaacggccagccaggtccagcgctttcttaccgctttgcgcaccggtgcaaacacgtcttcaccctggctgatgccgcccatcttacggatgttgctttcgttctcttcgttcaccaggtcaatcacatcttccacggtgatacggccaatcagcttgcctttggcatcggtcaccgcagcagagatcaggttatagcgttcgaaggcgctggcggcctcttccgctttgtcatccagctggaaagtggatatcggtcagcgccagttcacccagcagctgattgtgttcgtcgccccacgaagattttatcggtgccgtccggcatgcttttgcgcttgcgcagaaagcgttgcaccgtcgccagcgtcacgtctgagcgcacggctgggatcgagcgtggtgagcaggcggccggtgagatcgcgtggcagataacgcgccagatagacctgatcgtcaatatccagcggctcgatggcgcgcaggatttcgcggtcggtcatctcttccgtcaggctggcccacacg

SEQ ID NO: 72619 - DNA, 150 bp, Glycine max
  Peptide Sequence Number=SeqID_164304
atgtcatcttctgcaccctttgtcaatccagggacaatgagtcaggtggcaggtggagataccttatggttgtcagcacctttcgtcaaccaaggcgaacgagttcgacggtttttactctcatcatccagagacattcaggcccgatga

SEQ ID NO: 72620 - DNA, 339 bp, Glycine max
  Peptide Sequence Number=SeqID_164305
atggcaagatctggtgatggtggtggtgattatcatcagttagaagaatctcagcatttgtcattgaacgtaatgacaacacagatgcaacagttgttgagctgtaacaataaagagctctacagacgaatagaaggactagagaaccaaatcaacccaaatgctgggagaccttttggtgggaacagaagggtcaataatggaccaaaccgaatagaggggcagaacaaaattgagggagtaaaactcaatgtaccccatttcaaaggcaggagtgacccagatgcctaccttgactgggagatgaagattcaacatgcattctcctgcaatgactaa

SEQ ID NO: 72621 - DNA, 297 bp, Glycine max
  Peptide Sequence Number=SeqID_164306
aagtctaacaaggtcttggggtttccagctctgattacgggcctctgtcagttctacaaagtgcctgtcgcccccaacaaggtcatcaggccccctactaaccgaactttcatcaagaagtactgtgccgccaggcaggcgcaaggcgagacaccacagcagcctggggatggccagcagcgggcaacagacgcaccgctgccacctccaaagccactcagctcatctacaaaagctagagcgttgcctatgacccgtggtcgaccagcaggcgaccaagtccaaagccaaagataa

SEQ ID NO: 72622 - DNA, 195 bp, Glycine max
  Peptide Sequence Number=SeqID_164307
atgacaacccacaaaaggaagctgaaaggcaatggaaggattagcatgggcagaaatgtgtcagcattgataggtaaatctgttcctcacattcctgagaaatgtaaggacctagatgtggtgattcatttggcaaatagaagtgttgcttaccccgcaggtttcgtagaggatgtgttgggttcgggttggtga

SEQ ID NO: 72623 - DNA, 777 bp, Glycine max
  Peptide Sequence Number=SeqID_164308
atgacgaaggggtttctgatgacacaacgtatcgctttagtaaccggcggcagccgcggtctgggaaaaaacgcggcgctgaagctggcggcgaagggaaccgatattattctgacttaccacagcaaccagcaggcggcgcgggaagtggtgcgcgaaattgagcaaacaggagcgaaagcggcagcattgccgctgaacgtcggcgataccgccagttttgcaggctttgtacaacagctgacgcaatgtctgaaggagaagtggcagcgcgacagcttcgattatttattgaacaatgccggcatcgggttgaccgcgccgtttagcgagaccagcgaagggcagtttgacgagttgatgaacatccactttaagggaccgttcttccttacccagcagctgctgcctttgcttaaagacggtgggcgcattctgaacgtctccagcgggctggcgcgttttgcactcccgggctattccgcttatgcggcgatgaaaggcgccatggaggtgttaacccgttatcaggcgaaggagctcggcgctcgcggaatatcggttaatatcattgcccccggcgcaattgaaaccgactttggcggcggcgcggtgcgcgataatgccccgcttaaccagcatattgccgcccagacggcgctaggccgcgtcggcctgccggatgatatcggcgatgctatcgccgcgttgctgagtgacgagcttggctggatgaacgcccagcgcgttgaggtttccggcggcatgtttttataa

SEQ ID NO: 72624 - DNA, 285 bp, Glycine max
  Peptide Sequence Number=SeqID_164309
gaacatgagatggaactccaacgactaaatcaaaatgaagaaaccgacaagaggaaacgaagcgtagcacttaaagccacctcctcattacaagaagaagaagaagatgaagaagacttctcactctttgtgaagaagtttcacaaatttgtcaagatgagaagaatcgagaggcgtcaaaatttcaaccatggaaaaagattccaagaagactctccaactcttagatgctacaagtgcaaccaaattggtcacatcaaagcaaattgcccctcaaacgagtaa

SEQ ID NO: 72625 - DNA, 588 bp, Glycine max
  Peptide Sequence Number=SeqID_164310
atggggacaaatcaaatcggaaaaagattctatcaagtcaagattaagggcctagatgtcaccagccttaaggagttgggacggttgatgggatccctccaaaggaaagccttccgcagagtgtacggaaagattttagatttggccatagcagaggtatttacgaaagccgttgtatccctcgctcaatactatgaccagccgttgagatgcttcacgtttggggacttccaaatagtaccgactgttgaagaatttgaggagattctaggatgccctcttgggggaagaaaaccgtatcttttctccgggtttcttccctccttgagcaagattgcagctgtggtcagagattcggcgagagagttggatcgtatgaagcaaactcgaaacggcatagtgggcctactgtggaaatatttggaaggcaaggcaagggatatggcgaatcaagaggagtgggtcccgtttgcggatatactagctttgctaatctttggggttgccctctttccaaacgtggacggtttggtggacctagccgcaattgatgctttccttgcatatcaccatagcaaggagagcccg

SEQ ID NO: 72626 - DNA, 306 bp, Glycine max
  Peptide Sequence Number=SeqID_164311
atgacattaattgaggctccaaggtcaagcatggcatctgtaaaagtgcaatctctaatggtgcaagagacactaaaagtgtcaggatctttgcacttcaatggcaaggtggatggtggaatggcaatgaccaaggttatcaaactcgcgattctaggtagactcgtgaggcttcgtaaactcgactcgtataatcgaatcgtaaactcgcattggaccattaacgatctcttggggtggtcgacaaaagcggggcttttgctcctacgtatcctcaattgtgatgaggaaatcagatctacgtag

SEQ ID NO: 72627 - DNA, 354 bp, Glycine max
  Peptide Sequence Number=SeqID_164312
atggagaaagctttcccttctcaacctgttcctttacccactgatgaggtttccttagtggggcagacacttcacaccttccttgcttggccgacacatctggtcaagtctttatcacagcaggtagttgtgtctcctgcaaaaccacctccaaagcccgatgatccactttatctgatgacattgaccatcccagagcttttctcgaggccttatcaggttagatgggatgccaccgtgtttggggtctttaatctagatttccccctatacataaaacacgaagacctctccgaaatcgcacacggtggtcaatgtctcagcatatcagtgttacagttgtggattttgtaa

SEQ ID NO: 72628 - DNA, 252 bp, Glycine max
  Peptide Sequence Number=SeqID_164313
atgattacgaggggccaagacatttatagtagccaagataaggctactacttcaccttcctctagtgaaagtgaaaaagcaaaaggggaagaatctagtgaagaaatctacccccaagaagaaggacaaccattagtggttaaagagaagtgtaaggaggtaagtgtctcctccaagaggtattatgatgcaccaaatccctacgataggtggtatgatgaatgtgtcgagtggtgcaaccctcttatgtaa

SEQ ID NO: 72629 - DNA, 393 bp, Glycine max
  Peptide Sequence Number=SeqID_164314
atgtgggcatttcttatcggtcgtcaaatcgactgggctcacttagtccgttatcgcatgaataaggcattgcgatcaaacgctcccttaccctatcctcatcttatttatctctttcttcaccatttcgagcgtgatggctcttggataaagaaggatgctcaaccacatgatgctgagggttgctcgcccgctcgagaggattcttctcttctacagagtgtcatggataggtttaatagtcttcagacctatgttggagagagatttgactccttggagagtcaagtagacattcaattcggagagatggattataggatcacgaagattgaaggtgacattactttcatcagagattgcttcgaccttccactgccaccatccacttag

SEQ ID NO: 72630 - DNA, 1063 bp, Glycine max
  Peptide Sequence Number=SeqID_164315
atggcgacgacggcaacgccatcgcggtgggcaacaagaacggcttcacctccacccagatggttacccgctcgatgctggtggcctgctcgcactgacaccgggaagggaggtgggcagccacctccccctgtcatcatggttcgcagccctgcgtcagaagctgtaggccgcctgcacatacacccgtcgtggctcgccggggaaatgcccgttgcgttcaatgaagccactggccgcgtacaccttgtcgaacaggttcttgacgttggcctggaactgccactgcttccacgtggtcttccagctcatgtcgaacacggtgtaggccttgaccgtctgcccatccaggctgacgcgctcgccaacatgatccgcgccaaagccgatggcggagttgatcgccggcaggtcataacgcgtccacaatcccagcttgttgcgcggcgcattggcgaatcggtcgccggaggcgttggtgatgccattcggcccggcgtccttcacccgcgcatcgttgtaggcgtaggtcaggttcagcacccagcgctcggtgaggtcggccaaaaggtccagctccatgccggtactgcgcaccaggcccagcgcggccaactggttcacgccaccgatcacctcgccggtggcctgcacgatgttactgcggtcgatccggtaggccgccatgttcaaggtcacacggtcggccagcagcgacttcatgcccacttcccactgcttgctgcgctcggcatcgaacggtccgccagcggccgggttctggttggcggcactctgcggcacgaaaccattggcgatgttggcgtagacattcaggccctcgcgcacggtgaacgtgccacccagccgccagctgagatcgttgccatccacgctgctgccacccatgcggtcctcatccttgaagccatcccagcgcagtccgaccagcacatgccagcgcgtgcccagtgccagttcgtcctgcaggtagccgccatagcgcttgctgcgggtggacgtgctgcgccagggcagggccgccaggttgtagtcgtgccag

SEQ ID NO: 72631 - DNA, 396 bp, Glycine max
  Peptide Sequence Number=SeqID_164316
atggagaaatctgaaaagaaaaattttagtgaaaagaagatgaagaaggcctacatcacatgggatgacaatgatatggaatcatctgaggattcagaaaatgaagagataaacctgtgtctaatggctaaaatttatgaaagcgatgaagagaagaagaaatggtacatagatagcggttgttcaaaacatatgatgggagatgtatcaaagttcacacatatctctcccaagaaaagcgggcatgcaacttatggtgacaacaacaaaggtagaattcttggagttggaaaaataggtacggattcttcaactccattgaaaatgttctacttgttgaaggccttaagcacaacttgcttagtgttagtcaattatgtgataaaggctatctag

SEQ ID NO: 72632 - DNA, 301 bp, Glycine max
  Peptide Sequence Number=SeqID_164317
ggaaatatttttgagacgattccgtggacgtacgcaagaggtgccgaaccagtggtatcagaactatgatcgagagcacacaaagagtactattcaagaccttttggtgcaacaaggtcttgatcagacattagaagatgaaaggtcagcttttataaatgaaaccgagtggactaaaatccaaagaagggatgtgagtaggattcgattagcccttgctcccaagataaagcacaacatgttgaaggagacaacactgaaggccttgtgggagaagctagagaatatctatgtgtcatag

SEQ ID NO: 72633 - DNA, 219 bp, Glycine max
  Peptide Sequence Number=SeqID_164318
atggaatttggggtcatggtagctcgtcgaggcaagctattgcttcaacctgaagtaaccttgcttgcccaactggcgttcaacactgtaagtcgactagcaaggatcaaaagatcaacaaacgatagtcctcgaacgacattagggtatgacaaagacattataataaacatgttcacgataaggaatttgaagaagaagatttggtttggaaaataa

SEQ ID NO: 72634 - DNA, 279 bp, Glycine max
  Peptide Sequence Number=SeqID_164319
atgtcttttgctatcaagatatataatataagatctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcatggggaagggtgtttccctttgctcctacgtattcctcaattcgtgatgaggaaatcagacctacgtag

SEQ ID NO: 72635 - DNA, 315 bp, Glycine max
  Peptide Sequence Number=SeqID_164320
atggcggcgttccatctttgtgatgcgggcttggagttggcggagagcatcgttgtccatcatggtcgtcagagggggatttcaattttctgggggtggctatcgcctaagaccgaatcgtgtactaaccataagtgtgggtggccgcgaggaaggttttactatggccccacagtgggcgccaaatgtacttacccaaatttggagtggactggcgacagggtggactgtcgtcagaatgggctccataatctccagtgtcatacttgcagaggccttgggtccttgattgtcggggtcgttataacagtgtaa

SEQ ID NO: 72636 - DNA, 402 bp, Glycine max
  Peptide Sequence Number=SeqID_164321
atggccagtgaggtggagaaattaaactggaaacacctcatctacaggtacaacctcccatacgtcattgtcacagataatggcactcaattcaaaacttatacttatgaaaacttccggacaaggcgaggtatccagcacatagtcatctctatcgaacatcctcagactaacggacatgcagagatagggtggaacttgaagccaccaaagaagtccaagaaatggcaaggattagagaagaaactgccaaactccaagctgctaggagaaatgatacaaaggttcaaccgtgagcctttcaacctggcgacctcgtatggtgagtccgaggtgaagccagaaaagattcctgaacgggaaagcttggccccaactgggaaggtcccttcagggtcatag

SEQ ID NO: 72637 - DNA, 420 bp, Glycine max
  Peptide Sequence Number=SeqID_164322
atgtcgccacacgggggcgacatggatgggggtgaaaaaaggaaagagagggatggggtttctcttgcttttggcatagcgggccccggcgggaggcccgcacgacgggctattagctcagtggaggaagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 72638 - DNA, 1002 bp, Glycine max
  Peptide Sequence Number=SeqID_164323
atggcttcgctgaaagacgtcgcaaaacttgccggagtctctttgatgacggtgtcccgcgccatcaatgaacccggcaagctgcggccggaaacctaccgccgcgtcaaacaggctatcgaccagttggactacgtgccggatctgtcggcgcggcgtattcgcggtgacggaaatcgcgtgcagacgctcggcgtgctggcgctggacaccgccacgacgccgttctcggtggaaatgatcctgtcgattgagaaaaccgcgcgcgagcgaggctggaacagcttcgtcgtcaacctgtttgccgacgacaacgccgaacagaccgtcgatctgctgctagcgcatcgtccggatggggtgatcttcaccacgatggggctgcgcgaggtgacattgccggccaaactgctggacaaaaagctggtgctggccaactgcgtcagcccggcgcattcgatcgccagctacattcctgatgacgagcaagggcagtatgacgccatgcgcgcgctgatcgccaaaggctatcgcgcgccactgtgcattcatttaccggcggatacgctggcggcgggcctgcgccgtcgcggtctggaacgcgcctggcgcgaagcggggcgcgatgttgaacaactgcggcagtatcatctcgatctgagcggcggcgaccaaagctatcgcgactgcgtcgcgctgctggagcggcatttctctgcaggcaggcgcgattgcgatgtcgtggtgtgcgggaacgatcggatagcctttctggtgtatcaggtattgctggcgcaaggatggcggataccgcaacaggtagcggtgctgggttacgacaatatggtcggcaccggcgagctgttcctgccggcattgacgacggtgcaactgccgcattacgagctgggccgccttgcggcgttgcatgtgattgagcagcgggagcagcgtgagacggtgaaagtgccttgcccgctgttggagcgtggttcgctgtaa

SEQ ID NO: 72639 - DNA, 1302 bp, Glycine max
  Peptide Sequence Number=SeqID_164324
atgggaacggggatgaatcaacagactctcgacgcgcgccgctcgcgtcaggcgttgctggccggctcggtcggcaactttatcgaatggtatgagttcggggtgtacgggttcctggccaccgttatcgccgccaattttttcacgctgcagggtgaaaacgaaatcaccagcctgatcctcacctacgccgccttcgcgctggcgtttttctgtcggccgatcggcgcggtgatattcggccgcatcggcgatcgcatcggccgtcgcccaacgctgattgcggttctgctgttgatgacgctggccaccgcgctgatcggcgtcatgccgacctatgcctcgatcggcgtcgccgccccgctgctactgacgctgctgcgcatgttacaggggctgttcgccggcggtgaattcggcggcgccgtgtcgctgatgaccgagttcgccccgaagggcaagcgcgggctgttcggagcctggcaatcgctgaccgtcgcgctcggcctgctggccggggccgggctggtggcgctgttggccgcgctgctcagcgtgcagcagctgcatgactggggctggcgtattccgttcctgctggcgctgccgctgggcgccgtggcgctgtggctgcggctaaagctcgaggaaacgcccacattcacccaggcgcagcaacatgcggaacacgccgccgcgccgccggaagcgaagctgggcggcgtggtgaaaaccattttgatcggtatcggccgcatgatgggctggtcggccgccggctataccttcctggtggtgatgccttcctatttgcaaacctcattgcacgccaccttccagcaggcgctggtggcgacagtgctcgccaacgtcggcttcgccctgaccattctgccggcgggcattgtcagcgacaaactggggcgatgcgcagagttcactgtgggccaaagggctggcggtcatgatcgccggtgccgtggtcggcctgctggccggtcccggcccggcgatgctggcggagatgttcccgacccgggtgcgctataccggcttggggctggcttactcgctgtccaatgcggtgttttccggctcggccgggctgattatcaccggcctcatcaaacagaccggcaatatcgacattcccgcctactacgtggtcgccacctcggtggtcagcctgtttgcgctgatgacgctgcgccgcgacgatcatctgcgctcgctgaacgaacgttaatcctccgggggcgcatcgcccccttgccaacccgtgacctcgatcacaaggcataa

SEQ ID NO: 72640 - DNA, 441 bp, Glycine max
  Peptide Sequence Number=SeqID_164325
atggagatcattatttctattccaccaataacttacgatttttgccgaagggagcattaccaggataattgttatatgtactccacaaataactgtgggtggagacaagagttaactccctataatcagtatgaagaggaaagagcccctgatcttgataattatcaaagggaaccagagtcacaattctactatcaaaaggaagcagaaaggagtttcaatctggacattttgttaatgcaattcaaggatacaattggatctattcaacgggcatttaaaagtgcagaaattcaggttggtaagctggtagaagaaatgaatcaagctatgagtagaagagaagaagagattgtagaggttgacactcaagaggagagccctatgaatgagcatgatttagaagaagaagatgaggagaaagtgaagcaacgggaatag

SEQ ID NO: 72641 - DNA, 363 bp, Glycine max
  Peptide Sequence Number=SeqID_164326
atggctacattcagcaacatttctctaatggtcctatgtttcattattagttcttccttgatggtcaaaatcgggctttcacaagatgctccggaaccatcaaatgcaccagggccaatgtcatcgtatgtcaagtatttagccaattgtgggtctcatttgtccccaaattgtggtgatgaggtattctcagcaatattttttggtaacaaaacagttagtaatggttgttgtgacaagcttgtgaatgatgttgggaaagtgtgccacgatgatatgacaaagtatattttgacattgcctaagttccgggcccataaaattcagatcttgaagaggagtgagaagagtactataggataa

SEQ ID NO: 72642 - DNA, 210 bp, Glycine max
  Peptide Sequence Number=SeqID_164327
atggagtcaaatatagaggtcatttatcttcgcttccaaggaaatgaaattgatgctaataaactttgtaaatgttttccaacttgtatagaaggtcaacaaagtcatcacaatttaaattgcaagaagcacatgctacaattgcctgcgagcaagaaattcgaagtgcctgaaattctccacaatcacaccaccatttgttcaatttga

SEQ ID NO: 72643 - DNA, 285 bp, Glycine max
  Peptide Sequence Number=SeqID_164328
atgttccttatattcaacactagtgctttgaaaggacttgatgatactccacaactgaaatccaaggctgttgctaggtggattgttgttaagtgtaatagacaaaaaggaatcactgaatgtggctactacgtgatgcactggatgtccaccataatcttaggatctttcaggaataattgggagacgtattttaatgaagttagaccattggaagcagagagatttaaggcacttcgcatacagtgggcacaatattatctaaaagttagaaatcaaacatag

SEQ ID NO: 72644 - DNA, 135 bp, Glycine max
  Peptide Sequence Number=SeqID_164329
atggccatgggcaaatcggaggaggcatgtccaataggggatgcaaggacagacgatgacagtcagaggaaaaccctaacggagcaccattctataattggtccaatatttgtggggaaaggtctaacactgtaa

SEQ ID NO: 72645 - DNA, 651 bp, Glycine max
  Peptide Sequence Number=SeqID_164330
atgaaaaactcttggtggggaaaaaagttacacccttacaatcaatatgaagaagaaacaactcttaatcttgagagtatgtttacggaattcgtggcataccatgctagctctaaagccaatcaaaactcaacgcaaaatcaggaaattcgtgttggcaagaactactccatggaaaattgtcagtgggagcaagagttacaaccctacaatcaacatgaagaagaaagaagttctaatctggataatttgttgatgcaattcaaggaatcaactgaatctactcaacaagcatttaaaagtctagaaattcaagttggtaagctagcaaaagaagtggctaaatttatgtccacaagggaagaaaactttgtagaggttgaagctcaagaggaaagccttgtagaagagcatgattcaagagaaaaagatgaagaaaaaatcaatacccctcctcatcaactgattatcaaggaagaaaggcatggagaacatgataaatctttaagtgtcattctctccttgaacaccaacacttctcttgcaatgatatggaaggtgtttctagaatacatgagtttcatggagtctatagctaagaggcgaaaatgcaaggaagatgagttctatgtgacctttatgccaccttga

SEQ ID NO: 72646 - DNA, 117 bp, Glycine max
  Peptide Sequence Number=SeqID_164331
atgggggagggatattgtacgcagccttacccttgcatatgcaaagaggctgtttccggattcgaacccatgaccaacagtattcaagcgcaagtggaacaggagttttattcttaa

SEQ ID NO: 72647 - DNA, 333 bp, Glycine max
  Peptide Sequence Number=SeqID_164332
atgaaggaaagaagaaaaaccatagctgcgtggaaagtggaggaagaagaagaaccgcaaggaacaaccatgaacatgaacgatgacaggaagaaaaagcaccgtaggaagagaaagacgaacaagaagcctcgtatgaagaggaagacgaagggtcgtaggaataagaagaggaagaagaaggacatttttgccatttcaccctacatgctaggggcctcaacaaaaatgctgggtgcaccaagtaacactctaaagactattgtgtatataagtagaaaggctcttgataaatgcacctcccagtttgctaagttaaccccctcttattaa

SEQ ID NO: 72648 - DNA, 534 bp, Glycine max
  Peptide Sequence Number=SeqID_164333
atgactgcggcgcacgatgagccagtgatccctatgccagatgttcaggatgacccgatggaggcaccaactgctgtagaggacattgtggcagacattcctgcggacacaggcacagaggctgctgaggatgagcatgagggattttcgggtggtccgagcaacccatccgtgttaacccagtatgcggatcacgttgcttgcagtgtttggacgggagaggagcgtcctgagttgaagttatcttctcatgggaggaaggtaaacaccgacaatcggggacttttgtccgcgtttgtgaagtggtggcaccgagagacgtctagtttccatctcccggtgggagagctcaccatcacgctggacgacgtatcctcgcttctccatcttcccgtggttggcgacttacacgcctttgagcccttgcacgtggacgatgcagttcagatgctggtggacttattgatggtctctgcagagtctgccagggctgagacagcccagtgtcgtggaccttctgtacgtctgcaatgg

SEQ ID NO: 72649 - DNA, 150 bp, Glycine max
  Peptide Sequence Number=SeqID_164334
atgggctcaaaaatctaccctaaggttcatgagaaccctaaggccttcttcattagctctagcccaatcctcttagagtctcttgcacatggctctggtaacagggtaatgactagtttaactaaagaaatcaacgcgttcatgaattaa

SEQ ID NO: 72650 - DNA, 888 bp, Glycine max
  Peptide Sequence Number=SeqID_164335
atgatacccaggtctgataatattctttacctaatggcacgcattgtgatggctgctgcttcaaaacacctaacaccagttgtgctggagcttggaggaaaatctccagttgttgttgattcaaatatcaatttaaaggtagcaacaagacgaataattgcaggaaagtggggttctaataatgggcaagcctgcatttctccagattatattataacaactaaagactatgctcccaagttggtggatgcgctaaagactgaattggagaaattttatggaaagaacccattggaatcaaaagatttgtcccgtgttgtgaactccaaccactttaatcggttgacaaagctcttggatgatgataaggtttctggtaagattgtttatggaggccaaaaggatgaaaacaaattgaagattagccccactgttctattggatgtcccacgggactctttgattatgaatgaggagatatttggtcctttacttcccatcctcacggttgacaaactagaagaaagctttgacgtgatcaattcaggacccaagcctctcgctgcatatatatttacaaataacaagaagctcaaggagcaatttgttatgactatttcagctggtggtttggttgttaatgacactactttacatcttgcagttcatactttaccatttggtggagttggtgagagtggagtgggtgcataccatgggaaattctcatttgaagcttttagccacaaaaaagctgttctctatcgcaaatttattggtgatgctccagtaaggtacccaccatacacaaatacaaagatgagattgctgaaagctatcataggtggtggcatacatggtattgttcgtgccctgtttggttggtga

SEQ ID NO: 72651 - DNA, 549 bp, Glycine max
  Peptide Sequence Number=SeqID_164336
atgatttcatgcttctcgggacagctccgctgggggcctattgttgtcagatacagatcggagagggttatgcgccagtttggctacgtccagtgcattcatgcacaccctgtccattcatgggtgtcatatgatgacgtggacgatacttggacgcactactcagaccatctggcggtaacaggtgatctatgtgttgtgccaggtcagtgtgcgcctgactacatagactggttttttgtcatatcgcatccattcatgactgcgccacagacggatcctcctcgagatgcatatgcgacgcaacccagtcatatccctcatgaggcagcactgacatcaacacatatggatcctgatgcggacgagcccagacatgtagtggcttgtcatgcgatcgcggaggcgttggagcagcatctaaatgcgcctgacacatccacacatgaagaggtcatccaaaaatgtctcaggattgccaggggtgtcacagaagaccgcaatgtgtatgtgagatctcgacataggcggcgcacggatcaacaatag

SEQ ID NO: 72652 - DNA, 729 bp, Glycine max
  Peptide Sequence Number=SeqID_164337
atgggtgacatagacgaggtgcaagaacagatgaaggacgatatggtggccttgaaagaccaaatggcttccatgatggaagccatgctaagcatgaaaagattgatagaaagtaacgcggccacgactgccgccaccgaggcagaccctaatctttcgtttgccacgaatcaagcatatcaacctgccccaaacatggggggacaaggaggagagatattggggagcactggtggcccgcatctagggtataacataaatgcctacccctatggcttacccctcaatttcacaccgcccaccatgcatgagaacgtggatcatgccgttcccataaccttcgaagcgttccacgctatgcctcagcctaatactgtgggagcctctcaaccccgctcgatacaaccactacatttctacgtagggggaccaccaccgatagtggaaggaaaaggaaaacttaatctcactgaggagagattaagagcggtcgaagcgtctggtgattacttttttgttgatatgaccgatttatgtttagtaccggatgtcatctctcccaaattcaagaagttgctcatgcattttttccaagacagcttagccggggcggcgaacacatggtacactagcttggaaccctcccagattcattcttggaaggaccgaatggtttccttcgttaggcaatatcagtacaatgctgatatggctccagatagaatgtag

SEQ ID NO: 72653 - DNA, 990 bp, Glycine max
  Peptide Sequence Number=SeqID_164338
atggaggatttggcggctcaggtagcacctcccatgatggaaagggagatgatcaccatgatagtagaaactctcccagtgttctactatgagaagttagtaggctacatgccctttagctttgcggatctagtattcgcgggcgagaggattgaggctgactggggcaaagaggaaagaaggggatgctcacgccgtaacctcggcttctgcttagccaaaaccccaattaacccctcacaatactcattagtatgcccaataccatctgagctttttggcccacacggaaaaccccttcaactcggcacccgtccagcaaaggacatctgccccaccacaaagagcccccgcttaagcccccgctcctgcaaggcctcgtctcgtcggcgatttcaatcttggcacaagttccaattcggggaggatccctctagtgaagaagcttttagagtttgcactaactccgatgtcatacgggaacttgtttccatccttaatcgccaactagttggcagtggtaacccacagaagaatctaccagtctcctttcccgaggtggtacaaccccgacgcgacctgcgcgtatcacggaggtactccgggcattcgatcgagcagtgcatggccctcaagcataaggtccaaagcttgattgacgcgggatggctaacattccaagaagatggcctgaatgtgaagacaaatctgcttgccaatcatgggggatcggtggtaaatgcaatagaggcgcgtgggctagagaggccaaagcaaatgaaggacgtagtaacctcaagaaggtttatctttgaagcattgcaagaggcgggcatggtttcctttgatgggcacaaaggggacccctgtttgatgcatccggatgcatcacatgacatggaaacatgttcaacggtggaggagttgttacagcaaatgatggaccaaggccggtttgagatcagtgaagagaacaagggagaacaaaac

SEQ ID NO: 72654 - DNA, 495 bp, Glycine max
  Peptide Sequence Number=SeqID_164339
atggaggaaaatgttctgcaagaggagctcgagcacattgttgtcgacaagtgtgtcaaccaaaaccctagtggagtcgtcgttgtcattgagaaaatcctcattggtgaggtcctaaagcaattgcacgatgtcaatggtgatgtcggtgttgtcgtggttgaggaggtcaacgatggagagaaccgcattgaggttgacgaggtccgagtagaactccagtgcgccagcgaggacctttggcttctgaagctcttcatggagttctgctttggaattggcaaagtgatctggttggttagggtatttaagaaacaacaaagacggtgggagggagaaaaagggtttaggagtttgtttagggttttgagggtttggtctttggagagtaaaagggacagtgaaagagagagggagaatgagcatgagacagtagctaaagggacacattcaaatattacaaataacggaaagtcttccaagacagttttgtaa

SEQ ID NO: 72655 - DNA, 657 bp, Glycine max
  Peptide Sequence Number=SeqID_164340
atgcatctttgtctcgaactaacgtttgtgttgggtggccatgtttggcaagacatcgttggtgtggttgttgatctcattgatgttaagacagttaatccccctcacaggatgacagtcaggctcagggataacagattgtatgtgaacgctaacattgcagagatacaacaatttcgtctaagtttgtgtgtcccattttactgtggtggaataacccatgataaaggtggttctcagtcccaatctagccagagtaatctggtggagaagtttttgcataatgctcgagtggtcagtataggtgaaattaacaacctcagacaggattgttactgcttgactgttgggacagttgatgaaatcatcattgatgccccatggagttatgacagttgtcttaactgtacaaccacatttgatccatcgaaaggtgactcagcttgtcgttcttgccaaaacagtgtgaccgatacagttccacggatggagcataatggggacaaaggaaacttccttttctgggatgcaacatgtatcaagctgtttggtaagactgctgcagaatgtcgagatgaattgatagcggctggggacgatattaaggtgtttccaacctgtgttgatgaaattctgtccaaaacttgggctatctga

SEQ ID NO: 72656 - DNA, 246 bp, Glycine max
  Peptide Sequence Number=SeqID_164341
atggtggcgtctctggtgctctctagagctccttctctggttgctctgttagggttcttgtgcattagaaaagaaaaagggacaaaagtgttttgtaaaagctgctctagcaaatccttttacaagcaaagatccacaagggatgtaccctcccttgttctctttgaaaccctagtggatgtaccctccactagaactgatccacaagagatgtaccatctcttgttcttagtcaaacccaagtag

SEQ ID NO: 72657 - DNA, 1410 bp, Glycine max
  Peptide Sequence Number=SeqID_164342
atgggaggaagtgactttgagggctccattcggcaacccctagtagagcaggaagtagttcccattggcgattcttcatcgaaggatgttcctcacaaggggaatctggtgactgtggaaggtgtgagaaagggtgaagttagggttttcctgaggaataggcgtcgttgtggtggcgaaatgcctcattctctccattcattactggttttgagtggagaatatgagtattcctttatgcatcatgtccctgattgtcccttttatttctatgtttatcgtgtatgttcgagggatttcgatattttatgctcattctttaacattcgccctagtgttcatgtgctcatgtactttttccaaatgaagttgattgaaaggagagtagcgagcatcattttcccttctactagcaatcgaaccctaaaaggaataatgagtgactttgagtggcatcctttagtgaagcaggttgaacctgtcgatgacgtgctccctcccccaactagtgctgatgttgttgaggttacacctaatatgactcattctgcagctgccaagaggaaacatggcgaaaagactcccaacccacgaagcccaccttcgaccccctcaatcgttcagactactgctactacggtcaatgcctataatcctcttgctcctccacctttatccaccttagtggtttctgtatctcttccatatacactggtcactttcgctcctacccctgttgtgcttgcttctatttcttccttggcaccaccgctgcttagtgtggggctgacaaaggtacaaaattcaaatggtgctacaaaggtcttccttcagaagagcttggctattttagaggagagtgagaacaagcataaggaggctatggacataattgcttccttggagcgtcccaaggtggccgatgttactgttgcctttgtcgaggctatcaagtcaaatcaccagttgtcgttcagggttaacgatgtttttgccaagttagtaagtgaggtgaagcgctctgctagggagagggaaacacttgatgtcacgatggcagaattcgcaagagtgattgctaatcttcaagcccaactgagggattctgagctcacaacgtctaacctccaggccaagctgaaaaagtttgagcttgaagtggcaagggagaaggaggccaacaaggagctaaatgatgagcttatcatgtttaagaaagagccagtgcagcaacatgagaaagggttcttcaaagttgtcaggtatgaagggctcttttccaagggtctcgatctgaacctctttgacctattcaaagatgtgaaggacggtaaacttcttgatgaggacgagattactgctatagaggagtctaatggaggggaggaggatgatagggttgatgtttag

SEQ ID NO: 72658 - DNA, 183 bp, Glycine max
  Peptide Sequence Number=SeqID_164343
atgacaacaaaagatgatgacaaaggtgatgacaaaaagctcaaaggtcaatcaaagaatgagttcaagatattcaagagatcaggatttcaagaatcaagattcaagactcaagattcaagaatcaagaaaaagcttaatcaagataagtatgaaaagattattgtaatcgattaccagtag

SEQ ID NO: 72659 - DNA, 258 bp, Glycine max
  Peptide Sequence Number=SeqID_164344
atgtcggatggggacgtcgggttcaccttagcaacaacgctggtagcagcgcttgcaaccgcattggcttccattatcttcttcacgctcatcatggcctccatcattgcggccatttgctctttcatggcctccatcattgcggccatttgctctttcatggcctccatgtcgacctccctctactcttgtacctcctccgttttacccattactctagctccgtacaggttcggacatgaggttgaatcaatttag

SEQ ID NO: 72660 - DNA, 363 bp, Glycine max
  Peptide Sequence Number=SeqID_164345
atgccgatctccctctgcggaagtatcagttggtctgtgccgtcccgacatagggatcgcgcccacaagacacccagtggacccggagacgttcaacagggccctggggtttccagctctggttacgggcctctatcaatcctacagggtgcccgtacccccccggcaaggtcatgccatcccaacatagggatagcgctcgaaaggacacttggtggacccaaagaagtccaacagggtcctgggtttccagctctgattacgggcctctgtcagttctatggagtgcctgtcacccccagcaaggtcatcaggccccctactaatcgagctttcatcaagaggtactgcgcccccaggtag

SEQ ID NO: 72661 - DNA, 237 bp, Glycine max
  Peptide Sequence Number=SeqID_164346
atggcagctcgcctaggaaagctgagacttactccagaagtaactgtctcacccaggcgagctggttccttcacccttaagtcttttgagggcctaggcgagctagaggctagcctggccgagctagggtccaggaaactcaatgaaaagacccttttgcccctctattttggtatctttcgcattcttgatcaaaacattgaacggtctttcgtcttgtgcgataaccggtgttga

SEQ ID NO: 72662 - DNA, 621 bp, Glycine max
  Peptide Sequence Number=SeqID_164347
atggacttcttctctaatgagaattttgaatgcattcaggcatttcaaaattcaaatctcattcctttcatttctttgaaattgcctgtttattctgaattagtaaaagctttctattctaacctcgaaattcaagaaggcactttgatttctgaggtttatggaataaaaatggtcattgaccaatccttattctatgacttgacccagttatctagtgagggtgtaccatttgaagtcacacttttccttcaacactttaacatccctcttgatttcgaaccttatattccaatcaagagatccttcttaatcggtgccgctgtgattgcaacttttggttaccgtaaagagcatgatgactcttgggtaaaaaagggtgctcaacctattgatgatgaaggacatttaccagttggagaggattcctctctccttcagaggattttggacaggtttgatggtcttcaaacctatgttggtgaaaggtttgatgctctggaactacaagtggatatgcgtttcaacgagatggaatcaaggatcaccaaggttgaaggagatgtcacttacatccgcatatgctttgatctaccaccagcactgccaccatcatcttag

SEQ ID NO: 72663 - DNA, 1263 bp, Glycine max
  Peptide Sequence Number=SeqID_164348
cacgcggtcctcgcgccggttggccagcaggtgcagctggatgtgcaggcgcctgaagacctgttccgccatgcgcaggtcgcgtgcctcggacggcgtcaacaggccggcttgcgccaccgcgcgccagttctcgccaaaaccggccgcgcgcaccatccacaggatcactcgcaggtcgcgcaggccgccgcgcgattccttgcagttgggttcgagcgcgtagggcgtgtcctggtagcgcgcgtggcgctgctgcatctcgacgcgcttggcgcggaagaaggcgcgcgcatccagtcgcgactgggtggcggcttcgaacttcttcatcagcgcgcggctgcccgccagccagcgcgattcgagcagcgcggtctcgaccgtgatgtcggcgtcggcctcgcgttcgcagtcctcgatggtgcgcacgatatggccgggttccaggcccaggtcccagagcgcggcgaccaggcgctcgatggcggactagtcttcggcggtgggcgcgtgcggcagcaggatcagcaggtcgacgtccgaatgcgggtacagctcgccgcggccgtagccgccgaccgccgccagcgtggcgccggccggcaggggggtgtgcttgaccaggtcgcgcagcgccgcgtcgacgatgcggcgcaggtcgcccagcagggtgtcggggcgctcgtgttcgcggaactgggccaccgcggcccgccgggattcctgaatgcgttcgcgcagggtgctgaggatatcggcggtcatggtggcggactggccgggggtcaggacctcgtagccggtgtcggtgacgcagacagcatgctcccattgcgccgacaggctatggtcgcgcgtcacgaccgtccagccgtcggacaactggcggatctcgcggcggccggcgttgatcatgggctcgatggtgaacaacatacccgtcaccaattccacgccggtgcccggcttgccataatgcagcacctgcgggtcttcgtggaagcgctggccgatgccgtggccgcagaattcgcgcaccaccgagaagccgttggcctcggcgtgcttctggatggcgttgccgacgtcgcccaatgtggccccgtttttgacctgctggatgcctttccacatgcactcgaaggtgatgtcggtcaggcggcgcgacaggatcgactgctcgcccacggcgtacatgcggctggtgtcgccgaaccagccgtccttgatgatggtgacgtcgatattgagggagtcccc

SEQ ID NO: 72664 - DNA, 215 bp, Glycine max
  Peptide Sequence Number=SeqID_164349
atgtaccctctcttgttctcagtcaaacccaatgtcgcaacctacccttcggcgggagggcgacgcgtgactcgcgggatgcgtgttccacgaaaggaatacgcgcggagtcgccaccaacgtttatttgaggaaaacatcggaaaaaccggaaaagacgcgatctacgaacttttaagtgacaggttcgggagttgtatttacgtgcggggaag

SEQ ID NO: 72665 - DNA, 231 bp, Glycine max
  Peptide Sequence Number=SeqID_164350
atgactcaacctcaaatgttgatgaactcttgtaagaatacaagagttattgggtcaaagaccatggtaatgataatgactcctctttcgggccggaaggatgcaacatgtctccttcccacgaaccaatattcaaacgaagttggtaatctggggatgataggcaacaggataaaatcacagtcgaaattcacaacacttcgtaatttacccaagtctctgaaaaaataa

SEQ ID NO: 72666 - DNA, 282 bp, Glycine max
  Peptide Sequence Number=SeqID_164351
atggacggcaccaccaactccggcgaaccccgctccagttcggtgctccaaaatactggggcatccgaggatccgaatcgaagcgggtcgggtcagaattcgatggcgaggtacaagctgatgtcaccggcgaagcttccgatctcgaggtcgccgtgcatcacgattcctccggggctcagtccgacgtcgtttctggaatccccggttcttctttccaacatgaaggggtttgtgttttctgagaggaaatggattagaagaaggaaagctactcaatag

SEQ ID NO: 72667 - DNA, 393 bp, Glycine max
  Peptide Sequence Number=SeqID_164352
gctgaaatgaccggtagattgctggccggatcatggaccttggataatcgcatcatgcactacattattgttagaattttgcttccccggttttcaaatttggctcaagcctctgaggaggacttgattttgatgtgggctttccttaccggtcgtcagatcgactgggctcacttggttcggtatcgaatgcataaggcattacgggccaatgcacctctcccttaccctcaattggtcaatctgtttctccgtcattttcaaattccacttgatgatgaaccttttgttcaagtcaagcgttcctttgctattggtgttggggcacttgaagaagatgtgggttatattcgtcagagcttcgatcttccaccaccacctccaccttcttag

SEQ ID NO: 72668 - DNA, 147 bp, Glycine max
  Peptide Sequence Number=SeqID_164353
atggaggattgccttgagggtccgcacttaggcatcatgaaacatagctccaaactcgaaggtggaggacacatgaacagcgaaactgggtgttccggtcttttcctctttgttcatatggggtgggatatcaccagtcgagaatga
